United States Patent 11,078,247 (RNA ENCODING A THERAPEUTIC PROTEIN) - sequence listing, part 42

SEQ ID NO: 70528 - RNA, 1455 nt, Artificial Sequence
  derived and/or modified sequence opt5 from HTR3A__Homo_sapiens__NP_000860
augcugggcaagcucgccaugcugcuuugggugcagcaagcucugcucgcccugcuucugcccacccuccuggcgcagggggaggcuagacggagccgcaacacaacgagaccugcccugcuccggcuguccgacuaccuucugaccaauuaucgcaaaggagucagaccgguucgggauuggcgcaagcccacaaccgugucuaucgacgugauugucuacgccauccucaacguggaugaaaagaaucagguucugacaaccuauauuugguacagacaguauuggacagacgaguuccuucaauggaacccugaagauuuugacaauaucaccaaacugagcauucccacggauuccaucugggugccugacauccucauuaacgaguucgucgaugugggcaaaucucccaauaucccuuacguuuauauucggcaccagggggaagugcagaacuacaagccgcugcaggucgugaccgcuugcagccuggacaucuacaauuuucccuucgaugugcaaaacuguucccucacauuuaccucuuggcugcauacaauucaggacaucaauauuagccuuuggcgccugccugagaaggucaaauccgauagaagcguuuucaugaaccagggagagugggaacuccugggcgugcuucccuauuuucgggaguucucuauggaauccagcaauuacuaugccgagaugaaguuuuacguggucauccgcagacggccucuguucuaugugguuucucuccugcugcccuccaucuuucucauggugauggacauugucggguucuaccugccgccuaacagcggagagcgcgugucuuuuaaaaucacccuucugcucggcuauuccguuuuccugauuaucgugagcgacacgcuucccgcuacagccauuggcaccccucugaucggggucuacuucguggucugcauggcgcuccuggugaucucccuggccgaaacaauuuuuaucguuagacucgugcacaagcaggaucugcaacagcccguccccgcuuggcuucggcaucuggugcucgagagaauugccuggcugcugugucuucgcgaacagucuaccagccaacggccuccggcuaccucccaggccacaaaaacggacgauugcagcgcgaugggaaaucacuguucucauaugggcgggccccaggacuucgagaaguccccuagagaucgcugcucucccccucccccgccucgggaagccagccucgcuguuuguggacugcugcaggagcucagcuccaucagacaauuucuggagaagcgcgacgaaauucgggagguggccagagauuggcuucgcgucggcucugugcuggacaaacuccuguuccacaucuaccugcuugcugugcucgccuauagcaucacccugguuaugcugugguccauuuggcaguacgccuga

SEQ ID NO: 70529 - RNA, 1326 nt, Artificial Sequence
  derived and/or modified sequence opt5 from HTR3B__Homo_sapiens__NP_006019
augcugagcuccgugauggcuccccucugggccugcauccuggucgccgcgggcauucuugcuaccgacacacaccauccucaggauucugcccuguaccaccucagcaagcaacugcuucagaaauaucauaaggagguuagaccgguguacaacuggacgaaagccaccacaguguaucuggaccucuucguccacgcuauccuggauguggacgccgaaaaucagauucugaagaccuccguuugguaccaggagguguggaacgaugaauuucucucuuggaauagcuccauguucgacgagauccgggaaauuucucugccccuuagcgcuaucugggccccugauaucauuaucaacgaguuugucgacauugagcgcuaucccgaucugccuuacguguauguuaauuccagcgggacaaucgaaaacuacaaacccauucaaguggucucugcguguucccucgagaccuacgccuucccuuuugacgugcagaauugcagccugacauucaagucuauccuucauaccguggaagaugucgaccuggcuuuucucagauccccggaggauauucagcacgacaagaaagccuuccugaacgacagcgagugggaacugcucucuguuuccagcacguauuccauccugcagucuagcgcuggaggcuuugcccaaauccaguucaauguggugaugcggcgccacccccuugucuacgugguuucccugcucauuccuagcaucuuucugaugcuuguggaucuggggucuuucuaucugcccccuaacuguagagcgcggauugucuuuaagaccuccgugcucguuggauacacaguguuccgcgucaauaugagcaaccaggugcccagaucugucggcagcaccccgcugaucgggcauuucuuuacaauuugcauggccuuccucgugcugucccuugcuaaaucuaucguucuggugaaguuucuccacgacgagcagcggggaggccaagaacagccuuuccugugucuucgcggcgauaccgacgccgauagaccccgggucgagccucgcgcucagagagccgugguuacggaaagcucccuguauggggagcaucucgcccaacccggaacacugaaagagguguggagccagcugcagucuaucuccaauuaccuccagacccaagaccagacagaucagcaggaagcugaguggcugguccuucugagccgguuugaccgccuccuguuccaaucuuaucuguuuaugcuuggcauuuacaccaucacccucugcucccugugggcgcuguggggagggguguga

SEQ ID NO: 70530 - RNA, 1344 nt, Artificial Sequence
  derived and/or modified sequence opt5 from HTR3C__Homo_sapiens__NP_570126
auggagggcggguggcccgccagacagagcgcucugcucugccugaccgugucccuucugcuccaaggacggggcgacgccuucacaaucaacuguucuggguuugaucagcacggagucgacccugcgguuuuccaggcuguguuugaucgcaaggccuucagaccguuuacgaauuacagcauucccacccgggugaacaucuccuucacacugucugccauucuuggcgucgacgcucagcugcaacuccugaccagcuuucuguggauggaucucgugugggacaauccuuucaucaacuggaaucccaaagaaugcguugggauuaacaagcugacagugcuugccgagaaucuguggcucccugauaucuuuaucgucgaauccauggacguggaucagacccccucuggacugacagcuuauauuagcuccgagggccgcaucaaauacgacaagccuaugagaguuaccagcauuuguaaccuugauaucuucuauuuuccguucgaccagcagaauugcacguuuaccuucucuuccuuccuguacacaguggauagcaugcuccugggcauggacaaagaagucugggagauuaccgacacaucucggaaggugauccaaacccagggggagugggaacugcucggaauuaacaaggccacgcccaaaauguccaugggcaauaaccuguaugaucagaucauguuuuacguggcgauccgcagacggccuagccuuuauauuaucaaucugcucguccccucuuccuuccugguugccauugacgcucuuagcuuuuaccugccugccgaguccgaaaaccgcgcucccuucaagaucacacuccugcugggguacaauguguuucuccugaugaugaacgaucuucugccggccucuggaaccccucucauuagcguguauuucgcgcugugucuuucccugauggucgugagccuccuggagacaguuuuuaucaccuaccugcuccauguggccaccacacagcccccucccaugcccagauggcugcacucucuucugcuccauugcacguccccuggccgguguugcccgaccgcuccccaaaaagggaacaagggacugggccugacacuuacccaccucccuggccccaaagagccuggggaacuggccggaaagaagcugggcccccgcgagacagaaccggacgggggaagcggcuggaccaaaacgcagcucauggagcuguggguccaguucucucaugcuauggauacacuucuguuuagacucuaucugcuguucauggccagcuccauccuuaccgugauuguucucuggaauaccuga

SEQ ID NO: 70531 - RNA, 1215 nt, Artificial Sequence
  derived and/or modified sequence opt5 from HTR3D__Homo_sapiens__NP_001138615
auggagagaggcugguuccacgggaagggauuucugcucggcuucauccugcaucuucugcuccaggacagccaucugcaacuugugaccuccuuucuguggcucaacauguggaaucccgaugaaugcgggggaauuaaaaagucuggcauggccacagagaaccuguggcugagcgacgucuucaucgaagaguccguugaucagacgccugcugggcucauggccucuaugagcauugugaaagcgaccuccaauacaaucucucaguguggauggagcgcuuccgccaacuggaccccgagcauuucucccuccauggaccggggcgaacgcagcccuucugcccugucccccacacaggugaccagagcuuggcggcgcaugagcagaucuuuucaaauccaccaccggacauccuuccgcaccagacgggaguggguccuucugggcauccagaagcgcacgauuaaagugaccguugccacaaaucaguacgagcaggcuaucuuucauguggccauuagacggcgcugcagaccuagccccuaugucgugaacuuccucguuccuuccgggauccugauugcgaucgaugcccuuucuuuuuaccugccgcucgaaagcggaaauugugcucccuucaagaugaccgugcugcugggcuauuccgucuuucuccugaugaugaacgaccuucugccugccacaagcaccucuucccacgcuagccucgugcggccccacccuucucgcgaucaaaagagagggguguacuucgcccugugccuuagccugauggucggaucccuccuggagacgauuuuuaucacacaucugcuccacguugcgaccacacagccccugccgcuuccucgguggcugcauucucuccugcuucacuguaccggccaggggagaugcugucccaccgccccucagaaaggaaauaagggccccggccugacacccacgcaccucccuggggugaaagaaccggaggugagcgcuggacaaaugcccggcccuggggaggccgaacugaccggaggcuccgaguggacacgcgcucagcgggaacaugaggcccagaagcaacacagcgucgaacugugggugcaguucucucaugccauggacgcucuccuguucagacuuuaucugcucuuuauggcguccagcaucauuaccguuaucugccuguggaacacauga

SEQ ID NO: 70532 - RNA, 1371 nt, Artificial Sequence
  derived and/or modified sequence opt5 from HTR3E__Homo_sapiens__NP_001243542
auggagggcagcugguuccacagaaagcgguuuuccuucuaccugcuccugggguuucuucugcagggacgcggcgugaccuucacaaucaacugcucuggguuuggacaacauggcgccgaccccacggcucucaauagcgucuucaacagaaaaccuuuucggccgguuaccaauauuuccgugcccacacaggugaacaucucuuucgccaugagcgcgauucuggaugucaaugaacagcuucaccuucucuccucuuuucuguggcuggagauggugugggacaacccuuucaucagcuggaaucccgaagagugugaagggauuaccaagauguccauggcugccaaaaaccucuggcugccugauaucuuuaucauugagcuuauggacguugauaagacacccaaaggacugaccgccuaugugagcaaugagggccgcaucagauacaagaagccuaugaaagucgacucuauuugcaaccucgauaucuucuauuuuccguucgaccagcaaaauuguacacugaccuucuccagcuuucuuuacacgguggauucuaugcugcucgacauggaaaaggagguuugggaaauuaccgaugcuucccggaacauccugcagacacauggcgagugggagcugcucgggcugagcaaagccaccgcuaagcugucucgcggaggcaaucuguaugaccagauuguguucuacgucgccaucagacggcgccccucccucuaugugaucaaccugcuugugccuagcggguuucuggucgcgauugaugcccucuccuucuaccugcccguuaaaucuggaaauagagugccuuuuaagaucacacugcuccugggcuacaacguguuccuucugaugaugagcgaccuccugcccaccuccgggacgccgcuuauuggagucuauuuugcucugugccucagccugauggugggcucucugcucgaaacaaucuucauuacccaucugcuucacguugccacaacccagccucccccucugccccgguggcuccacucccugcugcuucacuguaacagccccggccgcugcuguccuaccgcuccgcaaaaggagaauaaagggcccggacucacaccuacgcaucugcccggcgugaaggaaccugaggucucugccgggcagaugcccggaccggcggaagccgagcugaccggcgggagcgaguggacaagagcucagcgggaacacgaggcccagaaacaacauuccguggaacucuggcugcaguuuucucacgcuauggacgccaugcuuuuccgccuguaccuccuguuuauggccagcuccaucaucaccguuauuugccuguggaacacauga

SEQ ID NO: 70533 - RNA, 1167 nt, Artificial Sequence
  derived and/or modified sequence opt5 from HTR4__Homo_sapiens__NP_000861
auggacaagcuggaugccaacgugagcuccgaggaaggcuucgggucugucgagaaaguugugcuccugaccuuucuuagcacagugauccugauggcuauucucggaaaucugcuugucaugguggccguuugcugggacagacagcugcggaagaucaaaacgaacuacuucauugugucccucgcguuugcugaucugcuggucucugugcucguuaugcccuucggcgccaucgaacuggugcaagacauuuggaucuauggggaggucuuuugucuugugcgcaccagccuggaugugcuccugacaaccgccuccaucuuccaccuuugcuguauuucucuggacagauacuaugcuaucugcugucagccucucgucuaccggaauaagaugacaccgcugcgcauugcccugaugcucggaggcugcuggguuauccccaccuuuauuagcuuccugccuaucaugcagggguggaacaauauuggaaucaucgaucuuauugagaaaagaaaguuuaaccaaaauuccaacagcacauauuguguguucauggugaauaagcccuacgcuauuaccugcucugucguggccuuuuauaucccuuuccugcucaugguucuggcguacuaccggaucuaugugacggccaaagaacacgcucaccagauucagaugcuucagcgcgccggcgcuuccagcgagucuagaccccaguccgccgaccaacauagcacccaccggaugcgcacagaaaccaaggcggccaaaacacuguguaucaucaugggcugcuuuugucucugcugggcuccuuucuucgucaccaacauuguggauccguuuaucgacuacacgguucccggacagguguggacagccuuccuguggcugggguauauuaauucuggccucaacccuuuucuguacgcuuuccuuaauaaguccuuuagacgggccuuccugaucauucucugcugugaugacgagcgcuauagacggcccagcauccuggggcagaccgucccuugcuccacaaccaccaucaacggaucuacacaugugcuucgcgaugccgucgaauguggcgggcagugggagagccaaugccaucccccggcuacguccccucugguggcggcccagcccagcgacaccuga

SEQ ID NO: 70534 - RNA, 1074 nt, Artificial Sequence
  derived and/or modified sequence opt5 from HTR5A__Homo_sapiens__NP_076917
auggaccugcccgugaaccucaccagcuucucccugucuacaccuagcccgcuugagacgaaucacucccugggcaaggaugaccucagacccucuagcccucugcuuuccgucuuugggguucugauccucacccugcugggauuccucguggccgcuacauuugccuggaaccugcuugugcuggcgaccauucuccggguccgcacauuccauagagugccccacaaucugguugcuucuauggccgugagcgauguccuuguggccgcucugguuaugccucucucccuggugcaugaacugagcggccggcgcuggcagcucgggagacggcugugccaacuuuggaucgccugugacguccugugcuguaccgcuucuauuuggaacgugacagccaucgcgcucgaucgcuacugguccauuaccagacacauggaguauacgcugcggacccgcaaaugcgugagcaaugucaugaucgcccuuacaugggcucugucugccguuaucucccucgcuccccugcuguuuggauggggcgaaaccuacagcgaggggucugaagagugucagguguccagagagccuagcuaugccguguucuccacagucggagcguuuuaccucccgcugugcgugguucuuuucguguauuggaagauuuacaaagccgcuaaguuucgggucggcucucgcaaaaccaacagcgugucccccaucagcgaagccguugaggugaaggacucugcuaagcagccucagauggucuucacggugagacaugccacagucaccuuucaacccgaaggcgauacauggcgggagcagaaagagcagcgcgccgcucugaugguggggauucucaucggaguuuucgugcuguguuggauucccuuuuuccuuaccgaacugaucuccccucucugcagcugugacauuccggcgaucuggaagucuaucuuccuguggcugggcuauagcaauuccuuuuucaacccucucauuuacaccgccuuuaauaaaaacuacaauucugcuuucaagaacuuuuucagcagacagcacuga

SEQ ID NO: 70535 - RNA, 1338 nt, Artificial Sequence
  derived and/or modified sequence opt5 from HTR7__Homo_sapiens__NP_000863
augauggacgugaacagcuccggcagacccgaucuguacgggcaccuccggucuuuccugcuuccugaggucggacgcggccugccggaccucagccccgaugggggagccgacccuguugcuggcuccugggcuccccaucugcuuucugaagugaccgcgagcccugcucccacaugggaugccccuccggacaaugccuccgggugcggagagcagaucaacuauggcagaguggaaaaggucgugauuggcucuauccugacgcucauuacccugcugacaaucgcugggaauugucucguugugauuagcgucugcuuugugaaaaagcugcggcaacccuccaacuaccuuaucguuagccuggcccucgcugaucugucuguggccgucgcggugaugccuuucguguccgucaccgaccuuaucggaggcaaauggauuuuugggcacuucuuuuguaauguuuucaucgccauggaugugaugugcuguacagcuagcauuaugacccugugcgugaucucuauugaccgcuaucucggaaucacaagaccccugaccuacccuguccggcagaacggcaaguguauggccaaaaugauucuguccguguggcuccugagcgcuucuaucacgcuucccccgcuguuugggugggcccagaauguuaacgaugacaaggugugccucaucucccaggauuucggauauaccauuuacagcacagcggucgccuuuuauaucccuauguccgugaugcuguucauguacuaccaaauuuauaaggcugcccgcaaaucugcugccaagcauaaauuucccggcuucccuagaguugagcccgacagcgugaucgcccuuaauggcauugucaagcugcagaaagaaguggaggagugugcuaaccucucccggcugcugaagcacgaacgcaagaauaucagcaucuuuaaaagagagcagaaggcggccaccacacucgggauuaucgucggagcuuucaccgugugcuggcugcccuucuuucuucugucuacggcccggccuuucauuuguggcacauccugcagcugcaucccgcucuggguugaacgcaccuuucuguggcuuggguacgccaacucucugauuaaucccuucaucuaugccuuuuucaacagagaccuccggacaaccuaccgcagccugcugcagugucaauauagaaauaucaaccggaaacucuccgccgcgggaaugcaugaggcucugaaacuugccgagagaccugaacgccccgaguuugugcugcagaacgccgauuacugccggaagaagggccacgacucuuga

SEQ ID NO: 70536 - RNA, 1443 nt, Artificial Sequence
  derived and/or modified sequence opt5 from HTRA1__Homo_sapiens__NP_002766
augcagauccccagagccgcucugcucccucugcuucugcuccugcuugccgcgccggcuagcgcccaacugucccgggccggccgcucugcuccccucgccgcugggugcccugacagaugugagcccgcccggugcccuccccagccugaacacugugagggaggccgcgcgagagaugccugcggguguugcgaaguguguggagcuccggagggcgccgcuugcgggcugcaggaaggacccuguggcgagggccugcagugcgucguuccuuucggggugcccgccagcgcgaccgugcggcgcagagcccaagcuggacucugugucugcgccuccucugagccugugugcggcagcgacgcuaacacauacgccaaucugugucagcuucgggccgcuucccgcagaucugaacggcugcauagacccccgguuauugugcuccagcgcggggcgugcggacagggccaagaggauccuaacagccugcggcacaaguauaauuuuaucgccgacgucguggagaaaauugcucccgccguugugcauaucgaacuuuuccgcaagcugccuuuuuccaaaagagagguccccguggccagcgggucuggauucauuguguccgaagauggccucaucgucacgaacgcucacguugugaccaauaagcaucgggugaaagucgagcugaagaacggcgccacauacgaagcgaagaucaaagacguggaugagaaggcugacauugcccugaucaaaauugaucaccaggggaagcuccccguucugcuucugggaagaagcucugaacuccgcccuggcgaguuuguggucgccaucggguccccguucagccugcagaauaccgugacaaccggaauuguuucuacaacccagcggggcgggaaagagcuuggacugagaaacuccgacauggauuauauccaaacggacgcuauuaucaauuacggcaacagcggcgggccccucgugaaucuggauggagaagucaucggcauuaacacccugaaggugacagccgggaucuccuuugcuauuccuucugacaagaucaaaaaguuccucaccgagagccacgaccgccaggccaaaggaaaggcgauuaccaaaaagaaauauaucggcauccggaugaugucccugacaagcucuaaggccaaggaacuuaaagauagacaucgcgacuuucccgaugucauuuccggggcuuacaucauugaggugaucccugacacgcccgccgaagcuggcggacugaaggagaaugauguuauuaucagcaucaacggccagucuguggucagcgccaaugacguguccgauguuauuaaacgggagucuacacucaacaugguggucagacgcgggaacgaagacaucaugauuaccgugaucccggaggaaauugauccuuga

SEQ ID NO: 70537 - RNA, 1377 nt, Artificial Sequence
  derived and/or modified sequence opt5 from HTRA2__Homo_sapiens__NP_037379
auggccgcucccagagccggcagaggggcgggauggagccugcgcgcuuggagagcccucggcgggauccgguggggacgcagaccucggcugaccccggaccuucgcgcccugcucacauccggcacgucugaucccagagcucgggugaccuacgggacaccuagccugugggcccgccuuuccgucggaguuaccgagcccagagcuugccugacaucuggcaccccuggcccccgggcccagcucacagcggugaccccugacacgcgcaccagagaagccagcgagaacuccgggacacggucucgcgcuuggcuggccguggcucugggagccggcggggcgguccuccugcuucuguggggaggcgggagaggaccgcccgccgugcucgcugccguuccuucucccccucccgcuuccccgcggagccaauauaauuucauugccgauguggucgaaaagaccgccccugcugugguuuacaucgagauucuggaccggcaccccuuucuuggccgcgaagugccuaucagcaacggcuccggguucgucguggcggccgauggacugauugugacaaaugcucaugucguugccgaccggagacgcgugcgggugagacuccugagcggcgauaccuaugaggccgucgugacggcuguugaccccguggccgauaucgcgacacugcgcauccagaccaaagagccccucccuacacugccgcuugggcggucugcugacgucagacagggagaauuugugguugccaugggcucccccuucgcccugcagaacaccauuaccagcgggaucgugucuuccgcucaacgcccugcccgggaucucggacugccccagacaaaugucgaguacauucagacggacgcugccaucgauuuuggcaacagcggcgggccucuugugaaucuggacggagaagucauuggcgugaacaccaugaagguuacagcggggaucuccuucgccauucccucugacagacuccgcgaguuucugcaccggggagagaaaaagaauagcuccagcggcaucucugggucccagagacgguauaucggcgugaugaugcugacccucagcccgucuauucuggcugaacuucaacugcgcgagccuagcuuccccgauguccagcauggagugcucauccacaaaguuauucugggcuccccugcccauagagcugggcuucggcccggagacgugauccuggccauuggcgaacagaugguccagaacgcggaggauguguacgaagccgugagaacacaaucucagcucgcuguucagauccgccgggggagagagacccugacgcuguaugucacaccugaggugaccgaauga

SEQ ID NO: 70538 - RNA, 1074 nt, Artificial Sequence
  derived and/or modified sequence opt5 from HTRA3__Homo_sapiens__NP_001284488
augcaggccagagcucugcuccuggccgcgcuugcugcccuggcccucgcucgggagcccccugccgcuccgugccccgcccgcugugacgugagcagaugcccuucuccccgguguccuggcggguacguccccgaucugugcaacuguugccuuguuugugcggccuccgaaggagagccuugcggcgggccgcuggacagccccuguggagaaucccucgagugcgugcgcggccuguguagaugccgguggucucacgcugugugcgggaccgauggacauacauaugccaaugucugugcucugcaagccgcgagccgcagagcccuccagcuguccggcacgccugugcggcagcuucagaagggcgcuugcccccuggggcuccaccaacugucuagcccucgcuacaaauucaacuuuaucgccgacguuguggaaaagauugcucccgccgucgugcauaucgagcuuuuccugagacacccgcucuuuggacggaauguuccucuguccagcggcucuggguucauuauguccgaggccggacugaucauuaccaacgcucauguggucagcucuaauuccgcggcccccggccgccagcagcucaaagugcagcugcaaaacggggauagcuaugaagcuacaaucaaggacaucgauaaaaagucugacauugccaccaucaagauucacccuaaaaagaaacuucccgugcugcuccugggacacuccgccgaucuuagacccggcgaguuugucguugcuaucggcagcccuuucgcccugcagaauacagugaccacagggauuguguccaccgcgcagcgggaaggacgcgagcucggccugagagacucugauauggacuacauccagacggaugcuauuaucaacuaugggaauagcggaggcccgcuggucaaccucgacggggaggugaucggaauuaauacccugaagguuacagccggcaucuccuuugccauucccagcgaccggaucaccagauuccuuacagaauuucaagauaaacagauuaaggcuccuucucuggccgugcauuga

SEQ ID NO: 70539 - RNA, 1431 nt, Artificial Sequence
  derived and/or modified sequence opt5 from HTRA4__Homo_sapiens__NP_710159
augaucagaccccagcugcggaccgccggccucgggcgcugccugcuuccuggacugcuccugcuucuggugccgguccucugggcuggcgccgagaagcugcacacacaacccagcuguccugcgguuugccagcccacgagauguccugcucugccuaccugcgcccucgggacaacccccguguucgaccugugucggugcugucgcgugugcccggccgcugaaagagaggucuguggaggcgcccaggggcagcccugcgcuccuggacuucaaugucugcagccccuccggccuggcuuucccuccacaugcggcugcccgacccuugggggagccguguguggcucugaucgcagaacauacccuagcaugugcgcgcugcgggccgaaaaccgcgcugccagacggcuggggaaaguucccgcugugccuguccaguggggaaauuguggcgacaccgggacgcgcuccgccggaccccucagacggaacuauaauuucauugcggccgugguugagaagguggcucccucugucgugcaugugcagcuguggggccgccugcuccacggcagcagacuggucccuguuuacuccgggucuggauuuaucgugagcgaagauggccuuauuaucaccaacgcccaugugguccggaaucaacaguggauugaggugguucugcagaacggggcuagauaugaggccguggucaaagacaucgaucucaagcuggaccuugccgugaucaaaauugaauccaaugcugagcugccgguucucaugcugggacgcagcucugaucugcgggcgggcgaguucguggucgcccucgggucccccuuuagccugcagaacacagcuaccgccggaaucgugucuacaaagcaaagaggcggcaaggaacuugggaugaaagacuccgauauggacuacguccagauugaugccaccaucaauuauggaaacagcggcgggccucuggugaaucucgacggagauguuauuggcgugaacucucugcgcgucacggacgggaucuccuucgcuauucccagcgaccgggugagacaguuucuugccgaguaccacgaacaucaaaugaagggcaaagcguucuccaauaagaaauaucugggacuccagaugcugucucugacaguuccucucagcgaggaacugaagaugcacuaccccgauuuuccggacguguccagcggcgucuacgugugcaaggugguugaggggaccgcugcccagucuuccggacuucgcgaucacgacgucaucgugaacaucaauggcaaaccuauuacaaccaccacagauguggucaaggcccuggacagcgauucucucagcauggcugugcugcgggggaaagacaaccugcuucucacgguuauccccgaaaccauuaacuga

SEQ ID NO: 70540 - RNA, 9435 nt, Artificial Sequence
  derived and/or modified sequence opt5 from HTT__Homo_sapiens__NP_002102
auggcuacacuggagaagcucaugaaggcuuucgaaagccugaaguccuuucagcaacagcagcagcaacagcagcagcaacagcagcagcaacagcagcaacagcagcagcaacagcagcccccuccucccccucccccucccccuccgccccagcuuccucaacccccuccccaggcccagccgcugcucccucagccccaaccuccgcccccuccgcccccucccccucccggcccggcgguggcugaggaaccucugcacagacccaaaaaggagcuuucugccaccaagaaagaccgggucaaucacugccugacgaucugugaaaauauuguugcccagagcgugcgcaacuccccugaguuccagaagcuccuggggaucgcuauggagcuguuucuccugugcucugaugacgccgaaagcgaugugagaauggucgcugacgagugucuuaauaaagugauuaaggcccugauggauuccaaccucccccggcugcagcuugaacuguacaaagagaucaagaaaaauggggcgccucgcucucucagagccgcucuguggcgguucgccgagcuggcucaccucguucgcccccaaaagugcagaccguaucuggugaaccuucugccuugucucacccggacaagcaagcgccccgaagaguccguccaggaaacccuggccgcggccgugcccaaaauuauggcuagcuuuggcaauuucgccaacgacaaugagaucaagguucuucugaaggcuuucaucgccaaccucaaaucuuccagcccuacaauuagacggaccgccgcugggucugcgguguccaucugccagcacagccgcagaacacaauacuucuauucuuggcugcugaauguccuccugggacuucuggugccgguggaagaugagcacuccacccuccugauucuuggcguccugcucacgcugcgguaccugguuccccuccugcagcaacaggucaaagacaccagccuuaagggguccuuuggagugacacgcaaagagauggaagucucuccuagcgccgagcaacuggugcagguuuaugaacucacccugcaccacacacagcaccaggaucacaacguggucaccggcgcucuggagcuucuccaacagcuguucagaacgcccccucccgaacugcuccagacacugaccgccgugggcgggaucggacagcuuacagccgcuaaggaggaguccggcgggcggagcagaucuggauccauuguugaacugaucgccggcgggggaagcucuuguagcccugugcucucccgcaagcaaaaaggcaagguccugcugggcgaggaagaggcgcuugaagacgauucugagagccgguccgacguguccucuagcgcucucaccgccagcgucaaagaugagauuucuggggaacuggccgcuuccagcggaguguccacccccggcucugccgggcacgacaucaucacagagcagccgagaagccagcacacgcugcaagcugacuccguugaucucgccucuugcgaccugaccagcuccgcgacagauggagacgaagaggauauucuuagccacucuuccagccaggugucugccgucccuuccgaccccgcuauggaucugaaugacggcacccaggccagcucuccuaucagcgauuccagccagacaaccacggaggggcccgacucugcugugacaccguccgauagcuccgaaauuguucucgacggaaccgacaaccaauaccugggccugcagaucggccagccucaggaugaggacgaagaggccaccgggauucuucccgaugaagcgucugaggccuuucgcaauagcuccauggcucuccaacaggcccaucugcugaagaacaugucucauugucggcagccuagcgacuccucuguggauaaauucguccucagagacgaggcuacagaacccggagaucaggagaacaagcccugccgcaucaagggcgacaucgggcaaagcaccgaugacgauuccgccccucuggugcacugugugcggcuucugagcgccucuuuucuccugacaggaggcaaaaauguucuggucccggacagagaugugcgcguguccgucaaggcucuugcgcucagcugcgugggggccgcuguugcccugcaucccgaaucuuucuucuccaaacuguauaaggugccucucgacacgaccgaguaccccgaagaacaguacgucagcgacauucugaacuauaucgaucacggcgacccucaggugcggggagccacagcuauucuuugcggcacccugaucuguucuauucucuccagaagccgcuuucauguuggggauuggaugggaacaauccggacccugacgggcaauaccuucucccuggccgacugcaucccccuucugagaaaaacacucaaggaugagagcucugugaccuguaagcuggcgugcacagcuguccggaacugugugaugagccucugcuccucuagcuacuccgaacuggggcuucagcugauuaucgacguucucacccugcgcaauucuagcuauuggcuggugagaacggagcuucuggaaacacucgccgagauugauuuucggcuggucuccuuccucgaagccaaagcugagaaccugcacagaggagcccaccauuacaccggccuucugaagcuccaagagcgcgugcugaauaacguggucauccaucugcuuggggacgaagauccucggguuagacauguggcggcugccucucugauucgccucgugccgaaacuguuuuauaagugugaccagggccaggccgaucccgucguggcuguugccagagaccaaagcuccguguaccucaaacugcuuaugcacgagacacagccucccagccacuucucugucuccaccaucacccggauuuaucgcggauacaaucugcugccuagcaucacagaugugacgauggaaaacaaucucucuagaguuaucgcugccgugucccaugagcugauuaccagcacaacccgggcgcuuacauuuggcugcugugaggcccugugccuccuguccaccgcuuuccccgucuguaucuggucucucggguggcacugcggagugccgccucugagcgccuccgacgaaagccgcaagucuugcacgguuggcauggcuacaaugauucuuacccugcuguccagcgccugguuuccccucgaccugucugcccaucaggaugcucuuauccuggcggggaaccuccuggccgcuagcgcccccaagucccucagaucuagcugggccuccgaggaagaggcuaauccugccgcgaccaaacaggaagagguguggcccgcucugggagaccgggcccuugucccuaugguggagcaacuguucucucaucugcucaaggugauuaacaucugugcccauguccuggaugacguugcuccgggccccgccaucaaagcggcccuuccuagccugacaaaucccccuucccucagccccauucgcagaaaggggaaagaaaaggagccgggcgaacaggccucugugccucugucccccaaaaagggaagcgaggccuccgcugccucucggcagagcgauaccuccggcccugugacaacgucuaagagcuccagccucgggucuuuuuaccaucugcccuccuaucuuaaacugcacgacguccugaaggcuacccaugccaacuacaaagugacacucgaucugcagaacagcaccgaaaaguucggaggcuuucuucgcucugcgcuggacguucucucccaaauccuggagcuggccacacuccaggauauugggaaaugcguggaggaaauccuuggauaucugaaguccuguuucucuagagagccuaugauggcuaccgucugcgugcagcagcugcucaagacgcuguucggcaccaaucuugccagccaauuugacgggcuguccucuaaccccagcaaaucccagggccgggcucagagacucggaagcuccucuguucgcccgggccuguaccacuauuguuucauggccccuuacacacauuuuacccaagcccuggcugaugcgagccuccggaauauggugcaggccgaacaggagaacgacacauccgggugguucgacguccuucagaaggugucuacccaacugaaaacaaaucugaccagcgucacgaagaacagagcugauaaaaaugccauucacaaccauauccgccucuuugaaccccuggugaucaaggcccuuaagcaguauacaaccaccacaugcguucagcugcagaaacaagugcucgaccugcuggcucagcucguccagcuucgggugaauuacugucugcuggauuccgaccagguuuucauuggauuugugcucaagcaauucgaguacaucgaggucggccaguuuagagaaucugaggccauuauccccaacauuuucuuuuuccuggugcuucugagcuaugaacgcuaccacuccaaacagaucaucgggauuccuaagaucauucagcucugcgauggaaucauggcgagcggccggaaagcugugacccacgccauuccggcccugcaacccaucguucaugaccuguuuguccucagaggcacgaauaaggcugaugccgggaaggagcuugagacacagaaagaagugguggucucuaugcugcugcgccucauucaguaucaccaagugcuggagauguucauccuuguucugcagcagugucauaaggaaaacgaggacaaauggaagcggcucuccagacagaucgcggauauuauccugccuaugcuggccaaacaacagaugcacauugacagccacgaagcucucggagugcuuaauacccuguucgagauccuggcccccucuucccuccggccugucgauaugcugcuucgcagcauguuugugacacccaacaccauggcuucuguuuccacagugcagcuguggauuagcggcauccucgccauccugagaguccugauuucccagagcaccgaggacaucgugcucucucggauucaagaacuuagcuucuccccuuaccugaucucuugcacgguuauuaaucgccugagagauggggacagcaccuccacacucgaggaacauucugagggaaagcagaucaaaaaccugccggaagagaccuuuagccgguuccuucugcagcucgugggcauccugcuggaggacauugucacaaagcagcucaagguggaaauguccgagcaacagcacaccuuuuauugucaggaacuugggacgcugcugaugugccucauccauauuuucaaaucuggaauguuuagacgcaucacagcugccgcgacccggcuguucagaagcgauggcugcggcggguccuuuuacacacuugacagccugaaccuccgcgcccggucuaugauuaccacccaccccgcucuggugcugcucuggugucaaauccuucugcuggucaaucauacagauuauagauggugggccgagguucagcagacgccuaagcgccacucccucagcucuaccaaacugcuuagcccccagaugagcggagaagaggaggacuccgaucuggcugccaagcucggcaugugcaaccgggaaauugugagacgcggggcccugauccuguucugugacuacgugugccaaaaucuccacgauucugagcaucuuacauggcugaucgucaaccacauucaggaccugaucagccucucccaugaaccucccgugcaggauuuuauuagcgcuguucacagaaauucugcggccuccggacuguucauccaggcuauucaaagccggugugagaaccuuucuaccccgacaaugcugaaaaagacccuccagugccuggagggcauccaccugagccaguccggggccgugcucacgcuguacgucgaccgccuucuguguacaccuuucagagugcucgcccggaugguugauauccuggcuugccgcagaguggaaaugcuucuggccgcgaaucuccagucuagcauggcccaacugcccauggaggaacugaaccggauucaggaguaucuccaguccucuggacuggcucaaagacaucagcgccuuuacagccugcucgaccgguuuagacuguccaccaugcaggauagccuuucucccuccccucccgucagcucccacccucuggacggcgacggccaugugucucucgaaaccgucagcccggauaaggacugguaugugcaccugguuaaaucccaguguuggacacgcucugauagcgcccugcucgagggggcugagcuggugaaucggauccccgccgaagacaugaacgcguucaugaugaacuccgaguuuaaccuuagccugcucgccccuugccugucucuuggaauguccgaaauuagcggcgggcaaaagucugcucuguucgaggccgcuagagaagugacccucgcccgggucuccggaacaguucagcagcugcccgcugugcaucacguguuucagccugagcugcccgccgagccggcggccuacuggagcaaacucaaugaucuguucggcgacgcugcccuuuaucaaucucugccuacgcucgcucgcgcccuggcccaguaccuugucgugguuuccaagcugcccagccaccuccaucugccucccgaaaaagagaaggauaucgugaaguuugucguggcgacccuggaagcucucucuuggcaccugauucaugagcagaucccucuuagccuggaccuccaggccgggcuggauuguugcugccuugcucugcaacuccccggacugugguccgucgugagcuccacagaguucguuacccacgccuguucucugaucuauugcgugcacuuuauucucgaggccgucgcugugcagccgggcgagcagcugcuuagcccugaaagacggacaaacacccccaaagccaucuccgaggaagaggaggaaguugaccccaauacgcagaacccuaaguacauuaccgcggccugugagaugguggcugaaauggucgagucucugcaaagcgugcucgcccugggccauaaacgcaacuccggggugccggcuuuccuuacaccccugcucagaaauaucauuaucucucuggcccggcugccucucguuaacagcuacacccgcgugcccccucugguguggaaacuuggauggucccccaaaccuggcggggauuuuggaacagcguuccccgaaauuccgguggaguuucugcaggagaaggaagucuucaaggaguucaucuauagaaucaauacccucggcuggacaagccggacgcaguuugaagagaccugggccacacugcuugggguucuggugacccaaccucucgugauggaacaggaggagucucccccugaagaggacaccgaacgcacacagauuaacguccuggcugugcaggccaucacgucccugguucuuagcgcuaugaccgugcccgucgccggaaauccggcugugucuugccuggagcaacagccuagaaacaaaccccucaaggcccuggacacacgguucggcagaaaacucuccauuauccgcggcauuguugaacaggagauccaggcgauggugagcaagcgggagaauaucgccacccaccaucuguaccaggcuugggaucccgucccuucucuuucccccgccacaaccggggcucugauuagccacgaaaaacugcuccugcagaucaacccugagagagaacuuggaucuauguccuauaagcugggccaggugagcauucauagcguguggcucggaaauuccaucacgccgcugcgcgaggaggaaugggacgaggaagaggaagaggaggccgaugcccccgcgccuucuuccccucccacaucccccgucaacucucggaagcacagagcuggaguugacauucacagcuguucccaguuucuccuggaacuguacucucgcuggauccuucccagcuccagcgcccggagaaccccggccauccugauuucugagguggugcgcucccuccuggucgugagcgaucuuuucaccgaacggaaucaauuugagcugauguauguuacacucaccgaacugagacgcgugcaucccucugaggacgagauccucgcucaguaccuggucccugccacaugcaaagcugccgcggugcugggcauggauaaggccguugcugaacccgugucccggcuucuggagagcacccucagauccucucaucugccuagccgcgucggggcccuucauggagugcuguauguucucgaaugugaccugcuggaugacacggcuaaacagcucauucccgugaucuccgauuaccugcuuucuaaccugaagggcauugcccacugcgucaauauccauagccaacagcacgugcucgucaugugugcgacagccuucuaccugauugagaacuauccgcuugacgugggcccugaauuuuccgcuagcaucauccagaugugcgggguuaugcugucuggauccgaggagagcacccccucuauuaucuaccacugugcccucagaggccuggaacggcugcuccugagcgagcagcuuucccgccuggaugcugaaucucucgugaaacugagcgucgacagagugaaugugcauagcccccaccgggccauggcugcccuugggcugaugcucacaugcauguauaccggaaaggagaaaguuagcccuggcagaacgucugaccccaacccugcggccccggauuccgagagcgugauugucgcuauggaacggguguccguucuguucgaccgcaucagaaagggguuucccugcgaggcccggguggucgcccgcauucugccucaauuccucgaugacuucuuucccccucaggauaucaugaauaaggugaucggagaauuucugucuaaccagcagcccuacccgcaauuuauggcuaccgucguguauaaaguuuuccagacacuucauagcaccggccaguccucuauggugagagacugggucaugcugagccucuccaacuuuacacagcgggccccuguggcgauggcuaccuggucucugagcuguuucuuuguuuccgccagcacaucucccuggguggccgcuauucuuccucacgucaucucccgcaugggcaagcuggagcaaguggaugugaaucucuucugccugguugccaccgacuuuuacagacaccagauugaagaggagcuggaucggcgcgcuuuccagagcguccucgaagugguggccgcgcccgggucuccguaucauagacugcuuacgugucugcggaacguccacaaagugacaaccugcuga

SEQ ID NO: 70541 - RNA, 2145 nt, Artificial Sequence
  derived and/or modified sequence opt5 from HUNK__Homo_sapiens__NP_055401
augcccgccgcugccggcgacgggcugcucggagagccugcggcuccgggcgggggaggcggggccgaagaugccgcuagacccgccgcugccugcgaggggagcuuccugccugcguggguguccggcgucccccgggaacgccuuagagacuuucagcaccauaagcggguuggcaacuaccugaucgggucucgcaaacucggagagggcagcuucgccaaggugagagaagggcugcacgugcuuaccggagagaaagucgcuauuaaggugaucgauaaaaagcgggccaagaaagacacauauguuacgaagaaucugcgcagagagggccaaauucagcagaugauccggcauccuaacauuacccagcuccuggauauccuggaaacagaaaauuccuacuaucucgugauggagcugugucccgggggaaaccuuaugcacaaaaucuacgagaagaaacgccuggaggaaucugaggcuagacgguauauucgccaacucaucagcgccgucgaacaucugcacagagcgggcgugguucaccgggaccuuaagauugagaaucugcuccuggaugaagacaacaauaucaagcugauugauuuuggccucuccaacugcgccgggauccugggauacucugacccuuucagcacccaguguggcuccccggcuuaugccgcucccgagcuucuggcccgcaaaaaguacgggccuaaaauugauguguggagcaucggagucaauauguacgccaugcucacaggcacccugcccuuuacaguggagccuuucucucuuagagcucuguaucagaagaugguggacaaagaaaugaacccccucccgacccagcuguccacgggggcgaucagcuuucugcggucucuccuggagccugaucccgucaagagaccuaauauucaacaggcccuugcuaaccgcuggcugaaugaaaacuacaccggaaaaguucccugcaaugugacauaucccaaccggaucucccucgaggaccugagcccuucugugguccuucauaugaccgaaaagcugggcuacaagaacuccgacgugauuaauacaguucucagcaacagagccugucacauccuggccauuuauuuccugcucaauaaaaagcuggagcgcuaccuuuccggcaaaucugauauccaggacagccugugcuauaagacccggcucuaccagaucgagaaauacagagcuccgaaggaauccuaugaggccagccuggauacguggacacgcgaccuggaauuucaugcggugcaagauaagaaacccaaggagcaggaaaaacggggagacuuccuucacagaccuuuuucuaagaaacucgauaagaaccugcccucccacaagcagccuagcggaucucugaugacccaaauucagaauacaaaagcucuccugaaggaccgcaaagccagcaaguccucuuuccccgauaaagacagcuuuggcugucggaacaucuucagaaagaccuccgauagcaauugcgucgccucuuccagcauggaguucauuccggugccucccccucgcacaccccggaucguuaagaaaccugagccccaucagccggggccuggaucuaccggcauuccccacaaggaagacccccuuaugcuggacauggugagauccuuugagagcgucgaucgggacgaucauguggaaguccucuccccuucucaccauuaccgcauccugaacagcccggugucccuggcuagaagaaauucuagcgagcggacgcuuucccccgggcucccuagcggcucuaugagcccccugcacaccccucugcaccccacacucguuuccuucgcccaugaggacaaaaacucuccucccaaggaagagggacuguguugcccgccucccgugccuuccaauggccccaugcagccgcuugggagcccuaacugugucaaaucucgcggacgguuucccaugaugggcaucgggcaaaugcugagaaagcgccaccagagccuccagccuuccgcugauagaccccuggaagccagccugcccccucuucagccgcucgcgcccgugaaucuggccuucgacauggcugauggaguuaaaacccaaugcuga

SEQ ID NO: 70542 - RNA, 837 nt, Artificial Sequence
  derived and/or modified sequence opt5 from HUS1B__Homo_sapiens__NP_683762
augaaguucagagccaaaaucaccggcaaggggugccuggagcucuuuauucacgugagcggaacagucgcucggcuggccaaaguuugugugcuucgcgugagacccgacucccugugcuucggcccugcggggucuggaggccuccaugaagcucggcuguggugugagguccgccagggggccuuucaacaguucagaauggaaggagugagcgaggaucuugacgaaauccaccuggagcucacggccgagcaucugucccgggcugcccgcucugcugccggcgcgagcucccugaagcuccagcugacccacaaaagacggccgucucuuacaguugccguggaacuggucagcucccucggccgcgcuagaagcgugguucaugaucugcccgugcggguccuuccucgcagaguguggcgggacugccugcccccuucucuccgcgccuccgaugcuagcauuagacugccccgguggagaacccugcgcucuaucguggagcggauggccaacgucgggucccacguucucguggaagcgaaucugagcggaagaaugacacuuucuauugagaccgagguggucuccauccagagcuacuuuaagaaccugggcaauccuccgcaauccgccguggggguucccgaaaaccgcgaccucgagucuauggugcagguccggguggauaauagaaagcugcuucaguuccuggaaggacagcaaauccacccuacaaccgcucucuguaacauuugggacaauacgcugcugcagcucguucuggugcaggaggaugucagccuucaguauuuuauccccgcccuguga

SEQ ID NO: 70543 - RNA, 843 nt, Artificial Sequence
  derived and/or modified sequence opt5 from HUS1__Homo_sapiens__NP_004498
augaaguucagagccaaaaucguggacggcgcuugccugaaccacuuuacccggauuagcaauaugaucgccaagcucgcgaaaacauguacgcugcgcauuucccccgauaaacuuaacuucauccugugcgacaagcucgcuaaugggggagucucuauguggugugagcuggaacaggagaacuuuuucaaugaauuucaaauggagggcguuagcgccgaaaacaaugagauuuaccuugagcugaccuccgaaaaccucucuagagcccugaagacagcucagaaugcccgggcucugaagaucaaacucaccaacaagcauuucccuugccugacagugagcguggagcuucuguccaugucuagcuccagccgcaucgucacccacgauauuccgaucaaagugauucccagaaagcucuggaaagaccugcaggaaccuguugugcccgauccugacgucucuaucuaucuucccgugcugaagacaaugaaguccguuguggagaaaaugaagaauauuagcaaccaucucgucaucgaggccaaucuggauggggaacugaaccucaaaauugagaccgaacuggugugugugacgacccacuuuaaggaccuuggaaauccuccgcuggcgucugaguccacacaugaagaucggaacgucgagcacauggccgagguucacaucgacauccgcaaacuccugcaguuccuugcuggccaacaggugaaccccaccaaggcccugugcaauauugugaacaauaaaaugguccauuuugaucuccugcacgaagacgugagccugcaguacuucaucccugcucucucuuga

SEQ ID NO: 70544 - RNA, 13125 nt, Artificial Sequence
  derived and/or modified sequence opt5 from HUWE1__Homo_sapiens__XP_005262022
augaagguggacagaaccaagcugaagaaaacccccacggaggcgccugcugauugccgggcccucaucgacaagcugaaagucuguaacgaugaacagcuucugcucgagcugcagcagauuaagaccuggaauaucggaaagugcgaacuuuaccacuggguugaccugcucgaucgcuucgacgggauucuggcggaugcuggacagaccguggagaacaugagcuggaugcuggugugugacagacccgaacgggagcagcucaaaaugcugcuucuggccguccucaauuuuaccgcccugcuuaucgaguauuccuucucucgccaucuguacagcuccauugaacaccucaccacccugcuggcuucuagcgauaugcaagugguucucgccgugcugaaccuucuguaugucuuuuccaagagaucuaauuacaucacacggcucggcagcgacaaacgcacaccccuccuuacgagacugcagcaucucgcugaguccuggggagggaaggaaaacggcuucgggcuggccgagugcugucgggaucugcacaugaugaaauauccucccagcgcgaccacacuccauuuugaguucuacgccgacccuggagcugaagugaagaucgagaagcgcaccacaucuaauacccugcacuauauucacaucgaacagcuugauaaaauuuccgagagccccucugaaaucauggagucccugacgaagauguacagcauuccuaaagacaagcagaugcuccuguuuacacauaucagacuugcccacggcuucucuaaccaucggaaacgccugcaagcuguucaggccagacuccacgcgauuuccauccugguguacagcaaugcccugcaggaguccgcuaacucuauccucuauaauggccugauugaggaacuugucgacgugcugcagaucaccgauaagcaacucauggaaauuaaagccgcuagccugcggacacugaccuccaucgugcaccuugagcgcaccccgaagcucagcucuauuaucgacugcacagggacggccuccuaccauggauuucugcccguccugguuagaaacuguauccaggccaugauugauccuagcauggaccccuauccucaccaguucgcuaccgcgcucuuuucuuuccuguaccaucuugccagcuaugaugcuggcggggaagcccugguguccugcggaaugauggaggcccuccugaaggugaucaaauuucugggcgacgagcaagaucagauuacauucgucacccgggcugugagaguuguggaccuuaucacaaaucucgauauggccgcguuccagucucacagcgggcuguccauuuuuaucuaccgccuggaacaugaggucgaccucugucggaaggaaugccccuucgugaucaaaccgaagauucagagaccuaacaccacgcaagagggagaagagauggagacagauauggacggcguucaguguaucccccagcgcgcugcccugcuuaaaagcaugcugaauuuucucaagaaggccauucaggacccugcuuucucugauggcauccggcacgugauggacgggucccugcccaccagccugaaacacauuaucucuaacgccgaauauuacggacccucccuuuuucuccuggcuaccgaggucgugacagucuucguguuucaagaaccuagccugcucuccucucugcaggauaacggccuuaccgacguuaugcugcaugcccuccugauuaaggaugugccggcgacaagagagguccuggggagccuucccaauguguucuccgcccucugccugaacgcucgcggacugcagucuuuuguucagugccaaccuuucgagcggcucuuuaaagugcugcuuagccccgacuaccugccugccaugagacgccggagauccagcgauccccucggcgacacggcuucuaaucugggguccgccgucgaugaacugaugcgccaccagccgacccuuaagacagacgcgaccacagccaucaucaaacugcucgaggaaauuuguaaccugggacgggauccuaaguauaucugccagaagcccagcauucagaaagcugacggcaccgccacggcuccucccccuagaucuaaucaugccgccgaggaggcuagcagcgaggaugaggaagaggaagaggugcaagcgaugcagucuuucaacagcacccagcaaaaugaaacagagcccaaccaacaggugguuggcaccgaggaacggaucccgauuccucucauggacuacauccugaaugucaugaaguuuguggaguccauccuuagcaacaauacaaccgacgaucacugucaggaguucgugaaccaaaaagggcugcucccccuggucacgauucugggacuucccaaucugccuaucgacuucccgacaucugccgcuugccaggccguggccggcguuuguaaguccauucucacccugagccacgagcccaaagugcuccaggaagggcugcuucagcuggauuccauccucucuagccuggagccucugcaucgccccauugaguccccuggaggcucuguccuucugagagaacucgcuugcgccgggaacguggcggacgcuacacugagcgcccaagccacaccccuccugcacgcucuuaccgccgcgcaugcuuauaucaugauguuuguucacacaugucgggugggccaguccgagaucagaucuauuagcgucaaucaguggggaucccagcugggccugagcgugcucucuaagcugucccaacuuuacugcagccugguuugggaaucuacggugcuccugucccucuguaccccuaacagccugcccucugggugcgaguucggacaggccgauaugcagaaacuugucccgaaagacgagaaggccggcacaacccaagggggaaaacgcuccgauggcgaacaggacggggcugccggcagcauggaugcuuccacacagggacugcuggagggcaucgggcucgacggagauacccuggccccuauggaaacggacgagcccacagcgagcgauucuaagggcaaaagcaagauuaccccugccauggcugcccggaucaaacagauuaagccccuucuguccgcuucuagcagacucgggcgcgcccuggccgaacucuuuggacugcuugugaagcugugugugggcuccccggucagacaacggcgcucucaucacgcugcgagcaccacaaccgccccuacacccgcugccagauccacggccucugcucugaccaaacuccugacaaaggggcuuagcuggcagccuccgcccuauaccccuacaccgcgguuccgccugaccuuuuucaucugcuccguuggcuuuacgagccccaugcuguucgacgagagaaaauacccuuaucaccugaugcuccagaaguuucugugcucuggaggccauaacgcccuuuucgagaccuuuaauugggcgcuguccaugggcgggaaagugcccgugagcgaagggcuggagcacucugaccucccugaugggacaggagaguuccuggacgcuuggcuuaugcuggucgagaagauggugaaccccaccacaguucucgaauccccucauagccugccggccaagcugcccggcggggugcagaauuuuccucaauucuccgcccuccgguuccuugucgugacccagaaagcugccuuuacauguaucaagaaccuguggaaucgcaaaccccugaagguuuacggcggaagaauggcggagucuaugcucgcuauucugugccacauccuucggggcgagccugugauucgcgaaagacugagcaaagagaaggaagggucccggggagaggaagauaccggccaggaggaagggggaagcagacgcgaaccccaggucaaccaacagcagcuccagcaacugauggacaugggcuucacgcgggagcaugccauggaagcccugcucaauacaucuaccauggagcaggcuaccgaguaccuucugacacacccgccucccaucaugggcggggugguuagagaucuguccaugagcgaagaggaccagaugaugcgcgccauugcuaugucucucggacaagauauccccauggaccagcgggccgaaagcccugaggaaguggcguguagaaaggaggaggaagaaagaaaagcccgggaaaagcaggaggaagaggaggcuaaaugccuggaaaaguuucaggaugccgacccccuugagcaagaugaacugcacaccuucacggacacaaugcucccuggcuguuuucaucugcuggacgagcucccggauaccgucuauagagugugcgaccuuauuaugacagcuaucaaacgcaacggggccgauuaccgggacaugauccugaaacagguggucaaucagguuugggaagccgcugaugugcugauuaaggcggcccucccccugaccacauccgacaccaaaacggugucugaguggaucagccagauggcuacccuuccucaagccuccaaccuggccacacgcauucuccugcugacccuccuuuucgaggaacugaagcugcccugugcuugggucguggagucuagcggaauccucaauguucugauuaaacuucuggaagugguccagccuugccuccaggccgcgaaggagcagaaagaggugcaaacacccaaguggaucaccccgguucugcugcucaucgauuuuuaugagaagacggcuauuuccagcaagcggcgcgcccagaugacaaaguaccuucagucuaacuccaauaacuggagaugguucgacgaucggagcggccgcugguguuccuauucugccagcaauaacuccaccaucgacucugcuuggaaaagcggggagacauccgugagauuuaccgccggacggagacgcuacaccguccaauucacaacgauggugcaggucaacgaagagaccggcaaucggagaccugugaugcugacacugcuccgcguuccccggcugaacaagaauagcaaaaacucuaauggccaggaacuugagaagacccuggaggaauccaaagagauggauauuaagagaaaggaaaacaaagggaaugacacaccucucgcgcuggagagcaccaacacggaaaaggagacaucucuggaggaaaccaaaaucggagagauucucauccagggccuuaccgaagauauggugacaguccugauccgcgccugcguguccaugcuggggguucccguggacccugacacccuccacgcuacacugcggcuuugucugagacucacgcgcgaucauaaguaugccaugauguuugcugagcugaaaagcaccagaaugauucugaaucucacacaaucuagcggauucaacggcuucacaccccuugucacacugcugcuccggcacaucauugaagacccgugcacccugcgccacacgauggagaagguggugagauccgccgcuaccucuggggccggaagcacaaccuccggcguugucagcggcucccuugggucucgggagaucaauuacauucugcgcgugcucggaccugcggccugcagaaaccccgauaucuuuacagaaguggcuaauuguugcauucggaucgcccugcccgcuccuagaggcagcgggaccgccuccgacgaugaguucgaaaaccugcgcaucaagggaccgaaugccguccagcucgugaaaacaacgccccuuaagccuucuccccugccuguuauucccgacaccaucaaagaggugauuuacgauaugcugaacgcucucgcggccuaucaugcuccugaggaagccgacaagagcgauccgaaacccggcgucaugacacaggagguggggcagcugcuucaagacaugggagaugacguuuaccagcaguaucggucccugaccagacagucuagcgauuuugacacccaauccggcuucagcaucaacucucagguguuugccgcugacggcgccuccacagaaacgagcgcgucugggaccucccagggagaggccagcacaccugaagagucucgcgauggcaagaaggacaaagagggggaucgggcuuccgaagagggaaagcagaaaggcaaggggagcaaaccccucaugccuaccuccacaauucugagacugcucgccgaacuuguccggagcuacgugggaaucgcuacccugaucgccaauuauucuuacacgguuggccaaagcgagcugauuaaggaagacuguuccgugcucgcguucguccuggaucaccuucugccccauacacagaacgccgaggacaaggauaccccggcucucgcccgccuguuucuggcuucucucgccgcugccggcagcgggaccgacgcccagguggcccuggugaaugaggucaaagcugcccuuggcagagcucuggccauggccgaauccacagagaagcacgcgcggcuccaagcuguuaugugcaucauuucuaccaucauggaaagcuguccuuccacaucuagcuucuauuccagcgccaccgcuaaaacgcagcauaacggcaugaauaacauuauccgccuguuucuuaagaaagggcuggugaaugaucucgccagagugccccacucucuggaccuguccagccccaacauggccaauacagucaacgcugcccucaagccucuggagacccuuucucggaucgugaaucagcccuccagccuguucggauccaaaucugcgagcuccaagaacaagagcgaacaggaugcccaaggcgcuucucaggacuccagcucuaaucagcaggacccuggggagccgggagaggccgaaguucaagaggaagaucacgacgugacacagaccgaggucgcugauggcgacauuauggauggcgaggccgaaacggacagcgugguuaucgcggggcagcccgaggugcucuccucucaggaaaugcaagucgagaacgaacuggaggaucuuauugacgagcugcucgaacgcgauggaggcagcggaaauuccaccaucauugugucuagaagcggagaggacgaaucccaggaggauguccugauggacgaagccccuagcaaccugucucaggcuuccacacuccaagccaaucgggaggauagcaugaacauccuggaccccgaggacgaagaggaacauacccaggaggaagauuccucuggcagcaacgaggacgaggaugacucccaggaugaagaggaagaggaggaagaggacgaagaggaugaccaggaagaugacgagggggaggaaggagaugaggacgacgaugacgauggcucugaaauggagcuugacgaagauuacccugacaugaaugcuagcccccuggugcgcuuugagagauucgaucgggaggacgaucucauuaucgaauuugacaacauguucuccagcgccacagauaucccgccuucucccggcaauauuccuaccacacacccccugaugguuagacaugcugaccacuccagccuuacccuggggucuggauccagcacgacacgccucacccaaggcaucgggcggucucagagaacccugcgccagcugacagccaacaccggacacacaauucaugugcacuacccuggcaaucggcagcccaacccgccucucauccugcaaagacuucuggggcccuccgcggccgcugauauucuccagcugagcucuagccuuccccugcagucccgcggccgggccagacuccuggugggaaaugacgacguccauaucaucgcucgcagcgaugacgagcugcucgaugacuucuuucacgaucaguccacggccaccucucaagccggcacacugagcuccauuccuaccgcgcuuacacgguggaccgaagagugcaaaguucuggacgcugaaucuaugcaugauugugugagcguggucaagguguccaucguuaaccaccucgaguuccugagagacgaggaacuugaggaacgccgggagaaaagacgcaagcagcuggccgaggaagagacgaaaauuaccgauaaggggaaggaagacaaagagaauagagaucagucugcccaaugcacagcuagcaaguccaacgacagcaccgaacagaaucucucugauggaacaccgaugcccgacuccuauccuaccacgcccagcucuacagacgccgcuaccuccgagagcaaagagacacugggcacccugcagucuucccagcaacagccuacccuccccacaccucccgcccugggggaagugccgcaggagcuucagagcccugcgggagaaggcgggucuuccacgcaacugcucaugcccgucgagccugaagaacugggccccacccggccgagcggagaggccgaaacaacccagauggagcuuagcccugcucccacaaucaccucccugucucccgaacgcgccgaggauagcgacgcucucacggccguguccucucagcuggaaggcagcccuauggauacauccucucuggcgagcuguacccucgaggaggccgucggggacaccuccgcugccggaagcucugaacagcccagagcuggcuccagcacaccuggggaugccccgcccgcuguggccgagguucaaggacggucugacggcuccggggaaagcgcgcagccucccgaggauuccucuccucccgccagcuccgagucuagcuccaccagagacagcgcuguggccauuucuggcgccgauucccggggaauccuggaagaaccucuuccgagcacaucuagcgaagaggaagacccccuggcuggcaucucccucccugagggggucgaucccucuuuucuggccgcgcuuccugacgacauucgcagagaggugcugcagaaccagcucggaauccggcccccgacgcgcaccgcuccuagcacaaauuccagcgcccccgccguugugggcaaccccggggucaccgaagugucuccugaguuccuggcugcccugcccccugcuauucaagaagaggugcuugcccagcagagagcggaacaacagcggcgcgagcuggcccagaaugcuuccagcgauacaccgauggaccccguuaccuuuauccagacgcucccuuccgaucugagacggucuguccucgaggacauggaagauagcgugcuggccgugaugcccccugacauugcugccgaggcgcaagcccuucgcagagaacaggaggcucggcagcgccagcugaugcacgaaagacuguucggacauuccucuaccagcgcccucuccgcuauccugcggucucccgccuuuacaagccgccuuuccggcaacagaggcguccaauacacccggcuggccguucagagagggggaacauuccagaugggcggguccucuucccacaaccgcccgagcggaucuaauguggauacccuccugcggcucagaggccgccugcugcuugaccaugaggcucuguccugccuccuggugcuucuguuugucgaugagccuaagcucaacacaagccggcugcacagagugcuccgcaaucuguguuaucacgcgcagacccggcauuggguuauuagaucucugcuuagcauccugcaacgcuccagcgaauccgagcucugcaucgaaacgcccaaacugacaaccucugaggagaaggggaagaaaagcuccaagucuugcggaagcuccucucacgaaaaccggccucuugaccugcuccauaaaauggagagcaaguccagcaaucagcugucuuggcuguccgugagcauggaugccgcucucggcuguagaaccaacauuuuccagauccaacgcucuggcgggcggaaacacacagaaaagcaugccuccggaggcagcacgguccacauucacccccaggccgcuccggugguuugcagacaugugcuggacacccuuauccagcuggccaaggucuuuccuucucacuucacacagcaacggaccaaagagacaaauugugaauccgauagagagcgcgggaacaaggcgugcagccccuguucuucccagagcuccagcucuggaauuugcaccgacuuuugggaccuccuggugaaacuugauaauaugaacgugagccggaagggcaaaaauuccgucaagucuguucccgugagcgcugggggagagggcgaaacauccccuuacucucuggaggccagcccccucggccagcugaugaacaugcugucccauccugugaucagacgcagcucucuccugaccgaaaaacuucugagacuccugucccuuaucagcauugcccugccggagaauaaggucucugaagcucaggccaacuccgggagcggagcuucuuccacgaccacagccaccagcacaaccuccacgacaaccacaaccgcggccucuacgacccccacaccucccaccgcuccuacacccgugaccagcgccccugcucucguugccgcgacagccaucuccaccauuguggucgcugccagcacgacagugaccaccccgacaaccgcuacaacgaccguuucuaucucccccacaaccaagggcagcaaaucuccugccaaggugagcgacgggggauccucuagcacagauuucaaaauggucuccagcggccugaccgagaaucaacugcagcucucuguggagguucugacgucccacagcuguucugaagaggggcuugaagacgccgcuaacgugcugcuccagcugucccggggagauagcggcacccgcgacacaguccuuaagcugcuccugaacggcgcgagacaucugggguauacccucugcaaacagauuggaacacugcuugccgagcugcgggaauacaaucucgagcaacagcgcagagcucagugugagacccugucccccgauggccuuccugaagaacagccccaaacgacaaagcugaaggggaaaaugcagucucgguucgacauggccgaaaacguggucaucguggccagccagaagcgcccgcucggaggcagagagcugcaacugccuuccaugucuaugcucaccagcaaaacauccacccagaaguuuuuccugcggguucuucaggugaucauucagcugcgcgaugacaccagacgggcuaauaaaaaggccaagcaaacagggcgccucggaagcucuggccugggcuccgcgagcucuauccaggcugccgucagacagcuugaggccgaagcugaugccauuauccagauggugcgggaggggcaaagagcucgccggcagcagcaggccgcgacguccgaaagcucucaauccgaggccagcgugagacgcgaagagagccccauggacguugaucagcccuccccuucugcucaggacacccaaagcauugccuccgacggaacaccccagggcgagaaagaaaaggaggaacggccuccggagcugccccuccugucugaacagcugagccucgaugagcugugggacaugcuuggggagugccugaaagaacucgaggaaucccacgaucagcacgcugugcugguccugcaaccugccguggaggcguuuuuccucguucaugccaccgaaagagagucuaagcccccugugcgcgacacacgggagagccagcuugcucacaucaaagaugaacccccgccucugucccccgccccucugacccccgcuacgccuucuagccucgaccccuuuuucuccagagagccgagcucuaugcauauuuccagcucucugcccccugauacacagaaguuucuucgcuucgccgaaacccaccggaccguccugaaccagauccucagacaauccacaacccaccuggccgacggacccuuugcugugcuggucgauuauauccgggugcuugacuucgauguuaagcgcaaauacuuuagacaggagcucgagcggcuggacgaaggccugcgcaaggaggacauggcggugcaugucagacgggaucacguguucgaagacagcuacagagagcuccaucgcaaaucuccugaagagaugaagaaucggcuguauauuguuuuugagggggaagagggacaggaugccggcggccuucugagagaaugguacaugaucauuucccgcgagauguucaacccgauguaugcucucuuccggacaagccccggggacagagugacguacaccaucaauccuuccagccacuguaaccccaaucaucugucuuauuuuaaauucgucggacgcauuguggccaaggccguguacgauaacagacugcuugaaugcuauuuuacacggagcuucuacaaacacauccucggcaaguccguucgcuacaccgacauggagucugaggauuaucacuuuuaccaggggcuggucuaucugcucgaaaaugacgugagcacacugggauacgaucuuaccuucuccacggaggugcaagaauuuggcgucugcgaggugagagaccugaagccuaacggggcuaauauccucguuaccgaagagaacaaaaaggaguaugugcaucuggucugucagaugcggaugacaggagccauucgcaaacagcuggcggcuuuccuugaaggcuuuuacgagaucauucccaagagacucaucucuauuuucaccgaacaagagcuggagcugcucaucagcggccugccuacaaucgauauugacgaucuuaaauccaauaccgaauaucacaaguaccagucuaacagcauccagauucagugguuuuggcgggcccugcgcuccuucgaccaagccgacagagcuaaguuucuccaguucgugacagggaccagcaaaguuccccugcagggauucgccgcucuggagggcaugaacgggauccagaaguuucaaauucaucgggaugacagaucuacggaucgccuuccguccgcccacacaugcuucaaucagcucgaccugccugcguacgagagcuuugagaaacugcggcacaugcuccugcuugccauccaggaauguucugagggauucggccuggcuuga

SEQ ID NO: 70545 - RNA, 822 nt, Artificial Sequence
  derived and/or modified sequence opt5 from HVCN1__Homo_sapiens__XP_011537150
auggccaccugggacgagaaggcugugacaagacgggccaaagucgcgcccgcugaacgcaugagcaaguuccugagacacuuuacgguugugggcgaugacuaccaugccuggaacaucaauuauaaaaagugggagaacgaagaggaagaggaggaagaggaacagccuccgcccaccccuguguccggggaggagggacgggccgcugcccccgaugucgcuccugcccccggcccugcgccgcgcgcuccccucgacuucagagggaugcugcggaaacuuuucucuagccaccgcuuccaagugauuaucauuugccugguugugcucgaugcccugcuuguccuggccgaacucauccuggaccugaagauuauccagccugauaagaauaacuacgcugccaugguguuucauuauauguccaucacaauucucguuuucuuuaugauggagaucauuuucaaacuguuuguguucagacuugaauuuuuccaccauaaguuugagauccuggacgcggucgugguggucguuucuuucauucucgauaucgugcugcuuuuccaggaacaccaguuugaggcccugggacuccugauucugcuccggcuguggcgcguggcuagaaucaucaauggcauuaucauuagcgucaaaacccgguccgagcgccaacuucugagacucaagcagaugaacgugcagcuggccgcuaaaauccagcaccuugaauuuucuuguagcgagaaggaacaagagauugaacggcugaauaagcuccugcgccagcaugggcugcucggagagguuaacuga

SEQ ID NO: 70546 - RNA, 1308 nt, Artificial Sequence
  derived and/or modified sequence opt5 from HYAL1__Homo_sapiens__NP_149349
auggccgcucaucugcuccccaucugcgcccuguuccuuacccugcucgacauggcgcagggcuuuagagggccucugcuuccgaaccggcccuucacaacgguguggaaugcuaacacccaauggugucuggagcgccacggagucgauguugacgugagcguguuugaugucguggccaauccuggccagacauucagagggcccgacaugaccauuuucuacuccucucagcucggaacauauccuuacuauacccccacaggcgaaccuguuuucgggggacugccgcagaacgccagccugaucgcucaccucgcccggaccuuucaagauauucuggcugccauccccgcgccugacuucuccggccuugccgugauugauugggaggcuuggcgccccagaugggccuuuaauugggacacgaaggauaucuaccggcagcgcucuagagcucugguccaggcccagcauccugacuggcccgcgccgcaaguggaagccguugcucaggaucaguuccagggcgccgcucgggccuggauggccgggacccuccaacugggacgcgcucuuagaccucggggccuguggggguuuuauggauuccccgacugcuacaacuaugauuuucucagcccuaauuacacaggccagugucccuccgggauccgcgcgcagaacgaccaacugggauggcuguggggccagucuagagcccucuaccccagcauuuauaugccugcugugcuggagggcaccgggaaaucccagauguacguccagcaccggguggccgaagccuuccgcguggcugucgccgcgggagacccgaaucuucccguucugccuuaugugcaaaucuucuacgauacaaccaaccauuuucucccccuggacgagcuugagcacagccugggcgaaucugcugcccagggggccgcuggagugguccucuggguguccugggagaauacgagaacaaaggaaagcugccaggccauuaaagaguauauggauaccacacugggcccuuucauccugaacguuaccucuggggcucuccuguguucccaggcccuuugcagcggacacggccggugugugagacgcaccucucaucccaaggcgcugcuccugcuuaauccggccuccuuuagcauucaacugacaccuggcgggggaccccucucccugcggggcgcucugucucucgaggaccaggcccagauggcugucgaauuuaaaugcagauguuacccuggguggcaggcccccuggugcgagcgcaagagcaugugguga

SEQ ID NO: 70547 - RNA, 1422 nt, Artificial Sequence
  derived and/or modified sequence opt5 from HYAL2__Homo_sapiens__XP_005265582
augagagccggccccgggccuaccgugacacuggcucucguccuggccguuagcugggcgauggagcuuaagccgacggcucccccuaucuucaccggacggcccuuugugguggccugggacgucccuacacaggauugcggcccccgccugaaagugccucucgaccugaacgccuucgauguucaggcuuccccgaaugaaggguuugugaaccaaaauauuaccaucuucuacagagaccggcuuggacuguauccccgcuuugauucugccggcagaagcguccacgggggagugccucagaacguuucccucugggcucaucggaagaugcugcagaaacgcguggagcacuacauuagaacacaagaaucugccggccuggcggucaucgacugggaggauuggcggcccgugugggugcgcaauuggcaggacaaggaugucuauagacggcucagccgccagcugguugccuccagacauccugacuggcccccggaucggauugugaaacaggcucaauacgaguucgaauuugccgcucagcaguucaugcuugagacccugcgcuaugugaaggccgucagaccucggcaccucuggggcuuuuaccuguuccccgacuguuauaaccaugauuacgugcagaauugggaaucuuacacagggagaugcccugacguugagguggcgcgcaacgaccaacuugccuggcugugggcugaaagcaccgcccucuuucccuccgucuaucuggaugagacgcuggcuagcucucggcacggaagaaauuucguguccuuucgcguucaggaggcccuccggguggccagaacccaccaugcuaaccacgcgcugcccgucuacguguucacacgcccuaccuauagccggagacuuacaggccugucugaaauggaccucaucuccaccaucggggagagcgccgcucugggagccgccggcgucauucuuuggggagaugcuggguacacgacaucuaccgaaacaugucaguaucugaaggacuaccucacccgccugcuggugccguauguugugaaugucuccugggccacccaauacugcagccgggcgcagugucauggccacggcagaugcgugcgccggaaccccuccgcuucuacauuccuccaccugagcaccaauuccuuuagacuuguuccugggcaugcccccggagagccucagcugcggcccgugggcgaacucagcugggccgauaucgaccaucugcagacgcacuuccgcugucaaugcuaccuuggguggucuggagagcagugucagugggaucacagacaggcugccggcggggcuuccgaggccugggcgggaagccaucugacaucucuccuggcccuggcugcccucgcuuuuaccuggacacuguga

SEQ ID NO: 70548 - RNA, 1164 nt, Artificial Sequence
  derived and/or modified sequence opt5 from HYAL3__Homo_sapiens__NP_001186959
augaccacacagcugggccccgcccucgugcugggggucgcucuuugccugggauguggccaaccucucccgcagguucccgagagaccuuucagcgugcuguggaacgugcccuccgcccacugcgaagcgcgguuugggguccaucuuccucugaaugcucucggaaucauugccaaccgcggccagcacuuccaugggcagaauaugacgaucuuuuacaagaaccaacugggacuguaucccuacuucggcccuagaggcaccgcccacaaugggggcauuccgcaggcucucccccuggaccggcaucuugcccuggcugccuaucagauccaccacucucuccgcccuggauuugcggggcccgccgugcuggauugggaggaaugguguccucuuugggcuggaaacuggggcagacggcgcgccuaccaggcugccagcugggcgugggcccaacagguuuuccccgaccuggauccgcaggagcagcucuauaaggcuuacacaggguuugaacaagccgcuagagcccugauggaggacacccugcggguggcccaggcucuccgcccucauggacuguggggcuucuaucacuaccccgcgugcggcaauggguggcauuccauggccucuaacuacacaggaagaugucacgcugccacccuugcccggaauacacagcugcacuggcucugggcugccagcuccgcgcuguuuccuucuauuuaucuuccuccccgccugcccccggcucaucaccaagccuucgucagacaucggcucgaggaagccuuucgcguggcucugguuggccacagacauccccugccugugcucgccuacguccggcugacccacagacgcagcgggcgguuccuuucccaggaggaaugcuggcaucugcacgauuaucucguggacacgcugggacccuacgugaucaacgucaccagagcugccauggcguguagccaccagcgcugccauggccacgggcggugugccagacgcgauccuggacagauggaggcuuuucuucaccuguggcccgacggcucucucggcgauuggaaauccuucagcugccauuguuauugggggugggccggaccgacaugccaagagccucggcccggcccuaaagaagcuguuuga

SEQ ID NO: 70549 - RNA, 1446 nt, Artificial Sequence
  derived and/or modified sequence opt5 from HYAL4__Homo_sapiens__XP_011514292
augaaggugcugagcgagggccagcucaaacugugcgucguucaacccgugcaccuuaccuccuggcugcucaucuucuuuauucugaagucuaucagcugucuuaaaccugccagacugccgauuuaccagcggaagcccuucaucgcugccuggaacgcgccuacagaccagugccucauuaaauauaaucugcgccugaaccucaagauguuucccgugaucggguccccucuggcuaaggccagaggacagaaugucacgaucuucuacgugaaccggcuuggcuauuaccccugguauaccucucaagggguuccuauuaauggaggccugccgcagaacaucagccuccaggugcaucuggaaaaagccgaucaggacauuaauuacuauauccccgcugaggauuuuuccgggcuugccgucauugacugggaauacuggcgcccucaaugggcuagaaacuggaacucuaaggauguguaccggcagaaaagccgcaagcugaucuccgacaugggcaaaaauguuagcgccacagauauugaguaucucgcgaaggugaccuucgaagagucugccaaggcuuuuaugaaagagacaaucaagcugggaaucaaauccagacccaagggccuguggggguacuaucucuacccugacugucacaauuauaacgucuacgcccccaauuauagcggaucuugcccggaagaugaggugcugcggaacaaugaacuuuccuggcuguggaacagcucugcugcccucuacccuuccauuggcguguggaaaagccugggggacuccgagaacauccuucgcuucucuaaguuuagaguccaugagagcaugcggauuuccaccaugacaagccacgauuacgcgcugcccguuuucguguauacccgccucggauacagagacgaaccucuguuuuuccugucuaaacaggaucucguguccacgaucggcgagagcgccgcucugggggccgcuggaauugucaucuggggcgacaugaaucuuaccgccucuaaggccaacuguacaaaggugaaacaguuuguuagcuccgaccugggcucuuauaucgcuaaugugacccgggcggccgaagucugcagccuccaucugugucgcaacaaugggagaugcauucggaagauguggaacgcucccuccuaccuucaccugaaucccgccagcuaucacaucgaggccucugaagauggagaguucacagugaaaggcaaggcuuccgacaccgaucucgccguuauggcggacacguucagcugucauugcuaccaaggguaugagggagcugauuguagagaaauuaaaacagccgacggcugcucugggguguccccuagcccgggaucccugaugacccugugccuccugcuucuggccucuuaccgcagcauccagcucuga

SEQ ID NO: 70550 - RNA, 2853 nt, Artificial Sequence
  derived and/or modified sequence opt5 from HYDIN__Homo_sapiens__NP_001185471
auggagagcgccggcggguucaagcugggaauggaaccccucuccggcgggggagugugcgagaaaaagaaacugcuuaagaugaccucuagacggcuggaagagagcaugggcgcuguccagauggggcucguuaacauguuuaaaggauuccaauccaaggugcugccuccgcuuucucccaagguggucacagaagaggaggugaaucgcaugcugacgccuagcgaauuucucaaagagaugucccugaccacagaacagagacuggccaagacccggcucaugugucgcccccagaucauugagcugcuugacaugggcgagacaacccaccagaaauucucuggcaucgaucuggaccaagcgcucuuucagccuuuccccagcgaaauuaucuuucagaacuacacaccuugcgagguuuaugaagugccgcugauucuuagaaauaacgauaagaucccccggcuggucaaagugguugaggaauccagcccuuacuucaaggugaucucucccaaggacauugggcauaaagucgcuccuggagugcccuccaucuuucgcauucucuucaccccggaggagaauaaggauuaugcccacacgcugaccugugugacagaaagagagaaauuuaucgucccuauuaaggcccggggcgcucgcgccauccuggacuuccccgauaaacucaacuuuucuaccugcccuguuaaguacagcacacagaaaauucugcuugugagaaauaucgggaacaagaaugcuguguuccauaucaagaccugucggcccuucuccauugaacccgccaucggaacgcugaacgucggcgagagcaugcaacucgaaguggaguuugagccucagucuguuggggaccacuccggacgccugauugugugcuaugauacaggcgaaaaagucuucgugagccuuuacggcgcggccaucgacaugaauauuagacuggauaagaacucccucaccaucgagaaaacauauaucucucuggcuaaucagcggaccauuaccauccauaaccgcagcaauauuaucgcccacuuucuguggaagguuuucgcuacacagcaagaagaggacagagaaaaauaccgggccugugaugaccucauuaaggaggagaaggacgaaacggaugaguuuuucgaagagugcaucaccgacccgcugcuuagagagcaccuguccgugcucagccgcacauuugcgaaccagcggagacugguccagggggauucuaaacuuuucuuuaacaauguguucaccgucgaaccccuggagggagacguguggccuaacuccagcgccgaaaucacaguuuacuuuaauccccucgaggcuaagcuguaucaacagaccauuuacugugauauccugggccgcgaaauucggcucccucugagaaucaaaggggagggaaugggccccaagauucauuucaacuuugagcuucuggacaucgggaaaguguucacgggaucugcccacugcuaugaagcuauucucuacaauaagggcagcaucgaugcccuguucaacaugacaccgccuaccuccgcccugggcgcuuguuuugucuucucucccaaggaggggaucauugaaccuagcggagugcaggcgauccagauuuccuuuagcucuaccauccuuggcaauuucgaggaagaguuucucguuaacgugaaugggucccccgagccugucaaacugacaauucgcggaugcgugaucggccccaccuuccauuuuaacgugccggcccugcacuucggggacguuagcuuuggcuucccucacacacucaucugcucucugaauaacacgucccuuauucccaugaccuauaagcugcggauccccggagauggccucgggcauaaaagcauuuccuacugugaacaacacgucgacuauaagagaccuucuuggacaaaagaggaaaucagcuccaugaagccgaaggaguuuaccauuucucccgauugcggaacaauccgcccucagggcuucgcugccauccgggugacccuguguagcaauacggugcagaaauacgaacuggcccuugucguggacguugaggggauuggagaggaagugcucgcucugcugaucaccgccagaugcgucgugcccgcgcuccaucugguuaacacagagguggacuuuggccacuguuuccuuaaguacccuuaugaaaagacccugcagcucgcuaaucaagaugaccugcccggguucuacgagguccagccucaggugugcgaggaaguucccacagugcuguuuuccagcccgaccccuucuggcgucauuucccccagcucuacgauccauauuccucuugugcucgagacacaggugaccggagaacaccgcuccacagucuauaucagcaucuucggcucucaagaucccccgcugguuugucaccugaaaagcgccggggagggaccugugauuuacgugcaucccaaccaggucgacuuuggcaacaucuaugugcucaaagauuccagccggauucugaaucuuugcaaccagucuuucaucccugccuuuuuccaggcucacauggcccauaagaaaucccuguggaccauugaacccaaugaggggaugguucccccugagaccgacgugcaacucgcucugacagccaaccugaaugauacgcuuaccuuuaaggacugugucauccucgauauugaaaacagcuccacauacagaaucccggugcaggcgucuggaaccggcagcacaaucguuuccgacaagcccuucgccccugagcugaaucugggggcucacuuucgguga

SEQ ID NO: 70551 - RNA, 1122 nt, Artificial Sequence
  derived and/or modified sequence opt5 from HYKK__Homo_sapiens__NP_001013641
augagcuccggcaacuaccagcaaucugaggcccugagcaagcccaccuucuccgaggaacaggcuucugcccucguggaaagcgucuuugggcugaaaguuuccaaggugagaccucuuccgucuuaugacgaucagaauuuccacguguacgucagcaaaacaaaggacggacccacggaguaugugcugaaaaucuccaacaccaaggcgagcaagaauccugaucucauugaaguucagaaccauaucauuauguuucugaaagcugccggcuuccccacagccucugugugccacaccaagggggacaauacagcuucccuugucagcguggauucuggauccgagaucaaaagcuaccugguucggcuccugaccuaucugccuggccgccccauugccgagcucccugugucuccgcaacugcuuuacgaaaucgggaagcuggcugccaaacucgacaagacacugcagagauuucaucaccccaaacuuuccagccugcaucgggagaacuucaucuggaaucucaagaacgucccucugcuggaaaaguaucucuacgcgcugggacagaaucgcaacagagagauuguggagcacgugauccaccuuuuuaaagaagaggucaugaccaagcugucccauuuccgggaauguauuaaucacggcgaucucaacgaccauaauauccugauugagucuagcaaauccgccagcggcaacgcugaauaccagguuucugggauccuugauuuuggagacauguccuauggcuacuauguguucgagguggccauuacgaucauguacaugaugaucgagagcaagucucccauucaagucgggggacacgugcuggcuggcuuugaaagcaucaccccucucacagccguugagaaaggggcgcuguuccugcucgugugcucccgcuuuugucagucucuggucauggccgcuuauagcugccagcuuuaccccgaaaauaaggauuaucugauggugaccgccaagacaggauggaaacaccuccagcaaauguucgacaugggccagaaggcuguugaggaaauuugguucgagaccgccaaauccuacgagagcggcaucucuauguga

SEQ ID NO: 70552 - RNA, 900 nt, Artificial Sequence
  derived and/or modified sequence opt5 from HYLS1__Homo_sapiens__NP_659451
auggaggaacugcuccccgacggccagaucugggccaacauggauccugaggaaagaaugcuggcugccgcgaccgcuuucacacacauuugcgccgggcaaggagagggcgacgugcggcgcgaagcccagagcauccaguacgauccguauuccaaggcuucugucgcccccgggaaaagaccugcccuucccguucagcugcaauacccucauguggagagcaaugugcccuccgagacggucucugaagcuagccagcggcuccgcaagccugugaugaaaagaaagguucugcggcgcaaaccggacggagaggugcuugucaccgaugaauccauuaucucugagagcgaguccggcacagaaaacgaccaggaucugugggaccucagacagcggcugaugaaugugcaauuucaggaggauaaggaaagcucuuucgacguuucccagaaguuuaaccugccccacgaguaucaggggauuagccaagaucagcucaucuguucucugcagcgcgaaggaaugggcuccccugcguacgagcaagaccuuaucguggccagcagacccaaaucuuucauucugccuaagcucgaucagcugucccggaaucgcggcaaaaccgacagagucgcucgguauuuugaguacaagcgcgacugggauagcaucagacuucccggggaagaccaucggaaagagcugagauggggagugcgcgaacagaugcucugccgggccgagccgcaguccaagccucaacacauuuaugugcccaacaauuaccuggucccuacagaaaagaaaagaucugcucugcgcuggggcguucggugugaucucgccaacggggugauccccagaaagcugcccuucccucuuagcccguccuga

SEQ ID NO: 70553 - RNA, 3000 nt, Artificial Sequence
  derived and/or modified sequence opt5 from HYOU1__Homo_sapiens__NP_001124463
auggccgacaaggugagacggcagcgccccagacggcgcgucugcugggcucugguugccgugcuccuggcggaucuucuggcucucagcgacacccuggccgugauguccgucgaucuuggcucugagagcaugaaaguggccaucguuaagccuggggugccgauggaaaucguccugaacaaagaguccagacggaagacacccgugaucguuacgcucaaagaaaaugagcgcuucuuuggagacucugcugccagcauggcuauuaagaacccuaaggccacccugagauacuuccaacaucugcucggcaaacaggcggauaauccccacguggcccuguaucaggcucgguuuccugaacacgagcuuacauucgacccccagcgccaaaccguccauuuucagaucuccucucagcugcaguucagcccugaggaagugcucgggauggugcugaacuacuccagaagccuugccgaggauuuugcugaacaaccgauuaaggacgccgucaucacaguucccguguucuuuaaucaggcggagcggcgcgccgugcugcaggcugccagaauggcuggacucaaaguccugcagcugaucaacgauaauaccgccacagcccucucuuauggcguguuccggcgcaaggacauuaacaccacggcucaaaauaucauguuuuacgauaugggguccggaagcaccguuuguacaauugugaccuaucagauggucaaaacaaaggaggcgggcaugcagccucaacugcagaucagaggcgugggguucgaccggacccuuggaggccuggaaauggagcucagacugcgcgaacggcuugccgggcuguuuaacgagcagagaaagggacagcgcgcuaaagauguucgggaaaaucccagagccauggccaagcuccugcgcgaggcuaaccggcugaaaacggugcucucugccaaugcggaccacauggcucaaauugagggccugauggacgaugucgacuucaaggccaaagugacaagagucgaguucgaggaacuuugcgccgaucuguuugagcgcgugccugggcccguucagcaggcucuccaguccgccgaaaugagccuggacgagaucgagcaagugauucuugucggaggcgcuacccgggugccgagaguucaggaagugcugcucaaggccgucggcaaagaggaacuggggaagaacaucaaugcggaugaggccgcugccaugggagcuguguaccaggccgcggcccugucuaaggcuuucaaagugaagccuuuuguuguccgcgacgccgugguguaucccauccucgucgaguucacacgggagguggaggaagaaccuggcauucauucccugaaacacaacaagagaguucuuuuuagccggauggggcccuacccccagcgcaaagugaucaccuucaacagauacucccacgauuuuaauuuccauauuaacuauggagaccugggcuuucucgggccugaagaucugcgggucuucggaucucaaaaucugaccacagugaagcucaagggcguuggcgacagcuuuaaaaaguacccggauuaugaguccaaagggaucaaggcucacuucaaccucgacgagagcggagugcugucucuggacagagucgaauccguguuugagacgcucguugaagauagcgccgaggaagagucuacccugacaaaacuuggcaauaccauuagcucccuguucgggggaggcacaacccccgacgccaaggagaacgggacggauacagugcaggaagaggaagagucuccugcugaaggcagcaaggacgagcccggagagcaggucgaacucaaagaggaagcggaggccccuguggaagauggcucccagcccccgccucccgagccuaagggggacgcuacccccgagggagaaaaagccaccgagaaggaaaauggcgauaaaagcgaggcccaaaagccuucugagaaggcugaagccgggcccgagggaguggcgccggcuccugaaggcgagaaaaagcagaaacccgcccgcaagcggagaauggucgaagagaucgggguugagcugguggugcuggaccuucccgaucucccugaagacaaacuggcccaguccguccaaaagcugcaggaucucacacugcgcgaccuugagaaacaggaaagagagaaggcugccaacagccuggaagcguucaucuuugagacccaggauaagcucuaccaaccggaguaucaggaagugucuacagaggaacagcgggaggaaauuuccggcaaacugagcgcugccuccacguggcuggaggacgagggaguuggcgccaccacagugaugcuuaaggaaaaacucgcugagcugcgcaagcugugucaggggcuuuucuuuagagucgaagaacggaaaaaguggcccgagcgccugucugcccuugacaaucugcucaaccauagcuccauguuccugaagggagcuagacugaucccugaaauggaucaaauuuuuaccgagguggaaaugacaacccuugagaaaguuaucaaugaaacgugggccuggaagaacgcgacccucgccgagcaggcuaaacugcccgccacagagaagccugugcugcucucuaaagacauugaagcuaagaugauggcccuggaucgggagguccaguaccuucugaauaaggccaaauucaccaagccccgcccuagacccaaagacaagaacggcacacgggcugaaccgccucucaaugcgagcgccuccgaucagggggagaaagugauucccccugcuggacaaaccgaagacgccgagcccaucagcgagccggaaaagguugagacgggcucugaaccuggggauacagagccccuggaacugggcggaccuggcgccgagcccgagcagaaggaacaguccaccgggcaaaaacgcccccuuaagaacgacgagcuguga

SEQ ID NO: 70554 - RNA, 354 nt, Artificial Sequence
  derived and/or modified sequence opt5 from HYPM__Homo_sapiens__NP_036406
augagcgagaagaaaaacugcaaaaauuccucuaccaacaauaaccagacacaagaccccagcagaaaugaacuccaggugccucgguccuucgucgaucgcguugugcaggacgagagagaugugcagucucaaagcuccucuacgaucaacacccugcugacacuucuggacugucucgccgauuacauuauggaacgggucggccuggaggcuagcaauaacggguccaugcgcaauaccagccaggacagagaacgggagguggauaacaaucgcgagccgcacucugccgaauccgacguuacaagauuucuuuucgaugagaugcccaagagccggaagaacgacuga

SEQ ID NO: 70555 - RNA, 270 nt, Artificial Sequence
  derived and/or modified sequence opt5 from IAPP__Homo_sapiens__NP_000406
augggcauccugaagcuccagguguuccugauuguccuuagcguugcccugaaccaccucaaagcuacccccaucgagucccaucaaguggaaaagagaaaaugcaauacagccacgugugcgacccagcggcuggcuaacuuucuugugcacucuagcaauaacuucggggccauucuguccucuacaaaugucggaagcaacaccuacggcaagcgcaaugccguggagguucucaaaagagaaccucugaacuaucugccgcucuga

SEQ ID NO: 70556 - RNA, 3039 nt, Artificial Sequence
  derived and/or modified sequence opt5 from IARS2__Homo_sapiens__NP_060530
augagauggggccugcggccccgcgggccuggagccgcugcccucgcgaccgcuagaagccuguggggcacaccgcggcuucccugcuccccuggguggcagggagccacgaagcgccugcucgugagaucugucagcggcgccuccaaccaccaacccaauucuaacagcgggcgguaccgcgacaccguucugcuuccucagacauccuuccccaugaaacugcucggaagacagcagccugauaccgagcuggaaauccaacagaaguguggcuuuucugagcuguauagcuggcagcgggaacgcaaagugaagacagaguucugccuccaugacggcccgcccuacgcuaauggggauccucacgugggacaugcccugaacaaaauucuuaaggacaucgcuaauagauuucacaugaugaacggcuccaagauucauuucguccccgggugggauugucacggacugccuaucgaaauuaaagugcucagcgagcugggccgggaggcccagaaucuuucugcgauggaaauccgcaagaaagccagauccuuugcuaaggccgcuaucgagaaacaaaagagcgccuucauucggugggggaucauggcggacuggaacaauugcuauuacaccuuugauggaaaguaugaagccaaacagcugcgcacauucuaccagauguaugacaagggccucguuuacagaucuuacaaacccguguuuugguccccgagcucucggaccgcucuggccgaggcugagcuggaauauaacccugagcacgucuccagaagcauuuacgugaaguucccccuccugaaaccuucccccaagcuggccucucugaucgauggcagcucccccguuagcauucucguguggacgacccagccuuggacaaucccggccaaugaagcugucuguuauaugcccgagucuaaauacgcgguggugaagugcuccaagagcggggaccuguauguccuugccgcugauaaaguugccucuguggccagcacccuggaaacaaccuuugagacgauuuccacacucucuggaguggaccuggagaacggcaccuguagccauccucugauccccgauaaggcuuccccucuccugcccgccaaucacgucacaauggcgaaagggaccggacuugugcauaccgcuccggcccacggcauggaagacuacgggguugccagccaacacaaccugccuauggacugccucguggaugaggacggagucuucacagauguggcuggccccgaacugcagaauaaggccguucuugaggaaggcacggacguggucaucaaaaugcugcagaccgcuaagaaccuccugaaggaggagaaacuggugcauucuuauccuuacgauuggcgcacaaagaaacccgucgugauucgggccuccaagcaaugguuuaucaacauuaccgacaucaaaacagcggccaaggaacuccugaagaaaguuaaguucauuccugggagcgcucuuaauggaaugguggagaugauggauagacgccccuacugguguaucucucggcagagagucuggggcgugccgaucccuguuuuccaccauaaaaccaaggacgaauaucugauuaacucccagacgacagagcacaucgugaaacucgucgaacagcaugggagcgauauuugguggacccugccucccgagcaacugcuucccaaggaggugcucuccgaagugggaggcccggacgcccuggaguacguucccgggcaggauauccuggacauuugguuugacucuggcaccagcugguccuauguccucccuggacccgaucagcgcgcugaccuguaccuugaaggcaaggaucagcuugggggaugguuccaaucuagccuccugacauccguggccgcgcggaaaagagccccuuauaagaccgugaucguccacggcuuuacacugggggagaaaggagagaagaugagcaaaucucuuggcaaugugauccaccccgacguuguggucaacgggggccaggaucaguccaaggaaccucccuacggagcugacgugcuccgcugguggguugccgauagcaauguguucacggaggucgcuauuggcccgucugugcugaacgccgcccgggacgauaucuccaaacugagaaauacccuccgcuuucugcuugggaacguugcugacuucaauccugaaacagauagcauucccgugaacgacauguaugucaucgaucaguacaugcugcaucuccugcaagaccuggcgaauaagauuaccgagcuuuacaagcaguaugacuuuggaaaaguggugcggcuccugagaacauucuacacccgggaacugucuaacuuuuauuucagcaucauuaaggaucgccucuacugcgagaaagagaaugacccuaagagacgguccugucagacggcccuggucgaaauccuugauguuaucgugcgcagcuuugcucccauucugccgcaccucgccgaggaaguguuccagcauaucccuuauauuaaagagcccaagucugucuuuagaaccggcuggaucuccacaagcuccauuuggaagaaaccugggcuggaagaggccguggagucugcuugcgccaugcgggacagcuuccugggauccauccccggcaagaacgcggcugaauacaaaguuaucaccgugauugagcccgggcuucucuucgaaaucauugagaugcugcaaucugaagagacaagcuccaccucucagcugaaugagcucaugauggccagcgaauccacgcugcuugcccaggagccuagagaaaugacagcugaugucaucgagcugaagggcaaauuucucauuaaccuggagggaggcgacauccgcgaagagagcucuuauaaggugaucguuaugccgaccacaaaggaaaaaugccccagauguuggaaguacaccgccgaguccagcgauacccugugcccucggugugcggaaguggucucugggaaauga

SEQ ID NO: 70557 - RNA, 3789 nt, Artificial Sequence
  derived and/or modified sequence opt5 from IARS__Homo_sapiens__NP_038203
augcugcagcaagugcccgagaacaucaauuucccugccgaagaggaaaagauucucgaguuuuggaccgaauuuaacugcuuccaggagugucugaaacagagcaagcacaaaccgaaguucacauuuuacgacgggcccccuuucgcuacggggcuuccccauuauggacacauccuggccggcaccauuaaagauaucgucacaagauacgcgcaucaguccggguuucacguugaccggcgcuucggaugggauugccauggccucccuguggaguaugaaauugacaagacccuggggaucagaggacccgaggauguggcuaagaugggcaucacagaauacaauaaccaaugucgggccauugucaugcgcuauucugccgaguggaaaagcaccguguccagacuuggccgguggaucgacuuugauaaugacuacaagacacuguauccucaguucauggagucuguuugguggguguuuaaacagcucuacgauaaggggcuggucuaccgcggagugaaaguuaugccguucagcaccgcuugcaacacgccccuguccaauuuugaaucucaccagaacuauaaggacgugcaagauccuagcgucuucgugaccuucccccucgaggaagacgagacagugucccuggucgccuggaccacaaccccuuggacgcuucccagcaaucuggcuguuugugugaacccggaaaugcaguacgugaagauuaaagaugucgccagaggccggcuccugauccuuauggaggcgcgccugucugcccucuauaagcuggaguccgacuacgaaauucuggagagauuuccuggggcuuaucucaaaggaaagaaauaccggccccuguucgacuauuuucuuaagugcaaagaaaauggcgccuucacagugcugguugauaacuacgugaaggaggaagaggggaccggagucgugcaccaggcuccuuacuuuggcgccgaggacuaucgcguuuguauggauuucaauaucauuagaaaggacagccuccccgugugccccgucgaugcgucuggcuguuuuacaaccgaagugaccgacuucgccgggcaguacgucaaagaugcugacaaguccaucauccggacacugaaagagcaaggacgccuucugguggccacgaccuuuacacauagcuauccuuucugcuggagaucugauaccccgcucauuuacaaggcuguucccuccugguuugugcgggucgaaaacaugguggaccagcugcugagaaauaacgaucucuguuauuggguuccugagcuggugcgcgaaaaacgguucggcaacuggcuuaaggacgccagagacuggacaaucagccgcaaucgguacugggggacccccauuccucugugggucuccgaugacuuugaggagguggugugcaucggaucuguugccgaacucgaggaacugagcggcgcuaagauuuccgaucuucacagagagagcgucgaccaucugacgauccccucucgcugcgggaaaggaucccuccaccggaucagcgagguguucgauuguugguucgaaucuggcagcaugccguaugcccaggugcacuacccuuuugagaacaagagagaauuugaggacgcguuccccgcugauuucauugccgaaggcaucgaccaaacacgcgggugguuuuacacccugcugguccucgccaccgcucuguucggacagccucccuuuaaaaaugugauuguuaacggccuugugcuggccuccgaugggcagaagaugucuaaacggaagaagaauuauccugaccccgucagcaucauucagaaauacggagcggaugcucucagacuguaucugaucaacuccccggugguucgcgccgagaaucuucgguucaaggaggaaggcgugagagacguccucaaagaugugcugcugccuugguacaacgccuaucgguuucucauccaaaauguucugcgccuucagaaggaggaagagauugaauuucuguacaacgagaauacagugagagagagccccaacaucaccgaccgguggauucucucuuucaugcagucccugaucggguucuuugaaacagagauggcugccuauagacuguacacggucgugccccgccuugugaaauucgucgacauucucaccaauugguacguucggaugaacagacgcagacugaagggcgaaaauggaauggaggauugcgugauggcucuggaaacacucuucagcgugcugcuuucucugugucggcucauggccccuuauaccccguuucugacagagcugauguaccagaaccuuaagguccucaucgaccccguguccguucaagauaaagacacccugagcauucauuaucugaugcucccucgcgugagagaggaacugaucgauaagaaaacggaguccgcggucucucagaugcagagcgugaucgaacuuggccggguuauucgcgacagaaagaccauccccauuaaauacccucugaaggagaucguggucauucaccaggaucccgaggcccucaaagacaucaagucccuggaaaaguauaucauugaggaacugaacgugcggaaaguuacacuuucuaccgauaagaauaaauacgggauccgccucagagcugagccugaccauauggugcugggaaagcggcugaaaggcgccuucaaggcugucaugacaagcauuaagcaacucuccagcgaagaacuggagcaguuucagaaaaccgggacgaucgugguggaaggacacgagcuucaugaugaagacauucgccugauguauacauucgaucaggccaccggcgggacagcgcaauuugaggcccacucugacgcucaggcccucguccugcuggacguuacccccgaucaguccaugguggacgaaggcauggcuagagaggugaucaaccggauccaaaaacuuagaaagaagugcaaucuggucccgaccgaugagauuacaguguacuacaaagccaagagcgaaggaacguaucucaacucuguuaucgagucccacaccgaguucauuuuuacaaccaucaaggccccucugaaacccuacccugugagccccucugacaagguccucauucaggagaaaacacagcugaagggcagcgaacuugagaucacccugacgcgcggguccagccucccgggaccugcuugugcguaugugaaucugaacaucugcgccaauggcucugagcagggcggaguucugcuucuggaaaaccccaaaggcgauaaucggcucgaccugcucaagcugaaguccguggucacaagcauuuucggggugaaaaacaccgagcuugcugucuuucaugaugaaaccgagauccaaaaucagacagaccugcucucccugucuggcaagacccugugugugacagccggaagcgccccuucccuuauuaacucuagcuccacgcugcucugccaguacaucaaucugcagcuccugaacgcuaaaccccaagagugucuuaugggcaccguugggacacugcugcucgaaaauccccugggacagaacggccuuacccaccaggggcugcucuaugaggccgcgaagguguucggacugagaucucgcaaacucaagcuguuucuuaacgaaacacagacccaagagauuacggaagauaucccugucaaaacccugaauaugaagacaguguacguuagcgugcugccgaccacagcugacuucuga

SEQ ID NO: 70558 - RNA, 1071 nt, Artificial Sequence
  derived and/or modified sequence opt5 from IBA57__Homo_sapiens__NP_001010867
auggccaccgcugcccugcucagaggcgcgacacccgggcggggaggcccuguguggcgcuggagacugcgggcugccccgcgcugcagacuugcccacagcuccuguucucccgggggagacccuacggcuggcgccgcuugggccugcuuccggcuggaugggcgcacccuccugagaguccggggacccgacgcggccccuuuucuucugggccuccugacaaacgagcugccccucccuagcccggcugccgcuggcgcgcccccugccgcccgcgcuggguacgcccauuuccugaauguucagggaagaacccuuuaugaugugauccuguacggccuccaagaacacuccgaggugucuggguuucugcuugaaugugacagcuccguccagggagcucugcagaagcaucucgcccuguaucggauucgcagaaaagugacaguugagccccacccugaacugcgggugugggccguccuccccucuagcccggaggcuugcggcgcggccucccugcaggagcgcgcuggggccgccgcuauccuuauuagagauccucggaccgccagaaugggauggcgccugcucacacaagacgaaggccccgcgcuggugccuggcgggcggcuuggagaucugugggacuaccaucagcacagauaucuccagggcguucccgagggggugcgcgaucugcccccuggagucgcucugccgcucgaaagcaaccuggccuucaugaauggcgugucuuuuaccaagggguguuacaucggacaggagcuuacggcccggacccaccauaugggcgugauuagaaaacgccuguuccccguccgguuucucgacccucugcccacauccggcaucaccccuggggcuacaguucuuaccgccagcggacaaacggugggcaaguucagagcugggcagggaaacgugggccuggcccuccuguggucugagaaaaucaaggggccccugcacauucgcgcguccgaaggcgcccaggucgcucucgccgcuagcgugccggauugguggccuacaguuucuaaguga

SEQ ID NO: 70559 - RNA, 954 nt, Artificial Sequence
  derived and/or modified sequence opt5 from IBSP__Homo_sapiens__NP_004958
augaagaccgcccugauccuccugagcauucuuggcauggcuugcgccuucuccaugaaaaaccugcacagacgggugaagaucgaggacucugaagagaauggggucuuuaaauaccgccccagauauuaccucuauaagcaugcguacuucuauccucaccugaaacgguuuccgguucagggaagcuccgauucuagcgaagagaacggcgacgauuccucugaagaggaggaagaggaagaggagacaagcaaugaaggggagaacaaugaagaguccaacgaagacgaggauagcgaggcugaaaauacgacccuuucugccacaacccugggauacggcgaggacgccacacccgggaccggauauacaggccucgcugccauucaacugccuaagaaggcuggcgauaucaccaacaaagccacgaaggaaaaagaguccgacgaagaggaggaagaggaagaggaagggaaugagaacgaggaaagcgaggcggaaguggaugagaaugagcagggaauuaacggcaccucuacaaauuccaccgaagccgagaacgggaauggaagcucuggcggggacaacggagaagagggcgaagaggaguccgugacaggcgcuaacgccgaagauaccacggagacagggcgccagggaaagggcaccagcaaaacaaccaccucccccaaugggggauucgaaccuacaacgcccccucaggucuacagaaccacaucuccgcccuuuggcaagaccacaaccguggaguacgaaggggaguaugaguacacgggagcuaacgaauaugacaauggcuacgagaucuaugaaagcgagaacggcgaaccucgcggggauaauuaccgggccuaugaggacgaguacuccuacuucaagggacaaggcuaugacggguacgauggacagaacuauuaccaucaccaguga

SEQ ID NO: 70560 - RNA, 4062 nt, Artificial Sequence
  derived and/or modified sequence opt5 from IBTK__Homo_sapiens__NP_056340
augagcucccccaugccugacugcaccucuaaguguagaagccugaaacacgcccucgaugugcuguccgucguuacaaagggcucugagaaccagaucaaagccuuccuuagcucccauugcuacaaugccgcgacgauuaaggacguguuugggcggaacgcucugcaccucgugucuagcuguggcaaaaagggaguccuggauuggcuuauccaaaaggggguggaccugcucguuaaagauaaggaauccggauggaccgcccugcaucgcagcauuuucuauggccacaucgacugcguguggucucugcucaaacauggggucucccuguacauucaggauaaggagggacuuagcgcccuggaccucgugaugaaagauagaccgacacacguuguguuuaagaauaccgaccccacagaugucuauaccuggggcgacaacacaaauuucacccugggccacgggucucagaacuccaagcaucacccugaacuuguggaucuguuuagccggucuggaaucuacaucaaacaggugguccucuguaaguuccauuccguuuuucugagccaaaaaggccagguguauacgugcgggcacggacccggcgggcgccugggacacggcgacgagcagaccugucucgugccuagacuggucgaaggccuuaaugggcauaacugcucccagguggcugccgcuaaggaccacacaguugugcugaccgaggauggaugugucuacacauucggccucaauauuuuucaucaacuggggaucauucccccuccgucuagcugcaacgugccccggcagauccaggccaaauaucuuaagggacgcaccauuaucggcguugcggccgggagauuccacacggugcuguggacacgggaggcugucuacaccaugggacucaauggcggccagcuggggugucugcucgacccuaacggagaaaaaugcgugacagcuccccgccaagucuccgcucugcaucacaaggauauugcccuuagccugguggcggccucugacggcgcuaccguuugcgugaccacaagaggggauaucuaccuccuggccgacuaucaguguaagaaaauggcuuccaagcagcuuaaucugaaaaagguccucgugagcggaggccacauggaguacaaaguugauccugaacaucugaaggagaacgggggccaaaagaucugcauucuggccauggacggagccggccggguguuuuguuggcgcucugucaauagcucccucaaacagugcagaugggcuuauccccgccagguguucaucucugauauugcgcugaaccggaacgagauccuuuuugugacgcaggacggggaaggauucagaggccggugguucgaggaaaagagaaaaagcuccgagaagaaagaaauucugagcaaucuccacaacucuuccagcgauguuucuuacgucuccgacaucaauagcguguaugagcgcauccggcuggagaagcugaccuuugcccauagagcuguguccgucucuacagacccgagcggguguaacuucgccauucuucaauccgauccuaagaccucucucuacgaaauccccgccgugagcuccagcuccuuuuucgaggaauuuggaaaacugcugcgcgaggcugacgaaauggauucuauucacgacguuacauuccaggugggcaaucggcucuuuccugcccacaaguauauccuggcgguccauagcgauuucuuucagaaacuuuuccugucugacgggaacaccuccgaguuuacggauauuuaccagaaggacgaggauagcgcuggcugccaccucuucgugguugaaaaagugcaucccgacauguuugaguaccugcugcaauucaucuauacagauaccugugacuuccuuacccacggauuuaagcccagaauccaucucaauaagaacccugaagaguaccagggcacacucaauucucaccugaacaaagucaauuuccacgaagaugacaaccagaaaagcgccuuugagguguauaaauccaaucaggcccaaaccguuagcgagcgccagaagucuaaaccgaaguccugcaaaaaggggaagaacauucgggaagacgaucccgugagaaugcugcagacagucgcuaaaaaguucgacuuuagcaaucuguccucucgccuugauggagugcgguucgagaacgaaaagaucaacgugauugccaagaauacgggcaacaaacugaagcucagccagaagaaauguuccuuucugugcgacgucaccaugaagucuguugaugggaaagaguucccuugucauaagugcgugcugugcgcuagacuugaguacuuucacagcaugcucuccucuagcuggaucgaagccuccagcugugcggcccuggagaugcccauucauucugacauccugaaagugauucucgauuaucuguacacagacgaagcugucgugaucaaggagucccaaaauguugauuucaucugcagcgugcuugucguggccgaccagcugcucauuacccgccugaaggaaaucugugagguugcucugacagagaaacuuacccucaagaacgccgcgaugcugcuggaauuugccgcuauguauucugccaaacagcucaagcuguccugccuucaauucauuggacugaauauggcugcccuccuggaggcccggagccuggaugugcuuucugacggcguccugaaagaucucuccgaauuuuacagaaagaugaucccugcuauggaccggcgcgugauuacgcccuaccaggacgggccggauaucagcuaucuggagguugaagacggcgauaucuuccucaaggaggagauuaacauggaacagaaucacuccgagaccauguucaaaaaggcgaaaacaaaggccaaaaagaaaccuagaaagcggagcgacucuagcggaggcuacaaccuguccgauaucauucagucucccagcuccaccgggcuucugaagucuggaaaaacaaauagcguggaaucccucccugagcugcugaccucugacagcgaaggcuccuaugcuggggucggaagccccagagaucuucaaucuccugacuuuacgacaggcuuccauuccgauaagaucgaggccaaagugaagcccuacgugaacgggaccagcccggucuauucucgcgaggaccugaaaccuugggaaaagucccccauucucaagaucagcgcuccccagccuaucccguccaaucggauugauacaaccucuagcgccuccuggguugccggcagcuuuucucccguguccccucccguggucgaccugagaaccaucauggagauugaagagagccgccagaaauguggagcgacaccuaagucucaccucggcaaaacggugagccacgggguuaagcugucccagaaacaaagaaagaugaucgcucuuaccacaaaggagaacaauucuggaaugaacagcauggaaaccgugcuguucacacccuccaaagccccuaagcccgucaaugccugggcuucuagccuccauuccgugagcucuaaauccuuucgggacuuccugcuggaggaaaagaaaagcguuaccucccacucuagcggcgaucaugugaagaaggucuccuuuaaagggauugagaacucucaggccccgaagaucgugcgcugcagcacgcacggaacaccuggccccgaaggcaaccacaucuccgaccuuccucugcucgauagccccaauccguggcugucuuccagcgucaccgcgccuucuaugguggcucccguuaccuucgccuccauuguggaggaggaacuccagcaggaggccgcucugaucagaagccgggaaaaaccucuugcccugauucaaaucgaggaacaugcuauucaggaccugcucgucuuuuacgaggccuucgggaaccccgaggaauuugugaucguugagcgcacaccccagggaccucuggcggugccgauguggaauaagcacggcuguuga

SEQ ID NO: 70561 - RNA, 1449 nt, Artificial Sequence
  derived and/or modified sequence opt5 from ICA1__Homo_sapiens__NP_001263407
augagcggccacaagugcuaccccugggaccugcaggauagauaugcccaagacaaauccguggucaacaagaugcagcagaaauacugggagaccaagcaggcuuucaucaaagccacagggaagaaggaagaugagcauguuguggcgucugacgcugaucucgacgccaaacuggaacuuuuucacagcauucaacggacgugucuggaucucuccaaggccaucgugcuguaucagaaacgcauuugcuuccuuucucaggaggaaaaugagcugggaaaguuucucagaagccagggcuuccaagacaaaacccgggcugggaagaugaugcaggccacaggaaaggcucuguguuuuuccucucagcagcgccuggcccucagaaacccucugugccgguuccaucaagaggucgaaaccuuucgccacagagcgaucagcgauacauggcuuaccgugaaucggauggagcagugucgcacagaauacagaggcgcccugcucuggaugaaagacguuucccaggagcuggauccggaccuuuauaagcaaauggagaaauuccggaaggugcagacccagguccgccuggcuaaaaagaacuuugauaaacucaagauggacgugugccagaagguugaccugcugggggccagcagauguaaucuccugucucauaugcuugcuacguaccaaaccacacugcuccacuucugggaaaagaccucccacacaauggccgcgauucaugagagcuuuaaaggauaucagcccuacgaguucaccacgcugaaaucucuucaggauccuaugaagaaacugguggaaaaggaagagaagaaaaagaucaaccagcaagaguccacagacgccgcuguccaggaacccagccagcucaucucucuggaggaagagaaucagcggaaagaauccagcuccuuuaagaccgaggauggcaaaucuauucugagcgcccucgacaagggcuccacacacaccgcuugcagcgggccuaucgaugagcugcuugacaugaagucugaagagggagccugucugggccccguggccgggaccccugaaccggagggagcugauaaagacgaucuccugcuucuguccgaaauuuucaacgcgagcucucucgaggagggcgaguucagcaaggaaugggccgcuguguuuggggacggacaagucaaagaacccguuccuacaauggcccugggcgagcccgauccuaaggcccagacgggcuccggguuccugcccucucagcuccuggaccagaauaugaaagaccuucaagcuagccugcaggagccggccaaggcggcuuccgaucucaccgccugguuuagccuguucgccgaccuggauccucuuucuaaccccgacgcugugggaaagacagauaaagaacaugagcuccugaaugccuga

SEQ ID NO: 70562 - RNA, 1599 nt, Artificial Sequence
  derived and/or modified sequence opt5 from ICAM1__Homo_sapiens__NP_000192
auggcccccagcuccccuagaccggcucugcccgcccuccuggugcuucugggcgcucucuucccugggcccggaaacgcgcagaccucugucagcccuuccaagguuauccugccccggggcgggucugugcuugugacaugcagcacguccugugaccaaccuaaacugcucggaauugagaccccgcugcccaagaaagaacugcuccugccuggcaauaaccgcaaggucuacgagcuuucuaaugugcaggaagauagccagcccaugugcuauuccaacuguccugacgggcagagcacagccaaaaccuuucugacaguuuacuggacccccgagagaguggaacucgccccgcugccuucuuggcaacccgucggaaagaaucuuacacugcggugccagguggagggcggcgcuccucgcgccaaccucaccguugugcugcugagaggggagaaggaacucaaacgggagcccgcugucggagaacccgccgaggugacgaccacagugcugguccgcagagaucaccauggcgcgaauuucuccugucggaccgagcuugaccugcgcccucaggggcucgaacuguuugagaacacaagcgccccguaucagcuucaaaccuucguucugcccgcuacgccuccccagcucgugucuccuagagugcuggaagucgauacacagggaaccgugguuugcucccuggacggccucuuucccgugagcgaggcccagguccaccuggcucuuggggaucaacggcugaauccgacagugaccuacggaaacgacucuuucuccgccaaggcgagcguuuccgugaccgccgaagaugagggcacacagcgccucacgugugcugucauccugggcaaucagucucaagagacccuucagacagugaccauuuauagcuuuccugcccccaacgucauccugacaaaaccugaaguguccgaggggaccgaaguuacggugaagugcgaggcucaucccagagccaaagucacacucaauggagugccugcccagccccugggcccgcgggcucagcugcuccugaaggcgaccccugaagacaacgggcgcagcuucucuuguuccgccacccuugagguugcuggacaacugauucacaagaaucagacaagagagcuccgggugcuguacggccccagacuggaugaacgcgacugccccgggaacuggaccuggccugagaacagccagcagacaccgaugugucaagccuggggaaauccccuuccugaacucaaaugccugaaggauggcacguuuccccugccuaucggcgagucugucaccgugacacgggaccucgaagggaccuaucugugcagagcccgcagcacacagggagaggugacccggaaaguuacggucaacgugcuuucccccagauacgagaucgugauuaucaccgucguggcugccgcgguuauuaugggcacagcugggcugucuaccuaccucuauaaucgccagcggaagaucaaaaaguacagacugcagcaagcccagaaaggaacaccuaugaagcccaacacccaggccacgccgccuuga

SEQ ID NO: 70563 - RNA, 828 nt, Artificial Sequence
  derived and/or modified sequence opt5 from ICAM2__Homo_sapiens__NP_001093259
augagcuccuucggcuacagaacccugacaguggcccucuuuacgcugaucugcugucccgggucugacgagaaggucuucgaaguucacgugcggccuaaaaagcuggcuguggagccgaaaggaagccuugaagucaacugcuccaccacauguaaucagcccgaggugggcgggcucgaaaccucucuggauaagauucuucuggacgagcaagcccaguggaaacauuaucucguuagcaacaucucccacgauacagugcugcagugccauuuuaccuguucuggaaagcaggagagcaugaacuccaaugucagcguguaccaaccuccccgccagguuauucugacacuccagccuacccugguggcggucggcaagucuuucacgaucgaaugcagagugcccaccguggagccucuugacucccugacacucuuucuguuccgggggaaugaaacccuucacuaugagacauuuggaaaagcugccccggcuccccaggaggccaccgccacguucaacagcacagcugaucgcgaagacggccauagaaauuuuucuugucuggccguccucgaucugaugucccggggcgggaacauuuuccacaagcacagcgcgccuaaaaugcuggagaucuacgaacccguuucugacucccaaauggugaucauugugaccgucgugagcguucuccugucccuuuuugugacaucuguccugcucugcuucaucuuuggacagcaucugcgccagcagagaaugggcaccuauggggugcgggccgcuuggcgcagacuuccucaagccuuccggcccuga

SEQ ID NO: 70564 - RNA, 1644 nt, Artificial Sequence
  derived and/or modified sequence opt5 from ICAM3__Homo_sapiens__NP_002153
auggccaccauggugcccagcguccuguggccuagagcuugcuggacacuccugguuuguugccuucugacgccgggcgugcaggggcaagaguuccuccugcggguggaaccccagaacccuguccuuuccgccggaggcucucuguuugugaauuguagcaccgacugccccuccucugagaagaucgcgcucgaaacaagccuguccaaagagcugguugcuucugggaugggaugggccgccuucaaccucagcaaugugaccggcaacucccgcauucuguguagcgucuacugcaaugggucucagaucacaggauccagcaacauuaccguguauagacuuccugaacggguugagcuggcuccccucccuccguggcagcccgugggccaaaauuuuacacugcgcugucaggucgaggauggcucuccuagaaccucccuuacgguggugcugcuccggugggaagaggaacugagccgccagcccgccgucgaggagccugcugaaguuaccgccacagugcuggcgucuagagacgaucacggggcccccuucuccugccggaccgagcucgacaugcagccgcaaggacugggccuuuuugugaacacaagcgcuccucgccagcugagaaccuucguccuccccgugacgccuccccggcugguugcuccccgcuuucuugaaguggagacauccuggccugucgauuguacccuggacggacucuucccggccucugaagcccagguguaccuggcgcugggggaucagaugcucaaugccacaguuaugaaccauggcgacacccugaccgcuacagccacggcuaccgccagagccgaucaagagggggcucgggagaucgugugcaaugucacacuuggaggcgaacgcagagaggcgcgggaaaaccugaccguguuuagcuuccucggccccauugucaaucuguccgagccuacagcccacgaagggagcaccgugacgguuucuuguauggcuggagccagagugcaggucacacuugacggcgugcccgccgcugccccugggcagcccgcgcaacugcagcucaacgcuaccgaguccgaugacggacgcagcuuuuucugcucugccacccuggagguugauggcgaauuucugcaucggaauagcuccgugcagcucagaguccuguaugggccgaagaucgaccgcgccacaugcccucagcaccuuaaauggaaggacaaaacccggcaugugcugcaaugucaggcuagaggaaaccccuacccugagcuccgcugccugaaggaaggcucuagccgggaggugcccguuggcaucccuuucuucgucaacgugacacacaaugggacguaucagugucaggccuccagcucuagaggaaaguacacccugguggucgugauggauauugaagcuggcuccagccacuuuguucccguguucgucgccgugcuucucacacuggggguugugaccaucguccuggcgcucauguauguguuucgcgagcaucaacggucuggauccuaccacguuagagaggaaagcacauaccugccgcuuaccuccaugcagccuacggaggccaugggcgaggaacccucucgcgcugaguga

SEQ ID NO: 70565 - RNA, 819 nt, Artificial Sequence
  derived and/or modified sequence opt5 from ICAM4__Homo_sapiens__NP_001034221
augggcagccuguucccccucucccugcuguuuuuccuugccgcugccuacccuggggugggaucugcgcucggcagacggaccaagcgcgcucagagcccgaaagggucuccccuggccccuuccggaacaagcguccccuuuuggguuagaauguccccugaguucguggccgugcagcccggcaagucuguccagcuuaacugcagcaauuccuguccucagccgcagaacagcucucugcggacgccccuccgccaagggaaaacccugagaggaccuggcuggguguccuaucagcugcucgacguucgggcuuggagcucucuggcccacugccuugugacaugugcuggcaagacccgcugggccacauccagaaucaccgcguacagcguccccgggggacugcucggcggggauccugaagccuggaaacccggacaucuguuucggaagccgggcgcccuucaccgcccugggucuggacagagagaccuggaucuccgggugugcuguuggacaccccgccugcuggccgcuagagaccucccucgggcuccccagucccgcagacccggcggcccucaacagcuggggacccauuauacggaugcgcggcuugagccgagagcccacagcuucggacugcgcuuucaucggugccccuguagagacccuccccacugcggccgcuguguuccuaugcaagugcccuccuacgaagucccgggggugaagggagaugugcucugccggcugucugagaaaaagagaaauaugaaacagagcggcgaaauggcuauucacgggggauga

SEQ ID NO: 70566 - RNA, 2775 nt, Artificial Sequence
  derived and/or modified sequence opt5 from ICAM5__Homo_sapiens__NP_003250
augcccggcccuagcccggggcugagacgggcccuccugggacuuugggcugcccugggccucgggcuguucggacuuuccgcggugucucaggagcccuuuugggcugaccugcaaccucgcgucgccuucguugaaagaggcgggagccucuggcugaacugcuccaccaauuguccccggccugagcgcggaggccuggaaacaucucucagacggaacggcacgcagcgcgggcugagauggcuugcccggcagcugguggauauccgcgagcccgaaacccagccugugugcuuuuucagaugugcucggcgcacacuccaagccagaggacugauucggaccuuucagcgcccggacagagucgagcuuaugccccugccucccuggcagccugugggcgagaauuucacacucagcugccggguucccggggcuggaccgagagccucccugacccugacacuccugcgcggcgcgcaggaacuuauccggagaucuuuugccggggagccuccccgcgcucggggagccgugcugaccgcuacgguccucgccagacgcgaagaucacggcgcgaacuucagcugucgggccgagcuggaccuuagaccucauggccuggggcucuuugaaaauuccagcgcuccccgcgaacugcggaccuucucucugucccccgaugccccuagacucgcugccccgcgccugcuugaggugggaagcgaacggcccguuucuugcacacuggacggccucuuuccugccuccgaggcuagaguguaccuggcgcuuggggaucaaaaccugagccccgacgucacccucgaaggagaugccuucguggcuacagccaccgccacggcuucugccgagcaggagggcgcgcggcagcugguguguaaugucacacucgggggagaaaaccgcgagaccagagaaaauguuacaauuuauuccuuuccugcuccccuccugacccuuagcgagccguccgugucugaaggccagauggugaccgucacaugcgccgccggcgcucaagcccuggugacgcucgaggggguuccugcugccgugcccggacagccugcgcagcugcaacugaacgccaccgagaaugacgaucggcgcagcuucuucugugacgcuacacuugaugucgacggcgaaacccucaucaagaacagauccgccgagcugcgggugcuguacgcucccagacucgacgauagcgacugcccucgcucuuggacauggcccgaagggccggagcagacccugagaugugaagcccggggaaauccugagcccuccguucacugcgcgcgcagcgauggcggggccgugcuugcucugggccuccugggacccgucacgagagcccugucuggcacauaucggugcaaagcugccaacgaccagggggaggccgugaaggaugucacccuuaccguggaauacgcuccugcgcucgacagcguuggauguccggagcgcauuacauggcuggaaggcaccgaggccucccugucuugcguggcucauggggugcccccucccgaugucaucuguguuagaagcggagagcucggcgccgugaucgaagggcugcuucgggucgcccgcgagcacgcuggcacauauagaugcgaagccacgaauccucggggauccgcggcuaaaaacguggccgugaccguugaguacggcccccgcuuugaggagccuagcugucccucuaacuggacaugggucgagggguccggaagacuguucagcugcgaaguggacggcaagccgcagccuucugugaaaugugucggguccggaggcgccaccgagggggugcuccugccccuggcuccucccgauccgagcccucgggcccccagaaucccucgcguucuugcgcccggcauuuaugugugcaaugcuacaaaccggcauggauccgucgccaagaccgugguugugucugccgaaagcccgccugagauggacgaauccacguguccgucucaccaaaccuggcucgagggcgcugaggccagcgcucuggccugcgcggccagagggcgccccuccccuggaguccgguguagcagagaaggcauucccuggccugagcagcagcgcgugucucgggaagaugcugggacauaccacugcguugccaccaaugcucauggaacagacuccagaaccgugacggucggcguggaguaccgccccguggucgccgaacuggccgcuagcccucccgggggcguucggcccggaggcaacuuuacacugaccugcagagcggaggccuggccucccgcucagaucucuuggcgggccccucccggggcccugaauauuggacuuuccagcaacaauucuacacugagcguggcuggcgccauggggucccacggaggcgaguaugaaugugcggcuaccaacgcccauggccgccacgccagacggaucaccgugcgcgucgcugggccguggcucuggguggccguuggaggcgcggcugggggagccgcccugcuggcugccggcgcugggcuugccuucuacgugcaaagcacagcgugcaagaaaggagaguauaauguccaggaagccgagucuuccggcgaggcugugugucucaacggcgccgggggaggcgcugggggagccgccggcgcugaagggggaccugaggcggccggcggcgcugccgaaagccccgccgagggggaaguuuuugcuauucagcugacguccgccuga

SEQ ID NO: 70567 - RNA, 6801 nt, Artificial Sequence
  derived and/or modified sequence opt5 from ICE1__Homo_sapiens__NP_056140
augaugcccggagaaacccacagcgccgcuccugggacagccgcggaccuguccagaugccagggaugugcuucucuccaacagaaccugaaugaauacguggaagcccuuaucacgcugaagcagaaaauuaucaacaccgauaaucuccugacagaauaucagaagaaaugcgacgaacuucaauucgcccggcgcgaaaacagcaaucugcaucaccaggucgaagagaugcuccagaagauuuccccgcugcagaaaugucaagaagaacugggaucucucaaggcugaacuggaggagaagaaaagcucccuuaagcuguaccaggauacccaucaggaauaugccagaguuaaagaggaaugccucaagucugacgcucagaaaaagaagcuggaggccaaagugaagaaacuucaagaagcggccgugaagcagacacaggauuuuaaacaacugcggaacgagaagaaaauccucgagaaggaguucaagaaaacccaggagcgccuggacgaauuuagcaagcagaaaaaugagaaggaacugagacacauugggacacagaucuccagcgauucuuacggauccaucgacaaacggaaggucaagcuccugcuuaaagagcuguggcucugugugaacaccacgcaucgccugcccggcgaggggagcagaugcguuccugaaaagcccgcuaaagccauuaccucuucccgggugccuggagaggauggcacacuucccccuacccaaggcagcccgcugcgcacaucuaauguccagaccugucucacgaagcuguccauggaaaucaaagaggacuuccugugccagaacguggaaaagcagagcuccucugggacaaauuguagcuccgaucacguuuuuaacgagaauggaaaccucgaggugcugguccaaagccacagagacggcgggucuaccgaguucguggaucaugaccacuuuuucgacgaggaucuucaggcugccauugacuuuuucaagcugcccccuccccuccuguccccugugcccagcccgccucccaugucuagcccucaucccggaucccuucccucuagcuuugcgccugaaacauauuucggcgaguacaccgauuccagcgacaaugauucuguccagcugcggaacuccgccgagugcguuagcgaagacgauaccacagagucucagaacuauuuugggucccuccgcaaaaauaagggaagcggcacgugggaagagaaaccgaagucccacgaagcuauccaagcccugaacaccugggaggugaauaaagugacaaccucuggccuggagacauucaccgcuacgcucagagaaagcuccgccacacacucucuggucggggagaagcauuggaccaccgccagccgguccaugagcgaccgcaagagagauauucuucacgaaacaaaaacccagauggaggugcgggaaauggacaagucuguucagacagagaaaacgauccauaagcugaccagaggacucuguauugagcgccuguccgcuagccccgcgcaggaaaaagaggccgcuccuggcaagucugaacugugcuccagcccccuugggaaacggccucucaacgagcugauggaaucugagggaaagacagugcugagcaagaugaugggcucccccaaaagcgaguucaccaaguggacaagaaucaaugaaaucaccucugagccggaucgcauuacggucuccgggcacuuucaucggcucagcagagaacuggagaaagagaaggaagacacccaaggauucacacuuggcgaguccccugaaucugaggacgaugacagcggcgaugggauggacguggccggacuggauaucgaaaccuccuuuucuagcuccucuacacucguugcccugagcgugggcuccaacccccaguccucuuccgggcuggacugcggaaaugauaccgacauuacgacaaaagucuucagcaccgagccucaccacucugagcauaaacuucagacaaagacccucaacacccugcaucugcaauccgaacccccugaguguagcaucggcgggaauaaccucgaaaauucucugugcgcucuuucccccgagcugggcgccagcaacuuuaaugaucagaaauccagcggaauugaauacacaaagguggucaaaggccucacgaagauccauucucugccgcgcagcguguucaugaaagcgaccaaggacgggcagugugagucccaggauccucggaucgagcugacacuuaacaagcccgacuuuaccucucucauuggaagccaagcugcccugaucaaauccggccugggguucguuaagucuacaagcuggcaccacuccgaucuccugagaaaaggaggcgaagagucucuucgcgccaagagcgaacaugagcagaaaaccucccaccagcugcagaaggcuaugcccuuucuccaaaaucgggggccuacgccgaagcccgaccugcugagagaaaacaacaauccuguggaguucaaaacaaccgccagcguccuucccaaccaggugucuguuauuaccaagcagacacgcccugagaaagugcaguccgcuaagcucgaacaucugcggccccacagagucgagccuacccuggugacagaaaauagcggcaacaaaacgggaaugucuaccguggccaagugcgacggcgagcgggaugacacaacccaaaauaucacagagguugcggccgucaaauccauuagccccgaaguguccgcuucucgcagaaagcucgauuuuaacagccccgggggauccagcccuguggagaauagcgacuguuccaccaacagccggcugucuuucagccccgaaaauauccuuauccagaaccaggauauugucagagaggccgcugugcaaggcgacgggcagaagcagcgccagccucaagccacggaucuggacuccucuggaacccauggcagcgaaaugcuccccgcgacagagguuaccguguccgggggcuuuucugucgaggaaacaagcugcggagauaccggccgguccgggggagaggcccuggcuguggccaaugacagcacaucuaccccgcagaacgcuaauggccuguggaaacuuaaguccacgacaccugggggagcccugcccgaauguuucggcaccaccgauacaaccuucagcuccgccuuuugcagaaaacacggggagacgcaggacacaucucagagcucccucccuggcacccugcacuguuacacaggaauccgcgaaggcggggaugacaccgagguugagucugaggcuuucagcugcuccgagggaagcgaacaacaggacgcgcccgaugacucucagaagaaccucggcgauacagacgccgcuguggccgaggucagacccucccuggaagugggguaucuuaccagcgcccugcaggauuuuaauauuucuacguucuccgagcucgaccggcugagcaccucugagguugugauguuucuggaaagcugucaacuuggagauuacuccucuggcgacagcgucuccgagugcagcuccaaaggcacacugucuaaggaaaugaacaaggagcucaaagcuagcgagaucggggaaaaguaucgcaaacagccuugcgaggaagagacccugggaacaugugaagaguggauugaguccgaagaggaugacuacucucucaagaacaccagccagcugacgcagugcucccuugaaacacugucugaggugcucaccaaaaucagacaagaacugcagacaaauagcgaggauuguaacggcaaggacaccgggucccugcuucugcucaaugugaacaauaacaugaccacagagaaucugaaggagaagucuccguuccgggagacgaccggaucuuccagccaugccucugaacccacaccucaggcggcugcccucgacaccgagggcuccagccccauuucugggaugccucaaaacgaaaauccccagucccgcccugaggccagaagcgaugcuggacggcagacagacggcggcgaggaagaucugccggagcccgucgaaccuuccgcccuuugcagcgacucuguuauggagcccagcaucgagcaguccucuaacugugaagcggagaccacguuucaaugccagaucgcuacagugaccagcgaagugauuaauguccugaucaacaaggaucagaaucuggugauugagaaaggggacaacuggaccaucauuuccggaguugccgugcucccucacgucgaucaggugacacugugugacauccccggcgauaucccgauuucucaagaccagggggaacuugaggccggaugcaucccuguuaccagcgcugagaagucccccgaagccucucauacaggccccgcuuuccaggaggccccuugugggaauaaccugagcugcccccaggaagauguguccagcucuggacaauccacgaacuuugacaaaagccgccucagaaaucggccugucaagccgucuauuuggaucuccagccagauuuaugaucagaacuucgagacccaaaucguggcguccgaccacacauacuauaauucuaagcuggaacccagcggcaaaaacaagaaucgcuccaaaaucagcaacaaggaccagucuaauaaaccuguuaagaccuccgccagcucuagaguggagacacaucagagcgaggucgcucaguccuuuucuggcgaaaaggccaacaccaaaacgcaacggagccagacccagacaauucucgcuaaugccgauaccuccacacccaccgacuguucuccugauacacugagcaagaucagacaggagguggggcccccgcuuccuccccugcuggccccucucauugcuacgcccccucgcaccucccaaccccugagcccgcuuaucucuuccagcuccccuucuagccccgcgucccccgugggacaggucucuccuuuccgggaaacaccgguucccccugccaugagccccuggccugaggaccccagacgcgcuuccccuccggaucccagcccuucucccuccgccgccagcgcuucugaacggguggugccuagcccgcugcaguuuugcgccgcgaccccgaaacacgcucucccuguccccggcagacugcccccuugcgccagcgggcacgccgcugugggaggcccccaggagaacucuguuaagauucucgacaccauguacccugagcuguccgcccgcgcgcggacacuuaauauccugaaagggaacauccaacugacgagaggaccgcccgcugauuguaagaaucucccuggccccgccagcgccaugauuggcuucaaaaccaucacaucugcugccaccgcuuucgugaagacagggagcuccagcggaggcgacugcaaccaggauaagucccgcgaccuggggacccagcaggauucuagcggaaaacggacgcuuuccacaucuacccugagaagcgccaagcggcuccgccuggacaccggcuccccugaacccgagacaagaggggucaccgcggaaggcauucacaaaaaucucccgggcaaccugccucccgccgagguggcuacaaccaaugaggaacggucuuguagcuccccugccguuagcgcugugucucaacuuccccuguccccuaaggagacggucgaaagccacgauaaagccaucgccaacgcucugaagaagauugcggaguuuucuuucgaccuccugcccgugauccgcucccaugucuacgugggcaacauuagcaaaaagccgguuaugagagaccaggaaaaagagguggucuaugaguuuucuacaaccaagaaacaccuugccgaaugccugcuccacuccauccugagcgagcugaagauccagaagauuucuauggaucauaauuacauccacgcucucugucggguguauguugggauuugcagacaacuuggagaccuggaacgcgcccggcuguucuguuacucccuccugaaagaggauuuuccugaaagcgagaaacuuacacuguucaucgccaacauguggcaugacauuuuucucagccaguccgugaucaauaaagcuaugcagcuggucgccagacagcgcgcgaagggcgaggugcugaacugccuccgggcuuuccuuaauugggagaagaacgcccccguggauguuggguuuauggucucuaagcugcugcucaccauccaacugugucccaagacggaguuccagccuagcgaaaaauuuggagaggaccuuuccgauaauaccugggaauauauuuucgccaucgaccugcucugcugucaccagaaguggauuuggacacaugauaacaucauuucuaaagagcuguggccggugauggacaaguggaucaaauacagaaagggccacgcuaauaucgccuauacccccgauauuaucauugcgagcauccugcgccucauugggcggcuuggacagcugggccugaaagagggcuucccuuccgccgugaagaacaucucuagcgucauugggauguuuauccaacacgcucaugacgaagacauccccuggggcauucagcucgccgcuguguacgcccugugcgaucuuuccccuagcaaucccgcugagaucucuaagauucuggaagccuggagacgcgaggcguccaaaagcguuccuucugccaucguguccugccucgaggaagucagcgcucuguccacagaggaacugggcuga

SEQ ID NO: 70568 - RNA, 1152 nt, Artificial Sequence
  derived and/or modified sequence opt5 from ICE2__Homo_sapiens__NP_001263314
augagcuccaagauggugaucucugagcccggccugaacugggacauuagcccuaaaaaugggcucaagaccuucuuuuccagagaaaacuacaaagaucacucuauggccccgagccugaaggagcuucggguccuguccaaucgcagaaucggagaaaaccucaaugcuucugccagcuccguugagaacgaacccgcggugagcucugcuacacaggccaaagagaaggugaagacgaccauuggcaugguccugcuuccuaaaccccgggugccuuauccccgcuucuccagauuuagccaacgggagcagcgcucuuacguugaccugcucgugaaguaugccaaaaucccugcuaauuccaaggccgucgggauuaacaaaaaugauuaccugcaguaucuggacaugaagaagcaugugaacgaagagguuacagaguuccucaaauuucugcagaauagcgcuaagaaaugcgcccaagauuacaacaugcuuucugacgaugcgagacuguucaccgagaagauccuccgggccuguaucgaacaggugaaaaaguauuccgaauuuuacacacugcacgaggucaccagccuuaugggauucuuuccguuccgcguggaaaugggccugaaacucgagaagacacugcuggcucucggguccgugaaguacgucaaaaccguuuuucccucuaugccuauuaagcugcagcuuagcaaagacgauaucgccacgauugaaaccuccgagcagacagcugaggccaugcauuaugacaucagcaaggaucccaaugcggaaaaacuggugucuagauaccacccucaaauugcccucaccucccagagccuguucacacuucugaacaaucauggacccaccuauaaggagcagugggaaaucccggugugcauucaggucaucccuguggcuggcucuaagcccguuaaagugaucuacauuaacagcccucucccccaaaagaaaaugacgaugcgggagcgcaaccagaucuuucacgaagucccccugaaguucaugauguccaaaaauacaucugugccuguuagcgccguguucauggacaagccggaggaguuuauuuccgaaauggaugucuguaacgcuuucuuuuuccccuga

SEQ ID NO: 70569 - RNA, 1899 nt, Artificial Sequence
  derived and/or modified sequence opt5 from ICK__Homo_sapiens__NP_057597
augaacagauacaccacaauccggcagcugggcgacgggacguauggaagcgugcuccugggccgcuccauugagucuggggaacuuaucgccauuaagaaaaugaagagaaaauucuacagcugggaggaaugcaugaaucugcgggaggucaagucccucaaaaagcugaaccacgcuaauguugugaagcugaaagaagugauccgcgagaacgaucaucuguauuuuauuuucgaguacaugaaggaaaaucucuaucaacugaucaaagagagaaacaagcuguuucccgaaucugccauccggaauauuauguaccagauccuccagggacuggcguucauucacaaacauggcuuuuuccaccgcgaccuuaagccugagaaccugcucuguauggggccggagcuggucaagaucgcugauuuuggacuugccagagaaauucggagcaaacccccuuauaccgacuacguguccacacgcugguacagagcccccgagguucugcuccggucuaccaauuauagcuccccuaucgaugugugggcugucggcugcauuauggccgaaguguacacacugcgcccccuguucccuggcgcuagcgagaucgacaccaucuuuaagauuugucagguucucgggacaccgaaaaagaccgauuggcccgaaggauaucaacugucuuccgccaugaacuucagauggccucagugcgugcccaauaaccuuaaaacgcugaucccuaaugcgagcucugaggccguccagcuccugcgggacaugcuucagugggaucccaagaaacgcccgaccgcuucccaagcccugagauacccuuauuuucaggugggccauccccucgggagcacaacccagaaccugcaggacucugagaagccucaaaagggcauucuggaaaaagcuggacccccucccuacaucaagccggugcccccugcccagcccccugcgaaaccccacacacggauuuccagcagacagcaccaagccucccagccgccucuccaucugaccuaucccuacaaggcugaggucucucgcacggaucacccuagccaucuucaggaagacaaacccuccccucuucucuuccccagccugcacaauaagcacccgcagucuaagaucacagccgggcuugagcauaaaaacggagaaaucaagccuaaaucccggagacgcuggggccugauuagccggucuaccaaggauagcgacgacugggcugaucucgacgaucuggacuuuucccccucucugagcagaaucgaucucaaaaacaagaagcgccaauccgacgauacacugugucgguucgagagcguucuugaccugaaacccucugagccugugggcaccgggaauagcgccccgacccagacaagcuaccagagacgcgauacgcccacccuccggucugccgcuaagcagcacuaucugaaacauuccagauaccugccuggaauuagcauccgcaacggcauucuuuccaaucccgggaaggaguucaucccucccaacccuuggucuagcuccggacucucuggcaaaagcuccgggacaaugagcgugaucucuaaggucaauuccgugggauccucuuccaccagcucuagcggccugacaggcaacuauguucccuccuuucugaagaaagaaauugggagcgcgaugcaacgggugcaccucgccccgaucccugaccccucuccuggauacuccagccugaaggcuaugagaccccauccgggccggccuuucuuucacacccagccccgcuccacgccugggcuuauucccagacccccugccgcccagccgguccacggacggacagauugggcuucuaaauaugccagcagacgcuga

SEQ ID NO: 70570 - RNA, 567 nt, Artificial Sequence
  derived and/or modified sequence opt5 from ICMT__Homo_sapiens__XP_011539442
augugcagccugucccucuuccauuacucugaguaucuggugaccgccgucaacaaucccaagagccuuucccuggacucuuuucuccugaaccauagccuugaauacacaguugcugcccuguccucuuggcucgaguucacgcuggaaaauaucuuuuggccugagcugaaacagauuaccuggcucagcgugacaggccugcuuaugguggucuucggggaaugucugagaaaggcggcuauguuuaccgccggauccaacuucaaucacgugguucaaaacgagaaaagcgauacacauacccucgugacaucuggcgucuaugccugguuucggcacccguccuacguggggugguucuauuggagcaucggaacccagguuaugcugugcaaucccauuuguggcgugucuuacgcucuuacggucuggcgcuuuuucagagaccggaccgaggaagaggaaaucucccugauucacuuuuucggggaggaguaucucgaauacaagaaacgcgugccuacaggacugcccuuuaucaagggcgugaaggucgaucuguga

SEQ ID NO: 70571 - RNA, 600 nt, Artificial Sequence
  derived and/or modified sequence opt5 from ICOS__Homo_sapiens__NP_036224
augaagucuggccugugguacuucuuucucuucugccugagaaucaaagugcuuaccggggagauuaacggauccgccaauuaugaaauguuuaucuuccacaacggcgggguccagauucuguguaaguaccccgacaucguucaacaguuuaaaaugcagcuccugaagggaggccagauucuuugcgaucugacaaaaacgaaggggucuggaaauaccgugagcaucaagucccucaaauucugucauucucaacugagcaacaauuccgugagcuuuuuccuguauaaccucgaccacagccaugcuaauuacuauuuuugcaaccuguccaucuucgauccuccgcccuuuaaggucacacuuaccggcggcuaccugcacauuuaugagagccagcucuguugccagcugaaauucuggcuuccuaucgggugugccgcguuugugguugugugcauucugggauguauccucauuugcuggcugacaaagaaaaaguacucuuccagcguccaugaccccaauggcgaauacauguucaugcgggcugugaacaccgccaagaaaucucgccugacagauguuacccucuga

SEQ ID NO: 70572 - RNA, 930 nt, Artificial Sequence
  derived and/or modified sequence opt5 from ICOSLG__Homo_sapiens__NP_001269979
augagacugggcagccccgggcuccuguuccuucuguuuuccucucuccgggccgacacccaggagaaggaagugcgcgcuauggucggaagcgauguugagcuguccugcgccuguccugaaggcucuagauucgaccuuaacgauguguacguguauuggcaaacaagcgaguccaaaacggucgugaccuaccacaucccgcaaaauucuagccuggaaaacguugacucccgguaucgcaauagagcgcucaugagccccgcugggaugcugcggggagauuuuucucugcgccucuucaacgugacaccucaggacgagcagaaguuucauugccugguccuuucccagagccugggcuuccaggaggugcucucuguugaagugacccugcacgucgccgccaauuuuuccgugcccguggucagcgcuccucauucucccucccaggaugagcuuacauucaccuguacaagcauuaacggguacccuagaccgaauguuuauuggaucaacaaaaccgacaauucccugcucgaucaggcccugcaaaacgacacgguguuucugaauaugcggggacucuacgauguggucucugugcugcgcauugcuagaacccccagcguuaacaucggcugcuguauugaaaaugugcuucugcagcagaaccucacagucggcucccagaccgggaaugacaucggagagcgggauaagaucacagagaacccugugagcaccggcgagaaaaacgccgcgacguggucuauucuggccguucuuugccugcucguggucguggcugucgccaucgggugggugugucgcgacagaugccugcaacacuccuaugcuggagccugggcgguuagccccgaaacagaacugaccgagucuuggaaucuccugcuucugcucagcuga

SEQ ID NO: 70573 - RNA, 468 nt, Artificial Sequence
  derived and/or modified sequence opt5 from ID1__Homo_sapiens__NP_002156
augaagguggccagcggcuccaccgcuacagccgcggcugggcccucuugcgcccugaaagccggaaagacggcuagcggcgccggggaggucguuagaugucucuccgaacagucuguggcuaucagccggugcgccggaggcgcgggggcccgccugccugcccuucuggacgagcaacaggugaacguccuccuguacgauaugaauggauguuauuccagacuuaaagaacuggugccgacccucccccagaaccggaagguuucuaaaguggagauucugcagcacgucaucgacuacauucgcgaucugcaacucgaacugaauagcgaguccgaggugggcacaccuggcgggagaggacuucccguucgggcuccucugagcacccucaacggcgaaaucucugcucugacagccgaggcggccugcgugcccgcugacgaucgcauucuuuguagauga

SEQ ID NO: 70574 - RNA, 405 nt, Artificial Sequence
  derived and/or modified sequence opt5 from ID2__Homo_sapiens__NP_002157
augaaggccuucagccccgugagauccguccggaaaaacucucugagcgaccacucccucggcaucucucgcagcaagaccccuguugaugacccgaugucccugcuuuacaauaugaacgauugcuauucuaaacugaaggagcucgugcccagcauuccucagaauaaaaagguguccaagauggaaauccugcaacaugucauugacuacauccuugaucugcagauugcucucgacagccaccccacaaucgugucucugcaucaccagagaccugggcagaaccaagccucccggacgccccugaccacacucaauaccgauaucagcauucugucucuucaggcguccgaguuuccuagcgaacugaugucuaacgacuccaaagcucucuguggauga

SEQ ID NO: 70575 - RNA, 486 nt, Artificial Sequence
  derived and/or modified sequence opt5 from ID4__Homo_sapiens__NP_001537
augaaggccgugagccccgucagaccuuccggccggaaagcuccgucugggugcggaggcggggagcuggcccuccgcugucuggcggaacacggacauagccuuggcggguccgcugccgccgcugccgcugccgcggccgcuagaugcaaggccgcugaggccgcggccgacgaacccgcucugugucuccagugcgauaugaacgacuguuacucucggcugcgcagacuuguuccuaccauucccccuaauaaaaaggugagcaaaguggagauccugcaacacgucaucgauuauauucucgaccugcagcuggcccucgaaacacaucccgcucugcuucggcagccuccgcccccugcucccccucaccaucccgccggaacgugcccggccgcgccuccccgcaccccucugacagcccucaacaccgaucccgcuggcgccgugaauaagcagggcgacuccauccuguguagauga

SEQ ID NO: 70576 - RNA, 1395 nt, Artificial Sequence
  derived and/or modified sequence opt5 from IDE__Homo_sapiens__NP_001159418
augagcaagcugugguucaaacaggacgauaaguuuuuccuccccaaagccugccugaacuuugaguucuuuuccccuuucgcuuacguggacccgcuucacuguaauauggccuaucuguaccucgaacugcuuaaggauucucugaacgaguaugcguacgcugccgaacucgccggccugagcuaugaccugcaaaauaccaucuacgggauguaucucuccgucaaaggauacaacgauaagcagcccauucugcuuaagaaaaucauugagaagauggcuacauuugaaaucgacgagaaaagauucgagauuaucaaggaagccuacaugcggucucugaauaacuuucgcgcugagcagccucaucagcacgccauguauuaccucagacugcuuaugacggaaguugcguggaccaaagaugagcugaaggaggcccucgacgaugugacacugccccggcugaaggcuuucaucccucaacuccugagccgccuucauauugaagcccugcuccacggcaauaucaccaaacaggcugcccuggggauuaugcagaugguggaggacacacuuaucgaacaugcgcacaccaagccccugcucccuucccagcuggucagauaucgggaggugcaacugccggaucgcggaugguuuguuuaccagcagagaaacgaagugcacaauaacugcggcauugagaucuauuaccagacagacaugcaaucuaccagcgagaauauguuccucgaacuguuuugucagauuaucuccgagcccugcuucaacacgcuucggaccaaagaacagcugggguauaucgucuucagcggaccucgcagagccaauggcauucaaggccuccgguuuaucauucagucugagaagcccccucauuaccuggaaucccgcguggaggcuuuccuuaucacaauggagaaaagcauugaagauaugaccgaggaagccuuucagaagcacauccaggcucuggccaucagacggcucgacaaacccaagaagcugucugccgagugugcuaaauacuggggagaaauuaucucccaacaguauaacuucgaccgcgauaauacagagguugcguaccugaagacccucacgaaagaggacauuaucaaguuuuauaaagaaaugcuggccguggaugcuccgagacggcauaaggucagcgugcacgugcuugccagagagauggacucuugcccugucguuggggaguuccccugucagaacgauauuaaccugucccaggccccugcucucccccaacccgaagugauccagaauaugacagaguuuaagcgcggccugccucuguucccgcuugugaaaccccacaucaacuuuauggccgcgaagcucuga

SEQ ID NO: 70577 - RNA, 1245 nt, Artificial Sequence
  derived and/or modified sequence opt5 from IDH1__Homo_sapiens__NP_001269315
augagcaagaaaaucuccggcgggucuguggucgagaugcagggagacgaaaugaccagaauuaucugggagcugauuaaggaaaaacucaucuuccccuacguugagcuggaucuucacagcuaugaccugggcauugaaaaccgggaugccacaaaugaccaagugacgaaggaugcugccgaggcgaucaaaaagcauaacgugggggucaagugcgcuaccaucacaccugacgagaaacgcguggaagaguuuaagcucaaacagauguggaaguccccgaauggaaccauuagaaacauccugggcgggacaguuuuccgggaagccauuaucuguaaaaauauuccccgccuugugucuggaugggucaagccuaucauuaucggcagacacgccuacggcgaucaguaucgggcuaccgacuuugugguucccgggccuggaaagguggagaucacauacacccccagcgauggcacgcagaaagucaccuaucuggugcauaacuucgaggaagggggaggcguggccauggggauguacaaucaagacaaguccauugaggauuuugcucacucuagcuuccagauggcccucuccaaaggauggccucuguaucugagcacaaagaacaccauccucaaaaaguacgacggccgcuuuaaagauauuuuccaggaaaucuacgacaagcaguauaagucucaauuugaggcgcagaaaauuugguacgaacauagacugaucgacgauauggucgcccaggcuaugaaguccgagggcggguucaucugggccugcaaaaauuaugacggagauguucagagcgacucuguggcucaaggcuacgggucccuuggaaugaugacaagcgugcuggucuguccggauggcaagaccguggaggccgaagcggcccacgggacgguuacacggcacuaucgcauguaccagaaaggacaggagaccucuacaaaccccauugcuuccaucuuugccuggaccagaggccucgcucaucgggccaagcuggacaauaacaaggaacuugccuucuuugcuaaugcgcuggaggaagugagcauugagaccaucgaggccggcuucaugacaaaagaucucgcugccugcauuaaggggcugccuaacguccaacgcuccgacuaucugaauacguucgaauuuauggauaaacucggagagaaccugaagaucaaacuugcccaggcuaagcuguga

SEQ ID NO: 70578 - RNA, 1203 nt, Artificial Sequence
  derived and/or modified sequence opt5 from IDH2__Homo_sapiens__NP_001276839
auggacggcgaugagaugaccagaaucauuuggcaguucaucaaggaaaaacugauucucccccacguggacauccaacugaaguacuuugaucuugggcugccuaaccgggaccagacagaugaccaggucacgauugauagcgcccucgcuacccagaaauauuccguugccgugaagugcgcgacaaucaccccggacgaggcucgcguggaagaguucaaacugaagaagauguggaaaucucccaauggaacaaucagaaacauucuuggcgggaccgucuuucgggaaccuaucauuuguaagaauaucccccgccuggugccuggauggacaaaacccauuaccaucggcagacaugcccacggggaucaauacaaggccacggacuucguugcugaucgggccggaaccuuuaaaaugguguucacaccuaaggacggcagcggcgucaaggagugggagguguauaacuuuccggcugggggaguuggcauggggauguacaauaccgaugaauccauuucuggauucgcccauagcugcuuucaguaugcgauccagaaaaaguggccccucuacauguccaccaaaaacacaauccugaaggccuaugacggccgcuucaaagacauuuuucaggagaucuucgauaagcacuacaaaacggacuuugauaagaauaagauuugguacgaacauagacugaucgacgauaugguggcucaaguccucaaaucuagcgggggauucgugugggccuguaagaacuaugacggcgaugugcaguccgacauucuggcucagggcuucgggagccuuggacugaugacaucuguccucguuugcccugauggcaaaaccaucgaggccgaggcggcccacgggacagugacccggcacuaccgcgaacaucagaagggaagacccaccuccacaaauccuaucgcuagcauuuuugccuggacgcggggccuggagcaccgcgggaaacuugacggaaaccaagaucugaucagauucgcucagaugcucgaaaaggugugugucgagaccguggaaucuggcgccaugacaaaggaccuggccggcugcauucaugggcuguccaauguuaaacucaacgagcacuuucugaauaccacagacuuccuugauaccaucaagagcaaccuggaccgggcucucggacgccaguga

SEQ ID NO: 70579 - RNA, 1131 nt, Artificial Sequence
  derived and/or modified sequence opt5 from IDH3B__Homo_sapiens__NP_001245313
auggccgcucugagcggcgugagauggcucacccgggcccuggucuccgcggggaaccccggagcuuggcgcggccuuucuacaagcgccgccgcucacgccgcuuccagaucucaggccgaggacguucggguggaagggagcuucccugugacgaugcugccgggagauggcgucgggcccgagcucaugcaugcggugaaggaaguuuuuaaagccgcugccgugccugucgaguuccaagaacaccaucuguccgaggugcagaauauggcuucugaggaaaaacuugagcagguucugagcuccaugaaggaaaacaagguggccaucauuggaaaaauccacacccccauggaguacaagggcgagcucgcgagcuaugacaugcgccugagacggaagcuggaucucuuugccaaugucgugcaugugaaaucucugccuggcuacaugacacgccacaacaaucuugaccuggucauuaucagagaacagaccgagggggaauauuccagccucgagcacgaaucugcucggggaguuauugagugccugaagaucgugacacgcgccaaaucccaaagaaucgcuaaguucgccuuugauuacgccaccaaaaagggccgggggaaggugacagcuguccauaaagcgaacauuaugaaacuuggagacggccuguuccuccaguguugcgaggaaguggccgagcuguaucccaagaucaaguuugaaaccaugauuaucgauaauuguugcaugcagcugguucagaacccuuaccaauucgacgugcucgucaugccgaaucuguaugggaacauuaucgauaaucuugcugccggacuggugggcggcgccgggguugugcccggagagagcuacucugcugaauacgccgucuuugagacgggcgcgcgccacccuuucgcucaggccguggggagaaacauugccaaucccaccgcuaugcuccuguccgccagcaacaugcuucggcaucugaaucucgaguaucacuccucuaugaucgcugacgccgucaaaaaggugaucaaaguuggaaagauuccuagcgcggugcccuccuuucugcugcacccgcucccuuucagcugggccaucuga

SEQ ID NO: 70580 - RNA, 564 nt, Artificial Sequence
  derived and/or modified sequence opt5 from IDNK__Homo_sapiens__NP_001001551
auggccgcucccggcgcccugcucgugaugggggucagcggauccggcaagucuaccguuggggcgcugcuugcuagcgagcugggauggaaauucuacgacgccgaugacuaucacccugaagagaacagacggaagaugggcaaagggaucccgcucaaugaucaggaccgcauucccuggcugugcaaccuucaugauauccugcucagagacguggccuccggacaacgggugguccuggcuuguucugcccugaagaaaacauaccgcgauauucucacgcagggcaaggacggcguggcucugaagugcgaagagagcgggaaagaagccaagcaggcggagaugcagcuucugguugugcaccucuccggaucuuuugaggucaucagcggcagacugcuuaaacgggaagggcauuucaugccucccgagcugcuccaaucccaguuugaaacccuggagccucccgccgcuccugagaauuucauucagaucagcguggauaagaacguuucugaaaucauugccacaaucauggagacccugaaaaugaaguga

SEQ ID NO: 70581 - RNA, 1212 nt, Artificial Sequence
  derived and/or modified sequence opt5 from IDO1__Homo_sapiens__NP_002155
auggcccacgcuauggagaacagcuggaccaucuccaaggaauaccacauugacgaggaagugggcuucgcccugcccaauccucaggagaaccucccggauuuuuauaaugacuggauguucaucgcgaaacaucugcccgaucuuauugaaucugggcaacugagagagcgggucgagaagcucaacaugcugagcaucgaccaccuuacagaucacaaaucccagcgccuggcuagacucguucugggaugcauuacgauggccuacguguggggcaaggggcauggagacgugcggaaaguccugccucgcaauaucgccgugcccuauugucagcucucuaagaagcuggaacuuccucccauccugguuuacgcugauugcgugcucgccaacuggaaaaagaaagacccuaauaagccgcugaccuaugagaacauggauguccuuuuuagcuucagagacggcgauuguuccaaaggguuuuuccuggugucucuccugguugaaauugcugccgcgagcgccaucaaggugauucccacagucuuuaaggcuaugcagaugcaagagcgggacacccugcucaaagcccugcuugagaucgcuuccugccuggaaaaggcccuccagguguuccaccagauucacgaucaugugaauccuaaagcguuuuucagcguccugcgcaucuaccuuucuggauggaagggcaacccccagcuguccgacggccucguuuaugagggguuuugggaagacccuaaagaguucgccggaggcagcgcugggcaaucuuccguguuucaguguuucgaugugcugcugggcauucagcagacagccggagggggacacgcugcccaauuccuccaggacaugagacgguacaugcccccggcccaucgcaauuuucugugcagccuugaaucuaacccuuccgucagagaguucgugcugagcaagggcgaugcuggccuccgggaggcguacgacgccuguguuaaagcucuggugucccuucgcucuuaucaucugcagaucgucaccaaguacauccucauucccgccagccaacagccuaaggaaaauaaaacauccgaggaucccagcaagcuggaagccaaagggaccggaggcacggaccugaugaacuuucucaagaccgugagaucuacaaccgagaaaucccugcuuaaggaaggguga

SEQ ID NO: 70582 - RNA, 1263 nt, Artificial Sequence
  derived and/or modified sequence opt5 from IDO2__Homo_sapiens__NP_919270
augcugcacuuccauuacuaugacaccagcaacaagaucauggagccccacagaccuaaugugaaaacagccgucccgcucucccuggaaucuuaccauauuagcgaggaauauggcuuucuucugcccgauucccucaaggagcugccugaccacuaccggcccuggauggaaaucgcuaacaaacuuccucagcugauugaugcccaucaacuccaggcgcacguugacaagaugccccugcugucuugccaguuccucaaagggcaccgcgagcagagacuggcucaucuugugcugagcuuucucacgaugggauauguguggcaagagggcgaagcccagccugccgagguccugccgcggaaucuugcucugcccuucguggaaguuucccgcaaccucgggcugccucccauccuggugcacucugaucucguccugaccaauuggacaaagaaggacccugauggauuucuugagauuggcaaccuggagaccaucaucagcuuccccgggggagaaucccuccauggcuuuauucuggugacagcccuuguugagaaagaagcugugccgggcaucaaggcccugguccaggcgaccaaugccauucuccagccuaaccaagaggcucugcugcaggcccuccagagacugcggcuuagcauccaggacauuacaaaaacccuggggcaaaugcacgauuacguggaccccgauaucuucuaugcuggcauucgcaucuuucucucuggauggaaggacaauccugccaugcccgcggggcugauguacgaaggagugucccaggagccccuuaaauacagcggcgggucugccgcucaguccacgguccugcacgccuucgaugaguuucucggaaucagacauagcaaggaaucuggcgacuuccuguaucggaugcgcgacuacaugccuccgucccacaaggcuuuuauugaggauauccauagcgcccccucccugagagacuauauucucucuagcggccaagaucaucugcuuaccgccuacaaccaguguguucaggcucuggcggaacuccgguccuaucacaucacaauggugaccaaauaccugauuacagccgcugccaaggccaaacacgggaagccuaaucaucugcccggaccuccccaggcucuuaaagaccgcggcaccgggggaacggccgugaugagcuuccucaagucugucagagauaaaacacuggaguccauccugcacccgcggggcuga

SEQ ID NO: 70583 - RNA, 1653 nt, Artificial Sequence
  derived and/or modified sequence opt5 from IDS__Homo_sapiens__NP_000193
augcccccuccgagaaccggccgggggcugcucuggcugggacuugugcugagcuccgucugcguugcccucggcucugagacacaggcuaacagcacgaccgacgcccugaaugugcuucugaucauuguggaugaccuccgccccucccugggguguuacggagauaagcuggucagaucuccuaacaucgaccagcucgcgagccacucccugcuuuuccagaaugcuuuugcccagcaggccgugugcgcucccucucggguuagcuuccugacaggccgcagaccugauaccacacggcucuaugacuuuaacuccuacuggcgcgugcaugccgggaauuucagcaccauuccccaauauuuuaaagaaaacggauacgucacaaugucugugggcaagguuuuccacccuggcaucuccagcaaucauaccgaugacucuccguauuccuggagcuuucccccuuaccaccccucuuccgagaaauaugaaaacacgaagaccuguagagggccugauggagagcugcaugcuaaucuucugugccccguggacguccucgaugugccggaaggcacacugccugacaaacagagcaccgagcaggccauucagcugcucgagaagaugaagacauccgcgucucccuucuuucuggccgugggguaccacaaaccucacauccccuuccgguaccccaaggaauuucaaaaacuuuauccucuggagaacaucacccucgcuccggaucccgaagucccugacggacugcccccuguugccuacaaucccuggauggacauucgccagagagaggaugugcaggcucuuaacaucagcgugccguauggcccuauucccgucgacuuccagcggaagauccgccaauccuacuuugccagcgugucuuaucuggauacgcagguugggagacuccuguccgcgcuggacgaucuccagcuggccaauagcacaauuaucgcuuucaccucugaccauggaugggcccuuggcgagcacggcgaaugggcuaaauacagcaacuucgauguggccacacaugucccucugaucuuuuaugugcccgggcggaccgccucccucccugaggcuggagaaaagcuguuccccuaccuugacccguuugauucugcgagccaacugauggagccuggccgccaguccauggaccucguugaacuggugagccuguuccccacccucgccgggcuggcuggacuucaggugcccccuagauguccgguccccucuuuucacgucgagcugugccgggagggcaagaaucuccugaaacacuucagauuucgcgaucuggaagaggacccuuaccuucccgggaacccucgggaacucauugccuauucccaguaccccagaccuagcgacaucccccaauggaacucugauaagccgucccugaaagacauuaagaucaugggauauagcauucgcacaaucgauuaccgguauacgguguggguuggcuucaauccugacgaguuucuggccaacuucuccgauauucaugcuggcgaacucuacuuuguggacucugauccccugcaggaccacaauauguauaacgauagccaagggggagaccuuuuccagcugcucaugccuuga

SEQ ID NO: 70584 - RNA, 1962 nt, Artificial Sequence
  derived and/or modified sequence opt5 from IDUA__Homo_sapiens__NP_000194
augagaccccugcggccucgcgccgcucuccuggcccuucuggcgagccuccuggcugccccgcccguggccccugcugaggcuccccaccuuguccauguugacgcugccagagcgcuguggccucuccggcgcuucuggagauccaccggcuuuugucccccucugccgcacucucaggccgaucaauacgugcugagcugggaccagcagcucaaccuggcuuaugugggggccgucccccaucggggaaucaaacaggugcgcacacacuggcuucuggaacucguuacgaccagaggcuccacagggcggggacugucuuacaauuucacccaucuugauggcuaucuggaccuccugcgcgagaaccaacugcucccuggguuugaacugaugggaagcgcuuccggccacuucacagauuuugaggacaagcaacagguguucgaauggaaggaucuugucucuagccuggccagacgguacauuggccgcuaugggcucgcgcacguguccaaauggaauuuugagaccuggaacgagcccgaccaucacgauuucgacaauguuagcaugacaaugcagggauuucugaacuacuaugaugccugcucugaaggccuuagagcugccuccccugcucugcggcucgggggacccggcgacagcuuccauaccccgccucgcucuccccuguccugggggcugcucagacacugccacgauggaacgaacuuuuucaccggcgaggccggcgugcggcuggacuacaucagccuucauagaaagggggcccggucuuccauuagcauccuggaacaggagaaagucguggcucagcagauucgccagcucuuuccuaaguucgcggacacacccaucuacaaugaugaggccgacccccuggugggauggucccuuccucaaccguggagagcugaugucaccuaugccgccaugguugugaaggugaucgcucagcaccagaaucugcuccuggccaacacaaccucugcguuccccuacgcucugcucagcaaugacaacgccuuucuguccuaucauccucaccccuucgcccaacgcacgcuuacagcucgguuucaggucaauaacaccagaccuccccaugugcagcugcuccgcaaaccgguucugacagccaugggccugcuugcucuccuggaugaggaacagcugugggccgaagugagccaagcggggaccguccucgacucuaaucacaccgugggaguucuggccuccgcucaccggccucagggccccgccgaugcuuggagagccgcggugcuuauuuacgccagcgacgauacacgcgcucauccuaaccggucugucgccgugacgcugagacuccgcggggugcccccuggacccggccuggucuauguuacccgguaccuggacaacggccuuuguagcccggauggggaguggagacggcucggacgcccuguguuccccacagcugaacaguuuagacggaugagagccgccgaggaccccgucgcugcggccccucgcccgcugcccgcuggcgggcggcugacccucagaccugcccugcgccuucccucccugcuccuggugcacguuugcgccagaccugagaagcccccuggacaggugacacggcugcgcgcccuuccccucacccaaggccagcugguccugguguggucugacgaacauguggggagcaaaugucucuggacguaugagauccaguucucccaggauggcaaggccuacacaccgguuagcagaaaaccuucuaccuuuaaucuguucgucuuuucccccgacaccggagcggugagcggcucuuaccgggugcgcgcucuugauuauugggccagaccugggcccuucuccgacccggucccuuaccuggaagugcccguuccucggggaccucccagccccggcaacccguga

SEQ ID NO: 70585 - RNA, 672 nt, Artificial Sequence
  derived and/or modified sequence opt5 from IER2__Homo_sapiens__NP_004898
auggaggugcagaaggaagcccaaagaaucaugacccugagcgucuggaaaauguaccacucccggaugcagcgcggcgggcucagacugcaucggucucuucagcugagccucguuaugcgcuccgcuagagagcuguaucuuucugccaagguggaagcgcuggagcccgaagugagccucccugcugcccugccguccgacccccggcugcacccuccccgcgaggccgagucuacagcugaaacggccaccccugauggagagcaucccuucccugaaccgauggacacacaggaggcucccaccgccgaggaaacaagcgcgugcugugccccuagacccgcuaaagucucccggaagcgcagaucuagcucccucagcgauggcggggacgccggacuggugccuucuaaaaaggcucggcuugaggaaaaggaggaagaggagggcgccuccagcgaaguugcggaucgccugcaacccccgccugcccaggcugagggggccuuucccaaccucgcuagagugcugcagcggcgcuucucuggacuucugaauugcuccccugccgccccucccaccgcucccccggcgugugaagccaaacccgcuugcagaccugccgacagcaugcucaacguccuggugcgggccguuguggcuuuuuga

SEQ ID NO: 70586 - RNA, 471 nt, Artificial Sequence
  derived and/or modified sequence opt5 from IER3__Homo_sapiens__NP_003888
augugccacagcagauccugucaucccaccaugacaauccugcaggccccuacgccggcucccucuaccauuccuggcccccggcgcgggagcggaccugagaucuucacauuugacccccucccugaaccggccgcggcucccgccggcagaccuuccgccucucgggggcaccgcaagagaagccggcgcgugcuguaccccagagucguucggcgccaacuuccuguggaggaacccaacccggcuaaaagacuccuguuccugcuucugaccauuguguuuugccagauccucauggccgaggaaggagucccugcuccccugccucccgaggaugcccccaaugcggccucccuggcuccuacaccggugucugccguucucgagcccuucaaccugaccagcgaaccuuccgacuaugcucuugaucugagcacauuucuccagcagcaucccgccgcguucuga

SEQ ID NO: 70587 - RNA, 249 nt, Artificial Sequence
  derived and/or modified sequence opt5 from IER3IP1__Homo_sapiens__NP_057181
auggccuucacccuguacagccuccugcaggcugcccuucugugcgugaacgcgaucgcuguccuccacgaggaaagauuucugaagaauauuggcugggggacagaccaaggaaucggcggguucggagaggaacccggcauuaaaucccagcuuaugaaccugauccggucuguucgcacggugaugagagugccucucauuaucgucaauagcaucgccauugugcugcugcuccuguuuggguga

SEQ ID NO: 70588 - RNA, 984 nt, Artificial Sequence
  derived and/or modified sequence opt5 from IER5__Homo_sapiens__NP_057629
auggaguucaagcuggaagcccacagaaucgugagcauuucccucggcaaaaucuacaacucucggguccagcgcgggggaauuaagcugcauaaaaaucuucugguuagccucgugcugagauccgcucggcaaguguaucuuucugaccccugcccuggccuguaccucgccgggccggcgggaacccccgcuccucccccucagcagcagcccggcgagccugccgccgggccgcccgcuggauggggcgaaccucccccucccgccgcucgcgccagcuggccggagacagaaccucaacccgagagauccucugucagcgaugcgccucgggugggcgacgagguucccguggccacggucaccggggugggagauguuuuucagggcggggaagcugacgccacagaggcugccuggucccgcguggaaggacccagacaggcggccgcucgggaggccgagggcaccgcugggggauggggcgucuucccugaagugagccgcgccgccagacggccguguggcugcccccugggcggagaggauccucccggcaccccugcugcgacaccccgcgccgcuuguugcugugccccgcagccugccgaagacgagcccccugcucccccugccgugugccccagaaagcggugugcggcuggggucggaggcgggccggccggaugcccugcccccggcucuacaccccugaaaaagccucgcagaaaccucgaacaaccgcccuccggcggggaggaugacgaugcugaggaaauggagaccggaaauguugccaaccugaucagcauuuuugggucuuccuucagcgggcuucugcggaagucuccuggaggcgggagagaagaggaagagggcgaggaauccggacccgaggcugccgaaccuggccagaucuguugcgacaaacccgugcuccgcgauaugaauccuuggagcacggcgaucguggccuuuuga

SEQ ID NO: 70589 - RNA, 1692 nt, Artificial Sequence
  derived and/or modified sequence opt5 from IFFO1__Homo_sapiens__NP_001034759
augaacccccuguucggcccuaaucucuuucugcuucagcaagagcagcaggggcuggccggaccgcucggcgacagccuugggggagaucacuucgcuggcgggggagaccugcccccugcgccccuguccccugccggccccgcugccuacucuccuccgggccccgggccugcucccccugccgccauggcucucagaaacgaucugggaagcaauaucaacgugcugaagacccucaaucugcgguuucgcugcuuccuugccaaaguccaugaacuggagagacggaaccgccuccuggaaaagcagcuucaacaggcgcuggaggaaggcaaacaggggagacggggacucggccgcagagaccaggccguucaaacaggguuugugucccccauucggccgcugggacugcagcucggcgcucgcccugccgcuguguguucucccagcgccagaguccugggcuccccugcgcggucucccgccgggccccuugcuccuagcgccgcuucccugagcagcuccagcacgucuaccuccacaaccuauucuucuuccgcccgcuucaugccgggaacaaucuggagcuuuucccacgccagacggcucggccccgggcuggagccuacccuugugcagggacccggccugucuuggguucauccugauggggugggaguccagauugacacaaucacccccgagauucgcgcucucuacaaugugcuggcgaagguuaaaagagaacgggaugaguauaagagacgcugggaagaggaguacacggugcggauccaacugcaggacagagucaacgaacuccaggaggaagcccaagaggcugaugccugccaggaggaacuggcccuuaagguggagcagcugaaagcugaacucguggucuucaagggccugaugagcaauaaccuuuccgagcuggacaccaaaauccaggaaaaggccaugaaaguugauauggacauuugucgccggaucgauauuacagcgaagcucugcgacguggcucaacagagaaauugugaggacaugauccagauguuucagaagaaacuggugccgagcaugggcgggcgcaagcgggaaagaaaagccgccgucgaggaggauaccucucuguccgaaagcgagggaccucgccaacccgacggcgaugaagaggaaucuacagcucucagcauuaacgaggagaugcagcggaugcugaaucagcuuagagaauaugacuucgaggaugacugcgauucccugaccugggaagagacggaggaaacacuccugcugugggaggacuuuucuggguacgccauggcugccgcggaagcccagggagagcaacaggaagauagccuugagaaggugaucaaagacaccgagucccucuucaagacacgcgaaaaagaguaucaggaaaccauugaucagaucgagcuggaacuggcuaccgccaagaacgacaugaaucggcaccuccaugaguacauggagauguguagcaugaagagaggccuggacguucaaauggaaacaugccggcgccuuaucacgcagucuggggauagaaaauccccugcuuuuaccgccgugccccugagcgacccucccccgccucccucugaggcggaagauuccgaccgggaugucagcuccgacucuagcaugagauga

SEQ ID NO: 70590 - RNA, 1413 nt, Artificial Sequence
  derived and/or modified sequence opt5 from IFFO2__Homo_sapiens__XP_011538932
auggugaacagccugcuguucggcgagauggcccuggcuuuugggugcccgccuggaggcgggggaggcggguguccgggaggcggcgggggaggcgggggagccggccccgggccuucccccgucaccgcggcucuuagagacgaucugggaucuaauauccaccuccugaagggccuuaacguucgguuccgcugcuuucuggccaaagugcaugaacucgagagacggaaucgccugcuggaaaagcagcucgagcaacagcagagcgaaagagagcggcgccugagauacaaaacauucucccgggagcaggccgugcaaacgggcccugaacuucugagacccccugcucccgggggaggccacgggcucucuagcggagccgcugccggcgcgaacgccaaugcugucgcccucgggggacuucccccuggcggcgggucccauccccagcacuauggacgccugccuggcaccauuuggucuuacacacaggugcggcgcaccgggggaggcgggguugagacagugcagggccccggagucagcugggugcauccggacggcguuggggugcaaaucgauaccauuacaccugaaaucagagcucucuauaacguccuggccaaggugaaacgggagcgcgacgaguacaagagacggugggaagaggaacuggcgaagagaaugaaucuccagaccaugguggauacgcugcaggaggccgcucaggaagccgacgcuauucaagaggagaugaacgaaaagaucgagcgccuuaaggccgaacuggucguuuuuaaaggacucauguccgauguggugcccaagaaaaaggagcggaaggucgccagcgacgaugacaucucugaacaggauggcgaggugaauagauucuccgacgaugagguugggagcaugaacauuaccgacgaaaugaaacgcauguuuaaucagcugcgggagacauucgacuuugaugacgauugugacucucuuaccugggaagagaacgaagauacacugcuccugugggaggacuucaccaauugcaacccuacgaucgaucugcaaggagagcaggaagagaaucucggcaaccugauucacgaaacagaguccuuuuucaagaccagagacaaagaguaucaggaaacaaucgggcagauugagcuugaacuggcuaccgcgaaaagcgauaugaaccgccaccuccaugaguacauggaaauguguucuaugaaacggggccuggacgugcaaauggagaccugcagacgccuuaucaagggauccgccgaucggaauagccccucccccucuagcgucgcuuccagcgacucuggcuccacagacgagauucaggaugaauuugagagagaagccgacguggagccuaugguuagcuga

SEQ ID NO: 70591 - RNA, 2190 nt, Artificial Sequence
  derived and/or modified sequence opt5 from IFI16__Homo_sapiens__NP_001193496
augggcaagaaauacaagaacaucgugcugcucaaagggcuggaggucauuaaugauuaucacuucagaaugguuaagagccuucuguccaacgaucucaaacugaaucuuaagaugcgggaagaguacgacaagauccagauugccgaucugauggaagagaaauuucgcggagacgcuggccucgggaagcugaucaaaauuuucgaagauauccccacccuggaggaccucgccgagacacugaagaaagaaaagcucaaggugaaaggaccugcgcugucuagaaagcggaaaaaggagguggaugcuacgagcccggcccccuccaccucuagcacagucaaaaccgaaggcgccgaggcuacaccuggggcccaaaaccccaagaccguggcuaaaugccagguuacaccucgcagaaaugugcuccagaagcggcccgucaucgugaagguucuguccaccacgaaaccuuuugaguaugaaaccccggagauggaaaagaaaauuauguuccaugccacaguggcgacccagacacaauuuuuccacgucaaggugcuuaacaccucucugaaagagaaguuuaauggaaagaaaaucauuaucauuagcgacuaccucgaauaugauucccugcuggaggugaacgaggaaagcacggucucugaggccggccccaaucagacauucgaaguuccuaacaagaucauuaaucgcgcuaaagagacccucaagaucgacauccugcauaaacaggccuccggcaacauuguguacgggguguuuaugcuucacaagaagacagucaaucagaaaaccaccaucuaugaaauucaagaugacagaggaaagauggaugugguuggcacagggcagugucauaacauccccugcgaggagggagacaaacugcagcuuuucuguuuucggcugcgcaagaaaaaucagaugagcaagcugauuucugaaaugcacuccuucauccaaaucaagaaaaagacgaacccuagaaacaaugaccccaaaagcaugaagcugccgcaggagcagcggcaacucccuuaccccucugaggcuuccaccacauuuccugaaagccaccuucgcacaccccagaugcccccuaccaccccguccucuagcuucuucacgaaaaaguccgaagauacaauuagcaaaaugaacgacuuuaugagaaugcagauccugaaggagggcucucauuuccccgggccuuuuaugaccuccauuggacccgccgagagccacccucauacaccccagaugccgccuucuacccccagcuccucuuuccucaccacaaagagcgaagauacgaucuccaaaaugaaugacuuuaugcggaugcaaauucugaaggagggcagccacuucccuggccccuuuaugaccucuaucgggccugcggaaucccacccccauacaccgcagaugccucccagcacccccucuuccagcuuccuuacaacccugaaaccucgccucaagacggagccggaggaaguguccaucgaggauucugcccagagcgaccugaaagaagucauggugcuuaacgcuaccgaguccuuuguuuacgaacccaaggagcagaagaaaauguuccacgccacaguggcuaccgagaaugaagucuuuagagugaaggucuucaacauugaucugaaagagaaguuuacaccuaaaaagaucauugccaucgccaauuaugugugccggaacggauuccucgaaguuuaccccuucacccugguggcugacgucaaugcggauagaaacauggagauuccuaagggccugauccgcucugccagcgugacgcccaaaauuaaucaacucuguucccagacaaaggggagcuuuguuaacggaguguucgaaguccauaaaaagaaugugcggggcgaguuuaccuauuacgagauccaggacaacacagggaaaauggaagugguuguccacggaagacugaccaccaucaauugcgaggaaggcgauaaacuuaagcugacauguuucgagcucgcuccuaagucuggcaacacgggggaacugcgcuccgugauucauagccacaucaaggugauuaaaacccggaagaacaaaaaggacauccugaaucccgacucuuccauggagacaagcccggacuuuuucuuuuga

SEQ ID NO: 70592 - RNA, 369 nt, Artificial Sequence
  derived and/or modified sequence opt5 from IFI27__Homo_sapiens__NP_001275885
auggaggccagcgcucugaccuccucugccgugacaagcgucgcgaagguugugagaguggcuuccggcucugccgucgugcucccccuggcccggaucgcuacgguugugauugggggagucguggccauggcugccguuccuauggugcuuagcgcgaugggcuucaccgccgcugggaucgccuccucuagcauugcugccaaaaugauguccgcggccgcuaucgccaacggaggcggggucgcuagcggaucucugguggccacacuccagucccugggcgccaccggccuuagcgggcugacaaaguuuauucucggaucuaucggcuccgcuaucgcggccgugauugcucgcuucuacuga

SEQ ID NO: 70593 - RNA, 753 nt, Artificial Sequence
  derived and/or modified sequence opt5 from IFI30__Homo_sapiens__NP_006323
augacccugagcccccuccugcuuuuccugccuccgcuccugcuucugcucgacgugcccacagccgcuguccaggccuccccucugcaagcgcuggacuuuuucggcaacgggcccccuguuaauuacaagacgggaaaccucuaucugagaggcccccuuaaaaagucuaaugcuccucuggugaacgugacccucuacuaugaggcccugugcgggggaugucgggccuuucuuauccgcgaacuguucccgacauggcuccuggucauggagauucugaaugugacccucguucccuacggcaacgcucaggaacagaaugugagcgggagaugggaguuuaaaugccagcacggagaagaggaguguaaguucaacaaagucgaagccugcgugcuggaugagcuugauauggaacuggcuuuucucacaaucguuuguauggaggaguucgaagacauggagcggucccugccucuuugccugcaacucuaugcccccggccugucuccugauaccauuauggaaugugcgaugggcgaccgcgggaugcagcugaugcaugccaaugcucagagaacagaugcccuccagcccccgcacgaguacgugccuugggucaccgugaacggaaagccccuggaagaccaaacgcagcuucugacccucgugugccagcuguaucagggcaagaaaccugaugucugucccagcuccacaucuagccuucgguccguuugcuuuaaguga

SEQ ID NO: 70594 - RNA, 867 nt, Artificial Sequence
  derived and/or modified sequence opt5 from IFI35__Homo_sapiens__NP_005524
augagcgcuccccuggacgccgcccuccacgcgcugcaggaggaacaagcuagacuuaagaugcggcugugggaucuccagcagcugcgcaaagagcuuggcgacuccccuaaggauaaagugccguucucuguccccaagaucccucugguuuuuagagggcauacccagcaagaccccgaagugccuaaaagccucguguccaaccugcggauucacugcccccugcucgccggaucugcccugaucacauucgaugacccuaaggucgcugaacaggugcuucagcagaaggaacauacgauuaauauggaggagugucgccugagaguucaagugcagccgcucgaacugcccauggucaccacaauccaggugaugaugagcucccagcuuucuggccggcgcguucuggugaccggguuuccugccagccucagacuguccgaggaggagcugcucgauaaacuggagauuuucuuuggaaagacacggaacggcgggggagacgucgaugugcgcgaacuucugcccggcagcgugaugcucggcuucgcuagagacggggucgcccaacggcugugccagaucggacaguuuaccguuccucuuggcgggcaacaggugccccugcgcgugucuccguacgucaauggagagauccagaaagcggaaauuagaucccagccugugccccggagcguucucgugcugaacaucccugauauucuggacggccccgagcuccacgauguccuggaaauccauuuccaaaagcccacacgcgggggaggcgagguggaggcccuuaccguugugccucagggccagcaggggcuggcugucuuuacgucugaauccggauga

SEQ ID NO: 70595 - RNA, 1374 nt, Artificial Sequence
  derived and/or modified sequence opt5 from IFI44__Homo_sapiens__XP_011538818
auggccgugaccacaagacugacguggcuccacgagaagauccugcagaaccauuucggcgggaaacggcuuagccugcucuacaagggauccguccacggcuuucgcaaugggguucugcuugacagaugcuguaaccaaggacccacccugacagugauuuauucugaagaucauaucauuggcgcuuacgccgaggaaagcuaucaggaggggaaauacgcguccaucauucucuucgcucugcaggacaccaagaucucugaauggaaacugggacucugcacaccugagacccuguuuuguugcgaugugacaaaguauaauagcccgaccaacuuccagaucgacggccggaaucgcaaggucauuauggaucuuaaaacgauggagaaccugggccucgcccaaaauuguaccaucuccauucaggacuacgaaguguuuagaugcgaggauucucuggacgaacggaagaucaaagggguuauugagcuucgcaagagccugcucuccgcccugagaacauaugagcccuacggaagccuggugcagcagauccggauucuccugcuuggcccuaucggggcuggaaaaucuuccuucuuuaacagcguccgcucuguguuccaaggccacguuacccaucaggcccugguggggacaaauaccacgggaaucuccgaaaaguacagaacauauagcauucgggauggcaaggacggcaaauaccuccccuuuauccugugugauucucuugggcuguccgagaaggaaggaggccucugccgcgacgauauuuucuauauccugaacgggaauauuagagaccgguaccaguuuaacccuauggagagcaucaaacugaaucaccacgacuauaucgauucccccucucucaaggaccgcauucauugugucgcuuucguguuugaugccagcuccauccaguacuucagcucucaaaugauugugaaaaucaagcggauuagaagagaacuggucaacgcgggaguugugcacguggcccuucugacccaugucgacuccauggaucucaucacaaaaggcgaccugaucgagauugagcgcugcgaaccugugcggagcaaacuugaggaaguucagagaaagcugggguucgcucucucugauaucagcguggucuccaauuauucuagcgagugggaacuggacccggugaaagauguucugauucucuccgcccugcgccggaugcuuugggcugccgacgauuuucuggaggaccuccccuucgagcagaucggaagaugguuuggcggcguggaagcguggaagcgcagcgggaaccugcgggaggaaauuaucaacugugcccaaggaaagaaguga

SEQ ID NO: 70596 - RNA, 3078 nt, Artificial Sequence
  derived and/or modified sequence opt5 from IFIH1__Homo_sapiens__NP_071451
augagcaacggcuacuccaccgacgagaauuucagauaucugaucucuugcuuucgggcccgcgugaagauguacauucaggucgaacccguucucgauuaucugacauuccuuccugcugaggugaaagaacaaauccagagaacgguggccaccagcgggaacaugcaggcggucgagcugcuccuguccacacuugaaaagggaguguggcaccugggcuggacccgggaguuuguugaggcucuccgcagaacagggucuccgcuggccgcccgguacaugaaucccgaacugaccgaccucccuagccccuccuucgagaacgcucaugaugaauaucugcagcuucugaaucuccugcaaccuacacuuguggacaaacugcucguccgcgaugugcuggacaaguguauggaggaggaacugcucaccauugaggauagaaaccggaucgccgcugccgaaaauaacggaaaugagucuggcguucgcgaacugcuuaaaagaauugugcagaaggagaacugguuuagcgcguuccugaauguccuccggcagacggggaacaaugagcuggugcaggaacuuaccggauccgacugcagcgagucuaacgccgaaaucgagaaucugucccaaguggauggcccccaggucgaagaacagcuccugagcacaaccguucagccuaaccuggagaaggaaguguggggcauggagaacaauucuuccgaaagcucuuuugcugacuccagcguggucuccgagucugauacaagccucgccgaaggguccgugagcugucuggacgagucucuuggacacaacuccaauaugggcagcgauucugggaccaugggaagcgacuccgacgaggaaaacguugcugcccgcgcgucuccggagcccgaacugcaacucagaccuuaccagauggagguggcccagcccgcucuggagggcaaaaauaucauuaucugccuuccuacggggagcggaaagacacgggucgccguguauauugcuaaagaucaucuggacaagaaaaagaaggccuccgaacccggcaaaguuaucgugcucgucaacaaggugcugcuggucgagcaacucuuccgcaaagaauuucagccguuccugaagaaaugguacagagugauuggccuuagcggggauacccagcugaagaucucuuuuccugagguugugaaauccugugacauuaucaucagcacagcccagauucucgaaaauucucugcugaaccuugagaauggagaggaugcuggcguccaacucuccgacuucagccugaucauuaucgaugaaugccaccauaccaacaaggaggcgguguacaauaacauuaugcggcacuaucugaugcagaagcucaaaaauaacagacugaagaaagaaaauaagcccguuaucccucuuccccagauccuggggcucaccgccucccccggagugggcggggcuacaaaacaggccaaggccgaggaacacauucugaagcugugugcuaaccuugacgccuuuacgaucaaaaccgucaaggagaaccucgaucaacugaaaaaucagauucaggagccuugcaagaaauucgcgaucgcugacgccacacgcgaagauccguucaaggagaagcugcucgaaauuaugacccggauccagacauacugucaaaugucucccaugagcgacuuuggaacccagccuuaugagcagugggccauccagauggagaaaaaggcugccaaagagggcaacagaaaggagcgcgugugcgcugaacaucugcggaaauacaaugaggcccuucaaauuaacgacacgaucagaaugauugaugcguauacacaccuggaaaccuucuacaaugaggagaaggacaagaaauuugccgugaucgaagaugacuccgaugagggcggggacgaugaauauugugacggagaugaggacgaagaugaccucaagaaaccccugaagcuggaugagaccgaccgcuuccuuaugacacucuuuuucgagaacaauaaaaugcugaagcggcuggcugaaaacccugaguacgaaaaugagaaacucaccaagcugagaaacacaauuauggaacaguacacgcgcaccgaggagucugcccggggcaucauuuuuacaaagaccagacagagcgcuuaugcccuuucccaauggaucacagaaaaugagaaauucgcggaaguuggggucaaggcccaucaccugaucggagcuggccacagcucugaguuuaaacccaugacccagaacgaacagaaggaggugauuuccaaauuccgcacggggaagaucaaucuccugauugccaccacaguggcugaggaaggccuggacaucaaggagugcaacauugucauccgguacggacuugugaccaaugaaaucgccaugguucaggccagaggccgggcucgcgcggaugagagcacauaugugcucgucgcccauucuggguccggagugauugagcacgaaaccguuaacgacuuuagagagaaaaugauguacaaggcuauccauugcgugcaaaacaugaaaccggaagaguaugcccacaagauucuggaacugcagaugcagagcaucauggagaaaaagaugaagacgaaacggaauauugccaagcauuacaaaaacaauccuucucucaucacauuccuguguaagaacugcagcguccuugcuuguuccggcgaggauauccacgugauugagaaaaugcaccauguuaauaugacccccgaauuuaaggaacuguauaucgugagagagaacaaggcccuccagaaaaagugcgcggacuaccaaauuaauggggaaaucauuuguaaaugcggacaggcuuggggcacaaugaugguccacaaggggcuggaucugccuugucuuaaaauccgcaacuucgugguggucuucaagaauaacagcaccaaaaagcaguacaagaaauggguugagcugcccaucaccuuuccuaaucucgacuauucugagugcugucuguucuccgaugaagacuga

SEQ ID NO: 70597 - RNA, 1344 nt, Artificial Sequence
  derived and/or modified sequence opt5 from IFIT1__Homo_sapiens__NP_001257858
augcccgaccuggagaacagagugcucgaucagaucgaguuccuggacaccaaguacagcgucggcauucacaaucuucuggccuauguuaaacaucucaaggggcaaaacgaagaagcucugaaaucccuuaaggaggccgaaaaucugaugcaggaggagcacgauaaccaggcgaaugugcggucucucgugacauggggaaacuuugcuuggauguacuaucauaugggccgccuggccgaagcccagacguaccuggacaaagucgagaauaucugcaagaagcucagcaacccuuucagauaucggauggaauguccggagauugauugcgaggaagggugggcucugcuuaaauguggaggcaagaauuacgagcgcgccaaggcuugcuuugaaaaggugcuggagguugaccccgaaaacccugaguccucugccggguaugcgaucagcgccuacagacucgauggauucaaacuggcuaccaagaaucacaagcccuuuucccuucugccucuccggcaagccgugcgccugaaccccgacaauggcuacauuaaaguccugcucgcucugaaacuucaggaugagggccaggaagccgagggggaaaaauauaucgaggaagcgcuggccaacaugucuagccagacauacguguucagauaugcugccaaguuuuaccggcgcaaaggauccguugacaaggcucucgagcugcuuaaaaaggcccugcaagagaccccuacaagcgugcuccugcaucaccagaucggccuguguuauaaggcccagaugauucagaucaaagaagcuaccaaggggcaaccgagaggacagaaucgggagaaacucgauaagaugauucgcucugcgaucuuccacuuugaauccgccgucgagaaaaagcccacauucgaaguggcucaucuggaccuugccagaauguacauugaggccggcaaccaccggaaggcugaggaaaacuuucagaaacugcucugcaugaagccuguggucgaggaaaccaugcaagauauccauuuccacuaugggcgcuuucaggaguuccagaaaaagagcgacguuaaugccauuauccacuaccugaaagcgaucaagauugagcaggcuucucuuacgagagacaaguccaucaacagccugaaaaagcucgugcugcggaaacugagacgcaaggcccucgaucuggaaucucuuucccugcucggauucguguacaaacuggagggcaauaugaacgaagcccuggaguauuacgaacgggcucuuagacucgccgcugacuuugagaauagcguccgccaaggccccuga

SEQ ID NO: 70598 - RNA, 1419 nt, Artificial Sequence
  derived and/or modified sequence opt5 from IFIT2__Homo_sapiens__NP_001538
augagcgagaacaauaagaacucccuggaaucuagccucagacagcugaaaugccacuucaccuggaaucuuauggagggcgaaaacucccuggacgauuuugaggacaagguguucuaccggacagaauuucaaaaucgcgaguucaaagccacgauguguaaccuccuggcuuaucuuaagcaucugaaagggcagaaugaggccgcgcucgaaugccugagaaaggcugaggaacugauccagcaggagcacgccgaucaagccgagauucggucucucgucaccuggggaaacuacgcuuggguuuauuaccauaugggccgccugagcgacgugcagaucuauguggauaaggucaaacacgugugugaaaaguuuuccucucccuacagaauugagagcccugaacuugacugcgaggaaggguggacacggcugaaauguggaggcaaucagaacgagcgcgccaagguuugcuucgagaaagcucucgaaaagaagccgaaaaaucccgaguuuaccuccgggcuggccaucgcgagcuauagacuugauaacuggccucccucucagaaugccauugacccucugcggcaagcuauccgccucaaccccgauaaucaguaccugaaggugcugcucgcccugaaacuucauaagaugagagaagagggagaagaggagggcgaaggcgagaaacuggucgaagaggcucucgaaaaggccccuggggugacagacguucugcgguccgcggccaaauucuaccgcagaaaggaugagccggacaaggcuaucgagcuucugaaaaaggcccucgaauauauucccaacaacgcuuaccugcacugucagaucggaugcuguuaucgggccaaaguguuucaggucaugaaucugcgcgagaacggcauguacgggaagagaaaacuccuggaacuuauuggacacgccguggcucaucugaagaaggcggaugaggccaaugacaaccucuuccgggugugcagcauccuggcuucucuucacgcccuggccgaccaauaugaggaugcugaauacuauuuucagaaagaguucuccaaggaacucaccccugucgccaaacagcugcugcaucucagauacggcaauuuucaacuguaccagaugaagugugaggacaaagcgauucaccacuucaucgaagggguuaagauuaaccaaaagagccgcgagaaagagaagaugaaagauaaacuucagaaaaucgcuaagaugcggcugucuaagaauggagccgacuccgaagcccuccaugugcuggcuuuccugcaggagcuuaacgaaaagaugcagcaggccgaugaggacagcgaaagaggccucgaguccggcucucugauccccagcgcuuccagcuggaauggggaguga

SEQ ID NO: 70599 - RNA, 1317 nt, Artificial Sequence
  derived and/or modified sequence opt5 from IFIT3__Homo_sapiens__NP_001276687
auguacaaccugcucgccuauaucaagcaccuggacggcaauaacgaggcugcccuugaaugccugagacaggcggaggaacucauucaacaggagcaugcugaucaggccgaaauccggagccuggugaccugggggaauuacgccugggucuauuaccaccuuggacgccuguccgacgcucagauuuauguugauaaagugaagcaaacauguaaaaaguucucuaaccccuacagcaucgaguauuccgagcucgacugcgaagagggcuggacgcagcugaaaugugggagaaaugaacgggccaaggugugcuuugagaaggcucuggaggaaaaaccuaacaauccggaguucucuagcggacucgccauugcgauguaccaucuggauaaccaccccgaaaagcaguuuuccaccgacguccuuaaacaggccaucgagcugucuccugauaaucaauacgugaagguucuccugggccuuaaacugcagaagaugaacaaggaagcugagggggagcaguucguggaagaggcccucgagaaaagccccugucagacagacguccugcgcuccgcugccaaguuuuauagacggaaaggagaucuggacaaggcgaucgaacucuuccaacgcgugcuggaaagcaccccuaauaacggcuaccuuuaucaucagauuggcugcuguuacaaagccaagguuagacagaugcaaaauacaggggagucugaggcuuccggaaacaaagaaaugaucgaggcccugaagcaguaugcuauggauuacagcaauaaggcccucgaaaaaggccugaacccccuuaacgccuauucugaccuggcugaguuucucgaaaccgagugcuaccagacaccuuucaauaaggaggugccggaugcggaaaaacagcaaucccaccagcgguacuguaaccugcagaaguauaaugggaaaagcgaggacaccgccguccagcacggacuggaaggccucucuauuuccaaaaagagcacggacaaggaggagaucaaggaucaaccccagaacguguccgaaaaucugcuuccucagaacgcucccaauuacugguaucugcaggggcucauucauaaacaaaacggagaccugcuucaggccgccaagugcuacgagaaagaacugggccgccuccugagagaugcuccuucuggcaucgggagcauuuuucuguccgccagcgagcucgaagacggaucugaggagaugggccagggggcgguguccagcucuccccgggaacugcuuagcaauuccgagcagcugaacuga

SEQ ID NO: 70600 - RNA, 1449 nt, Artificial Sequence
  derived and/or modified sequence opt5 from IFIT5__Homo_sapiens__NP_036552
augagcgagaucagaaaggacacccugaaagccauucuccuggaacuugagugccacuucacauggaaccugcucaaggaagauaucgaccuguuugagguggaagauacgauuggccagcaacuugaguuccugaccacaaaaucccggcucgcucuguacaaucugcucgccuaugucaagcaucugaaagggcagaacaaggacgcgcuugagugucuggaacaggcugaggaaaucauucagcaagagcacucugauaaggaggaaguucgcagccucgugaccuggggaaauuacgccuggguguauuaccauauggaccagcuggaggaagcccagaaauauacaggcaagaucgggaacgucugcaaaaagcuguccucucccagcaauuacaaacuugaguguccugaaaccgauugcgagaagggaugggcucuccugaaguuuggcgggaaauauuaccagaaggccaaagcugccuucgagaaggcgcuggaaguggagccggacaaccccgaauuuaauaucggauacgccauuacaguuuauagacucgaugacuccgaucgggagggcucugugaaauccuucagccugggcccucuucgcaaggcugucacccugaaccccgacaauagcuacaucaaaguguuucucgcccugaaacuucaagauguucacgcugaagccgagggggagaaguauauugaagagauccuggaccagauuucuucccagccuuacgugcucagauaugcggccaaguucuaccggcgcaagaacagcuggaauaaagcucuggaacugcucaagaaagcccuggaggucacgcccaccucuuccuuucuucaucaccagaugggacuguguuauagagcucaaaugauccagauuaagaaggccacacacaaccggccuaaaggcaaggacaaacucaagguggaugaacugaucagcucugccaucuuccauuuuaaagcugcgauggagcgcgacuccauguucgccuuugcuuacaccgaucuugccaauauguacgccgaagggggacaguauagcaacgcugaggacauuuucagaaaggcccugcggcucgagaauaucacagaugaccacaagcaucaaauucacuaccacuauggccgcuuccaggaauuucauagaaaauccgagaacaccgcgauccaccauuaccuggaggcucugaaggugaaagaucggucuccgcuccgcacgaagcugacaagcgcccuuaaaaagcuguccaccaagagacucugccacaacgcccuggacguccagagccugucugcucuuggguucguuuauaaacucgaaggagagaagcggcaggccgcugaauacuaugagaaagcccaaaagauugaucccgaaaaugcggaguuucugacagcccugugugagcucagacuguccaucuga

SEQ ID NO: 70601 - RNA, 378 nt, Artificial Sequence
  derived and/or modified sequence opt5 from IFITM1__Homo_sapiens__NP_003632
augcacaaggaggaacaugagguggccguccugggcgcucccccuagcaccauccucccgagauccacaguuauuaacauccacucugaaacgagcgugcccgaccauguggucuggucccuguucaauacccuuuuucugaacuggugcugucucggguucauugccuuugcguacucugugaaaagccgggaucgcaagaugguuggagacgugacaggcgcucaggccuaugccuccaccgcuaaaugccugaauaucugggcccuuauucuggggauccucaugacaaucggauucauucugcugcucgucuuuggcucugugaccguuuaccacaucaugcugcaaauuauccaggagaagagaggguauuga

SEQ ID NO: 70602 - RNA, 399 nt, Artificial Sequence
  derived and/or modified sequence opt5 from IFITM2__Homo_sapiens__NP_006426
augaaccacaucgugcagaccuucagccccgucaauuccggccaaccuccgaacuacgagaugcugaaggaggaacaggaaguugccaugcucggggugccccauaauccugcucccccuaugucuacagugauucacaucagaagcgagacguccguccccgaccaugugguuuggucucuguuuaacacccuuuucaugaauacaugcugucugggauuuauugccuucgcguauagcgugaaaucccgggaucgcaagauggucggcgacgugaccggggcucaggccuacgccucuacagcuaaaugccucaacaucugggcccugauucuuggaaucuuuaugaccauccugcucauuaucauuccuguucuggugguccaggcucaaagauga

SEQ ID NO: 70603 - RNA, 402 nt, Artificial Sequence
  derived and/or modified sequence opt5 from IFITM3__Homo_sapiens__NP_066362
augaaccacaccgugcagacauucuuuagccccgucaauuccggccaaccuccgaacuacgagaugcugaaggaggaacaugaaguugccgugcucggggcuccccacaauccugcgcccccuacgucuaccgugauccauauuagaagcgagacauccguccccgaccacgugguuuggucucuguucaacacccuuuuuaugaauccuugcugucugggauucaucgccuuugcuuauagcgugaaaucccgggaucgcaagauggucggcgacgugacaggggcccaggccuacgcuucuaccgccaaaugccucaacauuugggcucugauccuuggcauucugaugacaauccuccugaucguuauuccggugcugaucuuccaggccuauggauga

SEQ ID NO: 70604 - RNA, 399 nt, Artificial Sequence
  derived and/or modified sequence opt5 from IFITM5__Homo_sapiens__NP_001020466
auggacaccgccuaccccagagaggauacacgggcuccuacgccgagcaaggccggcgcgcacaccgcucugacacucggggcuccccauccucccccucgcgaccaccugaucugguccguguucucuacccuuuaucugaaccucugcugucugggauuucuugcccuggccuacagcauuaaagccagagaucagaaggucguuggcgaccucgaagcugcccggcgcuucggguccaaagcgaagugcuauaauauccuggccgcuauguggacacuggugcccccucuccugcuucugggacucguggucaccggcgcccugcaucuugcuagacuggccaaagauucugcggccuuuuucagcacaaaguuugacgaugcugacuacgauuga

SEQ ID NO: 70605 - RNA, 570 nt, Artificial Sequence
  derived and/or modified sequence opt5 from IFNA10__Homo_sapiens__NP_002162
auggcccugagcuucucccuccugauggcugugcuuguccugucuuacaagagcaucugcucccucggcugugaccugccccagacccacucucuugggaacagacgggcccugauucuccugggacaaaugggccgcaucagcccuuuuuccugccugaaagauagacaugacuuccggauuccgcaggaggaauuugaugggaaucaguuccagaaggcgcaagcuaucucuguucuccacgagaugauucagcagacauuuaaccuguucagcacggaagacuccagcgccgccugggagcagucucuucuggaaaaauuuuccaccgagcucuaucaacagcugaaugaucuugaggcuugugugauccaggaagugggagucgaggaaacaccccugaugaacgaggacagcauccucgccgugcgcaaguacuuccagagaauuacccuguaucugaucgagcggaaauacucuccuugcgcuugggaaguugugcgcgccgagauuaugagaucccucagcuuuucuacaaaucugcaaaagcggcuucgcagaaaggauuga

SEQ ID NO: 70606 - RNA, 573 nt, Artificial Sequence
  derived and/or modified sequence opt5 from IFNA13__Homo_sapiens__NP_008831
augauggccagccccuucgcucugcucauggcccuggugguccuuuccugcaagucuagcuguucccugggcugcgaccucccugagacccacucucuggauaacagacggacacuuaugcugcucgcgcagaugagccgcaucuccccgucuagcugucugauggacagacaugauuuuggguucccccaagaagaguuugacggaaaucaguuccagaaagcuccugccauuuccguucugcacgaacucauccagcaaauuuuuaaccuguucacgaccaaggauagcucugccgcuugggacgaggaucuucuggacaaauuuugcacagaacucuaccagcagcugaaugaucuugaggccugugugaugcaggaggaacgggugggcgagacaccccugaugaacgcugacuccauccucgccgucaagaaauauuuccgcagaauuacccuguaccugaccgaaaagaaguauagcccuugcgcgugggaggugguucgggccgagaucaugcgcucucucucccugagcacaaaucuucaagaaagacugcggcgcaaagaguga

SEQ ID NO: 70607 - RNA, 570 nt, Artificial Sequence
  derived and/or modified sequence opt5 from IFNA14__Homo_sapiens__NP_002163
auggcccugcccuucgcucucaugauggcccuggugguccuuagcugcaaguccucuuguagccugggcugcaaccucucccagacccacucucugaauaacagacggacacuuaugcugauggcgcaaaugcgcagaaucagcccuuuuuccugucucaaagaccggcaugauuucgaguuuccgcaggaagaguucgacgggaaucaguuucagaaggcucaagccauuucuguucugcacgaaaugaugcagcagacguucaaccuguuuagcaccaaaaauuccagcgccgcuugggaugagacacuccuggaaaaguucuacaucgagcuuuuucagcaaaugaacgaccuggaggccugcgugauucaggaagugggagucgaggaaacaccccucaugaaugaggauucuauccuggcugugaaaaaguauuuccagcgcauuacccuuuaccugauggagaagaaauauuccccuugugccugggaaguugugagagcggagaucaugcggagccucucuuuuuccaccaaccugcagaagcgccugagacggaaagacuga

SEQ ID NO: 70608 - RNA, 570 nt, Artificial Sequence
  derived and/or modified sequence opt5 from IFNA16__Homo_sapiens__NP_002164
auggcccugagcuucucccuccugauggcugugcuuguccugucuuacaagagcaucugcucccucggcugugaccugccccagacccacucucuugggaacagacgggcccugauucuccuggcgcaaaugggacgcaucagccauuuuuccugccugaaagauagauaugacuucggcuuuccucaggagguuuucgaugggaaucaguuucagaaggcucaagccauuucugccuuccacgaaaugauccagcagacauuuaaccucuucagcacgaaagacuccagcgcugccugggaugagacccugcuugacaaguuuuacauugaacuguuccagcaacucaaugaucuggaggcuugugugacacaggaagugggagucgaggagaucgcccuuaugaacgaagacucuauccuggcggugcggaaauauuuucagcgcauuacccucuaccugaugggcaagaaguauuccccgugcgccugggagguugugagagcugaaaucaugcggagcuucucuuuuuccacaaaucugcagaaagggcuccgcagaaaggauuga

SEQ ID NO: 70609 - RNA, 570 nt, Artificial Sequence
  derived and/or modified sequence opt5 from IFNA17__Homo_sapiens__NP_067091
auggcccugagcuucucccuccugauggcugugcuuguccugucuuacaagagcaucugcucccucggcugugaccugccccagacccacucucuugggaacagacgggcccugauucuccuggcgcaaaugggacgcaucagcccuuuuuccugccugaaagauagacaugacuucggccucccgcaggaggaauuugaugggaaucaguuccagaagacacaagcuauuucuguucugcacgagaugauccagcagacguuuaaccuuuucagcaccgaagacuccagcgccgccugggagcagucucugcucgaaaaauuuuccacagagcuguaucaacagcuuaauaaccuggaggcuugugugauucaggaagugggaauggaggaaacaccccucaugaaugaggauagcauccuggccguccggaaguacuuccagcgcaucacccuguaucucaccgagaaaaaguacucuccuugcgcuugggaagugguuagagccgagauuaugcggucccugagcuuuucuacaaaccuucaaaagauccugcgcagaaaagacuga

SEQ ID NO: 70610 - RNA, 570 nt, Artificial Sequence
  derived and/or modified sequence opt5 from IFNA1__Homo_sapiens__NP_076918
auggccagccccuucgcucugcucauggugcuggucguucuuuccugcaagucuagcuguucccugggcugcgaccucccugagacccacucucuggauaacagacggacacuuaugcugcucgcccagaugagccgcaucuccccgucuagcugucugauggacagacaugauuuuggguucccccaagaagaguuugacggaaaucaguuccagaaagcgccugcuauuuccgugcugcacgaacucauccagcaaauuuuuaaccuguucacgaccaaggauagcucugccgccugggacgaggaucuucuggacaaauuuugcacagaacucuaccagcagcugaaugaucuugaggcuugugugaugcaggaggaacgggucggcgagacaccccugaugaacgccgacuccauccucgcugugaagaaauauuuccgcagaauuacccuguaccugaccgaaaagaaguauagcccuugcgccugggagguugugcgggcggagaucaugcgcucucucucccugagcacaaaucuucaagaaagacugcggcgcaaagaguga

SEQ ID NO: 70611 - RNA, 570 nt, Artificial Sequence
  derived and/or modified sequence opt5 from IFNA21__Homo_sapiens__NP_002166
auggcccugagcuucucccuccugauggcugugcuuguccugucuuacaagagcaucugcucccucggcugugaccugccccagacccacucucuugggaacagacgggcccugauucuccuggcgcaaaugggacgcaucagcccuuuuuccugccugaaagauagacaugacuucggcuuuccgcaggaggaguucgaugggaaucaguuucagaaggcucaagccauuucuguucuccacgaaaugauccagcagacauucaaccuguuuagcacgaaagacuccagcgccaccugggaacagucucuucuggagaaguucuccacagaacucaaucaacagcugaacgaucuugaggcuugugugauucaggaggugggagucgaagagacaccccugaugaauguggacagcauccucgccguuaaaaaguauuuucagcggaucacccuguaccugaccgaaaagaaauauucuccuugcgcuugggaggugguccgcgccgagauuaugagauccuucagccucucuaagaucuuucaagaacggcugcgcagaaaagaguga

SEQ ID NO: 70612 - RNA, 567 nt, Artificial Sequence
  derived and/or modified sequence opt5 from IFNA2__Homo_sapiens__NP_000596
auggcccugaccuucgcucuccugguggcccuucugguccucagcugcaaguccucuuguagcguuggcugcgaccugccccagacacacucccuugggucuagacggacgcugaugcuccuggcgcaaaugcgcagaaucagccuguuuuccugucucaaagaucggcaugacuucggauuuccucaggaggaauuuggcaaccaguuucagaaggcugagaccauuccggugcugcacgaaaugauccaacagauuuucaaucuuuucucuacaaaagauagcuccgccgccugggacgagacccugcucgauaaguucuacacagaacuguaucagcagcuuaacgaccuggaggcuugcgugauccaaggggucggagugaccgagacaccccucaugaaagaagauagcauucuggccguucgcaaguacuuucagagaaucacccuguaucucaaggagaaaaaguacucuccuugugcuugggaagugguccgggccgagaucaugcgcuccuucagccugucuacgaaucuucaggagucccugagaagcaaagaauga

SEQ ID NO: 70613 - RNA, 570 nt, Artificial Sequence
  derived and/or modified sequence opt5 from IFNA4__Homo_sapiens__NP_066546
auggcccugagcuucucccuccugauggcugugcuuguccugucuuacaagagcaucugcucccucggcugugaccugccccagacccacucucuugggaacagacgggcccugauucuccuggcgcaaaugggacgcaucagccauuuuuccugccugaaagauagacacgacuucggcuuuccugaggaagaguucgaugggcaucaguuucagaaggcucaggccauuucuguucuccacgaaaugauccaacagacauucaaucuguuuagcacggaggacuccagcgccgcuugggaacagucucuucuggagaaauucuccaccgagcucuaucagcaacugaacgaucuugaagccugugugauucaggaggugggagucgaagagacaccgcugaugaaugaggacagcauccucgcugugcggaaguacuuucagcgcaucacccuguaucugacagagaaaaaguacucucccugcgccugggaaguugugagagcggaaauuaugcggucccucagcuucucuaccaaccugcagaagcgccuuagacggaaagauuga

SEQ ID NO: 70614 - RNA, 570 nt, Artificial Sequence
  derived and/or modified sequence opt5 from IFNA5__Homo_sapiens__NP_002160
auggcccugcccuucgugcuccugauggcucuugucguucugaacugcaagagcaucuguucccucggcugcgaccugccucagacccacucucuuagcaauagacggacacugaugauuauggcccaaauggggcgcaucuccccguuuucuugucucaaagauagacaugacuucggauuuccccaggaggaguucgauggcaaccaguuucagaaggcgcaagcuauuagcgugcugcacgaaaugauccagcagacguucaaucuguuuuccaccaaagacucuagcgccacaugggaugaaacccuccuggacaaguucuacacagagcuuuaucagcaacugaacgaucucgaagccugcaugaugcaggaggugggggucgaggacaccccucugaugaauguggauuccauucuuacaguucggaaauacuuucagcgcaucacccuguaucucacggaaaagaaguacagccccugugcuugggagguggucagagccgaaaucaugcggucuuucucccugagcgcuaaccugcaggagcgccucagacggaaagaguga

SEQ ID NO: 70615 - RNA, 570 nt, Artificial Sequence
  derived and/or modified sequence opt5 from IFNA6__Homo_sapiens__NP_066282
auggcccugcccuucgcucuccugauggcccuugugguccugagcugcaaguccucuuguagccucgacugcgaucugccucagacccacucccuuggccauagacggacaaugaugcugcucgcgcaaaugcgcagaaucucucuguuuagcugucugaaagaccggcacgauuuccgcuuuccgcaggaggaguucgacgggaaccaguuucagaaggcugaagccauuuccguucuccaugaagugauccaacagacguucaaucuguuuucuaccaaagauagcuccguggccugggacgagagacuucuggauaagcucuacacagaacuguaucagcagcuuaacgaccuggaggcuugcgucaugcaagagguguggguuggaggcacaccccucaugaaugaagauagcauucuggccgugcggaaauacuuccagcgcaucacccuguaucucaccgagaagaaguacucuccuugugcuugggaagucgugagagccgagauuaugcgguccuuuucuagcucccgcaaccugcaggagagacuucggcgcaaagaauga

SEQ ID NO: 70616 - RNA, 570 nt, Artificial Sequence
  derived and/or modified sequence opt5 from IFNA7__Homo_sapiens__NP_066401
auggcccggagcuucucccugcucauggugguccugguucuuucuuacaagagcaucugcucccugggcugugaccucccccagacccacucucugagaaaccgcagagcucuuauucugcucgcccaaauggggcggaucagcccuuuuuccugccugaaagaucgccaugaguucagauuuccggaagaggaguucgacggacaccaguuucagaagacacaggcgauuucugugcugcaugaaaugauccaacagacguucaaucucuuuagcaccgaagauuccagcgcugccugggagcagucucugcuugagaaauucuccacagaacuguaucagcaacucaacgaccuggaggccugugugauucaggaagucggcguggaggagacaccccuuaugaaugaagauuuuauccuggcuguucggaaguacuuccagcgcaucacccucuaucugauggagaaaaaguacagcccuugcgccugggaaguggucagagcugagauuaugcggucuuuuuccuucagcaccaaccugaagaaagggcuccgcagaaaggacuga

SEQ ID NO: 70617 - RNA, 570 nt, Artificial Sequence
  derived and/or modified sequence opt5 from IFNA8__Homo_sapiens__NP_002161
auggcccugaccuucuaccuccugguggcucuugucguucugagcuauaaguccuuuucuagccucggcugcgaccugccccagacacacucccuugggaacagacgggcccugauccuccuggcgcaaaugcgcagaauuucuccuuucagcugucugaaagaucggcaugacuuugaguucccgcaggaagaguuugaugacaagcaguuccagaaagcucaagccaucuccgugcuccacgaaaugauucagcagacguuuaaucuguucucuaccaaggauagcuccgccgcucuugacgagacacugcucgaugaauuuuacaucgagcuggaccagcaacuuaacgaucuggagagcugcgugaugcaggaagucggagugauugagucuccccucauguaugaagacuccauccuggccguucgcaaauacuuccagagaaucacccuguaucucacagagaagaaguacagcucuugugcuugggaggugguccgggccgaaauuaugcgcuccuuuagccugucuaucaaucuucagaaaagacugaaguccaaagaguga

SEQ ID NO: 70618 - RNA, 1674 nt, Artificial Sequence
  derived and/or modified sequence opt5 from IFNAR1__Homo_sapiens__NP_000620
augauggugguccugcucggcgccaccacacugguucuuguggcuguggcccccuggguccugagcgcggcugccgggggaaagaaccucaaauccccucagaagguggagguugacaucauugaugacaauuucauccugagauggaaccggucugaugaaagcgugggcaaugucacguuuuccuucgacuaccaaaagaccgggauggauaacuggauuaaacuuucuggaugccagaauaucacaagcaccaaauguaacuuuuccucucugaagcucaauguguaugaggaaauuaagcugcgcaucagagccgagaaagaaaacacaagcuccugguacgagguugacagcuucaccccguuucggaaggcucagaucgggcccccugaggugcaccuggaagccgaggauaaagcuauugucauccauauuucucccggcacaaaggacuccgugaugugggcccucgauggacugagcuucaccuauucucuugugaucuggaaaaauuccagcggcgucgaggaacgcauugagaacaucuacucuagacacaagauuuauaagcuguccccugaaacgaccuacugccucaaaguuaaggcggcccugcuuacaagcuggaaaaucggcguguauucccccgugcauuguaucaagaccacagucgagaaugaacugccuccgcccgagaacauugaagugucuguucagaaucaaaacuacgugcucaaaugggacuacaccuaugcuaauaugacguuucagguccaguggcugcacgccuuccugaagcggaacccugggaaccaucucuacaaauggaagcagauccccgauugcgagaaugugaagacaacccaauguguuuuuccucagaacguguuccagaaaggaauuuaucugcuucgcguccaggcuagcgacggcaauaacacauccuuuuggagcgaggaaaucaaguucgauaccgagauucaagccuuucugcugcccccgguguucaauaucagaucucucuccgacagcuuccacaucuacauuggggcgccuaaacagucuggaaacacccccgucauccaggacuauccucuuauuuacgaaaucaucuuuugggagaauacaagcaacgccgaacggaagauuaucgagaaaaagacggaugugaccguucccaaucugaagccccucacaguguauugcgucaaagcucgcgcccacaccauggacgagaagcugaacaaauccucuguguucagcgaugcuguuugugaaaagacaaaaccuggcaauaccuccaagauuuggcugaucguggggauuugcaucgcccucuuugcccugccguucgucauuuacgcugcgaagguguuucuuagauguaucaacuacguguucuuucccagccugaaaccuucuuccagcauugacgaguauuucucugaacaaccccucaagaaucugcuucuguccacgagcgaggaacagaucgagaaaugcuuuaucauugagaacaucuccacaauugccaccguugaagagaccaaucagacagaugaagaccauaagaaauacucuagccagaccucccaagauucuggaaacuauagcaacgaggacgaguccgaaagcaagacaucugaggaacuccagcaggauuucgucuga

SEQ ID NO: 70619 - RNA, 996 nt, Artificial Sequence
  derived and/or modified sequence opt5 from IFNAR2__Homo_sapiens__NP_997467
augcugcucagccagaacgccuucaucuuuagaucccugaaucuugugcugauggucuacauuucucucguuuucggcaucagcuaugacucccccgauuacaccgacgagucuugcacauuuaagauuagccugcggaacuuccgcuccauccuuucuugggaacugaaaaaucacagcauugugccuacgcauuauacccuccuguacacaaucauguccaagccggaggaucugaaaguggucaagaacugugcuaauaccacacggagcuuuugcgaccucaccgaugaauggagaucuacacacgaggccuaugugaccguucuggaaggguucuccggaaacacgacccuuuuuagcuguucucauaauuucuggcuggcgaucgacauguccuuugagcccccugaguucgaaauugugggcuuuacaaaccacaucaaugucauggugaaauuccccagcauuguugaggaggaacuccaauuugaucugucucuugugaucgaggaacaguccgaggggauugucaagaagcauaaaccugaaaucaagggaaacaugagcggcaauuucaccuacauuaucgacaaacugauccccaacacaaauuauugcguguccguguaccucgagcacucugaugaacaggcugucauuaagagcccucugaaauguacccugcucccgcccgggcaggaguccgagagcgccgaaucugccaagaucggaggcauuaucacgguuuuccugauugcucuugugcugacauccaccaucgugacacucaaguggaucggcuacauuugccugcgcaacagccuuccuaaaguccugagacaagggcucgccaagggauggaaugcuguggccauccaccgguguucucauaacgcgcugcagagcgagacccccgaacugaaacaguccucuugccucagcuuuccuuccagcugggacuauaagcgcgccucucugugucccuccgauuga

SEQ ID NO: 70620 - RNA, 564 nt, Artificial Sequence
  derived and/or modified sequence opt5 from IFNB1__Homo_sapiens__NP_002167
augaccaacaagugccugcuccagaucgcccugcuucuguguuucagcacaacggcucucuccaugucuuacaaucugcuuggcuuucugcaaagaagcuccaacuuccagugccagaaacuccuguggcagcugaaugggcggcucgaguauugucugaaggaccgcaugaacuuugauauucccgaagagaucaaacaacuucagcaguuccagaaggaagacgccgcgcugaccauuuacgagaugcuccaaaauaucuuugcuauuuucagacaggauucuagcuccacaggauggaacgaaaccaucguggagaaucugcuugccaacgucuaucaccagaucaaucaucugaaaacaguucucgaggaaaagcuggagaaggaagacuuuacccggggcaaacugaugucuagccuccaccugaagcgcuacuaugggcggauucuucauuaccugaaagccaaggaguauucccacugcgcuuggacaaucgugagaguggagauucuccgcaacuucuacuuuaucaauagacugaccggauaccuucggaacuga

SEQ ID NO: 70621 - RNA, 627 nt, Artificial Sequence
  derived and/or modified sequence opt5 from IFNE__Homo_sapiens__NP_795372
augaucauuaagcacuucuuuggcaccgugcugguccuccuggccagcacaacgaucuucucccuugaccugaaacucauuaucuuucagcaaagacagguuaaccaggaaucucugaaacuucugaauaagcuccagacccugagcauucaacagugccugccccaucggaagaacuuccuccugccucagaaaucccuuucuccgcagcaauaccagaaggggcacacacuggcuauccuccaugaaaugcugcagcagaucuuuagccuuuuccgcgccaauauuucccuggauggaugggaggaaaaccacaccgagaaguuucucauccaacugcaucagcagcuggaauaucucgaggcgcugaugggccuugaggcugaaaaacugucugggacacucggaagcgacaaucugagacuucaagugaagauguacuuccggcgcauucacgauuaucuggagaaccaggacuacuccaccugugccugggccaucgugcaggucgaaauuagcagaugccucuuuuucguguuuucucugacagagaaacuguccaagcagggccggccccucaaugauaugaaacaagagcugaccacggaguuccgcagcccuagauga

SEQ ID NO: 70622 - RNA, 501 nt, Artificial Sequence
  derived and/or modified sequence opt5 from IFNG__Homo_sapiens__NP_000610
augaaguacaccagcuauauccuggccuuccagcucugcauugugcugggcucccuuggguguuacugccaagaccccuaugucaaagaggcugaaaaccugaagaaauacuuuaaugccggacacucugauguugcggacaacggcacacucuuccuggggauccuuaagaauuggaaagaggaaagcgauagaaagauuaugcagucccagaucgugucuuuuuauuucaagcuguuuaaaaacuucaaggacgaucagagcauucaaaaauccguggagacgaucaaggaagacaugaaugucaaauuuuucaacucuaauaagaagaaacgggaugacuuugagaagcucaccaacuacagcgugacagaucugaauguucagcgcaaagcuauccaugagcugauucaggugauggccgaacucuccccugccgcuaagaccggaaaaagaaagcggagccagaugcuguuccgcggcagacgggccucucaauga

SEQ ID NO: 70623 - RNA, 1470 nt, Artificial Sequence
  derived and/or modified sequence opt5 from IFNGR1__Homo_sapiens__NP_000407
auggcccuucucuuccugcuuccccuggugaugcagggcgucagcagagcugagauggggaccgccgaccucggaccuuccucuguuccgacacccacgaacgugaccaucgaaagcuacaauaugaacccuauuguguauugggaguaccaaaucaugccccaggucccuguguuuacaguugaagugaagaauuauggcgucaaaaacuccgaguggauugaugcgugcaucaauauuucucaccauuacuguaacaucagcgaccacgugggggaucccuccaauucucuguggguucgggugaaggcucgcgucggacagaaagaaagcgccuaugccaaguccgaggaguucgcugugugcagagacggcaaaaucgggccuccgaagcuggauauucggaaggaagagaaacagaucaugauugacaucuuucaucccagcguguucgucaacggagaugaacaagagguugacuacgauccugagaccacauguuauauucgcguguacaauguguacgucagaaugaacggcucugaaauccaguauaagauucugacccagaaagaggacgauugcgacgaaauccagugucaacucgccauccccguguccagccugaauagccaguacugcguuuccgcugagggcgugcugcacgucuggggagugacaaccgaaaagagcaaagagguuuguauuacgaucuuuaacucuuccauuaaggggagccucuggaucccuguggucgccgcgcugcuucuguuccucgugcugucccuugucuuuauuugcuucuauaucaagaaaaucaauccccugaaggagaaaucuauuauccucccgaagucucugauuuccgugguucggagcgccacccuggaaacaaaaccugagucuaaguacgugucccucaucaccagcuaucagcccuuuucucuggaaaaagaggucgugugugaggaaccucuuagccccgcuacaguucccggcaugcauaccgaggauaacccugggaagguggaacacacggaggaacuguccucuauuacagaggucgugaccacagaagagaauaucccggacgugguucccggaagccaccucaccccuaucgagcgcgaauccagcucuccccuguccagcaaccagucugagccuggcuccauugcccuuaacagcuaccauuccagaaauugcucugaaagcgaccacucccggaacggguucgauaccgacucuagcugucuggagucccauagcucucucuccgauagcgaguuucccccgaauaacaagggagaaaucaaaacagagggccaagaacugauuacggucaucaaggcuccuaccucuuucggcuaugacaaaccccacgugcugguggaucuccuggucgacgauuccgggaaggagagccuuauuggauaccgcccuacagaagacucuaaagaguuuagcuga

SEQ ID NO: 70624 - RNA, 1014 nt, Artificial Sequence
  derived and/or modified sequence opt5 from IFNGR2__Homo_sapiens__NP_005525
augagacccacccugcucuggagccugcuucugcuccugggcguguucgccgcugccgcggcugccccuccggacccccuuucccagcugccugcuccccaacacccuaagauccggcucuacaacgccgagcagguccugucuugggaacccguugcccugagcaauuccacacgcccugugguguaucagguccaguuuaaauacacggauucuaagugguucaccgcugacauuaugagcaucggggugaacugcacacaaauuaccgccacagagugugauuuuaccgcggccuccccgucugcuggauuccccauggacuuuaauguuacacucagacugcgggccgaacuuggcgcucugcauagcgccugggugaccaugccuugguuccagcacuaucgcaacgucacgguggggcccccugagaauaucgaaguuacccccggagagggcucccucauuaucagauuuagcucuccguucgauaucgcggacacauccaccgccuuuuucugcuacuaugugcauuacugggagaaagggggcauucagcaggucaagggaccuuuucggagcaacucuaucucccuggauaaucuuaaacccagccgcguguauugucugcaagugcaggcucagcuccuguggaacaagucuaauauuuucagagucggccaccuguccaacaucagcugcuacgaaacaauggccgacgcuuccaccgagcuccagcaaguuauucugaucucuguggggacguuuagccuucuguccgugcucgccggagccuguuucuuccugguccuuaaguaccggggccugauuaaauauugguuucauacaccucccagcaucccccuccagaucgaagaguaccugaaggauccuacccagccgauucuggaggcucucgacaaagauucuucccccaaggacgaugugugggacagcguuucuaucauuagcuucccugaaaaagagcaagaagacgugcugcagacacuuuga

SEQ ID NO: 70625 - RNA, 624 nt, Artificial Sequence
  derived and/or modified sequence opt5 from IFNK__Homo_sapiens__NP_064509
augagcaccaagcccgacaugauccagaaaugccuguggcucgagauucugaugggcaucuucauugccgggacacuuucccuggauuguaaccuccugaaugugcaccuuagacgggucacguggcaaaaccugcgccaucucucuagcauguccaauucuuuuccuguugaaugccugagagagaacaucgcuuucgaacugccgcaggaguuucuccaguacacccagcccaugaagcgggacauuaaaaaggccuucuaugaaaugagccugcaagcguuuaauaucuucucccagcacacauuuaaauacuggaaggagcgccaucuuaagcagauccagauuggacuggaucaacaggcugaguaucucaaccagugucuggaagaggacaaaaaugaaaacgaggauaugaaggagaugaaagaaaaugagaugaagccuucugaagccagagugccccagcuuagcucccuggagcuccggcgcuacuuccacagaaucgacaacuuucugaaagaaaagaaguauagcgauugcgccugggagauugugcgggucgagauccgcagaugucuguacuauuucuacaaauuuaccgcucucuuccggcgcaaguga

SEQ ID NO: 70626 - RNA, 603 nt, Artificial Sequence
  derived and/or modified sequence opt5 from IFNL1__Homo_sapiens__NP_742152
auggccgcugccuggaccgugguccugguuacacucgugcugggccuugcgguggcugggcccgucccuacgagcaagccgaccacaaccggaaaaggcugccacaucgggagauucaagucccugucuccccaggagcucgccagcuuuaaaaaggcccgggacgcucuggaagagucccuuaaacugaagaacuggucuuguagcuccccuguguuccccggaaauugggaucuccgccugcugcaaguuagagaacggccuguggcccucgaggcugaacuggcccuuacacugaagguccucgaggcggccgcuggccccgcccuggaggacgugcuugaucagccucugcauacccuccaccauauucugucucagcugcaggcuugcauccaaccgcagcccacagccgggccucgccccagaggacggcuccaccauuggcugcaccgccuucaggaagcgccuaaaaaggagagcgccggcugucuggaggcuuccguuaccuuuaaccucuucagacugcuuacgcgggaccugaaauacguggccgauggcaaucucugccugcgcaccagcacacaccccgaaucuaccuga

SEQ ID NO: 70627 - RNA, 603 nt, Artificial Sequence
  derived and/or modified sequence opt5 from IFNL2__Homo_sapiens__XP_011525058
augaagcuggacaugaccggcgauugcacacccgugcucguccugauggccgcuguucuuacggugaccggggccgugccugucgcgagacugcacggagcucucccggacgcccggggcugucauaucgcccaguucaaaagccugucuccccaagagcuucaggcuuuuaagcgcgccaaagaugcucuggaagagucccuccugcugaaggacugcagaugucacagccgccucuucccucggacaugggaucugagacagcuucaggugcgggaacgccccauggcccuggaggcggaacucgcccugacccuuaaaguucuggaggcuacagccgacaccgauccugcucucguggacguccuggaucaaccccugcauacacuccaccauauucugucccaguuuagagccugcauccagccucagccgaccgcggggccccggacgcgcggaagacuucaccacuggcuguaccggcuccaagaggccccuaagaaggaaucucccggcugucuggaggcuagcgugaccuucaaccuuuuucgccugcucacaagagaccugaauugcguugccuccggggaucuguguguguga

SEQ ID NO: 70628 - RNA, 591 nt, Artificial Sequence
  derived and/or modified sequence opt5 from IFNL3__Homo_sapiens__NP_742151
augaccggcgacugcaugcccgugcugguccucauggccgcuguucugacagugacgggggccgugccugucgcgagacuucggggagcucugccggaugcccgcggcugucacaucgcccaguucaagagccucucuccccaagagcugcaggcuuuuaaaagagccaaggacgcucuugaagagucccugcuccugaaagauugcaagugucggagccgccuguucccuagaaccugggaccuccggcagcuucaggugcgcgaaagacccguugcccuggaggcggaacuggcccucacacugaaagugcuugaggcuaccgccgauacagacccugcucugggggauguccucgaccaaccccugcauacccugcaccauauucucucccagcugcgggccugcauccagccucagccgacagcgggaccccgcaccagaggccggcuucaccauuggcugcaccgccuccaagaggccccuaagaaggaaucucccgggugucuggaggcuagcgugacguuuaaccuuuucagacugcucacccgggaucugaauugcguugccuccggagaccuguguguguga

SEQ ID NO: 70629 - RNA, 588 nt, Artificial Sequence
  derived and/or modified sequence opt5 from IFNW1__Homo_sapiens__NP_002168
auggcccuccuguucccccugcuugcugcccuggugaugaccagcuacuccccugucggcucucucgggugcgaccugccgcagaaccacggacuucugagcagaaauacacucguucugcugcaucaaaugcggcgcaucucccccuuucucugucugaaggauagacgggacuuccgcuuuccucaggagauggugaagggcucucagcuucagaaggcgcacgugaugagcguccugcaugaaaugcuccaacagauuuucucccuguuucacacggagagaucuagcgcugccuggaacaugacccuucuggaucagcuccauacagggcugcaccagcaacugcagcaccucgaaaccugccugcuucaggugguuggagagggcgaauccgccggggcuaucagcucucccgcccugacacuccggcgcuauuuccagggaauuagaguguaccugaaagagaagaaauauuccgacugugcuugggaggucgugcggauggaaaucaugaaaagccuuuuucugucuaccaauaugcaagagcgccucagauccaaggaucgggaccugggcagcucuuga

SEQ ID NO: 70630 - RNA, 1356 nt, Artificial Sequence
  derived and/or modified sequence opt5 from IFRD1__Homo_sapiens__NP_001007246
augcccaagaacaaaaagagaaauaccccucaccggggcagcuccgccgggggaggcgggucuggagcugccgcggcuacagccgccacggcuggcgggcagcaucgcaacgugcaaccguucagcgacgaggaugccuccaucgaaaccaugucucacugcagcggauacuccgaccccucuagcuuugcugaggauggcccugaaguccuggacgaggaaggcacacaggaggaucucgaguauaaacugaaggggcuuauugaccugacccucgauaaauccgccaagacaagacaggcggcccuggaaggaaucaagaaugcucuugccagcaaaaugcuguacgaguucauucucgaacggcgcaugacccugacagacucuaucgagagaugucugaagaaaggcaaguccgaugagcagcgggcugccgcggcccucgcuagcguucugugcauucaacuugggcccggaaucgaaucugaggaaauccugaaaacccucggcccuauucugaagaagaucauuugugacggguccgccagcaugcaggcucgccagacgugcgccaccuguuuuggagugugcuguuucaucgccacagaugacauuaccgagcuuuauucuacacuggaaugccucgagaacaucuuuaccaaauccuaccugaaggagaaagauacgacagugauuuguagcacccccaauacaguccugcauaucuccucucuccuggcuuggacccuucugcucaccaucugcccuauuaacgaagugaagaaaaagcuggagaugcacuuccauaaacuuccgagccugcucuccugugacgacguuaauaugagaaucgcggccggcgaaagccuggcucugcucuuugagcuggcccggggcauugaaucugauuucuuuuaugaggacauggagucccuuacacagaugcugcgcgcccucgcuacggaugggaacaagcacagagccaagguggacaaacggaagcaacgcagcgucuucagagaugugcugcgggcgguugaggaacgcgacuuucccaccgaaacaaucaaauucggaccugagagaauguacauugauugcugggugaagaaacacaccuaugacacauuuaaggaaguccuuggcucugggaugcaguaccaucugcagagcaaugaguuccuccggaacguguucgagcugggacccccugugaugcuggaugcugccacccucaagacgaugaaaaucuccagauuugaacgccaccuguacaauucugccgcuuucaaggcccggacaaaagcuagaagcaagugccgcgacaaacgggccgaugucggcgaguuuuucuga

SEQ ID NO: 70631 - RNA, 3099 nt, Artificial Sequence
  derived and/or modified sequence opt5 from IFT122__Homo_sapiens__NP_001267475
auguucaacggcaucauuagcaucagaaauaagaacggggaggaaaaagugaagauugagcggcccggaggcucccugucuccuaucuggagcauuugcuggaauccgucccgcgaagagagaaacgacauccucgccgucgcugauugggggcagaaaguuucuuuuuaccaacugagcggaaagcagaucggcaaagaccgggcccuuaauuucgaucccuguugcauuuccuauuuuaccaagggggaauacauccugcucggaggcucugacaaacaggugagccuguucacaaaggauggcgugcgccuugggacggucggagagcagaacuccuggguguggaccugucaagcgaagccugacagcaauuauguuguggucggcugccaggaugggacaauuucuuuuuaccagcugaucuucuccaccgugcacggacucuauaaagacagauacgcuuaucgggauagcaugacagacguuauugugcagcaucugaucaccgagcaaaagguccgcauuaaauguaaggaacuggugaagaaaaucgccaucuacagaaaccggcucgccauucagcugcccgagaagauccuuauuuacgaacuguauucugaggaucucuccgacaugcacuaccgcgugaaagagaagaucauuaaaaaguuugaaugcaaucugcuugucguuugugcuaaccauaucauccugugccaggagaaaagacuccagugucugagcuucucuggcgugaaggaacgggaguggcaaauggaaucccugauucgcuauaucaaggugauugggggaccucccggcagagagggccuccuggucgggcuuaaaaauggacagauccugaagauuuuuguggauaaccucuucgccaucguucugcuuaaacaggcuacagccgugcggugccuggacaugagcgcgucccgcaagaaacucgccgucguggacgagaaugauaccugucugguuuacgacaucgauacgaaggaacugcucuuucaagagccuaacgcuaauucuguggccuggaacacccagugcgaagacaugcugugcuucagcggcgggggauaucuuaacauuaaggcuuccacauuuccgguccacagacagaaacugcagggcuucguggucggguacaauggaagcaagaucuucugucuccauguguuuucuauuuccgccguugaggugccccaaagcgcgccuauguaucaguaccuggaucggaaacuuuucaaggaagccuaccagaucgcuugccugggcgucaccgacacagauuggagagagcucgccauggaggcucuggaaggccuggacuuugagaccgccaaaaaggccuucauucgcgugcaggaucuccgguaucuggaacuuaucucuagcauugaggaaagaaagaaacgcggggagacgaacaaugaccuguuucucgcugauguuuucuccuaccaaggaaaguuucacgaggcggccaaacuguauaagcggucuggccacgaaaaccuggcucuugagauguacacagaccucuguauguucgaauaugccaaagacuuucuggggagcggagaucccaaggagaccaagaugcugaucacaaaacaggccgacugggcuagaaauaucaaggagccuaaagccgcgguggaaauguacauuuccgcuggcgagcaugucaaggccaucgaaauuugcggggaucacggcuggguggacaugcucaucgauauugcccgcaaacuggacaaggcugagcgggaaccccuucugcucugugccaccuaucugaaaaagcuggauagcccgggauacgcugccgagaccuaccuuaagaugggcgaccucaaaucucuggugcagcugcauguugagacacagagaugggaugaagcguucgcccucggggagaagcacccugaauuuaaagacgauaucuauaugcccuacgcucaauggcuggccgagaacgaccgcuucgaagaggcucagaaggccuuucacaaagcgggacggcagagagaggccguccaggugcuugaacaacugacgaauaacgcuguggccgagucccgcuucaaugaugcugccuauuacuauuggaugcucagcaugcagugccuggacaucgcccaggacccugcucaaaaggauaccaugcugggcaaguucuaccauuuucagcggcuugcggaacucuaucacggguaccaugccauucacagacauacagaggaccccuucucuguccaccggcccgaaacccuguuuaacaucucccgcuuccugcuccacagccugccuaaagauacaccguccggaauuucuaaggugaaaauccuuuuuacccuggcuaagcagagcaaagcccucggcgccuacagacuggcucggcaugccuaugacaagcugagagggcuuuacauucccgcgcgcuuccagaaguccaucgagcucggcacgcugacaauccgggcuaaaccuuuucacgauucugaggaacugguuccccucuguuauagaugcagcaccaauaacccucugcuuaauaaccugggaaauguguguauuaacugccgccaacccuucaucuuuuccgccagcucuuacgacguccuccaucugguggaguucuaucuggaagagggcauuaccgaugaggaagccaucucccuuauugaccuggagguucucagaccgaagcgggaugaccgccagcuggaaaucgcuaacaauagcucucagauccucagacugguggagacaaaagauuccauuggggacgaagauccuuuuaccgccaaacuuagcuucgagcagggaggcucugaguuuguccccgugguugugagccggcugguccuccgcuccaugagcagacgggacgugcugaucaagcgcuggccucccccucugagauggcaauacuuccggucucuucugcccgacgcguccauuacaauguguccgagcugcuuccagauguuucacuccgaagauuaugagcuccuggugcuccagcacgggugcuguccuuacugccgcagauguaaggacgaucccggacccuga

SEQ ID NO: 70632 - RNA, 4389 nt, Artificial Sequence
  derived and/or modified sequence opt5 from IFT140__Homo_sapiens__NP_055529
auggcccuguacuaugaccaccagaucgaggcucccgaugccgcgggcagcccuuccuucauuucuuggcauccggugcaccccuuucucgcugucgccuacaucagcaccacauccacggggucuguugacauuuaucuggaacaaggagagugcgugccugauacccauguggaaagacccuuccgggucgccagccuuuguuggcacccuacacgccuggugcucgcuguuggcugggagaccggggaagugacagucuuuaacaagcaggacaaagagcagcauaccaugccccugacacacaccgccgauaucacggugcuuagaugguccccuucuggaaauugccugcucagcggcgaccggcuggggguucugcuccuguggcgccuugaucagagaggacgggugcaaggcaccccgcugcucaagcacgaguacggcaaacaucugacacacuguauuuuccgccuucccccucccggggaagaccugguccagcucgcuaaggccgcgguguccggagaugagaaagcccuggacauguuuaacuggaagaagucuagcuccggcagccugcucaaaauggggucucaugaaggacugcuuuucuuugugucccugauggauggcaccguccacuauguugacgagaaggggaaaacaacccagguggugagcgcugauucuacgauccagaugcuguucuacauggagaagagagaagcccucgucgugguuacagagaaucuucggcugucccucuauaccgugccucccgaaggaaaagcugaggaagucaugaaggugaagcugagcggcaaaacaggccgcagagccgacaucgcgcugauugaggggucccuccugguuauggccgugggagaggcugcccuucgguuuugggacaucgaacgcggcgagaacuacauucugucuccggaugaaaaguucggguuugagaaaggagaaaauaugaacugcgucuguuacugcaaggugaaaggccuccuggcugccgggaccgacagaggacgggucgccauguggcgcaaggugccugauuuccuuggcagccccggcgcugaggggaaagacagaugggcgcugcaaaccccuacagagcuccagggaaauaucacgcagauucaguggggcucccggaagaaccugcuggccguuaauagcgugaucucugucgcuauucucuccgaaagagccaugagcucucacuuucaucaacagguggccgcuaugcagguuagccccucccugcuuaacguguguuuccugucuaccggggucgcccacagccuccgcacagauaugcauaucuccggaguguucgcgaccaaggacgcuguggccguuuggaauggccggcaagucgccaucuuugagcugagcggggcugccauuagaucugcuggcacauuccugugcgaaacccccgugcuugccaugcacgaggaaaacguguauacggucgaguccaaucgcgugcagguucggacauggcagggaaccgugaaacagcuccugcuguuuagcgagaccgaaggcaacccuuguuuccucgauaucugcgggaauuuucuggucgugggaacagaccuugcgcauuucaagucuuuugaucuguccagacgcgaggccaaagcucacuguagcugccggucccucgccgaacugguuccgggcgugggaggaauugcuucucugagaugcagcuccucuggcagcaccaucuccauucuucccagcaaggccgacaacucuccugauuccaaaaucuguuucuacgacgucgagauggacacagugacgguuuuugauuucaagaccgggcaaaucgaccgccgggagacacucagcuuuaacgaacaggagaccaauaagucucaccuguucguggaugaaggccugaaaaacuauguccccgugaaucauuuuugggaccaguccgagccuagacucuucgugugcgaagcgguccaggagacaccccgcagccaaccgcagucugccaacggacagccucaggauggccgggcugggcccgccgcugacguucugauucuuagcuucuuuaucuccgaggaacacggauuccugcuccaugagagcuuuccuagacccgccaccucucacucccugcugggcauggaagugccuuacuauuacuucacgcggaagcccgaggaagccgaucgcgaggacgagguggaaccggggugucaccauauuccucaaauggucagcagacggccccuuagagauuuugugggacucgaggacugcgauaaagcuacccgcgacgcgaugcugcacuucuccuuuuucguuacaaucggcgauauggacgaagccuuuaagucuauuaaacugaucaagagcgaggcugugugggaaaauauggcccggaugugugucaagacccagagacucgacguggccaaaguuugccuggggaacaugggccaugcucgcggagccagagcgcuucgggaggcugagcaggaacccgagcuggaagcccgcguggccguccucgcuacacagcugggcaugcuggaggaugccgagcaacuuuauagaaaguguaaacggcacgaccuccugaauaaguucuaccaggcggcugggcgcuggcaggaagcccugcaaguggccgagcaucacgauagaguucaccuccgguccaccuaccaucgcuaugcuggacaccuggaagccucugcugacugcagcagagcccuuuccuacuaugagaaaucugauacgcaucgguuugaagugccucgcaugcugagcgaggaccucccgucccuggagcuguacgucaacaagaugaaggauaaaacacuuuggagauggugggcgcaguaucuggaaagccagggcgagauggacgccgcucuccacuacuaugaacuggcccgggaucauuucucucucgugagaauccacuguuuucaggggaaugugcaaaaggcugcccagauugccaacgagaccggaaaucuggcugcguccuaccaccuugcccgccaguacgaaagccaggaggaggucggccaagcuguucauuucuauacacgggcccaggccuucaaaaacgcuaucagacugugcaaggaaaaugggcucgacgaucagcugaugaaccuggcccuucugucuucccccgaggacaugauugaagcggcucgcuacuaugaggaaaaaggcgugcagauggaucgggccgugaugcucuaccacaaggccggacauuuuagcaaagcucuggagcucgccuucgcgacccaacaguuugucgcucugcagcuuaucgccgaggaccuggacgaaaccucugauccugcccuccuggcuagauguuccgacuucuuuauugagcacagccaauaugaacgcgccguggagcugcuucuggcugcccggaaguaccaggaggcgcuccagcugugccucggccagaauauguccaucacagaagagauggccgaaaagaugacgguugcuaaagauagcucugaccugcccgaggaaagcagacgcgagcuucuggagcaaauugccgauugcuguaugcggcagggguccuaucaccuggcuaccaagaaauacacacaggccggaaacaagcucaaagccaugagagcucugcuuaagucuggcgacaccgaaaagaucacauucuuugcgagcgugucccggcagaaagagaucuacauuauggccgcuaacuaucugcaaucucucgauuggcgcaaggaaccugagaucaugaaaaauauuaucggguucuacaccaaggggagagcccuggaccuccuggccggcuuuuaugaugcuugcgcccaggucgaaauugacgaguaccagaacuaugauaaagcgcauggcgcucuuacggaggccuacaagugucuggccaaggcuaaagccaagagcccccuggaccaggaaacacggcucgcgcaacugcagucccgcauggcccuugugaaaagauucauccaggcucggagaaccuauaccgaggacccuaaggaaucuaucaaacagugcgagcugcuccuggaggagcccgaucucgacagcacaauucgcaucggggauguuuacggauuucugguggagcacuacguccggaaggaagaguaucaaaccgccuacagauuccuugaagagaugcgccggagacugccgcuggcuaauauguccuauuacgugagcccucaggccgucgacgcugugcaucgcggccucgggcugccccuuccucggacaguucccgaacaggugagacacaacucuauggaagaugcccgcgagcuggacgaagaggucguggaagaggcggaugacgauccguga

SEQ ID NO: 70633 - RNA, 5250 nt, Artificial Sequence
  derived and/or modified sequence opt5 from IFT172__Homo_sapiens__NP_056477
augcaccugaagcaucucagaacccugcuuagcccccaggacggcgccgcuaaagugacaugcauggccuggucccaaaacaaugcgaaguucgcugucuguacgguugaucggguggugcugcucuacgacgagcacggggaacgcagagauaaauuuucuaccaagccugccgacaugaaauauggacggaagagcuacauggucaagggcauggccuucuccccggauucuacaaaaaucgcuauugggcagaccgacaacaucauuuauguguacaagaucggagaggauuggggcgacaaaaagguuauuugcaauaaauuuauccagacaagcgccgugaccugucugcaguggcccgcugaauauaucauugucuucgggcuugccgagggaaaggugcgccuggcgaacacaaagaccaauaaauccucuacgaucuacggcaccgaaagcuauguugugucccucacaaccaacugcagcggcaaggggauucugucuggacaugccgauggcacaaucgucagauacuuuuucgacgaugagggguccggagagagccaaggcaaacuggugaaucacccuugucccccuuacgcucucgccugggcuaccaacucuauuguggccgcggggugcgaccggaagaucgucgccuauggaaaagaaggccauaugcugcagacguuugauuacucccgcgacccccaggagagagaauucacaaccgcuguuagcucuccuggcgggcaguccguggugcuuggaagcuaugaccggcugcgcgucuuuaauuggauuccgagacgguccaucugggaggaggccaagcccaaagaaaucacaaaccucuacaccauuaccgcucuggccuggaagcgcgauggcucuagacuuuguguggggacacugugcggaggcguugagcaauucgacuguugccuccggcgcagcaucuauaagaauaaauuugaacugacguacguggggccuucccaggucauugugaagaaccugagcucuggaaccagaguugugcucaaaucccacuauggcuacgaggucgaagaggugaagauccugggcaaagagcgguaccuugucgcccacacaagcgaaacccugcuccugggggaucuuaauacaaacagacugucugagauugcuuggcagggaagcggcgggaaugaaaaguauuucuuugagaacgaaaacguguguaugaucuucaaugcgggagagcucacccugguugaguacggcaacaaugacacgcugggguccgugcgcacagaauucaugaacccccaucucaucucuguccggauuaaugagagaugccagcgcggcaccgaagauaacaagaaacuggccuaucuuaucgacauuaagaccaucgcuauuguggaucugaucggaggcuacaauaucgggacaguuagccacgagucccggguggacuggcucgaacugaacgagaccggacauaaacuucuguuuagagaucgcaagcuccggcugcaccuguaugacauugagagcugcucuaaaacaaugauccucaauuucuguuccuacaugcaaugggucccuggcagcgaugugcugguggcccagaacagaaauucucuuugcguuugguauaacauugaagcccccgagcgcgucacgauguuuaccauccggggggacgugauuggacuggaaagaggcgggggcaagacagaggugauggucauggagggagugaccacaguugcuuacacccucgacgaaggccugaucgaguucgggacggccauugaugacggaaauuacauccgcgcgaccgcuuuucuggaaacacuugagaugaccccggaaacagaggccauguggaagacccucuccaaacuggcccuggaggcucggcagcuccacaucgccgaaagauguuucagcgcucugggccaaguggccaaggcgcgguuucuucaugagacgaacgaaauugccgaucaggucucccgcgaguaugggggagaaggcacagacuucuaccaggugagagcucggcuggccaugcucgagaaaaauuauaagcuggcugagaugaucuuucuggaacagaacgccguugaggaagcgauggggauguaccaagagcuucacagaugggaugaaugcauugccguggcugaggccaaaggccauccugcucucgagaagcugcgccggucuuauuaccaguggcugauggacacccagcaggaagagagagccggagaacuccaagagagccagggcgaugggcuggccgcuaucucccuuuaucugaaggcgggacuccccgccaaagcugcccgccugguccugacaagagaggaacuucucgccaacaccgagcugguggaacacauuaccgcugcccugaucaagggcgagcucuacgaacgggcgggggaccuguucgagaaaauccauaauccucagaaggcucuugaguguuaccgcaaaggaaacgccuuuaugaaggccguugaacuggcuagacucgccuuccccguggaggucgugaaacuggaagaggcguggggcgaucaccuggugcagcaaaagcagcuugacgcugccauuaaucacuauaucgaagcccggugcucuauuaaggcuaucgaggccgcucucggggcccgccaguggaaaaaggcgauuuacauccuggaucugcaggacagaaacacagccagcaaauauuacccccucgucgcucaacauuaugccucccugcaggaguacgaaaucgcugaggaacuuuauacgaagggcgaucggaccaaagacgccauugacauguacacacaggccggacgcugggagcaagcucacaagcuggcgaugaaguguaugagaccugaagauguuagcgugcucuacaucacccaggcccaggagauggagaaacagggcaaguaucgggaagcugagcgccuguacgugacaguccaagaaccggaccuggccauuaccauguauaaaaagcauaaacuuuacgaugacaugaucagacugguggggaagcaccaccccgaucuccugucugacacgcaucuccaccugggaaaggagcuugaggccgaaggccggcugcaggaggcugaauaucauuaccucgaggcccaggaauggaaagcgacaguuaauauguauagagcuuccgggcugugggaggaggccuaccgcguggcccggacccagggaggcgcuaacgcccacaagcaugucgcguaccugugggcuaaaagccuuggcggggaagccgccgugagacugcucaauaagcugggacuccuggaggcugccguugaucacgcugccgacaacugcucuuuugaauucgcguucgagcuuucccgccuggcccucaaacacaagaccccugaagugcaucugaaguaugcuauguuucuggaggaugagggcaaauucgaagaggccgaagcugaguuuauucgggccgggaagcccaaagaagccguccuuauguucgugcacaaucaagacugggaggcugcgcagagaguugccgaggcucaugauccugacagcguggccgaaguccuggugggacaggcccgcggcgcucucgaggaaaaggauuuucagaaagccgaggggcugcuccugcgggcgcaaagacccggacuugcucugaacuacuauaaggaggccggccuguggucugacgcccuccgcaucuguaaagacuacgugccgagccagcuggaagcucuucaggaggaauaugagcgggaagccacaaagaagggcgcgagaggggucgagggauucguugagcaagcccggcacugggaacaggcuggcgaguacucccgcgccguggauugcuaucugaaagugagagacagcgggaauucuggacucgcugaaaaguguuggaugaaagccgcugagcuguccaucaaguuucucccuccccagcggaacauggaagucgugcuggccguuggcccucagcuuauugggaucggaaaacauagcgcggccgcugagcuguaccugaaucucgaucuggugaaggaggccauugacgcuuucaucgaaggcgaggaauggaacaaggccaaacgcgucgccaaggagcuugaucccagauacgaagacuauguggaucaacacuacaaagaguuucugaagaaucagggcaaaguugacucccucgugggggucgaugugauugcugcgcuggaccucuaugucgagcagggacagugggauaagugcaucgaaaccgccacaaagcaaaacuacaaaauucugcacaaguauguggcucuuuacgccacgcaucugauccgggagggcucuagcgcccaggcucuggcccucuauguucagcacggggcgccugccaacccccagaauuucaacaucuacaaaagaauuuuuaccgacaugguguccucuccgggaacaaauugcgcugaagccuaccauagcugggcugaccugcgcgauguccuuuucaaccugugugagaaucucgugaaguccucugaggccaacagcccugcgcacgaagaguuuaaaaccaugcugcucaucgcccacuauuacgcuacacgguccgccgcucaaagcguuaagcagcuggaaaccguggccgcuagacuuucugucucccugcugcgccauacgcagcuccugcccguggacaaggccuucuaugaggcgggcauugccgcuaaagccguggggugggauaauauggcuuucaucuuucuuaaccgguuccuggaccucaccgaugccauugaagagggaacacuggacggccuggaucacagcgacuuucaggauaccgacauccccuucgagguuccucucccggccaagcaacauguccccgaagcggagagagaagaggugcgcgauugggugcuuacagucucuauggaccagcggcuggaacaggugcugccuagagaugagcgcggcgcuuacgaggccucccucguugcugccagcaccggggugagagcccugcccugccuuaucacaggauauccuauucugcggaauaaaaucgaauuuaagcgccccggcaaagcugccaacaaggacaauuggaacaaguuccucauggcgauuaaaaccucucacuccccugucugucaagacgugcugaaguuuaucagccaguggugcgggggacugcccuccacgagcuucucuuuucaguga

SEQ ID NO: 70634 - RNA, 561 nt, Artificial Sequence
  derived and/or modified sequence opt5 from IFT27__Homo_sapiens__NP_001171172
auggugaagcuggccgcuaaaugcauccucgccggcgaccccgcggucgggaagaccgcucuggcccagauuuucagaagcgauggagcccacuuucaaaaauccuacacacuuacgaccggcauggaccugguugugaagacagugccugucccggauaccggggacucuguggaacucuucaucuuugauagcgcuggaaaagaacuguucuccgagaugcuugacaagcugugggaaucucccaacguucucugucugguguaugaugucacaaaugaggagagcuuuaacaauugcuccaaguggcuggagaaagcccggucucaggcuccuggcauuagccuccccggggugcugguuggaaacaagaccgaccuugccggccgcagagcgguggauuccgccgaggcucgggccugggcucugggccaggggcucgaauguuucgagacaagcgucaaagaaauggagaauuuugaggccccuuuccauugccuggcgaagcaguuucaccaacuuuaccgcgaaaaaguggagguguucagagcccuggcuuga

SEQ ID NO: 70635 - RNA, 627 nt, Artificial Sequence
  derived and/or modified sequence opt5 from IFT43__Homo_sapiens__NP_001096034
auggaggaccugcucgaucuggacgaggaacuuagauacagccuggccaccucccgggcuaagaugggccgcagagcccagcaagaaucugcgcaggcugagaaccaccucaaugggaaaaacagcucccugacacuuacgggagaaaccucuagcgccaagcugccccggugccgccagggcgggugggccggagauuccgugaaggcuucuaaauucagacggaaagccagcgaggagaucgaagacuuucgccucagaccucagucccugaauggcagcgauuaugggggagacauuccgaucauucccgaucuggaggaaguccaagaggaggacuucguucuccagguggcugccccucccucuauccagauuaagcgggugaugacauaccgcgaucuggacaacgaucuuaugaaguauuccgcgauccagacccuggacggcgaaaucgaucucaaacugcuuacaaagguccuggccccugagcaugaagugagagaggacgacguuggcugggauugggaccaccucuuuaccgaagugagcucugagguccugacagagugggauccccugcaaaccgaaaaagaggacccugcugggcaggcccggcauacguga

SEQ ID NO: 70636 - RNA, 1290 nt, Artificial Sequence
  derived and/or modified sequence opt5 from IFT57__Homo_sapiens__NP_060480
augaccgccgcucuggccguggucacaacgagcggccucgaggacgggguucccagaucccggggagaaggcaccggggagguggugcuggaacgcggaccuggcgcggcuuaccacauguucgucgugauggaggaucuuguugaaaagcugaaacuccugagauaugaggaggaauuucuucggaagucuaaccugaaagccccgagccgccauuacuucgcccuccccacaaauccuggggagcaguuuuauauguucugcacccuggcugccuggcugaucaacaaggcuggaagacccuuugaacaaccucaggaguacgacgaucccaaugccacaauuuccaacauccucucugagcugcggagcuucggccgcaccgcggacuuuccuccguccaaacuuaagucuggcuauggggaacacguguguuacguccuggauugcuucgccgaggaagcucucaaguauauuggauuuacauggaaaagacccaucuacccuguggaggaacuggaggaggaaagcguugccgaggacgaugcugaacuuacccugaauaagguggacgaggaguucgucgaagaggaaacggauaacgaggaaaauuuuauugaccucaacgugcugaaagcccagaccuaccaucuggauaugaaugagacagcgaagcaggaagacauccucgaguccaccacagaugccgcugaguggagccuggaaguggagcggguccuuccccaacugaaaguuaccauccgcacggacaacaaggacuggcggauucacguggaucagaugcaucagcacagaucuggcaucgaauccgcccucaaggagacaaaaggguuccuggacaaacuucacaaugagauuacccgcacacuggaaaagaucagcucuagagagaaguauauuaacaaucagcucgaaaaccuggugcaagaguaccgggcugcccaggcccagcuguccgaagcuaaagagcgcuaucagcaaggaaauggcggggucaccgagagaacccggcuccugagcgaagugauggaggaacuugagaagguuaaacaggaaauggaggagaagggaucuuccaugacagauggcgcgccucuggugaagaucaaacagagccucacgaagcugaaacaagaaaccgucgagauggacauuagaaucggcaucguggaacauacacuucugcaguccaagcucaaagagaagucuaacaugacccgcaacaugcacgccacaguuauucccgaaccggcuaccggguuuuacuga

SEQ ID NO: 70637 - RNA, 1803 nt, Artificial Sequence
  derived and/or modified sequence opt5 from IFT74__Homo_sapiens__NP_001092693
auggccagcaaccacaaguccucugcugccagacccgugagccggggcggggucggacugaccggccgcccuccguccgggaucagaccccucucuggaaauauucggguugcgacagcuaugccucccggcacggcccgcccugggagcagaggaugccccaucggcaccggcggggugcuguccucucagauuaaaguggcccaucggccugucacacaacagggacuuaccggcaugaagacagggaccaaaggaccgcagcgccagauccuggacaagagcuacuaucucggccugcuuagauccaaaauuagcgagcugacaaccgaagugaacaagcuccaaaaggggaucgagauguacaaucaggaaaacucuguuuaucuguccuacgagaaacgggcugaaacgcuggccguggagaucaaggagcuccagggacagcuggcugauuauaauaugcuugucgacaaacugaacaccaauacagaaauggaggaagugaugaacgauuacaauaugcucaaggcccaaaacgaccgcgagacccagagccuggauguuauuuucacagagagacaggcgaaagaaaagcagauccggucuguggaggaagagauugaacaagagaagcaggccaccgacgauaucauuaaaaauauguccuuugagaaccaggucaaguaucuugaaaugaaaacgacaaaugagaagcugcuccaagaacuggacacccugcagcagcagcucgauagccaaaacaugaaaaaggagucucuggaagcugagaucgcccacucccaggugaaacaggaggcugugcuucugcaugaaaagcucuacgagcuggaaagccaccgcgaccagaugauugccgaggauaaguccaucggcucucccauggaagagagagagaaacuucugaagcaaaucaaagacgauaaucaggaaauugcgagcauggagcggcagcucacagacaccaaggaaaagaucaaccaguucauugaggagauccgccaacuggacauggaucuggaagaacaucagggcgaaaugaaccagaaguacaaggagcucaaaaagagagaagaacacauggacaccuuuauugagacauucgaagagacgaaaaaucaggaacugaagcggaaagcccaaaucgaggcuaacaucgucgcccuucuggaacacuguuccagaaauauuaaccgcaucgagcagauuagcucuaucaccaaucaggagcucaagaugaugcaagaugaccugaacuuuaaguccacagaaguucagaaaagccagucuaccgcucagaaucuuacaagcgauauucaacggcugcagcucgaccugcagaagauggagcugcucgaauccaaaaugaccgaggaacagcauucucugaaaagcaaaaucaagcaaaugacgacagaucuugagaucuauaacgaccugccugcccucaaguccagcggggaggagaaaauuaagaaacugcaccaggagagaaugauccugucuacccaucgcaaugccuucaagaaaauuauggaaaagcagaacaucgaguacgaggcucuuaaaacccagcuccaagaaaaugagacacacucccagcugaccaaccuggaacggaaguggcagcaccucgagcaaaauaacuuugcgaugaaggaguucauugccacaaaaagccaggagucugauuaucagcccaucaagaaaaaugugacgaagcagauugcugaguacaacaaaaccaucguggacgcccugcauuccacaagcggaaacuga

SEQ ID NO: 70638 - RNA, 1923 nt, Artificial Sequence
  derived and/or modified sequence opt5 from IFT80__Homo_sapiens__NP_001177171
augcugagaagcacccucgcccagcaaggcacacccguguacuccgucgcuugggggccugacucugagaagguucuguauacggccggaaaacagcuuaucauuaagccgcugcagcccaacgcgaaagugcuccaguggaaggcucacgauggcaucauucugaaaguggacuggaauagcgucaacgaucuuauccuguccgccggggaagacugcaaguacaaggugugggauucuuauggacggccucucuacaauagccaaccccaugagcacccuauuaccuccguugccugggcucccgacggcgaacuguucgccguggggucuuuucauacacugcgccucugugauaaaaccggauggagcuaugcucuggagaagccuaacacaggcuccaucuucaauaucgccuggagcauugacggcacccagaucgcgggggccugcggaaacggccacgucguguuugcucauguuguggaacagcacugggaguggaaaaauuuccaggucacacuuaccaagagacgggccaugcaagugcgcaacgugcugaaugaugcugucgaccuccuggaguuuagagaucggguuauuaaagccucucuuaacuacgcgcaccuggugguguccacgagccuccaguguuaugucuucucuaccaagaauuggaacacaccgaucauuuuugaccugaaggaagggaccgugucccugauccuccaggccgagcgccauuuccugcuuguugauggaagcucuauuuaccuguacuccuaugaaggcagauuuaucagcucccccaaauucccugggaugcggacagacauccucaaugcucagaccgugucucugagcaacgacacgauugccauccgcgauaaggcugacgagaaaauuaucuuucuuuucgaggccuccacaggaaagccccugggcgauggcaaauuucucagccacaagaaugaaauucuggagaucgcccuggaccaaaaagggcucaccaacgauagaaagaucgcuuucauugacaagaaccgggaucugugcaucacaucugucaaacgcuucggaaaggaggaacagauuaucaaacuuggcaccauggugcauacccuggcguggaaugacacauguaacauucucugcgggcugcaggauacgagauuuaucguuugguacuauccuaauaccguguacgucgaccgggauauccuucccaagacacuguaugaacgcgacgccuccgaguucagcaaaaacccgcacauugugucuuuugucggaaaucaagugaccaucagacgggcugacggcagccucguucacauuuccaucacaccuuaccccgccauucugcaugaguaugugucuagcuccaagugggaagaugccgucagacugugucgcuucgugaaggagcagaccaugugggcuugccucgccgcgauggcuguugccaaccgggacaugacgacagccgaaaucgcuuacgccgcuauuggggagaucgauaaagugcaguacaucaauagcauuaagaaccugccuucuaaagaauccaagauggcccacauccuucuguuuagcggaaauauucaggaggcggagaucguccuccugcaagccggccugguguaucaggcuauucagaucaacaucaaucuuuacaacugggaaagagcccucgagcuggcugugaaauauaagacccauguugacaccguccuggccuaccgccagaaguuccucgaaacauuuggcaaacaagagaccaauaagcgguaucugcacuacgcggaagggcuucagauugauugggagaaaaucaaggccaaaauugagauggaaaucacaaaggagagagaacagucuuccagcucccagucuagcaaguccauuggacugaaacccuga

SEQ ID NO: 70639 - RNA, 2646 nt, Artificial Sequence
  derived and/or modified sequence opt5 from IFT88__Homo_sapiens__XP_005266603
augaagguggagagcggcaugaaaaucaagguccacaacaaugccgaauccgagaccgcuguuggguuccuggaaguggaccagggaugccccauuuuuggcuucccugggccgcauagaaagaagaacugucucggaccccacaugaaauuuacaaauacgaaggugcaaaugaugcagaacguccaucuggccccugagaccgaugaagacgaucuuuacucuggcuauaaugacuacaaccccaucuaugauauugaggagcuggaaaaugacgcggcuuuccagcaggccgugcggacaagccacgggcgcagaccucccaucaccgccaagauuuccucuacagcuguuacccggccuaucgccacaggauacggcagcaaaaccucccucgcuucuagcaucggccgcccgaugacgggggccauucaagauggagugaccagacccaugacagcgguccgggccgcuggcuuuaccaaggccgcucugcgcggguccgccuucgacccucuuagccagucuagaggacccgcguccccucuggaggccaaaaagaaagauagccccgaagagaagaucaagcagcucgagaaagaagugaacgagcugguugaagagucuugcauugcuaauuccuguggcgaccugaagcucgcccuggaaaaagcuaaggaugccgggcggaaagagcgcgugcuugucagacagcgggagcaagugacaaccccggaaaacaucaaucuggaccucacguauagcgugcuguuuaaccuugccucucaguacuccgucaaugagauguaugcugaagcgcugaacacauaccagguuauugugaagaauaaaauguucagcaacgccggaauccucaagaugaacaugggcaauauuuaccugaagcagcgcaacuauuccaaagcuaucaaguuuuacagaauggcccuggaucaagugccuucugucaauaaacagaugcggaucaagauuaugcagaacaucggcgugaccuucauucaagccgggcaguauagcgacgcuaucaauuccuacgagcauauuaugagcauggcccccaaccucaaagcgggauauaaucugacaaucugcuacuuugcuaucggcgaccgcgaaaagaugaagaaagccuuccagaaacuuauuaccguuccucuggagaucgaugaggacaaauauauuucucccuccgaugacccccacaccaaccucgugacagaagccaucaagaaugaucaccugagacagauggagcgggaaagaaaagcuauggccgagaaguacauuaugacgagcgcuaaacuuaucgccccugucaucgaaaccucuuuugcggccggguacgacugguguguggagguugugaaagcuagccaauaugucgagcuggccaacgaucucgaaauuaauaaggcugugacauaccugcgccagaaagacuauaaccaggccgucgagauccugaaggugcucgaaaagaaggauucccggguuaagucugcggccgcuaccaaucugagcgcccuuuacuauaugggaaaagacuucgcucaggccuccagcuacgccgauauugcugugaacucugacagauauaauccggcggcccugacaaacaagggcaacaccgucuucgcuaauggggacuacgagaaagccgccgaguuuuacaaggaagcucuccgcaacgauuccagcugcacggaggcccuguauaauaucggacuuacauacgaaaaacugaaccggcucgacgaggcgcuggauuguuuccugaagcuccaugcuauucugagaaauucugccgaagugcuuuaucaaaucgccaacauuuacgagcugauggagaaucccucccaggcuaucgaauggcucaugcagguugugagcgucaucccuaccgacccccaggugcuguccaaacugggcgagcuuuaugaucgcgaaggcgacaagucucaagccuuucaguacuauuacgagagcuaccgguauuucccuugcaacauugaagugaucgaguggcucggggcguacuauauugauacccaguuuugggagaaggcuauccaguacuucgaaagagccucccugauucaacccacacagguuaaauggcagcugauggucgccucuuguuuucgccggagcggaaauuaucaaaaggcucucgacaccuacaaagauacacacagaaaguucccggagaacguggaaugccugcgcuuucuugugcggcuguguacggaccucggccugaaagaugcccaggaguaugcuagaaagcugaagcggcuugagaaaaugaaggagauccgcgagcagagaaucaaauccgggcgggacggaagcggcgggucuagaggcaagcgcgaaggauccgccagcggcgauucugggcagaauuacuccgcgagcucuaaaggagagcggcucagcgccagacugcgcgcucugccuggcaccaacgaacccuacgaguccagcucuaauaaggagauugacgccuccuaugucgacccucucgggccccaaaucgaaagaccuaagacagcugccaaaaagcggauugaugaggacgauuucgccgacgaagaacugggagaugaccuucugcccgaauga

SEQ ID NO: 70640 - RNA, 1020 nt, Artificial Sequence
  derived and/or modified sequence opt5 from IGBP1__Homo_sapiens__NP_001542
auggccgcugaggacgaacugcagcuccccagacugccugagcuuuucgaaaccggccggcaacugcucgaugagguggaagucgccacagagccggcggggagccgcaucguucaggagaagguguucaaaggacuggaccuucuggaaaaggcugccgagaugcucucccagcuggaucuguucucuagaaacgaagaccucgaggagauugccagcacggaucugaaauaccuucuggugcccgcuuuucagggcgcccucaccaugaagcaagucaauccuuccaaacggcuggaccaccuucagcgcgcuagagaacauuucaucaacuaucugacacagugccacuguuaccauguggccgaguuugaacuccccaagaccaugaauaacucugcggagaaucacacagccaacagcuccauggcuuauccuucucugguugccauggcuagccagcggcaagccaagauucagcgcuacaaacagaagaaagaacuggagcauagacucuccgcgaugaaaagcgccguggagucugggcaggcugaugacgaacggguccgcgaguauuaccugcuucaucugcaaagauggaucgauauuucccucgaagagaucgaaagcaucgaccaggagauuaagauccugcgggagcgcgauucuuccagagaagccagcaccucuaauuccagccggcaggagagacccccugugaagccguucauucuuacacgcaacauggcucaagccaagguuuuuggagccggcuaucccucccugccuaccaugacggugucugacugguacgaacagcaccggaaauacggggcucuccccgaucagggaaucgcgaaggccgcuccugaggaauuuagaaaagccgcccagcaacaggaggagcaggaagagaaggaagaggaggacgacgaacagacccugcaccgcgcucgggagugggaugacuggaaagauacacaccccagaggcuauggcaaucgccaaaacaugggguga

SEQ ID NO: 70641 - RNA, 2445 nt, Artificial Sequence
  derived and/or modified sequence opt5 from IGDCC3__Homo_sapiens__NP_004875
auggccgugcagagagcugccagcccccggcgcccuccggcgccccuguggccuagacuccugcuuccccugcuccugcuucugcucccugcucccuccgagggccuggggcacucugccgaacuggccuucgcugucgagccuagcgacgauguugccgugccgggacaacccaucgugcucgacugccgggucgaaggcaccccucccgugcgcauuacauggagaaagaacgggguugagcugccugaauccacgcauucuacccuucuggcuaauggaagccucaugauccggcacuuucgccuggagcccggcggguccccgucugaugagggagacuacgaauguguggcccagaacagauucggccuugucgugagccggaaagcgcgcauucaggccgcuacaauguccgauuuucauguucacccucaggccaccgugggcgaggaagggggagucgcuagauuccaaugccagauccauggccugcccaagccucucauuacaugggagaaaaaucgggugcccaucgacaccgauaacgagcgcuauacacugcugcccaagggggugcuccagaucaccggacugagagccgaagacggcgggauuuuucacugugucgcgagcaauaucgccucuauucggaucucccacggagcucgccuuacgguuagcggcucuggcuccggggccuacaaagagccugcuauucuggugggaccggaaaaccucacccugacagugcaucagaccgccguccuugagugcguggccacaggcaaucccagaccuaucguuagcuggucucggcuggaugggagacccauuggaguggaaggcauccaaguccucgggaccggaaaccugaucauuuccgacgugacgguucagcacagcggcguguaugucugugcugcgaaucgcccuggcacacgggugagacgcaccgcccaggggcggcuggucgugcaggcucccgccgaguucguucaacauccgcaguccaucucuagaccugccggaacaaccgcuauguuuaccugccaggcccaaggcgagcccccuccccacgugacauggcucaagaacgggcagguccugggaccuggcgggcacgugcgccuuaagaauaacaauagcacgcugaccauuuccggcaucggacccgaagaugaggcgauuuaccaguguguugcugaaaacagcgccgggucuucccaggccagcgcucggcucacagugcugugggccgaggggcuuccgggaccucccagaaauguccgcgcugugucugugagcuccaccgaaguucgggucucuuggagcgagccccuggccaacacaaaagagaucaucggcuaugugcuccauauuagaaaggcggccgacccuccggaacuggaguaccaagaagcuguguccaaaagcaccuuccagcaccuggucucugaucucgagcccuccacggccuauagcuuuuacaucaaggcuuacacaccucgcggggccucuuccgcgagcgugcccacccuggccuccacccuuggagaagcuccugcucccccuccccugucuguucgggugcucggcagcuccucucugcagcugcuuugggagccguggccuagacucgcccagcaugagggcggcuucaaacuguuuuaucggcccgccagcaagacauccuucaccggaccuauucugcuccccggcacagucagcucuuacaaccugucccaacuugacccgacggccguguaugaaguuaagcugcucgcuuacaaucagcacggggacggaaacgcgaccgugcgcuuugucagccugagaggcgccucugagcggacagcucuguccccucccugcgauuguagaaaagaagaggccgccaaucagaccagcacaaccgggaucgugauuggaauccauaucggcguuacgugcauuaucuucugugugcuuuuccuccuguuugggcagcgcggccggguccugcucugcaaggacguggagaaccaacugucuccuccccagggacccagaagccagcgcgauccuggcauucuugcucugaauggggccagacggggacagcgcggccaacucgggagagacgaaaaacggguggauaugaaggagcuggaacagcuguucccgcccgcguccgcugccggacagccugacccccgcccuacccaagaucccgccgcuccugccccgugcgaggaaacacagcuuagcguccucccccugcagggcugugggcugauggagggcaaaaccacagaggcgaagaccacggaagcuacagccccuugcgccggacucgcugccgcucccccucccccggacggcgggccuggacugcuuucugagggccaggccuccagacccgcggccgcucggguuacccaacccgcccacagcgaacaguga

SEQ ID NO: 70642 - RNA, 462 nt, Artificial Sequence
  derived and/or modified sequence opt5 from IGF1__Homo_sapiens__NP_000609
augggcaagaucagcucccugcccacccagcuuuucaaaugcuguuuuugcgacuuccugaaggugaaaaugcacacaaugucuagcucccaucucuuuuaccuggcccucugucugcuuacguucaccucuagcgcuacagccgggccugagacccugugcggagcggaacucgucgaugcucugcaauuuguuuguggcgacagaggguucuauuuuaacaagccgacaggauacggcuccucuagccggcgcgcuccccagaccgggauuguggaugagugcuguuucagauccugcgaccugcggcgccucgaaauguauugugccccucugaaacccgccaagagcgccagaucugugcgggcucagcgccacacagauaugccuaagacccagaaagagguccaucuuaagaaugccuccagaggaagcgcgggcaacaaaaauuaccggauguga

SEQ ID NO: 70643 - RNA, 4104 nt, Artificial Sequence
  derived and/or modified sequence opt5 from IGF1R__Homo_sapiens__NP_000866
augaaaagcggcuccgggggaggcucucccaccagccugugggggcuccuguuccuuuccgccgcucugucucucuggccuacaagcggagagaucugcggcccggggauugacaucagaaacgauuaccagcaacugaagcggcuugaaaauuguacggugauugagggauaucugcacauccuccugauuuccaaggccgaagacuaccgcucuuauagauuucccaaacugaccgucaucacagaguaccuccugcuuuuccggguugcgggccuggaaagccucggcgaucuguuuccuaaccuuaccgugauccgcggguggaagcuguucuauaauuacgcucucgugauuuuugagaugacaaaccugaaagacaucggacuguauaaucucagaaacauuacccggggcgccauccgcauugagaagaaugccgaucugugcuaccuuuccacagucgacuggagccugauccucgaugcugugucuaacaauuacauuguugggaacaagcccccuaaagaauguggagaccugugccccggcaccauggaggaaaagccuaugugugagaaaacgaccaucaauaacgaguauaauuacagaugcuggacaaccaaccggugucagaagaugugcccguccacaugugggaaacgcgccugcaccgaaaauaacgaguguugccaucccgaaugccuuggaagcuguucugcuccugauaacgacacggccugcguggcguguagacacuauuacuaugccggcgucugcgugcccgcuuguccucccaauacauaccgguucgagggcuggcgcugcguugauagagacuuuugugccaacauccuguccgcugaaagcucugauuccgagggguucgugauucaugacggagagugcaugcaggaauguccgagcggcuuuauccggaaugggucccagucuauguauugcauuccuugugagggacccugcccuaaggucugcgaagaggaaaagaaaaccaagacaaucgacagcgugaccuccgcccaaaugcuccagggcuguaccauuuucaaagggaaccugcugaucaauauccgcagaggaaacaauauugcgagcgagcucgagaacuuuaugggccugaucgaaguggucacaggcuacguuaagauucggcacucucaugcccuugugucccugagcuuccucaaaaaucugagacuuauccugggggaggaacagcucgagggaaacuacucuuuuuaugugcuggauaaucagaaccugcaacagcucugggacugggaucaccgcaaucugacgauuaaggcuggcaaaauguacuucgccuucaaccccaaacuuugcgucagcgaaaucuaucggauggaggaggugaccgggacaaagggaagacaguccaagggcgacaucaauacccgcaacaacggggaacgggcuucuugugagagcgauguucugcacuuuacauccaccacgacaagcaagaauagaauuaucauuaccuggcaucgcuaccggcccccugacuauagagaucucaucucuuucaccguguacuauaaagaagccccguuuaagaacgucacagaguacgacggccaggaugccugcggauccaauagcuggaacaugguggacguugaucugcccccuaauaaagacguggagcccggcauucugcuucacgggcucaagccuuggacccaauacgcugucuaugugaaggcggucacacugacgaugguggaaaacgaccauauccgcggagccaaaucugagauucuguacauccggaccaaugcuuccguucccagcaucccgcucgaugugcuguccgccucuaacagcuccucucagcuuauugucaaguggaauccucccagccugccuaacggcaaucucuccuauuacaucgugagauggcagcgccaaccccaggacggguaucuguaccggcacaacuauuguagcaaagauaagauuccuaucagaaaauacgccgacggaacaauugauaucgaagagguuaccgaaaaucccaagacagaggugugcggcggggagaagggcccguguugcgcuuguccuaaaaccgaagccgagaagcaggcggaaaaagaggaagcugaguaccggaaggucuucgagaacuuucugcacaauucuaucuucgugccccgccccgaaagaaaacggagagacgugaugcagguugccaacacgaccauguccagccgcucucggaacacaaccgccgcugauacauauaauauuaccgacccugaggaacuugagacggaauacccguuuuucgaguccagagucgauaacaaggagcgcacagugaucagcaaucucagacccuuuacccuguaucggauugacauccauucuugcaaccacgaagccgagaagcugggauguagcgcuuccaauuucguguuugcccgcacaaugccugcggaaggcgccgaugacauucccgggccugucaccugggagcccagaccugagaacagcaucuuccucaaauggcccgaaccggagaauccuaacggacugauccuuauguacgaaauuaaguauggcucucaaguggaggaucagcgggaaugcguuucccgccaggaguacagaaaauaugggggagcuaagcugaaucggcucaaccccggcaauuacaccgcccgcauccaggcuacaagccuguccgggaacggcucuuggacggacccuguguuuuucuacguccaagccaaaaccggauaugagaauuucauucaucugaucauugcgcuucccguggccguucuccugaucgugggcgggcuggucaucaugcucuacguguuucacagaaagcggaacaauagccgccugggaaacggcguucuuuaugcuuccgugaacccggaauacuucucugccgcugacgucuaugugccugaugagugggaaguggccagagagaaaauuacaaugagccgggaacuggggcagggauccuuuggcauggucuacgaggggguugccaagggcguggugaaggacgagcccgaaaccagagucgcuaucaaaacagugaaugaggcggccucuaugcgcgaacggauugaguuccucaacgaagcuagcguuaugaaggaguuuaauugccaucacguggucagacugcugggagugguuucccagggccagccuacccuugugaucauggagcucaugacgcgcggggaucugaaaagcuaucugcggucucucagacccgaaauggagaacaaucccguccuggccccuccgucccuuagcaagaugauucaaauggccggagaaaucgcugacggcauggccuaccugaacgcgaauaaauucgugcaccgcgaucucgcugcccggaacuguaugguugccgaggacuuuacagugaagauuggggauuucggaaugaccagagacaucuacgagaccgauuauuaccgcaagggcggcaaagggcugcugcccguccgguggaugucuccugaaucccuuaaggacggaguguuuacaaccuauagcgauguguggucuuucggcgucguucugugggagaucgcuacacucgccgaacagcccuaccaggggcuguccaaugaacaggugcucagauuugugauggaaggaggccugcuugacaaaccugauaacugccccgacaugcuguucgagcucaugcggauguguuggcaauauaauccuaagaugcgcccgagcuuucuggagauuaucuccagcauuaaagaagagauggaacccggguucagagaggucucuuucuacuauagcgaagagaacaagcugccugagcccgaggagcuugaccuggaaccugagaauauggaauccgugccccucgauccgucugcgagcuccucuagccugccucuccccgaccggcauuccggacacaaggcugagaacggccccggcccugggguucuggugcuucgcgccucuuuugaugagagacagcccuacgcccauaugaauggaggccggaaaaacgaaagagcucugccucucccgcagagcuccacgugcuga

SEQ ID NO: 70644 - RNA, 1317 nt, Artificial Sequence
  derived and/or modified sequence opt5 from IGF2BP1__Homo_sapiens__NP_001153895
augaacaagcuguacaucggcaaucucaacgagagcgugacccccgccgaccuggaaaaagucuucgcugagcacaagauuuccuauucugggcaguuucuuguuaaaagcggauacgccuucguggauugcccugacgaacauugggcgaugaaggcuaucgagacauuuuccggcaaaguggaacugcaagggaagagacucgagauugagcacucugucccgaagaaacagcggagccgcaagauccagauuagaaauauucccccucagcugcggugggaagugcuugauucccugcucgcccaauauggaacgguugagaacugugaacaggugaauaccgagucugagacagccgucgugaacguuaccuacagcaaucgcgaacagacaagacaggcugacgaggugccccugaaaauccuggcccauaacaauuucgucggccggcucaucgggaaggaaggacgcaaccugaaaaagguggagcaagauaccgaaacaaagaucaccauuuccagccuucaggaccugacgcucuauaauccugagagaaccaucacagugaaaggcgcuauugagaacugcugucgggccgaacaggagaucaugaagaaaguccgcgaagcguacgagaaugauguugccgcuaugucucugcagucccaccuuauucccggccugaaccucgccgcuguggggcuguuuccugccucuagcuccgcggugccgcccccucccagcucugucaccggagccgcuccuuauuccagcuucaugcaagcccccgaacaggagauggugcagguuuuuaucccggcucaagccgugggcgccaucauugggaagaaaggacagcauaucaagcagcuguccagauucgcuucugcgagcauuaaaaucgccccucccgagacaccugacuccaagguccggauggugauuaucaccggcccucccgaagcucaguuuaaggcccaagggcgcaucuacggaaaacucaaggaggaaaauuucuuuggccccaaagaggaaguuaagcuggagacgcacauuagagugccggccagcgcugccggccgggucaucgggaaaggaggcaagacagugaacgagcuucagaaccugaccgcggcugaagucgugguuccccgcgaucagacaccugacgagaaugaucaggugauugucaagaucauugggcacuucuacgccucucaaauggcccagagaaaaauccgggacauccucgcucaggugaagcagcaacaucagaaaggacaguccaaccaggcccaagcuagacgcaaguga

SEQ ID NO: 70645 - RNA, 1671 nt, Artificial Sequence
  derived and/or modified sequence opt5 from IGF2BP2__Homo_sapiens__NP_001007226
augaugaacaagcuguacaucggcaaucucagccccgccgugaccgcugacgaucugagacagcuuuucggggaccggaaacugccucucgccggacaaguccugcuuaaguccggcuaugcguuuguugauuacccggaccagaacugggcuauucgcgccaucgagacacugucugggaaaguggaacuccauggaaagauuauggagguggauuauagcgucuccaaaaagcugagaucucggaagauccagauucgcaauaucccgccucaucugcagugggaagugcucgacggccugcuugcccaauacgggacgguugagaacguggaacaggucaauaccgauacagagaccgcugugguuaacgugacauaugccaccagagaggaagcuaaaaucgccauggagaagcugagcggacaccaguucgaaaauuacuccuuuaaaauuucuuauauccccgacgaggaggucagcuccccuucucccccucagcgggcgcaacgcggcgaucauagcuccagagaacagggccacgcccccgggggaacaagccaggcucggcagauugacuucccccuccgcauccuggugccuacccaauuugugggcgccauuaucgggaaggagggacuuacgauuaaaaacaucaccaagcagacacagucuagagucgauauccaucggaaggaaaauuccggcgcugccgagaaacccguuaccauucacgcgacaccugaagggaccagcgaggccugccgcaugauccuggagauuaugcaaaaggaagcugacgagacgaaacucgccgaagagaucccccugaagauucuggcucacaacggacucgugggcagacugaucggcaaagaagggcggaaucuuaagaaaaucgagcaugagacaggaaccaagauuacaaucucuucccugcaggaucucagcauuuacaacccggaacgcaccaucaccgugaagggcacagucgaggccugugccuccgcugaaauugagaucaugaaaaagcugagagaagcguucgagaaugacaugcuugccgugaacacgcacucuggguacuuuagcucccuguauccucaucaccaguucggacccuuuccucaccaucacagcuaccccgagcaggaaaucguuaaucucuucauucccacccaagcugugggcgccaucauugggaaaaagggagcccauaucaaacagcuggcucgguuugccggcgcgucuauuaagaucgcuccugccgagggcccggacgucuccgaaagaauggugauuaucacagggcccccugaggcccaguucaaggcucagggacgcaucuuuggcaaacugaaggaggaaaacuucuucaaccccaaagaggaaguuaagcucgaggcccacauucgggugccuagcucuaccgcugggagagucaucggaaaaggcgggaagacagugaaugaacugcaaaaccuuaccagcgccgaggucauugugccccgcgaucagacgccggacgagaaugaagagguuaucgugcggauuaucggccacuuuuucgcgucccagacagcccagagaaagauccgcgaaauuguccaacaggugaaacagcaggagcaaaaguauccucagggaguugcuucucagcggagcaaauga

SEQ ID NO: 70646 - RNA, 1740 nt, Artificial Sequence
  derived and/or modified sequence opt5 from IGF2BP3__Homo_sapiens__NP_006538
augaacaagcuguacaucggcaaucucagcgagaacgccgcucccuccgaccuggaaucuauuuucaaagaugccaagaucccugugagcgggccguuucuugucaaaaccggauaugcguucguugacugccccgaugaguccugggcucugaaggccauugaagcccucucuggcaaaaucgagcugcacgggaagccuauugaaguggagcauagcgugcccaagagacagcggauccgcaaacuucaaaucagaaauauuccuccccaccuucagugggagguccucgacucccugcuggugcaguacggaguuguggaaucuugugagcaggucaacacagauagcgaaacggcugugguuaaugugaccuauuccagcaaggaccaagcccggcaggcucucgauaaacugaacggcuuucagcuugagaauuucacacugaaggucgccuacaucccugacgagauggcggcccagcaaaacccgcuccagcagccccgcgggagacggggacugggccagcgcgggucuuccagacaaggcagcccuggaucuguguccaaacagaagcccugcgaucuuccucugcggcuccuggugcccacccaguuugucggcgcuauuaucgggaaggaaggagccacaauucgcaauaucaccaaacaaacacagagcaagauugacguucauagaaaagagaacgcuggcgccgcggaaaagucuaucaccauccuguccacgccggaggggaccagcgccgcuuguaaauccauucucgaaaucaugcacaaggaggcccaggauauuaaauucacagaggaaaucccucugaagauucuugcucauaauaacuuugugggacggcugaucggcaaggagggccgcaaucucaaaaagaucgaacaggacaccgauacaaaaauuaccaucucuccccugcaagagcuuacgcuguauaacccugaaagaacaauuaccgugaaggggaaugucgagacaugcgccaaagccgaggaagagaucaugaagaagauucgggaaagcuacgagaacgacaucgcuuccaugaaccuccaggcgcaccugauccccggacugaaucucaacgcccugggccuuuuucccccuaccagcgggaugccgcccccuaccucuggacccccuuccgcuaugacacccccguauccucaguucgaacagagcgagacggagaccgugcaccuguucauucccgcccucucuguuggcgccaucauugggaaacaaggacagcauaucaagcagcugagccgcuuugcuggcgccuccauuaaaaucgcgccugcugaagcccccgacgccaaggugagaauggucauuaucacaggcccucccgaggcucaguucaaagcccaagggcggaucuacggaaagauuaaggaagagaauuuugugucuccgaaagaggaaguuaagcuggaggcucacaucagagugccuagcuucgccgcgggccgcgucauugggaaaggaggcaagaccgugaacgaacugcagaaucucuccagcgccgaggucgugguuccccgggaucagacacccgacgaaaacgaucagguggucgugaaaaucaccgggcauuucuacgcuugucaaguugcccagagaaagauucaggagauccugacgcaagugaagcagcaccagcagcaaaaagcucugcagucuggcccuccgcagucccgccggaaguga

SEQ ID NO: 70647 - RNA, 711 nt, Artificial Sequence
  derived and/or modified sequence opt5 from IGF2__Homo_sapiens__NP_001121070
auggugagccccgacccucagaucauugucguugccccggagaccgaacuggcuuccaugcaagugcagagaacagaggauggcgugacgaucauucagaucuucugggucgggcggaagggagaacuccugcgcagaacccccgugucuagcgccaugcagacaccuaugggcauucccauggggaaauccaugcuuguucugcucaccuuucuggcguucgcuucuugcuguaucgccgccuaccggccuagcgagacacuuugcggaggcgaacugguggacacccuccaauuugucuguggggaucgcggauucuauuuuuccagacccgcuucucgggugagccgcagaucccggggcaucguugaggagugcuguuuccgcagcugcgaccuggcccugcucgaaacauacugugcuaccccugccaagucugagagagauguguccacgccgcccaccguccugccugacaacuuuccccgguauccugugggcaaauucuuucaguacgauacauggaagcagagcacccagcgccuuagacgggggcugcccgcgcuccugcgcgccagacggggacacgugcuugcuaaagaacuggaggccuucagagaggcuaagcgccaucggccgcucauugcccugccuacacaagaccccgcgcacggcggggccccucccgaaauggcuucuaauagaaaguga

SEQ ID NO: 70648 - RNA, 7476 nt, Artificial Sequence
  derived and/or modified sequence opt5 from IGF2R__Homo_sapiens__NP_000867
augggagccgcugccgggagaagcccccaccugggaccugcgccggcucggcgcccccagagaucccuccugcuucugcagcuccugcuucugguggccgccccuggcucuacccaggcucaggccgcucccuucccugagcucugcagcuacaccugggaagccgucgacacgaagaacaauguucuguauaaaaucaacauuugcggguccguggacaucgugcagugcggacccucuagcgcggucugcaugcaugaccugaagacccggaccuaccacuccgugggcgauucuguucuccgcagcgccaccagaucccugcuugaauuuaauacaaccgugagcugcgaccaacaggggacaaaccaucggguccagucuuccauugcuuuccuguguggaaaaacccucggcacgccugaauuugugaccgccacagagugcguucacuauuucgaauggcgcaccacagcugccuguaagaaagauaucuuuaaggcgaauaaggaggugccgugcuacgucuucgacgaggaacugagaaaacaugaucuuaacccccugauuaagcucagcggcgccuaucugguggacgauucugacccugauaccucccuguuuaucaaugugugucgggacaucgauacgcuccgcgaccccgggagccagcugagagcuugcccucccggaacagccgcuugucuuguccggggccaccaagccuucgacguugggcagccgcgcgauggacugaaacucgugagaaaggaccggcuggugcuuucuuacguccgcgaggaagccggcaaacuggauuuuugcgacgggcacuccccugcugugaccauuacauucguuugccccagcgagagacgggagggaaccaucccuaagcucaccgcgaaguccaacuguagauaugaaauugaguggaucacagaauacgccugccaucgcgauuaccuggagucuaaaacguguagccuguccggcgaacagcaggacgugagcauugaucucacaccccucgcucaaucuggcggguccagcuauaucucugacggaaaggaguaccucuuuuaucugaaugucugcggcgagacagaaauucaguucuguaacaaaaagcaggccgccgugugccaaguuaaaaagagcgauaccucccaggugaaagcugccgggcgguaccacaaucagacacucagauauucugacggagaucugacccuuaucuacuuuggcggggacgaguguagcuccggauuccagcgcaugagcgucaucaacuucgaaugcaauaagacggcgggcaacgacggcaaggggacacccguguuuaccggagaggucgauuguaccuauuucuuuacaugggacaccgaauacgcuugcgugaaagagaaggaggaucugcucuguggcgccacagacgggaaaaagcgguacgaucugucugcccugguuagacaugcugaaccugagcaaaauugggaagccguggacggaucccagacggagaccgagaaaaagcacuucuuuauuaacaucugccaccgcguccuccaggagggcaaggcucgggggugcccggaggaugccgcggugugugccguugacaaaaacggcagcaagaaucugggaaaauucauuucuucccccaugaaggaaaaaggcaacauccagcuuagcuauuccgauggggacgauugcggacauggcaagaagauuaaaacaaauaucacccugguguguaagccuggggaccucgagucugcucccguccugagaacaagcggagaaggcgggugcuuuuacgaguucgaguggcacaccgccgcugccugugugcuguccaaaacggaaggcgagaacugcaccguguuugauucucaagcgggauucagcuuugaccuuuccccucucacaaagaaaaauggcgccuauaagguugaaaccaagaaauacgacuucuauaucaacgucugugggcccgugagcgugucuccgugccagccugauuccggagcuugucaggucgccaagagcgacgagaaaacauggaaucugggccugucuaacgcuaagcucuccuacuaugaugggaugauucagcugaauuaccgcggaggcacccccuacaacaaugaacggcauacgccuagagccacacuuaucaccuuucugugcgaccgcgaugccggggugggcuuccccgaguaucaagaggaagacaacagcacauacaauuuccggugguauaccucuuacgcuuguccugaggaaccccucgagugcguugugaccgauccgagcacacuggaacaguaugaccuguccagccuugcgaaaucugagggaggccucgggggaaacugguacgccauggauaauuccggcgagcacgucacguggagaaaguauuacauuaacgugugccggccucugaaccccguucccggguguaaucgcuacgcuagcgccugccagaugaaauaugaaaaggaccagggauccuuuaccgagguggucucuaucagcaaccugggcauggccaagacagggccugugguugaagauuccggcucucuccugcuugaguacgugaauggaagcgcuuguaccacauccgacggcagacaaaccacguauacaacccggauucaucuggucugcucuagagggcgccucaacagccacccgaucuucucccugaauugggaauguguggugagcuuucuguggaacaccgaggccgcgugccccauccagacaaccacagauacggaccaggcuuguucuauucgggacccuaauuccggauucgucuuuaaccuuaauccccucaacagcucucaaggcuacaauguuuccgggaucggaaaaauuuucauguuuaacgugugcggcaccaugccuguguguggcacaauccuggggaagcccgccagcggaugcgaggccgaaacccagacagaggaacugaaaaauuggaagccugcuagacccgucggcauugagaaaucucuccagcuguccaccgagggguucaucacgcuuaccuauaagggaccgcugagcgccaagggcacagcggaugcuuuuauugugcgcuucguuuguaacgacgauguguacuccgggccucucaaauuucugcaccaggacaucgauagcggacaaggcaucagaaauaccuauuucgaauuugagacagcccuggccugcguccccucuccuguggacugccagguuaccgaucuugcuggcaacgaauacgaccucacagggcugagcaccgugcggaagcccuggacggccgucgauacauccguggacggacgcaaaagaaccuucuaccugucuguuuguaacccgcucccuuauauucccggcugccaggggagcgcugugggauccugucuggucucugagggcaauagcuggaaccuugggguggugcagauguccccucaagccgcggccaauggaucucugagcaucauguacgucaacggcgauaagugcggcaaucagcgguucuccacccgcauuacauuugaaugugcucagaucagcgggucucccgccuuccagcuccaagacggaugcgaguauguuuuuauuuggagaaccguggaggcuugucccgugguccggguggaaggcgacaacugcgagguuaaagauccucgccaugggaaucuguacgaccugaagccgcuuggacugaacgauacgaucguguccgccggcgaauauacauacuauuucagagucugugggaagcucagcucugacgugugccccaccuccgauaaaagcaagguuguguccucuugucaggagaaacgggaaccucagggauuucacaaggucgccggccugcucacacaaaaacugaccuacgagaauggccuucugaagaugaacuucacagggggagauaccugccauaagguguaccagcgcagcacggcuaucuuuuucuauugcgauagaggcacccagcggcccgucuuucucaaagagacauccgacuguagcuaccuguucgaauggagaacccaguaugcgugcccucccuuugaucugacagaguguucuuucaaggacggggccggaaauuccuucgaucuuagcucucugagccgcuacuccgacaacugggaagcuauuaccggcacgggggauccugagcacuaucucaucaaugugugcaaaucucuggccccgcaagccggaacagaacccuguccucccgaggcugccgcgugccuccugggcggcagcaagccuguuaaccuugggcgggugagagacggaccccaguggcgcgacggcauuaucguccugaaauacguggauggggaccucuguccggauggcauucggaagaaauccaccacaaucagauuuaccugcucugagagccagguuaauucccgcccuauguucaucagcgcuguggaagacugugaguauaccuuugccuggcccacagccacggcuugccccaugaagucuaacgaacacgaugacugucaggucaccaacccuuccacaggccaucuguucgaucugagcucccuuucugggcgggccggauuuaccgcggcuuacagcgagaagggccugguguacauguccauuugcggcgagaaugaaaacugucccccuggggugggagccuguuucggccaaacaagaaucucuguugggaaagccaauaagcgccuccgguaugucgaccaggugcugcagcucguguacaaagauggaagcccgugccccuccaagagcggccugucuuauaaauccgucauuagcuuuguguguagaccugaggcugggcccaccaaccggccuaugcuuaucucucuggacaagcagacgugcacacuguucuuuuccuggcacacaccccuugccugugaacaagcuaccgagugcagcguucgcaauggaucuagcauuguggaucuguccccgcuuauccauagaacaggcggcuacgaagccuaugacgagucugaggaugacgcgagcgacaccaacccugauuucuacaucaauauuugucagccccugaacccuaugcacgggguccccugcccugccggagcugccguguguaagguucccaucgacggcccgccuauugauaucgggcggguggcuggaccgcccauucucaauccuaucgccaacgaaauuuaucugaauuuugaguccagcacaccgugccucgccgacaaacauuucaacuacacgucccugaucgcuuuucacuguaagcgcggcgucucuauggggacccccaaacuucugagaacaagcgaaugcgauuucguguucgagugggaaaccccuguugugugucccgacgagguccggauggauggcugcacacugaccgacgagcagcuccuguacuccuuuaaucuuucuagccuguccacgucuaccuucaaggugacaagagauagccgcaccuauuccgugggagucugcacauuugcgguuggcccugaacaagggggauguaaagacggcggggugugccuccugagcggaaccaagggcgccucuuucgggcggcuccaauccaugaagcuggauuacagacaccaggacgaggcugugguccuuagcuaugugaacggcgaccgcugucccccugaaacagaugacggaguuccgugcguguuucccuucaucuuuaauggcaaaucuuacgaggaauguauuaucgagucccgggccaagcuguggugcagcacgaccgccgauuaugacagagaucaugaguggggguucugucgccacucuaacuccuaccggacaagcuccauuaucuuuaaaugcgacgaagaugaggacauuggaagaccucaggucuucagcgaagugcgcggcugugauguuaccuuugaguggaagaccaaaguggucugucccccuaagaagcuggaguguaaauucgugcaaaagcauaaaacauaugaccucagacugcuuucuagccugacgggguccuggucucucguccacaauggagugagcuacuacaucaaccugugccagaagaucuauaaaggcccccucgggugcuccgaacgggcuucuauuugucgcagaaccacaaccggcgauguucaggugcugggacuugugcauacacagaagcugggcgucaucggggacaagguuguggugaccuacagcaaaggauauccgugcggcgggaacaagacggccuccucugucauugagcugacauguaccaaaaccgugggacggccugcguuuaagcgcuucgauaucgacagcugcacauacuauuucuccugggacagcagagcugccugugccguuaaaccccaagaagugcagauggucaauggcaccauuacaaaccccaucaauggcaagucuuuuucccucggggauaucuacuucaaacuguuucgggcuagcggagacaugagaaccaacggcgauaauuaucuuuacgagauucagcugucuuccaucacgagcucccgcaacccugccugcucuggggcgaauauuugucaggugaagcccaacgaccaacacuucagccggaaggucggaacauccgauaaaaccaaguacuaucuccaggacggcgaucuggacgugguuuuugccuccucuagcaaaugcgggaaggauaaaacaaagagcgugucuagcaccaucuucuuucacugugacccucuggucgaagauggcauucccgaguucucccaugagacggcugacugccaguaccucuuuucuugguauaccagcgccguguguccccuuggaguuggcuucgacuccgaaaauccuggggaugacggacagaugcacaagggccugucugagagaagccaagcugugggggccguccugucccuccugcuuguggcucugacaugcugccuccuggcccugcuccuuuacaaaaaggaacgccgggagaccgugaucagcaaacugacaaccuguugcagacggucuuccaacguuagcuauaaguacuccaaagucaauaaggaagaggagacagaugaaaacgagaccgaauggcugauggaggaaauucagcugcccccuccccgccagggaaaggagggccaagagaaugggcauaucacgacaaaaucugugaaggcgcugagcucccuucacggagacgaucaggacucugaagaugaggugcugaccaucccggaagucaaaguucacagcggcagaggcgccggggcugaguccagccauccugugcggaacgcccagucuaaugcucuccaggagcgcgaagacgauagagugggacugguccggggcgagaaggcccgcaaagggaaguccagcucugcccaacagaagaccguguccagcacaaaacugguuucuuuucacgacgauuccgacgaagaucuccuucauauuuga

SEQ ID NO: 70649 - RNA, 1932 nt, Artificial Sequence
  derived and/or modified sequence opt5 from IGFALS__Homo_sapiens__NP_001139478
auggcccugagaaaggcuggcgaccucgagccccaguucaccccugaacggcgcuuuagacugugcugguaccaagcccacagcgggcgggcgcuucugggaccgcccccucaggcuucucccccugccggcgggcucgcccuggcccuucugcuccuguccuggguggcccugggaccccgcagccucgagggcgcugauccugggacaccgggagaagccgagggccccgcguguccugccgcuugcgucuguuccuaugacgaugacgccgaugaacugucuguuuucugcagcuccagaaaccuuacgcggcugcccgacggcgugccugggggaacccaggcucucuggcuggauggcaauaaccuuucuagcgugcccccggccgcguuucagaaucuguccagccucggguuccugaaccugcaaggaggccagcucgggucucuggagccucaggcccuucugggacucgagaaucugugucaucuucaccuggaacgcaaccagcucagaucccuggcucugggcacauuugcccauacccccgcucucgccagccugggccuuucuaauaaccggcugucccgccucgaggacgggcuguucgaaggacuuggcagccugugggaucucaaucugggguggaacucucuggccguccucccugacgcugcguuuagaggacugggcucccuucgggagcuggugcucgccgggaaucgccuggcuuaccugcaacccgcccuuuucagcggacucgccgagcugagagaacuggaucucucccggaacgcucugcgcgccaucaaagcgaauguuuuugugcagcuucccagacugcagaagcucuaucuggaccggaaccugauugcugccgucgccccuggcgcuuuccuuggccucaaagcccugagauggcuggaucucucucacaaucgcguggcugggcugcuugaggacacauuuccgggacugcucggccugcggguucugagacuuagccauaacgccaucgcgucccuccgcccccggaccuucaaggaccugcacuuucuggaggaacuccagcuggggcacaaccgcauuagacaacuugccgaacggagcuucgagggacugggccagcucgaggugcugacacuggaucauaaucagcuucaagaagucaaagcuggggccuuccucggccugaccaacguggcugugaugaaucugucuggaaacugccucagaaaucugccugagcaggucuuucgcggccuugggaagcugcacucccuccaucuggaaggaagcugucugggccggaucagaccccacacguucaccgggcuuucuggacugcgccggcucuuucugaaggacaacggccucguugggauugaggaacagagccuguggggccuugccgagcugcucgagcuggaucugacauccaaucagcuuacccaucugccucacagacucuuccaaggacugggcaaacucgaauaccugcuucugucucggaaccgccucgcggagcugcccgccgacgcucuggggccgcuucagagagccuuuuggcuggaugugagccacaaucggcucgaagcucugccuaacucccuccuggcuccccuuggaagacugcgcuaucugagccuccggaauaacucucugagaacauucaccccucagcccccuggccuugagcgccuguggcucgaagggaaucccugggacugcggauguccgcugaaggcccucagagauuuugcucugcagaacccuuccgcggugccccgguucguccaagccaucugcgagggcgacgauugucagcccccugcuuacacguauaauaacaucacaugcgccagcccgcccgaggugguugggcuugaccugcgcgaucugucugaagcccauuuugcuccuugcuga

SEQ ID NO: 70650 - RNA, 780 nt, Artificial Sequence
  derived and/or modified sequence opt5 from IGFBP1__Homo_sapiens__NP_000587
augagcgaggugcccgucgccagaguuuggcuggugcuccugcuucugaccgugcaggucggcgugacagcuggggccccuuggcaaugcgcgccguguuccgcugaaaagcucgcccugugucccccuguuucugccagcugcuccgaggugacgcggucugcuggaugcggcuguugccccaugugugcccuuccucugggggcugccugcggagucgcgaccgcccgcugugcuagaggccucagcugccgggcccugcccggggaacagcagccucugcacgcucucacacgcggacagggcgccugugugcaagaguccgacgcgucugccccgcaugcugccgaagcuggcagccccgaguccccugagagcaccgaaaucacagaggaggaacugcuugauaacuuccaccugauggcccccucugaggaagaccauuccauucucugggaugccaucagcaccuacgacgggucuaaagcucugcacguuacaaauauuaagaaauggaaggagccuugcagaaucgaacuuuaucggguggucgagucccuggcgaaagcccaggaaaccagcggagaggagauuucuaaguuuuaccuccccaacugcaauaagaacggcuucuaucauucccgccagugugaaacgagcauggauggggaggcuggacugugcugguguguguacccguggaauggcaaaagaaucccugggucccccgaaauccggggagacccuaacugccagauuuauuuuaaugugcaaaacuga

SEQ ID NO: 70651 - RNA, 987 nt, Artificial Sequence
  derived and/or modified sequence opt5 from IGFBP2__Homo_sapiens__NP_000588
augcugcccagagugggcugcccugcccucccgcugcccccucccccucuucugccccuccugccucuucugcuccugcugcucggggcuagcggaggcgggggaggcgcccgggcggagguccuguuccgcuguccgcccugcaccccugaaagacuugcugccugugggcccccucccguugccccgccugcugccguggcugccguggcgggaggcgcccggaugcccugcgcugagcugguccgcgaaccuggcugugggugcuguuccgugugcgccagacucgagggagaggcuuguggcguuuacacaccccggugcgggcagggacugcgcuguuauccccacccuggcucugagcuuccgcugcaagcccucgugaugggggagggaacgugcgaaaagagacgggacgcggaguacggcgccagccccgaacaggucgcugauaacggcgacgaucauuccgaagggggacugguggagaaucacguugacucuaccaugaacaugcugggcgggggaggcagcgccgggcgcaaaccucucaaguccggaaugaaagaacuggcuguguuuagagagaaggucacagaacagcaucggcagaugggcaaaggcgggaagcaccaucuuggacuggaggaacccaagaaacuccgcccucccccggccagaaccccuugccaacaggagcuggaucaggugcuugagcggaucucuacaaugcgccugcccgacgaaagaggcccucucgagcaccuguauagccugcacauucccaauugugauaagcaugggcucuacaaccugaaacagugcaagaugucccuuaauggacaacggggcgaauguuggugcgugaacccuaauaccgggaaacugauccagggcgcccccacaauuagaggagacccggagugucaccucuucuauaacgaacagcaggaggcucgcggcguccauacccaacggaugcaguga

SEQ ID NO: 70652 - RNA, 876 nt, Artificial Sequence
  derived and/or modified sequence opt5 from IGFBP3__Homo_sapiens__NP_000589
augcagagagcccggcccacccugugggcugccgcgcucacacugcuugugcugcuccgcggcccuccggucgcuagagccggggccagcuccgcuggacugggccccguugugcggugcgagccuugugacgcccgcgcucuugcccaaugcgcgcccccucccgccgugugugcugaacuggucagagagccugggugcggauguugccucacgugugcccugucugaaggccagccgugcgggaucuacaccgagcgguguggaagcggccugcgcugccagcccuccccugaugaagcuagaccccuccaggcccugcuugacggccgggggcugugugugaacgcgucugccguuagccgccucagagcuuaucugcuuccugcucccccggccccuggaaaugccuccgagucugaggaagaucggagcgccggcuccguggagagccccucugucuccagcacacaccgcgugucugacccuaaguuccauccccugcacuccaaaauuaucauuaucaagaaagggcaugcuaaggauagccaaagauacaaaguugacuaugaaucucaguccaccgauacacagaacuuuagcuccgagucuaagcgggagaccgaauacggacccugccgcagagagauggaagacacacucaaucaccugaaguuccugaacgugcucagcccucggggcguccauauuccgaauugcgauaaaaagggguuuuauaaaaagaaacaguguagacccuccaagggacgcaagcggggcuucugcugguguguggacaaauacggccaaccucugcccggguauaccacgaagggaaaagaggaugugcacugcuacagcaugcagucuaaguga

SEQ ID NO: 70653 - RNA, 777 nt, Artificial Sequence
  derived and/or modified sequence opt5 from IGFBP4__Homo_sapiens__NP_001543
augcugccccucugccugguggccgcccuucugcucgccgcgggcccugggccgagccugggagacgaggcuauccacugucccccuugcuccgaagagaaacuugccagaugucggcccccugucggcugcgaggaacugguucgcgaacccggguguggaugcugugcuaccugcgcucucggccuggggaugccuuguggaguguacacaccgagaugcggcucuggccugcgguguuaucccccucgcgggguggagaagccccuccauacgcugaugcacggacagggcgucugcauggagcuugccgaaauugaggcuauccaagaaagccugcagccuuccgauaaggacgagggggaucaucccaacaauucuuucagcccgugcuccgcccacgacagacggugucuccagaaacauuuugcgaagauucgcgauagaucuaccagcggaggcaaaaugaaggugaacggggccccucgggaggacgcucgccccguuccucagggauccugccaaagcgaacugcacagagcccuugagcggcuggcugccucucagucccgcacacacgaagaucucuacaucauucccauccccaauugugacagaaacggcaauuuccauccuaagcagugccacccggcgcuggauggccagcgggggaaauguuggugcguggaccgcaagaccggagucaaacugcccggcgggcucgagccuaagggagaacuggauugucaucaacuugccgacagcuuuagagaguga

SEQ ID NO: 70654 - RNA, 819 nt, Artificial Sequence
  derived and/or modified sequence opt5 from IGFBP5__Homo_sapiens__NP_000590
auggugcugcucaccgccguccugcuucugcucgcugccuacgcgggccccgcucagagccugggguccuucguucacugcgagccuugugacgaaaaggcccuuucuaugugcccgcccagcccucugggaugugagcucgugaaagaacccggcugcggguguugcaugacaugugcccuggcugagggacaauccugcggcguguauacggaaagaugugcccaggggcugcggugccucccucgccaggaugaggagaagccccugcaugcccuucugcacggaagaggcgucugucucaacgaaaaaucuuaccgggaacaggugaagaucgagcgcgacagcagagagcaugaggaaccuaccacauccgagauggcugaagagaccuauucuccgaaaauuuuucggcccaagcacacacgcaucagcgaacugaaggcggaggccguuaaaaaggauagacggaaaaagcugacccaauccaaauucgugggcggggcugagaauacagcccauccucgcauuaucagcgcucccgaaaugagacaggagucugaacagggaccuugccggcgccacauggaggccucccuucaggaacucaaggcgagccccagaauggucccgcgggccguguaccugccuaacugcgaccgcaagggcuuuuauaaaagaaagcaauguaaacccucucgggggagaaagcgcggaauuugcugguguguugauaaauacggcaugaagcugccugggauggaguauguggacggagauuuccagugccacaccuuugacuccagcaaugucgaguga

SEQ ID NO: 70655 - RNA, 723 nt, Artificial Sequence
  derived and/or modified sequence opt5 from IGFBP6__Homo_sapiens__NP_002169
augacaccccacagacugcucccuccgcugcuucugcuccuggcccuucugcucgcugccagccccggcggggcgcuggcucggugcccuggauguggccagggggugcaagccggaugccccggcgggugugucgaggaagaggacggaggcuccccugccgaaggcugcgcugaggccgaagggugucugcgcagagagggacaggagugcggcguuuacacccccaacugugcuccugggcuccagugccauccgcccaaggaugacgaagccccucugcgggcgcuucugcucggacgcggcagaugucugcccgcccgggcuccugccguggcugaggaaaaucccaaagagucuaagccgcaggccgggacggcgcgcccucaagaugugaacagacgggaccagcagcgcaaucccggaaccagcacaaccccuucccagcccaacucugccggcguccaagauacagagaugggccccugcagacggcaccuugacagcgugcugcagcagcuccagaccgaaguuuaucgcggggcucaaacacuguacgugccuaauugugaucauagaggauucuaucggaaacgccagugcagauccucucagggccaacggagagggccgugcuggugugucgaccgcaugggaaagagccugcccggcuccccugaugggaacggaucuagcuccugccccaccggcagcucuggcuga

SEQ ID NO: 70656 - RNA, 840 nt, Artificial Sequence
  derived and/or modified sequence opt5 from IGFBP7__Homo_sapiens__NP_001240764
auggagagacccagccugcgggcccuccugcuuggcgcugccgggcugcuccugcuucugcucccucuguccucuagcuccucuagcgauaccugcggaccgugugaacccgcguccugcccuccccugccuccccucggcugucugcuuggggagacacgcgacgcuugcggauguugcccuaugugugccagaggcgaaggggagccgugcggaggcggcggggccggacggggcuacugugcucccgggauggaaugcgugaagucucgcaaaagacggaagggaaaagccggcgcugccgccgggggaccuggcgucagcggcguuugugugugcaagucccgcuaucccgugugcgggagcgacggaacgaccuacccuucuggcugucagcugagagcggcuucccaacgggccgagagccgcggggagaaagcuaucacacaggucucuaagggaaccugcgaacagggccccuccauugugacaccgccuaaggauaucuggaacguuaccggggcccagguguaucucagcugugaggucauuggaauccccacaccugugcugauuuggaauaaaguuaagagaggccacuacggcgugcaacggaccgaacuucugcccggggaccgcgauaaccucgcgauccagacgagaggaggccccgagaaacaugaggucaccgggugggugcuggugucuccucuguccaaggaagacgccggagaguaugaaugccacgcuagcaauucccagggccaggccucugcuagcgccaaaaucacagucguugaugcccuccaugagauuccggugaagaaggggacccaauga

SEQ ID NO: 70657 - RNA, 837 nt, Artificial Sequence
  derived and/or modified sequence opt5 from IGFBPL1__Homo_sapiens__NP_001007564
augcccagacugagccuccugcuuccucugcuccugcuucugcuccugccgcugcugcccccucugucccccucucuuggcauccgggacgucgggggacgcagaccuaagugcggccccugucggccugaggggugcccggcccccgcuccuugucccgccccuggaauuagcgcgcuggaugaaugcggcuguugcgcucgcugucucggggccgagggagccuccugcggcggcagagcugggggacgguguggccccgggcuggugugcgccucucaggcugccggagcggccccggaaggcaccgggcuuuguguuugcgcucaacgcggaacagugugcggcagcgacggcagauccuacccuucugugugugcccugcggcuccgcgcuagacacacgccccgggcccauccugggcaccuccauaaagcgcgcgauggacccugcgaguucgcccccgucgugguugugccuccgagaagcguccacaacgugaccggcgcucagguugggcuguccugugaagugcgggccguccccacaccugugaucaccuggcgcaaggugacaaaaagccccgagggaacccaggcucucgaggaacugccuggcgaccaugucaauauugccguucaggugagagggggacccucugaucacgaggccacagcuuggauccuuauuaacccgcugcggaaggaagacgagggcguguaucaaugccacgcggccaauauggucggcgaggcugaaucccauagcaccgugacgguucucgaucugucuaaauacagauccuuucacuucccugcccccgacgaucgcauguga

SEQ ID NO: 70658 - RNA, 333 nt, Artificial Sequence
  derived and/or modified sequence opt5 from IGFL1__Homo_sapiens__NP_940943
auggcccccagaggcugcaucguggcugucuucgccaucuuuuguauuagccggcugcucugcucccacggggcgccuguugcuccgaugacccccuaccugaugcuuugucagccucauaagcgcugcggagacaaauucuaugauccccugcaacacuguugcuacgacgaugccguggugccucucgccagaacacagacguguggcaacugcaccuuucgggucuguuucgagcagugcugucccuggacauuuauggugaagcugauuaaucagaacugcgacucugcucgcaccagcgaugacagacuuugccgguccguuucuuga

SEQ ID NO: 70659 - RNA, 1068 nt, Artificial Sequence
  derived and/or modified sequence opt5 from IGFLR1__Homo_sapiens__NP_078936
augggccccgggagaugccugcucaccgcccugcuucugcucgcucuggccccuccgcccgaggcgagccaguacuguggacggcuugaauauuggaacccugacaauaagugcuguuccucuugccugcaacgcuucgggcccccucccuguccugauuacgaguuuagagaaaacugcggccucaaugaccacggagauuucgugacaccgcccuuucggaaguguagcuccggccagugcaacccugacggggcugagcuguguucucccugcggaggcggcgccgucacgccuacccccgccgcugggggaggccgcacaccguggagaugucgggaacgcccuguucccgccaaggggcauugcccucugacccccggaaaucccggcgcuccuagcucccaggagagaucuagcccggccuccagcaucgcguggcggacacccgagccugugccccagcaagccuggccuaacuuccucccccuggugguccuugugcugcuccugacccuugcuguuauugccauccugcucuuuauucugcuguggcaccucugcuggccgaaagaaaaggcugauccuuaucccuacccugggcugguguguggaguccccaauacacauaccccuucuuccagccaccuuucuucccccggcgcccuggagacgggcgacaccuggaaagaagcgagccuccugccgcuucugucucgcgagcucuccagccuggccucccagccucugucuagacuccuggaugagcuugaagugcuggaggaacucaucguucugcuugaccccgagcccgggccuggaggcgggauggcucauggaacaacccggcaccuggccgcucgcuauggccucccggccgccuggagcacauucgcuuacucccugagacccagccggucuccucugcgcgcgcucauugaaaugguggucgccagagagcccuccgcuagccuggggcagcuuggaacccaccuggcccagcucggccgggccgaugcucugagagugcugucuaaacuuggcagcuccggggugugcugggccuga

SEQ ID NO: 70660 - RNA, 2982 nt, Artificial Sequence
  derived and/or modified sequence opt5 from IGHMBP2__Homo_sapiens__NP_002171
auggccagcgcugccguggaguccuucgucaccaagcagcuggaccuccuggaacuugagagagaugcggaaguugaggaacggcgcucuuggcaagagaacaucagccugaaagagcuccaguccagaggcgugugccugcuuaagcuccaggugucuagccagcggacagggcucuacggacgccugcuggucacguuugaacccagacgguauggcuccgcugccgcccucccuucuaauagcuucaccuccggggacauugugggacuguacgaugcugccaacgagggcagccaacuugcuacagggauccugacccgcguuacacagaaaucugugaccgucgccuuugacgaaucccacgauuuccagcucagccuggacagagaaaauucuuaucggcuucugaagcucgcgaacgaugugacauaccgcagacugaaaaaggcccugauugcucucaagaaauaucauuccggaccggccagcucucugaucgagguucuuuuuggccgguccgcucccagcccugccuccgaaauucacccccugaccuucuuuaauacgugucucgacaccucucagaaggaggcggugcuguucgcccuuagccaaaaagaacuggcuaucauccauggcccucccgggacaggaaagaccacaaccgucguggagauuauccuccaggccgugaaacagggccugaagguccugugcugugcuccuuccaacauugccguugauaaucucguggaacgccuggcccuuugcaagcagagaauccugcggcucgggcacccggcucgccugcuugagagcauucaacagcauucucuggacgcggugcucgccagauccgauagcgcucagaucgucgccgacauucggaaagauaucgaccaaguguuuguuaagaacaaaaagacgcaggacaaaagagagaagucuaauuuccgcaacgaaaucaaacugcugcggaaggagcucaaggaaagagaggaagccgcuaugcuggagagccuuacauccgccaaugugguccuggcgaccaacacaggagcuucugccgauggcccccucaaacugcugccugagagcuacuuugacgugguugugauugaugaaugugcccaggcucuugaggccuccugcuggaucccccuccugaaggcucgcaaauguauucuggccggggaccacaagcagcucccucccaccaccgucagccacaaagcggcccuggcuggacuuucucugucccucauggaacggcuggccgaggaauauggcgcuagagugguccgcacacugacggugcaauaccggaugcaucaggccaucaugagaugggcgagcgauaccauguaccuuggccagcucacagcccacucuuccguugcucgccaucugcugcgggaccucccggggguggccgcuaccgaggagacaggagucccucugcuucugguggauaccgccggcugcgggcuguucgaacuggaggaagaggacgagcagagcaagggaaaucccggcgaaguuagacuggugucccuucacauucaagcccucgucgaugcuggggugccugcgcgcgacaucgccgugguuucucccuauaaccugcaggucgaucugcuccggcagagccuggugcacagacaucccgagcuugaaaucaaguccguggacggauuucagggccgggagaaagaagcugucauucugucuuucgugcgcagcaauagaaagggcgagguuggguuccucgccgaggaccggagaaucaacguggccgucacgcgcgcucggagacacguggccguuauuugugauucccgcacagugaacaaucaugcguuucugaaaacccuggucgaauacuucacccaacacggagaggugagaacagcuuuugaauaucuugacgauaucguuccugagaacuacagccaugaaaauucucagggcuccagccacgccgccaccaagccgcaggggcccgcuacaucuacgcggaccggaucccagcgccaagagggcgggcaggaggccgcggcuccugccagacagggccggaaaaagcccgccggaaagagccucgcuucugaagccccuagccaacccucccugaacggcgggagcccggagggaguggaaucucaggacggcgucgaucacuuccgcgcuaugauuguggaguuuauggccuccaaaaagaugcagcuggaguucccucccagccucaauucccaugacagacugcgggugcaccagaucgcggaggagcaugggcuucgccacgauucuagcggagaaggcaaaagacgguuuaucacagucuccaagcgcgccccuagaccccgggcugcccuggggccucccgcuggcaccggaggcccggccccucuccaacccguucccccuacaccggcccagaccgagcagcccccuagagaacagcgcgggcccgaccaaccugaucugcggacgcugcaccuugagagacugcagcgcgugcggucugcucagggacagcccgcgagcaaagagcaacaggccuccggccagcaaaagcucccugaaaagaaaaagaaaaaggcuaaagggcaucccgccaccgaccugccgacagaggaagauuucgaggcccucgugucugcugccgucaaggcggacaauaccugcggauuugcuaaauguacagccggcgugaccacgcuggggcaguucugccagcuuugcagcagacgcuauugucugucccaccaucucccugaaauucacggcugcggagagcgggccagagcucaugcccgccagcggaucagcagagagggcguucuguacgcggggucuggaacaaagaacggcucccuggaucccgcuaagcgggcccaacuucagcgcagacuggacaaaaagcucagcgaacugucuaaccagcggaccucccgcagaaaagagcgggggacauga

SEQ ID NO: 70661 - RNA, 480 nt, Artificial Sequence
  derived and/or modified sequence opt5 from IGJ__Homo_sapiens__NP_653247
augaagaaccaccuccuguucuggggcgugcuggccgucuuuaucaaagcuguucaugugaaggcccaggaggacgaaagaauugugcuugucgauaauaaaugcaagugugcgcggaucaccagccgcauuaucagauccucugaggaccccaacgaagauauuguggagcggaauauccgcaucauuguuccucugaacaauagagaaaacaucagcgacccgacaucuccccuccggacgcgcuucguguaccaccuguccgaucuuugcaaaaagugugacccuaccgaggucgagcuggauaaucaaauugugacagcuacccagagcaacaucugcgacgaagauuccgccacagagaccuguuauacauacgacagaaauaagugcuauaccgccguugugccccucgucuacgggggagaaacgaaaaugguggagaccgcucugacaccugaugccuguuaucccgacuga

SEQ ID NO: 70662 - RNA, 642 nt, Artificial Sequence
  derived and/or modified sequence opt5 from IGLL1__Homo_sapiens__NP_064455
augagacccggcaccgggcagggaggccuggaggccccuggggaaccgggacccaaccuccggcaacgcuggccucugcuucugcucggccuggcuguggucacacacgggcuucugagacccacggccgcgagccagucccgggcucucggaccuggcgcccccggcgggucuagccgcuccucucugagaagccgguggggacgcuuccugcuccagagaggcuccuggaccgggccucggugcuggccgcgcggauuucagucuaagcauaauagcguuacacacguguucggcuccgggacccaacugacagugcuuagccagcccaaagccaccccuucugucacacuguuucccccuuccagcgaggaacuccaggcuaacaaggccacccuggugugucuuaugaaugacuucuaccccggaauccugacgguuaccuggaaagcugauggcacaccgauuacccagggcguggagaugacaaccccuucuaagcaauccaacaauaaauaugccgcgagcucuuaccucucccugacgcccgaacaguggagaagccggcgcuccuauucuugccaggucaugcaugaggggagcacaguggagaagaccguugccccugcugaauguuccuga

SEQ ID NO: 70663 - RNA, 7872 nt, Artificial Sequence
  derived and/or modified sequence opt5 from IGSF10__Homo_sapiens__NP_849144
augaaggugaaaggaagagggaucacaugccugcucgucagcuucgccguuauuugucugguggcuacacccggaggcaaggccugcccucggcgcugugccugcuacaugcccacggaagugcacuguaccuuuagauaucuuacauccauccccgacucuauuccucccaacgucgaacggaucaaucugggguacaacagccucgugcgccugauggagaccgauuucuccggacuuacaaaacuggaacuccugaugcugcauucuaaugggauucacaccaucccugacaagacauuuagcgaucuccaggcucugcaaguucuuaaaauguccuauaacaaggugagaaagcugcagaaagacaccuucuacggacuccggucucugacgcgccuucauauggaucacaauaacaucgaguuuauuaaucccgaagucuucuauggacugaacuuucucagacuggugcaucuggagggcaaucagcucaccaagcugcacccugacacauucguuagccuuuccuaccugcagaucuuuaaaauuagcuucaucaaguuucucuaucugucugauaacuuccuuaccucccugccgcaagagauggugagcuacaugcccgaccucgauucucuguaccugcacggcaauccuuggacaugcgacugucaucucaaauggcuguccgauuggauucaggaaaagcccgacgucaucaagugcaaaaaggaucggagcccuucuuccgcccagcaguguccccuuugcaugaacccgcgcaccagcaaagggaagccucuggccaugguguccgcugccgcuuuucaaugugccaaacccacgauugacucuagccucaaguccaaaagccugacaauccuugaggacucuuccagcgcguucaucucuccucagggauucauggcccccuuuggcagccugacccucaauaugacagaucaguccgggaacgaagcuaauauggugugcucuauucagaagcccagcagaaccuccccuaucgccuucaccgaggagaacgacuauauuguccugaacacauccuuuucuacguuccugguuugcaauaucgauuacggacacauucaaccgguguggcagauccucgcucuguauuccgacagcccccuuauccuggaacggucucaucuccuguccgagaccccucagcuguacuauaaguacaaacaaguggcccccaagccugaagauauuuuuacaaacaucgaggcggaccuucgcgccgaucccagcuggcucaugcaggaccagauuucccugcagcugaauagaaccgcuacaaccuucucuacgcuccaaauccaguauagcuccgaugcccagauuacacugccgcgggcugaaaugcgcccugucaaacacaaguggaccaugaucucuagagacaacaauaccaaacuugagcacacagugcugguuggcgggaccgugggacucaacugucccggccagggcgauccuacaccccaugucgacuggcugcuggccgacgggagcaaggugcgggccccuuacguuuccgaggauggaagaauccuuauugacaagagcggcaaacucgaacugcaaauggcugauucuuuugacacggggguguaccacugcaucuccagcaauuaugaugacgcggauauucugaccuaccgcaucacagucguggagccccucgucgaagccuaucaggagaacggcauucaccacaccguguucaucggcgaaacacuggaccuuccgugucauucuaccgggauuccugaugcuuccaucagcuggguuauccccggaaauaacgugcuguaccagucuagccgggacaagaaaguccucaauaacggcacgcugcgcauucuccaggugacccccaaggaucaaggcuauuaccgcugcguugccgccaauccuuccgggguggacuuucuuaucuuccaggucagcgugaaaaugaagggacagcggccgcucgagcacgauggcgagacagaagggucuggacuggacgaguccaaccccauugcucaccugaaggaaccucccggcgcccagcucagaaccagcgcgcugauggaggcugaaguggggaaacauacauccucuaccagcaagcgccacaauuaucgggagcuuacgcugcaaagacgcggcgacuccacacaucggagauuucgcgagaaccggagacacuucccucccucugcccggcgcaucgauccucagcacugggccgcucuccuggaaaaagccaagaaaaacgcuaugcccgacaagagagagaauaccacaguuagcccgccucccgucgugacccagcugccuaacauucccggagaagaggaugacuccucuggcaugcuugcccuccaugaggaauuuauggugccggcgaccaaggcccugaaucugccugcucggacagucacggccgauagcagaaccaucuccgacagccccaugacaaacaucaauuacgggaccgaguucucuccugugguuaacucccaaauucugccgcccgaagaaccuacagauuucaaacugagcaccgcuaucaagacgacagccaugucuaaaaauauuaacccgaccauguccagccagauccagggaaccacaaaucagcacucuuccaccguguuuccccuucugcucggcgcgacagaguuccaagacagcgaucagauggggcgcggacgggagcauuuucaguccagaccucccauuacgguccgcaccaugaucaaggacgugaacguuaaaaugcugagcucuacaaccaauaagcugcuucuggagagcgugaacacaaccaauucccaccagacgucugucagagaagugagcgagccucggcauaaccacuucuacucccacaccacacaaauccucucuaccagcacauuucccuccgauccucauaccgccgcucacucucaguucccgauuccccgcaauagcacaguuaacaucccucuguuuagacgguucggccgccagagaaaaauugggggccggggacgcaucauuucccccuauagaaccccugugcuccggcgccauagauacagcaucuuucggucuacgacaagaggcuccagcgaaaagucuaccaccgccuucuccgcuacaguccugaacgugaccugucuuagcugccugccccgcgagcggcucacgacagccaccgccgcucuguccuuuccgucugcggccccuaucacauuccccaaggcugacauugccagagugcccagcgaagaguccaccacacugguccagaauccucuucugcuccuggagaacaaacccagcguugaaaagaccacgccuaccaucaaauauuuucgcacagagauuucucaagugaccccgacaggggccgugaugaccuacgcucccacguccaucccuauggaaaagacacacaaagucaaugccagcuauccccgggugucuagcaccaacgaggcgaagagagauuccguuauuacaucuagccucuccggagcuaucaccaagccucccaugaccauuaucgccaucacacgcuucucucggagaaaaauuccguggcagcagaauuucgugaacaaucauaacccuaagggccgccugcggaaucaacacaaagucagccuucagaaguccacggccgugaugcugcccaaaaccagcccugcucuccccagagacaagguuucuccuuuucacuucacaacccuguccacaagcgugaugcagauccccuccaacacccugacgacagcccaucacaccaccacaaagacccauaauccggggucucuuccuaccaaaaaggaacugcccuuucccccucucaacccgaugcugcccagcauuaucuccaaagacucuagcacgaaguccauuaucagcacccagacagcgaucccugcuaccacacccaccuucccugccucugucauuacguacgagacccaaacagagcggucccgcgcccagaccauccagagagaacaggagccccagaaaaagaaucggacagauccuaacauuagcccggaccagucuuccggauuuaccacacccacggcuaugaccccucccgugcucacaaccgccgaaaccagcguuaagccuucugugagcgcuuucacacacagcccucccgagaauacgaccggcaucucuagcacaauuuccuuucacagccgcacccugaaccuuacagaugucaucgaggaacuggcccaggcguccacccagacgcugaaaucuacaaucgccagcgagaccacccucuccucuaagagccaucaauccacaaccacaagaaaagcuauuauccggcacucuaccauuccucccuuccugagcuccagcgccacgcuuaugcccgugcccaucucucccccuuuuacacagagagcugugaccgacaacgucgccacaccgauuuccgggcugaugaccaauacgguugugaagcuccaugaaagcucucgccacaacgccaaaccccagcagcugguggcugaggucgcgaccuccccuaaggugcaucccaaugccaaauucacaaucggcaccacacacuuuauuuauagcaaccuccugcacucuaccccuaugcccgcucuuacaaccguuaagucccaaaauagcaagcugacgccguccccuugggccgaaaaccaguucuggcauaaacccuacagcgagaucgccgagaagggcaaaaagccugaagugucuaugcuggcuacaaccggccucagcgaggccaccacacuggucuccgauugggacgggcagaaaaauaccaagaagucugauuucgacaaaaagcccgugcaagaagcgacaacgagcaaacuucugccuuuugauucccucucucgguacaucuucgagaagcccagaauuguuggaggcaaagcugccagcuuuaccaucccggccaacuccgacgcuuuccugccuugugaagccguggggaauccccuccccacaauucacuggacccgcgucccuucuggacuggaucuuagcaagcggaagcagaacuccagagugcagguccugccgaauggcacacugagcauccagcgcguggagauucaagaccgggggcaguaucucugcucugcguccaaccuguuuggcaccgaccaucuucacguuacgcugagcguggucucuuaucccccuagaauccucgagcgcagaaccaaagaaaucacagugcacuccggaagcaccguugagcugaagugucgggcugaaggccgccccuccccuacagugaccuggauucucgccaaucagacggucgugucugagagcucccaggggagcagacaagccgugguuacagucgauggaacccuggugcuucauaaccugucuaucuacgaccggggcuucuacaaaugcguggcuuccaaucccgggggacaggauagccugcucgucaagauucaggugaucgccgcuccucccguuauucuggaacagcgcagacaagugaucgucggcacauggggcgagucucuuaaacugccguguaccgccaaggggaccccucagcccagcguguauuggguucucuccgacggaacagaggugaagccucugcaguuuacgaacucuaaacuguuccucuuuagcaauggcacccuuuacauccggaaccuggcguccucugauagagggacauaugaaugcauugccaccagcuccacaggaagcgagcgccgggucgugaugcugaccauggaagagagaguuacgucuccccgcaucgaggcugccucccaaaagcggacagaagugaacuucggcgacaaacuccugcuuaauugcagcgcuaccggggagccgaagccucagauuauguggagacugcccuccaaagccgucguggaucagcagcaccgggugggaucuuggauccaugucuaccccaacggcagccucuuuauuggcuccguuaccgaaaaggacucugggguguaccuguguguggcccgcaauaagaugggagaugaccugauccucaugcacgucagccuuagacugaaaccugcuaagauugaucauaaacaauauuuccggaagcaagugcugcacggcaaagacuuucagguugauugcaaggcguccgggagccccgugccugagaucucuuggucccucccggacggaacaaugaucaacaaugccaugcaggcugacgauagcggccaccgcaccagacgguacacacuguucaacaaugggacgcuuuauuucaacaaagucggaguggccgaagagggcgacuacaccuguuaugcccaaaauacacugggcaaggaugagaugaagguucaucucaccgugauuacagcugcgccccgcaucagacagucuaacaaaaccaauaagcggauuaaagcgggggacacggcuguccuggauugcgaagugaccggagacccuaagcccaaaaucuuuuggcugcucccuuccaacgauaugauuagcuucucuaucgaccgcuacacauuucacgccaauggcucccuuaccaucaacaaggucaagcugcuggauagcggggaguauguguguguugccagaaaucccucuggagacgauacaaaaauguacaagcucgacguggugagcaaaccuccgcugauuaacggccuuuacaccaaccggacagucaucaaggcuaccgccguuagacauuccaaaaagcacuucgauugccgcgcggaagggacgcccagcccugaggugauguggauuaugcccgacaauaucuuucugacagccccuuauuacggaucccggauuaccgugcacaagaacggcacccucgaaaucagaaauguccgccugucugacagcgcugauuucaucuguguggcccggaacgagggcggggaguccguucuggugguccagcucgaagugcuugagaugcugagacgccccacauuucggaauccguucaacgagaaaauugucgcucagcugggaaagucuacggcccucaauugcagcguggacggcaacccuccgcccgagaucauuuggauccugccuaaugggaccagauuuuccaacggaccccaaucuuaucaguaccuuauugcuagcaauggcuccuucaucauuagcaaaacaacccgcgaagaugccgggaaguaucggugugcggccagaaacaaaguuggauacaucgagaagcuggugauccucgagauuggccagaagccugucauccugacauaugcuccgggcaccgugaaagggauuucuggagaaucccugagccuccauugcguuucugacggcauccccaagccuaauauuaaauggacaaugcccuccggguacguggucgaucgcccucagaucaacggaaaguacauccuucacgacaauggcacccuggugauuaaagaggccacggcuuaugaucgggggaacuacaucuguaaggcccaaaacagcgugggacauacccugauuacaguucccgucaugaucguggccuauccgccuagaauuaccaauagacccccuagaucuaucgugacacggaccggcgcugcguuucagcuccacugcgucgcccugggcguucccaaaccggaaaucacgugggagaugccugaccauucccuucugagcacagcuucuaaggagcgcacccacggguccgaacagcuccaucugcaaggaacacuggugauucagaacccccagaccagcgauagcggcaucuacaagugcacggccaaaaauccccucggguccgacuaugccgcuaccuacauucaggugaucuga

SEQ ID NO: 70664 - RNA, 1296 nt, Artificial Sequence
  derived and/or modified sequence opt5 from IGSF11__Homo_sapiens__NP_001015887
augaccagccagagaagcccccuggccccucuccugcuucugucucuccacggcguggcugccagccuggaggucuccgaaucuccggggagcauccaaguugcgcggggacagcccgcugugcuuccuugcacauucacgaccuccgccgcccugauuaaccucaaugugaucuggauggucacaccccugucuaacgcuaaucagccugaacaggugauucuguaccaaggcgggcagauguuugacggagcuccccgcuuccauggcagaguuggguuuaccggaacaaugccugcuaccaacgugagcaucuucauuaauaacacacagcucuccgauaccggcacguaucagugucuggucaauaaccuuccggacaucggcgggcggaauaucggagugaccggccugacaguucucgugcccccuagcgcgccccacugccaaauucaggggucucaggauaucggauccgacgucauucugcuuuguagcucugaggagggcaucccucgccccaccuaccugugggaaaagcucgauaacacacugaaacugccgccuaccgccacgcaggaccaagugcaggggacagugaccauuagaaauaucuccgcccucagcucuggacuguaucagugcgucgcuuccaacgccauuggcacaagcaccugucuucuggaucuccaaguuaucucuccccagccucggaauaucggccugauugcuggggccaucggaaccggcgcggugauuaucaucuuuugcauugcccuuauccugggggcuuucuuuuacuggcgcuccaagaacaaagaggaggaagaggaagagauucccaaugagaucagagaagacgaucugcccccuaaguguagcuccgccaaagccuuccauacagagauuuccucuuccgacaacaacacgcucaccagcucuaaugccuauaacagccgguacugguccaauaacccgaaggugcaccgcaauacagaaucugucagccauuuuuccgaucugggacagagcuucucuuuucacuccggcaacgccaauauccccagcauuuaugcuaacgggacccaccucgugccuggacagcauaagacacugguugugaccgcgaauagaggcucuagcccccaagucaugucccgguccaacggcucugugagccgcaaaccuagacccccgcacacgcauuccuacacaaucucucacgccacccuugagcggaucggggcuguuccugugaugguccccgcccagagccgcgccggaucccugguguga

SEQ ID NO: 70665 - RNA, 4026 nt, Artificial Sequence
  derived and/or modified sequence opt5 from IGSF1__Homo_sapiens__NP_001164432
augacccuggacagacccggcgagggggccacaaugcucaagacguucaccgugcugcuuuucugcauccggaugagccugggaaugacauccauugucauggauccucagccggaacucuggaucgagucuaacuacccccaagcuccuugggaaaauauuacccuguggugucgcagccccuccagaaucucuagcaaauuccuucugcucaaggacaaaacacagaugaccuggauucggccuucccacaagacauuucagguuucuuuccugaucggcgcccugaccgagagcaacgcggggcucuaucgcugcuguuacuggaaagaaacgggaugguccaagcccagcaaggugcuggagcuugaggcuccuggccagcugccgaaacccaucuuuuggauucaagccgaaaccccugcccuccccgggugcaaugugaacauccugugucauggauggcuucaggaucuggucuucaugcucuuuaaggagggcuaugcugaaccuguggacuaccagguucccacaggcaccauggccauuuucucuaucgauaaucugacaccggaggacgaggggguguauauuugcagaacccacauccagaugcugccuacgcucugguccgaacccagcaacccucugaaacuugucguggcuggacuguaccccaagcccacacucaccgcccauccuggcccgauuauggcgcccggggagucucugaaucuucggugucaaggaccuaucuauggcaugacauuugcccugaugcgcguugaagaucucgagaaauccuucuaccacaagaagaccaucaaaaacgaagcuaacuuuuucuuucagagccugaagauucaggacaccgggcauuaccugugcuucuauuacgaugccucuuauagaggaucccuccugagcgacgugcuuaaaaucugggucacagauacguuccccaagaccuggcugcucgcucggccuuccgccguggugcagaugggccaaaaugucucucugcgcuguagaggccccguugacggggugggacuugcgcuguacaaaaagggcgaggauaaaccgcuccaguuucuggacgccacaagcauugacgauaauaccuccuucuuucugaacaaugugacauauagcgacaccgggaucuacucuugccacuaucuccugacguggaagacauccauucggaugccuagccacaacaccgucgagcuuauggugguugauaagcccccuaaacccucucugagcgcuuggccuuccaccguguucaagcucggaaaagccaucacacugcagugucgcgucucucaucccgugcuggaauuuagccuugagugggaagagagagaaaccuuccaaaaguuuuccguuaauggcgacuucaucauuagcaacguggaugggaaaggaacaggcacguacucuugcuccuaccgggucgagacccacccgaacaucuggagccaucgcucugagccucucaagcugaugggccccgcuggguaucugacauggaauuacgugcucaacgaagccauuagacugucccuuaucaugcagcuggucgcccuccugcuggugguucuuuggauucgguggaagugcagacgccuccggaucagagaggcuuggcugcugggaaccgcgcagggcgugacaaugcucuuuaucgucaccgcccugcuuuguugcgcuauuagcuucgccgggcuguguaauggagugcucaucgaagagacggaaauuguuaugcccaccccuaaaccggagcugugggccgagacaaacuuuccccuggcuccuuggaagaaucuuacccucuggugccgcucccccucuggcagcacaaaagaauuugugcugcugaaggacgggaccggcuggaucgccacgcggccugcguccgagcaggucagagcugccuuuccccucggagcccugacacaaucucacaccggcagcuaucacugucauuccugggaagagauggcugugagcgagccuucugaagcccuugagcugguggggacagauauucuccccaaaccgguuaucuccgcuagcccuaccauucgcggacaggaacugcagcugcggugcaagggcuggcuugccgggaugggauucgcgcucuacaaggagggcgaacaggagcccguccaacagcugggggccgugggcagagaggcuuucuuuaccauccagcgcauggaagacaaagaugagggaaacuauucuugucggacacacacggaaaagagaccuuucaaaugguccgagcccagcgaaccgcuggagcucgugaucaaggagauguacccuaaacccuuuuucaagaccugggccucuccugucgugacacccggcgcucgcguuaccuuuaauugcagcacaccccaucagcacauguccuucauucuguauaaggacgggagcgaaaucgccucuuccgaucggagcugggcguccccuggagccucugcugcccauuuucuuauuaucagcgugggcauuggggacggaggcaacuacuccuguagauacuaugacuucucuaucuggagcgagccguccgaucccgucgaacuggugguuaccgaguuuuacccuaaacccacgcuccuggcucaaccugggcccguggucuucccuggcaagucugugauccugcggugccagggaacauuucagggcaugcgcuucgcccuucugcaggaaggggcccacguuccgcuccaauuuagaagcguguccggaaauagcgcugacuuccugcuccacaccgucggcgcggaggauucugggaacuauuccuguauuuacuaugagaccacaaugagcaaucggggaucuuaccuguccaugccccuuaugaucugggugaccgacacauucccuaaacccuggcuguuugccgaaccuagcucugugguccccaugggccagaacguuacgcucuggugcagagggccggugcauggcgugggauauauucugcacaaggagggcgaagcuaccuccaugcagcugugggggagcacauccaaugauggagccuucccuaucaccaacauuagcggcacaucuauggggcgcuacagcugcuguuaccaucccgacuggaccuccucuaucaaaauccaacccagcaauacgcuugagcugcucgucaccggacugcucccuaagcccucccugcuugcccagccuggcccgaugguggcucccggcgagaacaugacacugcagugccagggggaacucccugauucuaccuuuguucugcugaaagagggagcccaagaaccccuugagcagcagcggccuagcggcuauagagcggacuucuggaugcccgcugugcgcggggaagauuccggaauuuacucuugugucuauuaccuggacagcacaccguuugccgccuccaaccacagcgauucucucgagaucugggugaccgacaagccucccaagccuucccugagcgcuuggcccucuacaauguucaaacucggcaaggauauuacccugcagugcagagggccucuucccggaguugaguuugugcuggaacacgacggcgaggaagccccgcaacaguucuccgaggacggcgauuuugucaucaauaacguggaagggaaaggaauuggcaauuauagcuguuccuaccggcugcaggcguauccugacaucuggucugagcccagcgauccccucgagcugguuggggcugccggaccuguggcccaggaaugcacggucggcaacaucgugcgcuccagccuuauuguggucguugugguggcucugggggucgugcucgccaucgaguggaagaaauggccgagacugcggacacgcggaucugaaaccgacggcagagaucaaaccauugcucucgaggaauguaaucaggagggcgagcccgggaccccugccaacucccccagcucuacaagccagcggaucuccguugaacugccugugcccauuuga

SEQ ID NO: 70666 - RNA, 1224 nt, Artificial Sequence
  derived and/or modified sequence opt5 from IGSF5__Homo_sapiens__NP_001073913
augggccagaaggagagaagcaccgccgacacacugcccgaucucgaagaguggaaauccgcugccgggcugcggugguggcaaacggcgguggucgacggaucuggcagcgggaacgaaguuaucgagggaccucagaaugcucgcgugcuuaagggcucccaggccagauucaacugcaccgugucucagggguggaaacugauuaugugggcccucagcgauauggucgugcuguccguucggccgauggaacccaucauuacaaaugaccgcuuuaccucucaaagauacgaucagggaggcaacuucacaagcgagaugaucauucacaauguggagccuuccgacagcggcaacauccgguguucucuucaaaauucccgccugcaugggagcgcuuaucucaccguccaggugaugggagaacuguuuauccccucuguuaaccugguggucgccgagaaugaaccuugcgaggugacaugucuccccucccacuggaccagacugccugauauuagcugggagcuuggccugcucgugucucauuccagcuacuauuucgucccggaacccuccgaccugcagucugcuguuagcauccuugcccugacgccucaguccaacgggacccucacaugcguggcgaccuggaaaagccugaaagcccggaagucugcuacagugaaucugaccgucauucgcuguccccaggauacgggaggcgggaucaacauuccuggagugcucuccagccugcccucucuuggcuuuagccugccgacauggggcaagguugggcucggacuggccggcaccaugcuucugacaccuaccugcacccucacaaucagauguugcuguugccggcgcagauguugcgggugcaauuguugcugucggugcuguuucugcugucgcagaaaacggggauuucgcauucaguuccaaaagaaauccgagaaggaaaagacgaacaaggagaccgaaacagagucuggcaaugagaacagcggguacaacuccgacgaacagaagaccacagauaccgcuagccugcccccuaaaucuugcgaguccagcgaccccgaacagagaaauucuuccuguggacccccucaccaacgggccgaucagagaccgccccgcccugcgagccauccccaggccuccuuuaaccuggcuucuccugagaaggugagcaauacgacagucguguga

SEQ ID NO: 70667 - RNA, 726 nt, Artificial Sequence
  derived and/or modified sequence opt5 from IGSF6__Homo_sapiens__NP_005840
augggcaccgccagcagauccaacaucgcucggcaucugcagacaaaucucauucuguucugcgugggggccgucggagcguguacgcuuucuguuacccaacccugguaccuggagguggacuauacacacgaagcugugaccaucaagugcacauuuagcgccaccggcuguccuuccgagcagccgacaugccucugguuccgcuacggggcccaccagcccgaaaaccugugucuugauggaugcaaaucugaggcugacaaguuuaccgucagagaagcccugaaagagaaucaggugagccucacgguuaaccgggugaccuccaaugauucugcuauuuauaucuguggcauugccuucccuagcguccccgaggcgcgcgccaagcaaacagggggaggcaccacacuggugguuagagaaaucaaacugcucuccaaggagcugcggagcuuucuuaccgcucuggugucucuccuguccgucuacgugacgggcgugugcgucgccuucauccuucugagcaagucuaaauccaacccucuccgcaauaaggaaauuaaagaggacagccagaagaaaaagucugcuagacggaucuuucaggagauugcccaggaacuguaucauaagcgccacguugagacaaaccaacaguccgaaaaagauaauaacaccuacgagaauagacgggugcugagcaacuaugaacgccccuga

SEQ ID NO: 70668 - RNA, 1842 nt, Artificial Sequence
  derived and/or modified sequence opt5 from IGSF8__Homo_sapiens__NP_001193594
augggcgcccugagacccacccuccugccuccgagccuuccccugcuccugcuucugaugcucgggaugggaugcugggcucgggaggugcuggucccugaaggcccccuguaccgcguugccgggacagcgguguccaucucuuguaacgugacgggauaugagggcccugcucagcaaaauuucgaaugguuucucuacagacccgaggccccugacaccgcccuggggauugucagcacaaaggauacccaguucuccuaugcuguguuuaaaucucggguuguggccggagaaguccaggugcagcgccuucaaggcgacgcuguugugcugaagaucgccagacuccaggcgcaggaugccggcauuuacgagugccacacaccgagcaccgacacacgguaucugggguccuacucuggaaaagucgagcuucgcgugcugcccgaugugcuccaggucagcgcugccccucccggcccuagagggcggcaagcucccaccuccccgccucgcaugacgguucaugaaggacaggagcuggcccugggcugucucgcgagaaccagcacacagaagcacacccaucuggccgugucuuucgggcgguccgugcccgaagcuccugucggacgcagcacacuucaggaggugguuggcaucagaucugaccuggccguggaggcuggcgcccccuaugccgaacggcucgcugcgggggagcugcgccuuggaaaagaaggcaccgauagauaccggauggucguugggggagcccaagcuggcgacgccgggacguaccacugcacagccgcugaguggauucaggaucccgacggauccugggcccagaucgcggaaaagagagcugugcuggcccauguggauguccaaacccucagcucucagcuggccgugacagucggcccuggcgagcgccggaucgggccgggagagccccuggaacuccuguguaacguguccggcgcccuuccucccgcugggagacacgcugccuauagcguuggaugggagauggcgccugccggcgcucccgggccgggccgccugguggcccagcucgacaccgaaggagucggcucccuggggccuggauacgagggccggcacauugcuauggaaaagguggccucuagaaccuaucgccuucggcuggaggcggccagacccggggaugcuggaacauaccgcugccucgccaaggcuuauguucggggcagcgggacgagacugcgcgaggccgccuccgcucggagcagaccucugcccgugcauguccgggaagagggcguggugcucgaagcgguugccuggcuggcuggaggcaccgucuaccgcggggagacagccucucuucuguguaauaucuccgugagaggaggcccucccgggcuccggcuggccgcuagcugguggguggaaagaccggaggacggagagcugucuagcgucccugcccagcuugugggcgggguuggccaagacggaguggcggaacucggcguccgccccgggggaggccccguguccguugagcugguggggccucggucucacagacugcgccuccauagccugggaccggaagaugagggcgucuaucacugcgcucccuccgccugggugcagcacgccgacuacagcugguaccaggcugggucugccagauccggcccuguuaccguguaucccuacaugcaugcgcuugauacacuguuugucccucuccuggugggaaccggcguggcucuggucacgggggccacaguucuuggaaccauuaccuguugcuucaugaaacggcuccgcaaaagauga

SEQ ID NO: 70669 - RNA, 1236 nt, Artificial Sequence
  derived and/or modified sequence opt5 from IHH__Homo_sapiens__NP_002172
augagccccgccagacugcggccucgccuccacuucugccuggugcuucugcuccugcuugucguuccggcugccuggggcugugggcccggaagaguggugggcucccggcgcagaccuccccggaagcuggucccucucgcguacaaacaguuuucucccaacgugccugagaagacccugggggcuagcggacgcuaugaaggcaaaaucgccagauccucugagcgguucaaggaacugacaccgaauuacaaccccgacauuaucuuuaaagaugaggaaaauacgggggccgaccgccucaugacccaaagaugcaaggaucggcugaacagccuugcuauuuccguuaugaaucaguggccuggagugaagcugcgcgucacagagggcugggacgaggauggccaucacucugaagagagccuccauuaugaagggagagccguggacaucaccacauccgaucgggaccgcaacaaauacggacugcuugcuagacuggccguugaggcgggcuucgauuggguguauuacgagagcaaggcccacguccauuguucugugaaauccgaacacagcgcugccgcuaagaccgggggaugcuuucccgccggcgcccaggugcggcucgagucuggggcgagagucgcucuguccgccguucgcccuggagaccgggugcuggcuaugggcgaagauggcagccccacauucucugacgugcucauuuuucuggauagagagccgcaccgccuucgggccuuccaggucaucgaaacccaagacccucccagacgccuggcccucacgccugcucaucugcuuuuuaccgcggacaaucacacagagcccgccgcucgguucagagccaccuuugccucccaugugcagcccgggcaguauguucugguggcuggagucccuggccuccagccggcccgcguggcggcuguuagcacacacguggcccugggggccuacgcuccccugaccaaacacggaacgcucgucguggaggaugucguggccuccuguuucgcugccguugcggaccaucaccuggcccaacuugcuuuuuggccucugagacucuuccauucucuggccuggggcagcuggacacccggggaaggagugcacugguacccucagcuucuguaucggcucggccgccugcugcucgaggaaggcuccuuccauccccuggggaugagcggagcuggcucuuga

SEQ ID NO: 70670 - RNA, 3999 nt, Artificial Sequence
  derived and/or modified sequence opt5 from IKBKAP__Homo_sapiens__NP_003631
augagaaaccugaaacucuuccggacccuggaguuucgcgacauccagggccccgggaauccucaaugcuucagccuuagaacagaacagggaacggugcugauuggcuccgagcacgggcucaucgaagucgauccgguuucucgggaggugaaaaacgaagugagccuggucgccgagggauuucuucccgaggacggcuccgggcgcauugugggaguucaggaucugcucgaccaggaaucugugugugucgcuaccgccagcggcgaugugauccugugcucccugucuacacaacagcucgaguguguuggcagcguggcguccgggauuagcgucaugucuugguccccugaccaggaacuggugcuucuggcuaccggacagcaaacacucaucaugaugaccaaggauuucgagcccauccuggagcagcagauucaucaggacgauuuuggcgaaagcaaauucaucacagugggguggggaagaaaggagacccaauuucacggcucugaagggcggcaggccgccuuccagaugcaaaugcaugaguccgcccuuccuugggacgaucaccgcccccaggucacguggagaggagacggccaguuuuucgcuguuagcguggugugcccugaaaccggcgcucggaaaguccgcguguggaauagagaguuugcccugcagucuacauccgagccgguugcggggcucggacccgcccuggcuuggaagccuagcggcucccugauugccucuacccaagauaagcccaaccagcaggacaucguguucuuugaaaagaaugggcuccugcauggacacuucacacuuccuuuccugaaggacgaggucaaagugaacgaucuccuguggaaugcugacagcuccguucuugccguguggcuggaagaucuccagcgggaggaaagcucuauucccaagaccuguguccaacuguggacggugggcaacuaccacugguaucugaaacagucccucagcuuuucuacaugcggaaagagcaagaucgucucccugaugugggacccggugaccccuuaccgccuucauguucugugucagggguggcacuaucucgcguacgauuggcauuggacaaccgacagaucugugggcgauaauagcuccgaccugagcaacgucgccgugauugauggcaaucggguucuugugaccgucuuccgccagacaguggugcccccucccaugugcacguaucaacugcucuuuccccacccuguuaaccaggucaccuuccuggcucacccgcagaaaucuaaugaccuggccgugcucgaugcuuccaaccagaucagcguguacaaguguggggacugccccucugccgacccuacagucaaacugggagccgugggcggguccggauuuaagguuugucuuagaacgccccaucuggagaaacgguauaagauccaauucgagaauaacgaagaucaggacgugaacccucucaaacugggccugcuuacauggauugaggaagaugucuuucucgcugugagccacuccgaguucucucccagaagcguuauccaucaccugaccgcggccuccucugaaauggacgaggagcaugggcagcugaaugugagcuccagcgcugccgucgauggcgugauuaucucucucugcugcaacuccaagaccaagagcguugugcugcaacuugccgacggacagauuuuuaaauaccugugggaaucuccgucccucgcuaucaagccuuggaaaaauagcggcggguuccccguccgcuuuccuuaccccuguacacagaccgagcuggccaugaucggagaagaggagugcgugcugggccuuaccgaucgguguagauucuuuauuaacgacaucgaaguggcgucuaauauuacaucuuucgcugucuaugaugaguuccuccugcugaccacacacucccacacgugccaguguuuuugccuccgcgacgccagcuucaagacccugcaagccgggcuuucuuccaaccauguuagccacggagaagugcugcggaaaguggagagaggcucccgcaucgucacagugguuccucaggauaccaagcucgugcugcagaugccccgggggaaucuggaagucgugcaucacagagcucuuguucucgcccagauucgcaaguggcuggacaaacugauguuuaaggaggcuuucgaguguaugcggaaacucagaaucaaccugaaucuuaucuacgaucacaacccgaagguguuucugggcaaugucgaaacauucauuaaacaaaucgacucugugaaccauauuaaucucuuuuucaccgagcugaaggaagaggacguuacgaagaccauguauccugcccccgugacaagcuccgucuaccugucucgcgaucccgacggaaacaaaaucgaucuugugugcgacgcgaugcgggccgugauggaaagcauuaauccucacaaguauugucucuccauccugaccucucaugucaaaaagacaaccccggagcuggagauuguucuccagaaagugcacgaacugcagggcaacgcucccagcgauccugacgccguguccgcugaggaagcccuuaaguaccugcuccaucuggucgaugugaacgagcuguaugaccacagccuugggacguacgauuuugaccugguucucaugguggcggaaaagucucagaaagaucccaaggaguaccugccuuuccucaauacacugaaaaagauggagaccaacuaucaaagauuuacaaucgacaaauaccuuaagcgguaugaaaaagccaucggacaccuguccaagugcggccccgaguacuucccugaaugucucaaucugauuaaggauaaaaaccuguauaaugaggcucuuaagcuguacagccccucuucccagcaguaucaagacaucagcauugccuacggggagcaucucaugcaggaacacauguacgagccggcuggacugauguuugcccgcugcggcgcccaugaaaaagcucucucugcguuccugaccugcgggaacuggaagcaggcccuuugugucgcugcccagcugaauuucaccaaagaccaacucgugggccugggaagaacacuggccggcaaacuuguugagcagcggaagcacaucgaugcugccauggugcuggaagagugcgcgcaggacuaugaggaagcuguccuccugcuccuggagggggccgccugggaagaggcucuuagacugguguacaaguauaaccgccuggauauuaucgaaacgaaugucaagccuuccauccucgaggcccagaaaaacuacauggcguuucuggacagccaaaccgcuacauucucccggcauaagaaaagacuucuggugguucgcgagcucaaggaacaggcccagcaggccggacuggaugacgaggugccccacggccaagaaagcgaucucuuuucugagaccagcuccgucgugucugggagcgaaauguccggaaaguauucucacagcaauuccagaauuucugcucggagcuccaaaaaccgcagaaaggccgagcggaaaaagcauagccugaaagagggcucuccucuugaagaccuggcucugcucgaggcccuguccgaaguugugcagaauacagagaaccuuaaggaugaggucuaccacauccugaagguucucuuccuguuugaguucgacgaacaggggcgcgaacuccagaaagcguuugaggauacccugcaacuuauggaaagaagccugcccgagauuuggacgcugacauaucagcagaauagcgccaccccggugcucggcccuaacuccaccgcuaacagcaucauggccuccuaccaacagcagaagacaucugugcccguccuggacgcugagcuuuucauuccucccaaaaucaaucggcgcacccaguggaagcugagccuccuggacuga

SEQ ID NO: 70671 - RNA, 2265 nt, Artificial Sequence
  derived and/or modified sequence opt5 from IKBKB__Homo_sapiens__NP_001177649
auguucagcggcgggugccacucccccggauuuggcagaccuucuccggccuuccccgcuccugggagcccuccucccgccccucggccgugucgccaggagaccggagaacaaaucgcgauuaagcagugcagacaggagcugucuccccggaaccgcgaaagauggugucucgagauccagauuaugcggcgccugacacauccuaauguggucgcugccagagacguucccgaaggcaugcaaaaccuugccccuaaugaucugccccuccuggcuauggaguacugccaagggggagaccuucggaaauaucugaaccaguuugagaauuguugcggccuccgcgaaggcgccauccugacgcugcucuccgauauugcuagcgcccugagauaccuucacgagaaccggaucauccaucgcgaccugaagccggaaaauauugugcuccagcaaggggagcagagacugauccacaaaauuaucgaucuuggauaugcgaaggagcuggaccagggcucccucuguaccucuuucguggggacacugcaguaccuggccccugaacuccuggagcaacagaaauauaccgucacaguggauuacuggagcuuuggaacccuugcuuucgaaugcauuacaggcuuucggcccuuccugccuaacuggcagcccguucaauggcauuccaaggugcgccaaaagagcgaggucgacaucgugguuucugaagaucucaaugggaccgugaaauuuuccagcucucugcccuaucccaacaaucuuaacuccguccuggccgagagacucgagaaguggcugcagcugaugcucauguggcacccgcggcagagaggaacggaccccaccuacggcccuaauggcuguuucaaagcucuggaugacauucuuaaccugaagcucgugcacauccugaauauggugacagggaccauccauacauaccccgucaccgaagaugagagccuucagucucugaaagcccgcauucagcaggacacgggaaucccugaagaggaccaggaacuccugcaagaggcgggccuggcccucauucccgauaagccggcuacacagugcaucuccgacgggaagcugaacgagggacacacccuugauauggaccugguuuuucucuucgauaacagcaaaauuacauaugaaacccagaucuccccucggccccagccugagucugugagcuguauccugcaagaacccaagagaaaucuggccuuuuuccagcuucgcaaaguguggggccaggucuggcauuccauucagacccucaaggaggacugcaaccggcugcaacaggggcagagagcugccaugaugaaucugcuccgcaacaauagcugccugucuaaaaugaagaacuccauggccagcaugucucaacagcuuaaagcuaagcuggauuucuuuaagacaagcauccagauugaccucgaaaaauacuccgagcagacggaguucggaaucaccucugauaagcugcugcuugcguggcgggaaauggagcaagccguggaacucuguggcagagagaaugagguuaaacugcugguggaacgcaugauggcucuccagacagacauugucgaucugcagcggagcccuaugggcagaaagcaagggggaacccuugacgaccuggaggaacaggcccgcgagcucuaucggagacugcgggaaaaaccccgcgaucagagaacagagggcgacucccaggagauggugcggcugcuucuccaggccauccagagcuuugaaaagaagguuagagugaucuacacccagcugucuaaaacggucgugugcaagcagaaagcucuggagcuccugccgaaggucgaagaggugguuucccuuaugaacgaagaugagaaaacagugguccgccugcaagagaagcggcagaaggaacucuggaaucugcugaaaauugccuguagcaaggugagagggccuguuucuggaucccccgacagcaugaacgcgucccgccuuucucagcccggccagcucaugagccaaccuuccaccgcuucuaauagccugccggagcccgccaaaaaguccgaggaacugguggccgaagcucacaaccucugcacccugcuugagaaugccauccaggauacagucagagagcaggaccagagcuucaccgcucuggauuggucuuggcuccaaacagaagaggaggaacacuccugucuggagcaggccagcuga

SEQ ID NO: 70672 - RNA, 1896 nt, Artificial Sequence
  derived and/or modified sequence opt5 from IKBKE__Homo_sapiens__NP_001180250
auggaguacugcagcuccggcucucugcucagcgugcuggaaucccccgagaacgccuucgggcuuccugaagacgaguuucuggucguucucagaugugugguggcuggaaugaaucaccuucgggaaaacggcaucguccaucgcgauauuaagccggggaauaucaugagacuugugggagaggagggccagucuauuuauaaacugaccgacuucggggccgcgcgggaacucgaugacgaugagaaguuuguuagcguguacggaacagaagaguaucugcaccccgacauguacgagcgcgcuguccugagaaaaccucaacagaaggccuucggcgugacgguugaucucugguccaucggcgugacccuguaucaugccgcuacagggucucuucccuuuauuccuuucggaggcccccggcgcaacaaagaaaucauguacagaaucaccacagagaagccugccggggcuauugccggagcgcagcggcgcgaaaauggcccgcuggaguggagcuauacccuccccaucacaugccagcugucccuugggcugcaaagccagcucgucccuauucuggccaacauccuggaaguggagcaggcuaaguguuggggauuugaccaguucuuugccgagaccucugauauucuccaaagaguggucguucacguguucucccugagccaggcugugcuucaucacaucuacauucacgcccauaauacgaucgcgaucuuucaggaagccguccacaaacagaccucuguggcuccccggcaucaagaguaccuguucgaaggccaccucugcguucuggagccuuccgugagcgcccagcacauugcucauacaaccgccucuagcccccuuacacuguuuagcaccgccaucccgaagggccucgcuuuccgcgacccugcgcuggauguccccaaauucgugccuaagguugaccugcaggccgauuauaacacggcuaaaggggugcucggagccggcuaccaagcccugagacuugcucgggcccugcucgacgggcaggaacugauguuucgcggacuucacugggucauggaggugcugcaggcgacauguagacggacccucgaggucgcuagaacaucccugcuguaucucucuagcucccugggcaccgaacgcuucagcucuguggccgggacccccgagauucaggaacuuaaggccgcugccgagcugcgguccagacuccgcacacuggcugaaguucugagccggugcucucaaaauaucacggagacccaggagagccuuuccucucucaacagagaacuggugaagucccgcgaccagguccaugaggaucgguccauucagcaaauccaguguugccuggacaaaaugaauuuuaucuacaagcaguucaaaaagagcagaaugcgccccggacucggcuauaacgaagaacagauucacaaacuggauaaggugaauuuuucucaucuugccaaacggcugcuccaaguuuuccaggaggaaugugugcagaaguaccaggcgucccuggucacacacggcaagagaaugcgcguggugcacgagacccggaaccaucugagacuuguugggugcagcgucgccgcuuguaauacagaagcccaaggagugcaggagucucucuccaaacugcuggaggagcucagccaccagcugcuucaagaccgggcuaagggcgcccaggcguccccuccgcccaucgccccuuaucccucuccuacccgcaaagaucugcuccugcauaugcaggagcugugcgaagggaugaagcugcucgcuagcgaccugcuggauaacaacagaauuaucgagcggcucaauagagugcccgccccgccugacgucuga

SEQ ID NO: 70673 - RNA, 1464 nt, Artificial Sequence
  derived and/or modified sequence opt5 from IKBKG__Homo_sapiens__NP_001093326
auggcccuggugauccaggucggcaagcucagaccccgggagguucgcaccccucaaacaauuaacccgagccuguuccccucccuuccugugaaacugucuagcaucauugaagugcccuccgggggagagagaugcuguucucggcgcacgcucgucuacaaggcuagagccuuuuggaaaggcgcgccucugcccugcuggaugaaucggcaccuuuggaaaagccagcugugugaaauggugcagccuuccgggggaccggcugccgaccaggauguucucggcgaggaaucuccccuggggaagccugccaugcugcaucuccccagcgagcaaggagcuccugagacccugcagcgcugccuugaagagaaccaggaacugagagacgccauccggcaguccaaucaaauucuccgcgagagaugugaggaacugcuucacuuccaggcuagccagcgggaggaaaaggaguuucugaugugcaaguuccaggaagcccgcaaacucguggagagacugggccuggagaagcucgaucugaaacggcaaaaggaacaggcgcuucgcgaggucgaacaucugaaaagaugucagcaacagauggccgaggacaaggcuucugugaaggcccagguuacaucccuccugggcgaacuucaggagagccaaucucggcuggaggcugccaccaaagaaugccaggcgcucgaggggagagcccgcgcugccuccgaacaggcucggcagcuggagagcgaaagagaggcccugcaacagcagcacucugugcaggucgaucaacuccgcaugcagggacaguccguggaggccgcucugcggauggaaagacaggcggccagcgaggaaaagcgcaaacuugcucaacuccagguggccuaucaucagcuguuucaagaguacgacaaccacaucaaguccucugucguuggcagcgagcggaaaagagggaugcagcuggaagaucuuaagcagcagcugcaacaggccgaggaagcucucguggccaaacaggaggugaucgacaagcugaaggaagaggcggagcagcacaaaauugucauggaaacagugcccguucugaaggcucaagccgauaucuauaaagccgacuuccaggcugagcgccaggcccgggaaaagcucgcugagaaaaaggaacugcuucaggagcaacuggagcagcuccagagagaauacuccaagcugaaagccagcugucaagagucugcgcgcauugaagauaugcggaagagacauguggaggucucccaggccccgcugccucccgcuccugccuaucuuagcucuccccucgcucugcccagccagcggcgcuccccuccggaggaacccccugacuuuugcugucccaaaugccaguaccaagccccugauauggacacccugcagauccacgugauggagugcauugaauga

SEQ ID NO: 70674 - RNA, 1674 nt, Artificial Sequence
  derived and/or modified sequence opt5 from IK__Homo_sapiens__NP_006074
augcccgagagagacagcgaaccuuucuccaacccgcuggcccccgauggccacgacguggaugacccucauucuuuucaccagagcaagcucaccaaugaggauuuccggaaacugcuuaugacaccccgcgcugccccuacguccgcgcccccuucuaagagcagacaucacgaaaugccgcgggaguacaacgaagacgaggaucccgcugcccgcagacggaaaaagaaauccuauuacgccaagcugcgccaacaggagaucgaaagagagcgggaacucgcugagaaguaucgcgacagagccaaagagcggcgcgauggggucaauaaggacuacgaagagaccgaacugauuucuacaaccgcuaacuauagagccguuggaccuacagcggaggccgauaaaagcgcugccgaaaagcggcgccagcuuauccaggaguccaaauuucugggcggggacauggagcauacccaccucgugaagggacuggauuucgcucugcuccaaaaggugagagccgaaauugcgagcaaagagaaggaagaggaagaacugauggagaaaccccagaaggaaaccaaaaaggacgaggacccugaaaauaaaaucgaguuuaagacacggcuuggcagaaacgucuaccgcaugcuguucaagucuaaagccuaugaacggaaugagcucuuucugcccgggagaauggcuuacgugguugaucuugacgaugaguacgccgacacggauauuccgaccacacugauccgcuccaaggcugacugcccuaccauggaagcccagacaacccucacgacaaacgauaucgugauuagcaaacugacccagauccugucuuaucuccggcaaggaacaagaaauaagaaacugaagaagaaagacaagggcaaacuugaggaaaagaaacccccugaggccgauaugaacauuuucgaggacaucggcgauuacguccccuccaccaccaagacaccccgcgacaaggaacgggagagauaucgcgaacgggagagagaccgcgaacgggauagagaccgggaucgcgagagagagcgggaaagagaccgcgagcgggaaagagagcgcgauagagaacgggaggaggagaaaaagcgccacagcuacuuugagaaaccuaagguggacgaugaaccgauggacguugauaaagggcccggaucuacgaaggagcugauuaaguccaucaaugaaaaauucgcuggcagcgcggggugggagggaaccgagucccucaagaaaccugaagacaagaaacagcugggcgacuuuuucgggaugucuaacagcuaugccgaguguuaccccgcuacaauggaugauauggccguggacuccgacgaagaggucgauuauagcaagauggaccagggaaauaaaaagggcccucuuggcagaugggauuuugacacccaggaggaauacucugaguacaugaacaauaaggaagcccugcccaaagcugccuuccaauaugggauuaagauguccgagggacggaaaacacgcagauucaaggaaaccaacgauaaagcggagcucgaccggcaguggaagaagaucagcgcuaucauugagaaacgcaagaaaauggaagccgauggcguggaggugaagagaccgaaauacuga

SEQ ID NO: 70675 - RNA, 1299 nt, Artificial Sequence
  derived and/or modified sequence opt5 from IKZF1__Homo_sapiens__NP_001207697
auggacgccgaugagggccaggacaugagccaaguguccgggaaggaaucucccccugucagcgauaccccggacgagggagaugaacccaugccuauccccgaggaccuguccacaacgucuggcgggcagcagagcuccaaaucugauagaguuguggcuagcaacgugaaggucgaaacccaguccgacgaggagaauggacgggccugcgaaaugaacggcgaggaaugugcggaggaucuccgcaugcuggacgcuagcggggagaaaaugaauggaucucacagagaucaaggcuccagcgcccuuucuggcgugggagggauucggcugccuaacggcaagcucaaaugcgacaucugugggauuaucugcauuggacccaauguucugauggugcauaagcgcucccacacaggcgaaagaccuuuccaguguaaccagugcggggccagcuuuacccagaagggaaaucuucugcggcauaucaaacuccacucuggcgagaagccguucaaaugucaucugugcaacuacgcuugucgcagacgggaugcccugacaggccaccuccgcacccacuccggggacaagggacugagcgacacacccuaugauuccucugcuagcuacgaaaaagagaaugaaaugaugaagucccaugucauggaccaagccaucaacaaugcgauuaacuaucuuggcgccgagagccugagaccucucgugcagaccccucccgggggaucugagguugugcccgucaucuccccgauguaccagcugcacaagccucuugcugaaggcacgccccggagcaaucauucugcccaggauagcgcuguggagaaccugcuccugcuguccaaagccaagcucgugccuucugaacgcgaggcgagccccuccaauagcugccaagacucuaccgauacagaauccaacaacgaggagcagagaagcgggcugauuuaucuuaccaaucacaucgcuccccacgcccggaacggacugucucucaaagaggaacaucgcgccuacgaccugcuuagagcugccuccgaaaauagccaggaugcccugcgggucguuuccacaucuggcgagcaaaugaagguguauaaaugugaacacugcagagugcucuuucuggaccaugucauguacaccauucacaugggcugccauggguuccgcgauccuuuugaguguaacaugugcggauaccacagccaggaccgguaugaguucuccucucacaucacgagaggcgaacaucgcuuucacaugagcuga

SEQ ID NO: 70676 - RNA, 1503 nt, Artificial Sequence
  derived and/or modified sequence opt5 from IKZF2__Homo_sapiens__NP_001072994
auggagaccgaagccaucgacggcuacauuacaugcgauaacgagcugagccccgaaagagagcacuccaauauggcuaucgaccucacgucuagcaccccuaacgggcagcaugccuccccgucucacaugacaagcaccaauuccgugaagcuggaaaugcaaucugaugaggagugugaccggaaaccccuuagccgcgaagaugagauuagaggacaugacgaaggcuccagccuggaggagccucucaucgaaucuuccgaggucgcggauaaccggaagguucaggaacugcagggggagggaggcauucgccuucccaauggggaaagaccuuuccacugcaaccaguguggagcuagcuuuacacaaaaaggcaaucugcuccggcauaucaagcugcacucuggcgagaaacccuucaagugcccuuuuuguuccuaugccugccgcagacgggacgcccugaccgggcaccuccgcacacauagcgugggaaagccgcacaaauguaacuacugcggcagaucuuauaagcagcgguccagccuggaggaacauaaagagcgcugucacaauuaccuucagaacguguccauggaagcugccgggcaggucaugucucaccaugugcccccuauggaggauugcaaggaacaagagcccaucauggacaauaacauuagccugguuccuuucgagagacccgcugugaucgaaaaacucaccggaaauaugggcaagcggaaguccagcacgccgcagaaauuugucggggagaagcugaugcgcuucucuuauccugauauucacuuugacaugaaccuuaccuacgaaaaagaggccgaacugaugcagucccauaugauggaucaggcgaucaauaacgccauuacauaucucggagcugaggcccugcacccccugaugcaacauccucccagcaccaucgcugagguggcccccguuauuucuagcgcguacucccagguguaccacccuaacagaaucgaacggccgaucucuagagagacagccgacagccacgaaaauaacauggacggccccauuucccucauccgcccuaagagccggccccaggagagagaggcuucuccuuccaauagcugucuggauucuaccgacuccgaaagcucccaugaugaccaccaaucuuaucagggccaucccgcccuuaacccgaaacgcaagcagagcccugcuuacaugaaagaggaugucaaggcccuggacacgacaaaggcccccaaagggucccucaaggauauuuauaaaguguucaauggagaaggcgagcagauccgggcuuuuaagugcgaacacugcagagugcuguuccuugaccacgucauguacaccauucauauggggugucacggauaucgcgauccucuggagugcaacaucuguggcuaccggucucaagacagauaugaguuuagcucccauaucguucgcggggaacacacauuccauuga

SEQ ID NO: 70677 - RNA, 1428 nt, Artificial Sequence
  derived and/or modified sequence opt5 from IKZF3__Homo_sapiens__NP_001244337
auggaggacauccagaccaacgccgaacugaaaagcacacaagagcaguccgugcccgcugaugacucuaugaaagucaaggaugaauacagcgagagagacgaaaauguucucaaauccgagccuaugggcaacgccgaggaaccggagauucccuauucuuacagccgggaauauaaugaguacgagaacaucaagcuggaacgccacgugguguccuucgauucuagcagaccuacguccgggaaaaugaauugcgacgucuguggacuuagcugcauuucuuuuaacgugcugaugguucauaagcggucccacaccggcgagcgccccuuccaguguaaucagugcggggcgagcuuuacacaaaagggaaaccuccugagacauaucaaacuucacaccggcgaaaagccuuucaaaugucaucugugcaauuaugcuugucagcggcgcgaugcccucacagggcaccugagaacccacucuguggagaagcccuacaaaugcgaauuuuguggacgguccuauaagcagcgcagcucucuggaggagcauaaggaaagaugccggacauuccuccaguccaccgacccuggcgauacggccagcgcugaggcccgccacauuaaagcugaaaugggcuccgagagagcccugguccuugaccggcuggcgucuaacguggccaagcgcaaaagcuccaugccgcaaaaguuuaucggggaaaagagacauuguuucgauguuaauuacaacagcucuuacauguaugagaaggaguccgaacucauccagacccggaugauggaccaggcuauuaauaacgccaucagcuaccugggagcugaggcccuuagaccccuggugcagacaccucccgcgccuaccucugaaaugguccccgugauuagcuccauguauccgaucgcccucacacgcgcugagaugucuaauggcgccccucaagaacuggagaaaaagagcauucaucugcccgagaaguccgugccuagcgaacgggggcucucucccaacaacuccggacacgauagcaccgacacggacucuaaucacgaggaaagacagaaccacaucuaccagcaaaaucauaugguccugucccgcgcucggaacggcaugccccuucugaaagagguuccuagaagcuaugagcuccugaagccgcccccuauuugcccccgcgauuccgugaaagugaucaauaaggaaggggaggucauggacguguaccggugcgaucacuguagaguucuuuuucuggacuaugugauguucacaauccauaugggaugccacggcuuucgcgauccuuucgaauguaacaugugcggcuaccggucucacgacagauacgaguuuagcucccauauugcccgcggggaacaccgggcccuccugaaauga

SEQ ID NO: 70678 - RNA, 1758 nt, Artificial Sequence
  derived and/or modified sequence opt5 from IKZF4__Homo_sapiens__NP_071910
augcacaccccgccugcccugccgagacgguuccagggcgggggacgcgugagaacacccggcagccaucggcaagggaaggacaaccucgagcgcgauccuuccggaggcugcguccccgacuuucugccucaggcucaggauucuaaucacuucaucauggaaagccuuuucugugaguccucuggggacagcucccuggaaaaagaguuccucggagcccccguuggcccuucugugagcacgccgaacucccagcauagcucucccuccagaagccugucugcuaauuccauuaagguggaaauguacagcgaugaggagucuucccggcuucugggcccugacgaacgccuccuggagaaagaugacagcgucaucguggaagauucccugucugagccccucggguauugcgacggaagcggcccugagccccacucccccgggggaauuagacugccuaacggcaaacuuaagugugauguuugcgggaugguguguaucggacccaauguccugauggugcauaagcggagccacaccggcgaacgcccuuuucacugcaaccaauguggcgcgucuuucacacagaaggggaaucuccugagacauauuaaacuucacuccggagagaagcccuuuaaaugccccuucuguaacuacgccugccggcgcagagacgcccugaccggccaucuccggacacacagcguuucuagcccuaccguggggaagccguauaaauguaauuacugcggacgcuccuauaagcagcagucuacacuggaggaacacaaggaaagaugccauaacuaccugcaaagccucuccaccgaggcucaggcccuggcuggccagcccggggaugagauccgggaccuugaaauggucccugacagcaugcugcacucuuccagcgagagacccacguuuaucgaucgccucgccaauucucugaccaaacggaagagauccacaccucagaaauucgugggagaaaagcaaaugcgcuuuagccuuuccgaccugcccuaugaugugaacucuggcggcuacgagaaagacgucgaacucguugcgcaucacagccuggagccgggguucggauccucucuggccuuugugggcgcugagcaucuccggccucugagacuucccccuaccaauuguauuagcgaacugacacccgugaucuccagcgucuacacccagaugcagccucuccccgggcgccuggagcuuccgggaucucgggaagccggcgaggggccugaagaucuggcugacggcggaccccuccuguauagaccccgcggcccucugacggauccgggggccucccccagcaacggaugccaagacucuacagauaccgaguccaaucacgaggaccggguggcgggcguugugagccucccucaggggcccccuccccagccucccccgacaauugucgugggaagacacucuccugccuacgcuaaggaagaucccaaaccucaggagggccugcuucgcgggacccccggcccgagcaaggaaguucugcggguggucggagaguccggcgagccugugaaggccuucaaaugugaacauugcagaauccucuuccuggaccacgucauguuuaccauucauauggggugucacggauuccgggaccccuuugagugcaacaucuguggcuaucacagccaagaucgcuacgaauuuucuucccauauugugagaggggagcacaagguuggauga

SEQ ID NO: 70679 - RNA, 537 nt, Artificial Sequence
  derived and/or modified sequence opt5 from IL10__Homo_sapiens__XP_011507808
augcacagcuccgcccugcucugcugucuggugcuucugaccggcgucagagcuucucccgggcagggaacacaaagcgagaacuccugcacgcauuucccuggcaaucucccgaacaugcugcgggaccuucgcgaugccuuuucuagaguuaagaccuucuuucagaugaaagaccagcuggauaaucuccugcugaaggaaagccuccuggaggacuucaaaggguaccuuggaugucaggcgcuguccgaaaugauccaauuuuaucucgaggaagugaugccccaggcugagaaccaggauccugacauuaaggcccacgucaauucucugggcgagaaccuuaaaacacugcggcuccgccugagacggugccaucgcuuccugcccugugaaaauaagagcaaggccguggaacaggugaaaaacgcuuuuaauaagcuccaagagaaagggaucuacaaggccauguccgaguucgauauuuuuaucaacuauauugaggcuuacaugaccaugaaaaucagaaauuga

SEQ ID NO: 70680 - RNA, 1737 nt, Artificial Sequence
  derived and/or modified sequence opt5 from IL10RA__Homo_sapiens__NP_001549
augcugcccugccucgugguccugcuugccgcucugcucagccugagacuuggcuccgacgcccacgggaccgagcugccuucuccgcccagcguuugguucgaagcggaguuuuuccaucacauccuccauuggacaccuauucccaaccaguccgaaucuacguguuacgagguggcucugcugcgguauggaaucgaaagcuggaacuccauuucuaauugcagccaaacccucuccuacgaucugacagccgugacccuugaccuguaucacagcaauggcuaccgcgccagaguccgggcuguggaugggucucgccauuccaacuggacaguuaccaauacaagauuuagcguggacgaggucacccucacggugggaucuguuaaccuggagauccacaauggcuucauucuugggaagauccagcugccucggcccaaaauggccccugcuaacgauaccuaugaauccaucuuuagccacuuccgcgaguacgaaauugccaucagaaaggugccgggaaauuuuacauucacccauaaaaaggucaaacacgagaacuuuucucuccugacauccggcgaggugggcgaguucugugugcaggucaagcccagcguugcgucccggucuaauaaggggauguggagcaaagaggaaugcauuucccugacccgccaguauuuuacggugacaaacgugaucauuuucuuugccuucguccuccugcuuagcggagcucuggccuacugucucgcucugcaacuuuacgugagacggcgcaagaaacugccuucuguucuccuguucaagaaacccuccccuuuuaucuucauuagccagagacccucuccggagacccaggacacaauccauccucuggaugaagaggccuuucucaaggugagccccgagcugaagaaucuugaccugcacggcuccaccgauucuggguucggaagcaccaaaccuucccuccagacagaagaaccccaauuucugcuucccgacccucacccgcaggcggaucggacgcugggcaaccgcgaacccccuguccucggggacagcuguucuuccggaagcucuaauuccaccgauagcggcaucugccugcaggagcccucccugucuccuagcacaggccccaccugggaacagcaagugggguccaacucuagaggacaggacgacagcggcauugaucucguucagaacuccgaggggcgggccggagacacacaaggcgggagcgcucugggacaucacucuccgccugagcccgaagugccuggcgaggaagaucccgccgcugucgccuuccagggcuaucuuagacagacccgcugcgccgaggaaaaggcuacgaaaacagggugucuggaggaggaauccccucucaccgacggacugggccccaaguuugggcggugccugguggaugaggcgggacuucauccgccugcccucgcuaaaggcuaccugaagcaggacccccuggaaaugacccucgccagcucuggggcccccacaggccaauggaaucagccuaccgaggaguggucccugcuugcucugagcucuuguagcgaucucggaaucuccgacuggagcuucgcccacgaucuggcgccgcugggcugcgucgcugcccccgggggacuucucggcucuuuuaacuccgaccuggugacacugccucucauuagcucccugcagucuagcgaauga

SEQ ID NO: 70681 - RNA, 978 nt, Artificial Sequence
  derived and/or modified sequence opt5 from IL10RB__Homo_sapiens__NP_000619
auggccuggagccugggcuccuggcucgggggaugccugcuugugucugcucugggcaugguucccccuccggagaacgucagaaugaauagcgugaacuucaagaauauccuccagugggaaucccccgccuuugcgaaagggaaccugaccuucacagcucaauaccuuucuuaucggauuuuucaggacaaguguaugaauacgacccugacagagugcgauuucagcucccucucuaaauacggagaccacacccugcgcgugagagccgaauuugccgaugagcauagcgacugggucaacaucacauucuguccuguggaugacaccauuaucgggcccccuggcaugcagguugaagugcuggcugauucccuccacaugcgguuucuggcccccaagauugagaaugaguaugaaacauggaccaugaaaaacgucuacaauagcuggacguauaacgugcaguacuggaagaauggaaccgacgagaaguuccaaaucacaccucaguaugauuuugaaguucuucgcaaccuggagccguggaccacauacugcgugcaggucagaggcuuccuccccgaccggaauaaagcuggcgaguggucugaaccugugugugagcagaccacgcaugaugaaacagugcccuccuggauggucgccguuauccugauggcgagcguguuuauggugugccuugcccugcucggguguuucgcucugcuguggugcgucuacaagaaaaccaaguaugccuuuucuccucgcaacucccucccccaacaccugaaagaguuccuuggacauccgcaccacaauacacuucucuucuuuagcuucccucugucugacgaaaacgauguguuugacaagcuguccguuauugcugaggacagcgaguccggcaagcagaaccccggggauucuuguagccugggaaccccucccggccaggggccccaguccuga

SEQ ID NO: 70682 - RNA, 600 nt, Artificial Sequence
  derived and/or modified sequence opt5 from IL11__Homo_sapiens__NP_000632
augaacugcguguguagacugguccucguugugcugagccuuuggcccgacaccgccguggcuccuggcccgcccccugggcccccucgggucucccccgauccucgcgccgagcuggacucuacagugcuccugacgagaagccuucuggcggauacccggcagcucgcugcccaacugcgcgacaaguucccggccgauggagaccacaaucuggauucccuccccacacuggcuaugucugccggcgcucuuggggcccugcagcucccuggaguucugaccagacuucgggcggaccugcucagcuaccugcgccaugugcaguggcugagacgggccggcggguccucucucaaaacacuggaacccgagcuuggaacccugcaggcucgccucgauagacugcuucggcgccugcaacuccugaugagcagacuggcccucccucagcccccgccugaucccccugcuccuccccuggcgcccccguccagcgccuggggcggcauccgggccgcucacgccauucuugggggacugcaucucacacuggacugggcuguccgcggccuucugcuccugaagaccagacuguga

SEQ ID NO: 70683 - RNA, 1269 nt, Artificial Sequence
  derived and/or modified sequence opt5 from IL11RA__Homo_sapiens__NP_001136256
augagcuccucuugcagcggccuguccagagugcucgucgccguugcuaccgcccuggugucugcgagcucccccuguccucaggcuugggggccgcccggagugcaauacggccagccugggcggucugucaaacuuugcugucccggagugacagccggcgacccuguuagcugguuccgcgauggggagcccaagcugcuccagggaccugacuccggccugggccacgaacuugugcuggcccaggcugauagcacggacgaggggaccuauaucugccaaacacucgauggagcccugggcgggaccgucacacugcagcucggauacccgcccgcuagaccugugguuucuugucaggccgcggacuaugaaaacuuuuccugcaccuggagccccucucagauuuccggccugccuacacgguaccuuaccagcuaucgcaagaaaacggugcugggggccgauucucaaagacggucccccagcaccggaccguggccuuguccccaggacccucucggcgcugcccgcugcgucgugcauggcgcugaguucuggucccaguacagaaucaaugugacagaagucaacccccugggggccucuacccggcuucuggauguuagccuccaguccauucugcgccccgacccuccgcaaggacugagaguggagagcgugcccggcuauccucggcgccucagagcgucuuggacauaccccgccuccuggccuugucagccccacuuucugcuuaaguuccggcugcaguaccgcccggcucaacauccugccuggagcaccgucgagcccgcugggcucgaagaggugaucacggaugccguugccggacugccucacgcugugagagucucugcgcgggacuuucuugaugccggcacauggagcaccuggucccccgaggcuugggggacaccuucuaccggaaccauucccaaagaaaucccggccuggggccagcugcauacacagccugagguggaaccccagguugacagccccgccccuccgagacccucccuccaaccucacccccgccugcuggaccaccgggauagcguggagcaggucgcugugcucgccucucugggcauccuuuccuuccuggggcucgucgcgggagcucuggcccuuggccuguggcucagacugcgcagagggggaaaggacggcagcccuaagcccggguuucuggccucugugauuccuguugaucggcgccccggcgcuccgaaucucuga

SEQ ID NO: 70684 - RNA, 762 nt, Artificial Sequence
  derived and/or modified sequence opt5 from IL12A__Homo_sapiens__NP_000873
auguggcccccuggcagcgccucccagccgcccccuucucccgcugccgcgaccgggcugcacccugcugccagacccgugagccuccaaugccggcuguccauguguccugcccgcucucuucugcucgucgcuacacugguucuucuggaccaucucagccuggccagaaaccugccgguggcuacgcccgauccuggaauguuccccugccuccaccauucccagaaucugcuucgggccgugucuaacaugcugcagaaggcgcgccagacccucgaguuuuacccuuguacaagcgaagagaucgaccacgaagauauuaccaaagacaagacauccaccgucgaggccugccugccccuugaacugacaaagaaugagagcugucucaacucuagagagaccuccuucaucacgaauggcagcugccuggcuucucggaagaccuccuuuaugauggcccugugucucagcucuauuuaugaagaucugaaaauguaccaaguggaguucaagacaaugaacgcuaaacuucugauggacccgaaacgccagaucuuucucgaucagaauaugcuggccguuauugacgaacuuaugcaggcgcugaacuucaauuccgagaccgugccucaaaagagcucccucgaggaacccgauuuuuauaaaacaaagaucaaacugugcauccugcuccaugccuuccggauuagagcugucaccaucgaccgcgugaugucuuaccugaacgccagcuga

SEQ ID NO: 70685 - RNA, 987 nt, Artificial Sequence
  derived and/or modified sequence opt5 from IL12B__Homo_sapiens__NP_002178
augugccaccagcaacuggugaucagcugguucucccucgucuuucuggccucuccccuuguugcuauuugggagcugaagaaagacguguacguggucgaacucgauugguauccugacgccccgggcgagauggugguucugaccugugauacacccgaagaggacgggaucacguggacccuugaucagagcuccgaagugcugggaucuggcaagacacucaccauucaggucaaagaguucggggacgcgggacaguacacaugccauaagggcggggaggugcugagccacucccugcuccugcuucauaaaaaggaagauggaaucuggucuaccgacauucugaaggaucaaaaagagccuaagaacaaaacauuucucagaugugaagcuaagaauuauagcggccgguuuaccugcugguggcugacgaccaucuccacagaccuuaccuucagcguuaaaucuucccgcggcagcucugauccccagggggugacauguggagccgccacccuguccgcugagagaguccggggcgacaacaaggaguacgaauauagcguggagugccaggaagauucugccuguccugcugccgaggaaucccuccccaucgaggugauggucgacgcgguucacaagcugaaauacgagaauuauacgagcuccuucuuuauucgcgacaucauuaagccugauccgcccaaaaaccugcagcucaagccucugaaaaauucuagacaaguggaagugagcugggaguaccccgacacaugguccaccccucauagcuacuucucucuuacauuuugcguccaggugcaggggaaguccaaacgggaaaagaaggaucgcguuuucaccgacaaaaccagcgccacagugaucuguagaaagaacgcuucuauuagcguccgggcccaggaucgcuauuacuccucuagcugguccgagugggcuagcgugcccugcucuuga

SEQ ID NO: 70686 - RNA, 2109 nt, Artificial Sequence
  derived and/or modified sequence opt5 from IL12RB1__Homo_sapiens__NP_001276953
auguucgugggccuguuuagccuccuguccuucaacgucuuuagaucuggggacggaguugccgagccccggcgcuggcagagaggcagcccuggggcugugggacuuuacguggauccgauggaaccccuggucaccugggugguuccucuccuguuccuuuuucugcucucccggcaaggcgccgcgugccgcacaucugaguguugcuuccaggaucccccuuaucccgacgcugacagcggguccgccucuggaccuagagaucugcgguguuaccgcaucagcuccgacagauaugaaugcagcuggcaguacgagggcccgacggccggcgugucucacuuucugcgguguugccucuccagcgggcgcuguugcuauuucgcugccggaucugcuaccagacugcaguuuuccgaucaagccggcgucagcgugcuuuacacaguuacccuguggguggaaucuugggcgcggaaucagacagagaagucccccgaggucacccuccagcuguauaacagcgugaaauacgaaccuccccuuggggacauuaagguguccaaacuggccggacagcuccgcauggagugggaaacaccugauaaucaagucggcgcugagguucaguucagacaucggacccccucuagcccguggaagcugggggacuguggaccucaggaugacgauacggaguccugccuguguccccucgaaaugaacguggcccaggaguuucaacugcgcagacggcagcuuggcagccagggcuccuccuggagcaaauggucuagcccugugugcgucccucccgaaaaucccccgcaaccccaggugagauucuccguugagcagcuggggcaggacggacgccggagacucacccugaaggaacaaccuacacagcuugagcugcccgagggcugccaggggcucgcuccuggaaccgaagugacauaccgccugcagcugcacaugcucucuugucccugcaaggccaaagcgacccggacgcugcaucuuggcaagaugccguaucugagcggggccgcuuacaacgucgccgugaucuccagcaaucaauuuggaccuggccucaaccagacauggcacauucccgcugacacccauacagagccuguugcccugaauaucucugugggcaccaacgggaccacaauguauuggcccgccagagcucaguccaugacguacuguauugaauggcagccugucggacaagauggcgggcuugcgaccugcagccugacagcuccccaggacccggauccugccggaauggccaccuauucuuggucccgcgagagcggcgccauggggcaggaaaaauguuacuauaucacaaucuucgcuuccgcccaccccgagaagcucacccuguggucuacggugcugagcacauaccacuucggcggaaaugcguccgcugccggcacaccccaucacgucucugugaaaaaccauagccucgacuccguuagcguggauugggccccuucucugcuuucuaccugcccggggguccugaaggaguacgugguucgguguagagacgaagauagcaaacaggugucugagcaccccguccaaccuaccgaaacccaggugacacucuccggacugcgcgcuggcguggccuauacgguucagguccgggcugacaccgccuggcugagagggguguggagccaaccccagcgcuuuucuauugaggugcaggucagcgauuggcuuaucuucuuugcgucccucggcagcuuccugucuauucugcucgugggaguucugggguaccuuggccugaaucgggccgcuagacaccucugcccuccccugccuacacccugugccuccagcgcuaucgaauuuccgggaggcaaagagaccuggcaguggauuaacccuguggacuuccaagaggaagccucccugcaggaggcgcuugucguggaaaugucuugggauaagggggagcggacagagccccucgaaaagaccgagcugccugaaggagcccccgagcuggcucucgacacggaacugagccuugaggacggcgaucgcugcaaggccaaaauguga

SEQ ID NO: 70687 - RNA, 441 nt, Artificial Sequence
  derived and/or modified sequence opt5 from IL13__Homo_sapiens__NP_002179
augcacccccugcucaacccucugcuucuggcccucggccugauggcccuucugcucaccacagugaucgcucugacgugccuugggggauucgcgagcccgggccccgucccucccuccaccgcucucagagagcugauugaggaacuuguuaauaucacacagaaccaaaaggccccucuguguaaugggucuaugguguggagcauuaaccucaccgccggaauguacugcgcugcccuggaaucccuuaucaaugugucuggcuguagcgcuauugagaaaacacagcggaugcuguccggguuuugcccccauaaggucucugccggacaguucagcucccuccacgugcgcgacaccaaaaucgaaguugcgcaguuugugaaggaucugcugcuccaucugaaaaagcuguucagagagggccaauuuaacuga

SEQ ID NO: 70688 - RNA, 1284 nt, Artificial Sequence
  derived and/or modified sequence opt5 from IL13RA1__Homo_sapiens__NP_001551
auggaguggcccgccagacugugcggccucugggcucugcuucugugugccgggggaggcgggggaggcgggggagcggcuccuaccgaaacacagccgcccgugacgaaccucagcgucuccguugagaaucugugcaccgugaucuggacauggaacccucccgaaggcgccucuagcaauuguucccuuugguacuucucucacuuuggcgacaagcaagauaaaaagauugccccugagacccggcgcagcaucgaagugccccugaacgagagaauuugccuccaggucgggucccaguguucuacaaaugagagcgaaaaaccuuccauccugguggagaagugcauuagcccgcccgaaggagacccugagucugcuguuaccgagcugcaguguaucuggcauaaccucuccuauaugaaaugcagcuggcugcccggccggaauacaucuccugauaccaacuacacgcuuuauuacuggcaccgcucccuggaaaagauccaucaaugugagaauauuuucagagaagggcaguauuuuggaugcagcuucgaccucaccaaggugaaagauucuuccuuugagcagcacagcguccagaucauggugaaggacaacgccggcaaaauuaagcccuccuucaauaucguuccgcugacaucucgggugaaaccugaucccccucauauuaagaaccuuagcuuucacaaugacgaucuguacguccaaugggaaaacccccagaauuucaucucccgcugucucuuuuaugagguggaggugaacaacagccagaccgaaacacacaaugucuucuacguucaggaggcuaagugcgaaaaccccgaguuugaaagaaauguggagaacaccucuugcuucauggugccugggguccugccggacacgcugaauacagugcggauucgcguuaaaaccaacaagcucuguuacgaggaugacaaacugugguccaauuggagccaagaaaugucuaucggaaagaaaagaaacagcacacuuuauaucaccaugcugcucauugugcccgucaucguggccggcgcgauuaucguucugcuucuguaccucaagcggcugaaaauuaucaucuuuccucccauuccugaucccggcaagaucuucaaggagauguucggggaccagaaugacgauacccugcauuggaaaaaguaugacauuuacgaaaaacagacaaaggaggaaacggauuccgugguccucaucgagaaccugaaaaaggccucucaauga

SEQ ID NO: 70689 - RNA, 1143 nt, Artificial Sequence
  derived and/or modified sequence opt5 from IL13RA2__Homo_sapiens__NP_000631
auggccuucgugugccuggcuaucggcugucucuacaccuuucugauuagcacaacguucgggugcaccuccucuagcgacacagagaucaaggucaaucccccucaggauuuugaaauuguugacccgggauaucuuggcuaccuguaucuccaauggcagcccccucugucccuugaucacuucaaagaguguaccguggaauacgagcugaaguauagaaacaucgggucugaaacauggaaaaccauuaucacaaagaaccuccauuacaaagacggauuugaucugaauaagggcaucgaggccaagauucacacccugcuccccuggcagugcacgaacgggagcgaggugcaguccucuugggcggaaaccacauauuggaucagcccucaaggcauucccgagaccaaaguccaggacauggauuguguguacuacaauuggcaguaucugcuuugcuccuggaagccuggaaucggcguucugcucgacacaaacuacaaucuguucuauugguacgaagggcuugaucaugcucugcaguguguggacuauauuaaagccgauggacaaaacaucggcugccgguuuccguaccucgaggccagcgacuauaaggauuucuacauuugugucaaugggucuuccgagaacaaacccauccgcagcucuuacuuuaccuuccagcugcagaauaucgugaagccucugcccccuguuuaucucacguuuacaagagaauccagcugcgagauuaagcugaaauggucuaucccccuuggaccgauuccugcucgguguuucgacuacgaaaucgagauucgcgaagacgauaccacacuggugaccgccaccgucgagaacgagacauauacgcucaagaccacaaaugaaaccagacagcugugcuuuguggugcgguccaaagucaacaucuacugcagcgacgauggcaucugguccgaguggucugacaagcaauguugggaaggggaggaucuuagcaaaaagacacugcuccgcuucuggcugcccuucggauuuauucugauccucguuauuuucgugaccggccugcuucugagaaaaccuaauacguaucccaagaugauccccgaauuuuucugcgacacauga

SEQ ID NO: 70690 - RNA, 489 nt, Artificial Sequence
  derived and/or modified sequence opt5 from IL15__Homo_sapiens__NP_000576
augagaaucagcaagccccaucugcgguccauuucuauccagugcuaccucugucugcuucugaacagccacuuccucaccgaagccggcauucacguguuuauccuggggugcuucuccgcuggacuuccuaaaacagaagccaauugggucaacguuauuucugaccugaagaaaaucgaggaucucauccaaagcaugcauauugacgcgacgcuguauaccgaauccgaugugcacccgucuuguaaggugacagcuaugaaaugcuuucugcucgagcugcaggucaucagccuugaauccggcgacgccagcauucaugauaccguggagaaucugaucauucucgccaacaauucucuguccagcaacgggaauguuacagagucuggauguaaggaaugcgaggaacuugaggagaagaacaucaaagaguuccugcaguccuuugugcacauuguccagauguucaucaauaccagcuga

SEQ ID NO: 70691 - RNA, 696 nt, Artificial Sequence
  derived and/or modified sequence opt5 from IL15RA__Homo_sapiens__NP_001230468
augagcguggagcacgccgacaucugggucaaguccuacucucuguauagcagagaacgguacauuugcaacuccggcuucaaacgcaaggcugggaccucuagccucacagaguguguucugaauaaagccacgaacguggcgcauuggaccacacccucccuuaagugcaucagagauccugcucuggugcaccagcggccggcucccccuucuaccgucacaaccgccggagugacaccccaaccugaaagccucucccccagcggcaaagagccugccgccucuuccccgagcucuaauaacaccgcugccacgaccgcggccauuguucccgggucccagcugaugccuagcaagucucccuccacaggaaccacagaaaucagcucccaugagucuagccacggcaccccuucccagacgacagcuaagaauugggagcuuaccgccagcgcuucucaucagcccccggggguguauccucaaggacacuccgacacaaccgucgccauuagcaccucuacagugcugcucuguggccugagcgcgguuucccugcucgccugcuaccugaaaucucgccagacgcccccucuugcuagcguggaaauggaggccauggaagcucugcccgucaccuggggcacauccagcagagaugaggaccucgagaacuguucucaccaucuguga

SEQ ID NO: 70692 - RNA, 3996 nt, Artificial Sequence
  derived and/or modified sequence opt5 from IL16__Homo_sapiens__NP_001165599
auggagagccacuccagagccggcaagucucggaaaagcgcuaaguuccgcuccaucucuagaagccugaugcucugcaacgccaaaaccuccgacgaugggucuagccccgacgaaaaguacccugauccguuugagauuucccuggcgcagggaaaagaaggcaucuuccauagcucugugcaacuugcugacacauccgaggccgggcccagcucugucccugaucuggcccucgcuuccgaagccgcucagcugcaggccgcgggaaaugaccggggcaagacgugucgcagaaucuuuuucaugaaggagagcucuaccgccuccagccgggagaaacccgggaaacuugaagcucaguccucuaacuuucuguucccuaaggccugccaccaacgcgcuagaagcaauuccacaagcguuaaccccuauuguacccgggagauugauuuuccuaugacaaagaaaucugccgcgccgaccgaccgccagcccuacucccucugcagcaauagaaagucucugagccagcagcuggauuguccugccggaaaggcugccggcacaucccggcccacccgcucucucagcacggcucaacuggugcagccuuccggcgggcuucaggccagcgugauuucuaacaucguccugaugaaaggacaggccaagggccucggguucuccaucgugggaggcaaagacagcauuuaugggcccaucggaauuuacguuaagaccaucuuugcuggcggcgcggccgcugccgaugggagacugcaagaaggagacgagauucuugagcugaauggcgaaucuauggccgggcucacacaucaggaugcucugcagaaauucaagcaagccaaaaagggacugcucacccugacagugcggacccgccuuacggcgccgccuucccugugcagccaccucuccccuccccuguguagaucucuuagcuccucuacaugcaucaccaaggacagcuccagcuuugcucuggagucucccuccgcccccauuagcacagccaaaccuaacuaucggaucauggucgaagugucucuccagaaggaggcuggcguugggcugggaaucggccuguguuccgugccguacuuccagugcauuagcggcaucuuuguccauacccucucucccgggagcguggcccaccuggacggaagacuucgcuguggcgaugaaauuguggagaucuccgacagcccuguccacugccugacccucaaugagguuuauacaauucugucucauugcgaucccgggccugugcccaucaucgugucccggcacccggacccucaggucagcgaacaacagcuuaaagaggcuguggcccaggcgguugaaaacacgaaguucggaaaagagagacaucaguggucccuggaaggcgugaagcgccucgagucuagcuggcacgggcggcccacccuggagaaggaaagagagaaaaauuccgccccuccccaccgccgggcucaaaaggucaugauuagaucuagcuccgauucuagcuacauguccggcagcccuggaggcucucccggguccggaagcgccgaaaaaccgucuuccgacguggauaucagcacacauucuccuucccugccccucgcucgcgagcccguugugcugagcauugccuccagccggcuuccucaggaaucuccgccccugccugagagcagagacucccaucccccucuccgccugaagaaaucuuucgagauccugguccggaagcccaugagcuccaagccuaaacccccgccuagaaaguacuuuaaaucugauagcgacccccagaagucccuugaggagcgggaaaacucuagcuguuccagcggccacaccccucccacaugcgggcaggaggcgcgcgagcuccugccgcugcuccugccucaagaagauaccgccggaagaucucccuccgcuagcgccggcuguccugggcccggcauuggaccccagacgaaaucuuccacagagggcgaaccuggguggcggagagcuagcccggugacccagaccucccccaucaagcacccucuucugaagcgccaggcccggauggacuauucuuucgacacaaccgccgaggaucccugggucagaaucagcgacugcauuaaaaaucucuuuuccccuaucaugagcgaaaaccauggacacaugccccugcaaccuaaugcuucucugaacgaggaggaaggcacacaggggcacccggauggaacgcccccuaaacuugacaccgcgaacggcacacccaagguguacaaguccgccgauagcucuaccguuaaaaaggggccucccguggcuccgaaaccugccugguuccgccagagccucaagggccugagaaaucgggccuccgacccccgcggacugcccgauccugcucucucuacacaacccgccccugcgagcagagagcaucugggcucccacauucgggcuucuagcuccagcuccuccauccgccagagaauuagcuccuuugaaaccuucgggucuagccagcuuccggacaagggagcccagcggcugucccuccaacccucuagcggcgaggccgcuaaaccucuggggaagcaugaagagggacgcuuuuccggccugcuugggagaggcgccgcgcccacgcucgucccucagcagcccgaacaggugcugagcucuggauccccggcugccagcgaagcccgggauccuggcguuucugagucucccccucccgggcgccaaccuaaccagaaaacccugcccccgggaccugacccccuccugagacuucugagcacacaggcugaagagucucagggccccgugcucaagaugccuagccaacgggccagauccuucccgcugacccgcucucagagcugugaaacaaaacugcuugaugagaagaccuccaagcucuauagcaucuccucucaggucagcuccgcugugaugaaaucucugcugugccuccccagcuccauuucuugugcccaaacgccuugcauccccaaggagggggcgagcccuacauccagcucuaaugaagacuccgccgcuaacggaagcgccgagaccucugcucuggauacaggcuuuucccuuaaucugagcgaacuccgggaguacaccgagggccugaccgaagccaaagaggacgacgauggggaccacucuucccugcagagcggacaguccgugaucagccuucugucuagcgaggaacucaagaaacugauugaagagguuaagguccucgaugaggccacacugaagcagcuugacggcauccacgugacgauucugcauaaagaagagggggcuggacucggcuucucccuggccgggggagcggaucuggaaaacaaggugaucaccguccacagaguguuucccaauggccuugcuucucaagagggcacaauucagaaagggaacgaaguucugagcaucaauggaaagucccucaaaggcaccacacaucacgacgcccuggccauccuccgccaggcucgggagccuagacaggccgugauugucacccgcaagcugacgccggaggcgaugcccgaucuuaacucuagcacagacuccgcugccucugccagcgcugccuccgaugugagcguugaaucuaccgaggcgaccguguguacagucacccuggaaaagauguccgcugggcucggauucagccuggagggcgggaaaggaucucugcauggcgacaagccucuuacaaucaaucggauuuuuaaaggcgccgccuccgaacaaagcgagacggugcagcccggggaugagauccugcagcucggaggcaccgcuaugcaggggcugacaagauucgaagccuggaacauuaucaaggcucucccugacggacccguuaccaucgugauucgccggaaaucccugcaaucuaaggagacaaccgccgcgggcgauagcuga

SEQ ID NO: 70693 - RNA, 468 nt, Artificial Sequence
  derived and/or modified sequence opt5 from IL17A__Homo_sapiens__NP_002181
augacccccggcaagacaagccuggugucccuccugcuucugcucucucuggaggccaucgucaaagcugggauuacgaucccuagaaacccgggaugccccaauagcgaagacaagaacuucccucggaccguuauggugaaucuuaacauucacaaucgcaacacaaauaccaaccccaaaagauccucugauuacuauaaucggagcacauccccuuggaaccugcaucgcaaugaggaccccgaaagauacccuucugugaucugggaggccaagugucggcaccucggcugcauuaacgcggaugggaaugucgacuaucauaugaacagcgugccgauccagcaagaaauccugguucugcgcagagagcccccucacugucccaauuccuuucggcucgagaaaauucuggugagcgucggaugcaccugugugacaccuaucguucaucacguggcuuga

SEQ ID NO: 70694 - RNA, 543 nt, Artificial Sequence
  derived and/or modified sequence opt5 from IL17B__Homo_sapiens__NP_055258
auggacuggccccacaaccuccuguuccugcuuaccaucagcauuuuucugggccucgggcagccuagauccccgaagucuaaacggaagggacaaggccgccccgggccucuggcccccggaccucaucaggugccccuugaucuggucagcagaaugaaaccuuacgcucggauggaggaauaugagcgcaauaucgaagagaugguugcccagcucagaaacuccucugaacuggcgcagcggaagugcgaggugaaucugcaacucuggaugagcaacaaacgcucccugucuccguggggcuacagcauuaaucacgaccccuccagaaucccuguggaucuucccgaggcucggugucugugccucgggugugucaacccuuucacaaugcaggaagaccgcagcauggugucuguucccguguuuucccaggucccggugagacggcgccugugcccucccccucccagaacgggacccugucggcagcgcgccguuauggagaccauugccgugggcugcacauguaucuucuga

SEQ ID NO: 70695 - RNA, 594 nt, Artificial Sequence
  derived and/or modified sequence opt5 from IL17C__Homo_sapiens__NP_037410
augacccugcuccccggccugcuuuuccugacauggcuccacacgugccuggcccaucacgacccuagccuuagagggcauccgcacucccauggaacaccccacuguuacucugcugaagaacugccucucggccaggcgcccccucaucugcuggcccgcggggcuaaguggggacaagcccuccccguggcccuggucagcucccuugaggcugccucucaccggggcagacacgaacggccuagcgcuaccacccagugcccgguucugcgccccgaggaagugcucgaggccgauacacaucagagauccaucucuccuuggcgguaucgcguggacaccgaugaggacagauacccccagaaacuggcguuugccgaaugucuuugccggggguguauugaugcucgcacaggaagagagaccgccgcucugaacagcguccggcuccugcaaucccugcucgugcugcgcagacggccuugcagccgcgacggcucuggccuucccacgccgggggccuucgcguuucacaccgaguucauccacguuccugugggauguacaugcguccugcccagauccguguga

SEQ ID NO: 70696 - RNA, 609 nt, Artificial Sequence
  derived and/or modified sequence opt5 from IL17D__Homo_sapiens__NP_612141
augcugguggccggcuuccuccuggcccuucccccuagcugggcugcgggggcuccgagagccggacggcgccccgccagaccucggggcugcgcugaccgccccgaggaacugcucgagcagcuguacgggagacuugccgcuggaguccuguccgccuuucaccauacccuccaacugggcccucgggaacaggcgcgcaacgccucuugucccgcugggggaagaccugccgaucggcgcuucagaccgcccacaaaucugcggagcguuuccccuugggcuuaucgcaucucuuacgaccccgccagauauccucgguaccuccccgaggcguauugccugugucgcggcugccuuacgggccuguuuggggaagaggaugugagauuccggagcgccccgguguacaugccuaccgucgugcucagacgcacacccgcuugugccggaggccgguccguuuauaccgaggcuuacgugacaauuccugucgggugcaccugugugcccgaacccgagaaggacgccgauucuaucaacagcuccauugacaaacagggagccaagcugcuucugggcccuaaugaugcuccggcggggcccuga

SEQ ID NO: 70697 - RNA, 492 nt, Artificial Sequence
  derived and/or modified sequence opt5 from IL17F__Homo_sapiens__XP_011512578
augaccgugaagacacugcacggccccgccauggucaaauaccuccugcuuagcauccuggggcucgcuuuccuguccgaggccgcggcuagaaagauuccuaaaguuggacauacguuuuuccagaagccggaaucuugucccccugugcccggcgggagcaugaaacuugacaucggaauuaucaacgagaaucaacggguguccaugucucgcaacauugaaagcagauccaccucuccuuggaauuauacagucaccugggaucccaaccgguacccuagcgaggugguucaggcccagugccgcaaucugggcugcaucaacgcccaggggaaggaagacaucuccaugaauagcgugccgauucaacaggagacacucgucgugagacggaagcaccagggauguucuguuuccuuucagcuggagaaagugcuggucaccgugggcugcacaugugugacccccgucauccaucacguucaauga

SEQ ID NO: 70698 - RNA, 2499 nt, Artificial Sequence
  derived and/or modified sequence opt5 from IL17RA__Homo_sapiens__NP_001276834
augggcgccgcuagaagcccucccuccgccgugccggggccccugcucggacugcuucugcuccugcuuggcguccuggcgccugggggagcuucucuccggcugcuggaccaccgcgcccucguuugcagccagcccggccugaacuguaccgugaaaaauuccacaugccuugaugacucuuggauccauccuagaaaccugacgcccagcuccccuaaggaucuccaaauucagcugcacuucgcccauacccagcagggggaccuuuuuccgguggcucacaucgaguggacacugcaaaccgaugccucuauucucuaccuggaaggagcugagcugagcguccuccagcugaauacaaacgaacggcuuugugugcgcuucgaguuucuguccaagcucagacaucaccaccggcgcuggagauucaccuuuagccauuucguuguggaccccgaucaggaauaugaggucacagugcaccaucugccuaaacccaucccugacggcgaucccaaucaccagucuaagaacuuucuuguuccggacugcgagcacgcccggaugaaagugaccacgccuuguauguccagcggcucucugugggaucccaauauuaccgucgaaacacucgaggcgcaucaacugcgcguguccuucacccuguggaacgaaagcacacacuaccagauccuccugaccucuuuuccucauauggagaaucacuccugcuucgagcauaugcaccacauccccgcccccagaccugaagaguuucaucagcggagcaacgugacgcuuacacugcgcaaucucaagggguguugcagacaccagguccaaauucagccguucuuuuccucuugucugaacgacugccuucggcauagcgcuaccguuuccugucccgaaaugccugauacacccgagccuauccccggaccgggcagcgaaaaguauucugacgacaccaaauacaccgaugggcugccugccgcugaccucauucccccuccccugaagccucgcaaaguguggaucauuuauuccgccgaucacccccuguacguggacgucgugcucaaguucgcgcaguuccugcuuacagccugcggaacggagguugcucuggaucuccuggaggaacaagccaucagcgaggcuggcgugaugaccugggucgggagacagaaacaggaaaugguggagucuaauagcaagauuaucguucugugcucccggggaacaagagccaaguggcaggcccuucucggccgcggcgcuccggugcggcugagaugugaccacgggaaaccugucggagaucuguuuaccgcggccaugaacaugauccuccccgacuucaagcgccccgcuugcuuuggcacauauguggucuguuacuucucugaagugagcugcgauggggacguuccugaucuguuuggagccgccccgcgguacccccuuauggacagauucgaggagguguauuuucgcauucaagaccuggaaauguuccagccuggccggaugcauagagucggggagcucuccggagauaauuaccugcgcagccccggcggccggcagcugagagcugcccuugaccgcuuucgggauuggcaagugagauguccugacugguucgaaugcgagaaccucuauucugcggaugaccaggaugcucccucccuggacgaagagguuuuugaggaaccucugcugcccccggggaccggaaucgugaaacgggccccucugguccgcgagcccggcagccaggccugucuugcuauugauccucuggugggggaagagggaggcgccgcuguggccaagcucgagccccaucugcagccgagagggcagccugcgccccaaccucugcacacgcuuguucucgccgcugaagagggcgcccuggucgcugccguggaacccggaccccuggcggacggcgccgcugugcggcucgcccuggcuggggagggagaagccugcccucuucugggcucuccgggggccggaagaaacuccguccucuuccugcccguggauccugaggacagcccccugggcuccucuacaccuauggcuagccccgaucuucucccugaggacguucgcgaacaccuggaggggcugaugcucucccuguuugaacagucucuuagcugucaggcgcagggcggaugcucccggccggccauggugcugaccgacccccauaccccuuacgaggaggaacaaagacagagcguccagucugaucaaggcuauaucucccgcagcucuccccagccucccgaggggcucacagaaauggaggaagaggaagaggaggaacaggacccgggaaaaccugcucugccccugucccccgaggaucuugaaagccugagaucucuccagcggcaacuccucuuccgccagcugcagaagaauagcggcugggacaccaugggguccgagagcgagggaccuucugccuga

SEQ ID NO: 70699 - RNA, 1509 nt, Artificial Sequence
  derived and/or modified sequence opt5 from IL17RB__Homo_sapiens__NP_061195
augagccuggugcuccugucccuugccgcucugugcagaucugccgucccccgggagccuaccguucaguguggcagcgaaacagggccgucccccgaguggaugcuccaacacgaccugaucccuggagaucuucgcgaccugagaguggaacccgugacgaccucugucgcgacaggcgauuacagcauucucaugaacguguccuggguucugcgggcugacgccucuauccgccugcucaaggccaccaaaauuugcgugacaggcaagagcaauuuccaguccuauagcugugucagaugcaacuacaccgaggcuuuucagacacagacccggccuucuggaggcaaauggacguucuccuauaucggguuucccguggaacugaauaccguuuacuucauuggagcccauaacaucccuaaugcuaacaugaaugaggauggcccgagcaugucugugaacuuuacaucccccggcugucuugaccacaucaugaaguauaaaaagaagugcgucaaagccgggagccugugggauccuaauauuaccgcguguaagaaaaacgaggaaacaguggaggugaauuucaccacgacaccccucggaaaccgcuacauggcccugauccaacauucuaccauuaucggcuuuucccaggucuucgaaccucaccagaagaaacagacaagagcuagcguugugauucccgugaccggggacuccgagggagccaccguccaacuuacaccguauuuuccuacgugcggcucugauuguauccggcauaaggggaccgugguucugugcccccagacaggagugccuuucccccucgacaauaacaagagcaaacccggcggcuggcugccucugcuccugcuuucccugcucgucgcuaccugggugcugguugccgggauuuaccuuauguggcgccacgagagaaucaagaaaacauccuuuucuaccacgacacugcucccgcccaucaaggugcuggucguguacccuuccgaaauuuguuuccaccauaccaucugcuauuuuaccgaguuccugcagaaucacugccggagcgaagucauucucgagaaauggcagaagaaaaagaucgcggaaaugggacccgugcaauggcuggccacacagaagaaagcugccgauaagguuguguuccuucugucuaacgacgucaacagcgugugugaugggaccugcgggaaauccgagggaucuccuagcgagaauagccaggaccucuuuccccuggcuuucaaccuguuuuguagcgaccuucgcucucaaauucaucuccacaaguacguuguggucuauuucagagaaaucgauacaaaagacgauuacaaugcccuguccgugugcccgaaguaucaccugaugaaggacgccacggcuuuuugugcggagcuccugcaugugaaacagcagguuagcgccggcaagcggucucaggcuugccacgauggguguugcucccuuuga

SEQ ID NO: 70700 - RNA, 2124 nt, Artificial Sequence
  derived and/or modified sequence opt5 from IL17RC__Homo_sapiens__NP_001190192
augcccgugccuugguuccugcucagccuggcccuuggccgguccccggucguucugucucucgagcggcugguggggccccaggacgcuacccacugcagcccuggacuuuccugucgccugugggauucugacauccucugccugcccggcgauauugugccugcccccgggccuguccuggcgccgacacaucuccaaacggaacuggugcuuagaugucagaaggagaccgacugcgaucugugucuccggguugcugugcaccuggccguccauggacacugggaggagcccgaagacgaggagaaauuuggcggggccgcugauagcggaguggaggaaccucgcaacgccucccuucaggcucagguugugcugucuuuccaagccuaccccacagcgagaugcguccuccuggaaguccaggugccugccgcucugguccaguuuggccagagcguuggcuccgugguguaugacuguuucgaggccgcucucgggagcgagguccggaucuggucuuacacccaaccccgcuaugaaaaggagcugaaucauacacagcagcuuccggauugcagaggacuggaaguguggaacuccauuccuagcuguugggcccuccccuggcugaauguuucugcggacggcgauaacgugcaccuuguccugaauguguccgaggaacagcacuuugggcucagccuguacuggaaccaaguucagggaccucccaaaccccgguggcauaagaaucugaccggcccucagaucauuacacucaaccacaccgaccuggugccgugccuuuguauccaagucuggccccuggagccugauucugugcgcacgaauaucugccccuucagagaggacccucgggcccaucagaaccucuggcaggcugcccgccugagacuucugacccuccaguccuggcugcuggacgcucccugcagccucccggccgaagccgcucuguguuggcgggcgccugggggagaucccugccaaccucuugugcccccucuguccugggagaaugugacaguugacaaagugcucgaauuuccccugcugaagggccacccgaaccuuuguguccagguuaauucuagcgagaagcuccagcugcaggaaugccugugggccgauucccucggcccucugaaagacgaugugcuucugcucgagacccgcgggccccaagacaacagaagccugugugcucuggagcccucuggaugcacaucccuuccuagcaaggccucuacccgggccgcuagacucggcgaauaucugcugcaggaucuccagagcgggcagugucugcaacuuugggacgaugaccugggagcccucugggcgugcccgauggauaaauacauucacaagcgcugggcucugguguggcuggccugucuucucuucgccgcugcccugucccugauccuccugcuuaaaaaggaccaugcuaaggccgcggcccggggcagagcugcccugcuccuguauucugcugacgauagcggguuugagcgccuggucggagcccuugcguccgcccucugccagcugccccugcggguggcuguggaccucuggagcagacgcgaacugucugcccagggcccuguugcuugguuccacgcccagcggagacaaacgcuucaggagggcggggucguggugcugcucuuuucccccggagccgucgcucuguguagcgaauggcugcaggauggcgugucugggccuggagcgcauggcccccacgacgccuuccgcgcuucccuuagcugcguucugccugauuuucuccaagggcgggcccccggcuccuacgugggagccugcuucgacagacugcuccauccggaugcugucccugcccuguuccgcacagugcccguuuuuacccuuccuucucagcugcccgacuuccucggcgcgcugcagcagccgcgggcuccuagaagcgggcggcugcaagagcgcgccgaacagguguccagagcccuucagcccgcucuggauucuuacuuucacccucccggaacacccgccccuggcagaggggucggaccgggcgcggggcccggcgcuggagacggcaccuga

SEQ ID NO: 70701 - RNA, 2220 nt, Artificial Sequence
  derived and/or modified sequence opt5 from IL17RD__Homo_sapiens__NP_060033
auggcccccuggcugcagcucugcagcguguucuuuaccgucaacgcuugucugaauggcucccaacuugccguugcggcugggggaucuggcagagcccgcggggccgacacaugcggauggcggggcguggggccugcuagcagaaacuccggacuguacaauaucacguucaaguaugauaacuguaccacauaccucaauccggugggcaaacacgucauugccgacgcucagaacaucaccauuucucaguaugccugccaugaucagguggcgguuacaauccuguggagccccggcgcccuugggauugaguuucugaagggauuccgggugauccucgaagaacugaaauccgaaggccgccaaugucagcagcugauccucaaggacccuaaacagcuuaauucuagcuuuaagagaaccgggauggagucccaacccuuccugaacaugaaguuugaaacagauuacuucgucaaagugguuccuuuucccagcauuaagaaugagucuaacuaucacccuuucuuuuuccggacccgcgcuugcgaccugcuccugcagccggauaaucuugccuguaaacccuuuuggaagccuagaaaccugaauaucucccagcauggaagcgacaugcaagugucuuucgaucacgcuccccauaacuucggcuuucgguucuuuuaccuccacuauaaacugaagcacgaggggccuuucaagcgcaaaacgugcaagcaggaacagaccacagagaccacauccugucugcuccagaaugucagccccggagacuacauuaucgaacugguggaugacaccaacacgacaagaaaagugaugcauuacgcccuuaagccgguccacucuccuugggcgggccccauucgggccguugcuaucaccgugccucugguggucauuuccgccuuugcuacacucuucaccgugaugugccgcaaaaagcaacaggagaacaucuauagccaucuggaugaggaauccucugagagcuccaccuacacagccgcccuucccagagaacggcugcgccccagaccuaaaguuuuucucuguuauagcucuaaggacggccagaaucacaugaacgugguccagugcuucgcuuacuuucugcaagacuucugcgggugugagguggcgcuggaucucugggaagacuuuucccugugccgggagggacagagagaguggguuauccagaagauucacgaaagccaguucaucauuguggucuguucuaaaggcaugaaguauuuuguggauaaaaagaauuacaaacauaaagggggaggccgcgggagcggaaagggcgagcuuuuccuggucgccguguccgcuaucgccgaaaagcuccggcaagccaagcagucuagcuccgcugcccugagcaaauucauugcgguuuauuuugacuacucuugcgagggcgaugugccggggauccuugaccuguccacgaaguacagacucauggauaaccugccccagcuguguagccaccuccauucucgcgaccacggacugcaggaaccuggccaacauacccggcagggguccagacgcaauuauuuccggagcaaauccggaagaucucuuuacgucgcuaucugcaacaugcaccaguuuauugaugaggagcccgacugguucgaaaagcaguuugugccuuuccaucccccgccucugcgcuaucgggagcccguucucgaaaaguuugauagcggccuggugcugaaugacgucauguguaaaccugggcccgaguccgacuucugccuuaagguggaagccgccgugcucggcgcuacaggaccugccgauucucaacacgagagccagcacggcgggcuggaccaggauggagaggcuagacccgcccuggacggcuccgcggcccuccaaccgcugcuucauaccguuaaagcugggagcccuucugauaugccccgcgacuccggaaucuacgauagcucuguccccuccagcgaacugucucucccucugauggagggccugagcacagaccagaccgaaacguccagccuuacagagucuguguccagcuccucugggcucggcgaggaggagccgcccgcccugccuagcaagcugcucuccucuggaagcuguaaagcugaucugggcugccgguccuauaccgacgaacuucacgccguggcgccccuguga

SEQ ID NO: 70702 - RNA, 1602 nt, Artificial Sequence
  derived and/or modified sequence opt5 from IL17RE__Homo_sapiens__NP_001180309
augggcagcuccagacuggccgcucuccugcuuccccugcuccugaucgugauugaccuuucugauagcgccgggaucggauuccggcaccuuccucauuggaacacccgcugcccgcucgcgucccacacagacgauucuuuuacgggcagcuccgcuuacauucccuguagaaccuggugggcccuguucucuacaaagccuuggugcguccggguuuggcauuguagccgcugccugugucagcaccuccuguccgggggaagcggccuucaaagagggcuguuucaucuccuggugcagaaaucuaagaaauccagcaccuucaaguuuuaucggcgccacaaaaugcccgccccugcucagagaaagcugcugccccggcgccaccucucugagaagucccaucacaucagcauuccuucuccggacaucucccauaaaggacugagaagcaagcggacacagcccuccgauccugaaaccugggagucucugccccgccucgacagccaaagacacggcggcccugaguucuccuuugaucugcuucccgaagcccgggcuauccgcgugacaauuagcucugggccggaagucuccgugagacugugccaccagugggcccucgagugugaggaacugagcucuccuuacgacguucagaaaaucgugagcggaggccauaccgucgagcuucccuaugaguuccugcucccuugccuguguauugaagcguccuaccugcaggaggauacggugcggagaaagaaaugccccuuucaaucuuggcccgaagccuaugggagcgacuucuggaaguccguucacuuuaccgauuacagccagcauacacagauggugauggcucucacccugcgcuguccucuuaagcuggaggccgcucucugccagcggcacgacuggcauacacugugcaaagaucuuccgaaugccaccgcgagagaaucugacggaugguauguccuggagaagguggaccuccacccccaacuguguuucaaauuuuccuucggcaacagcucucacguggaaugcccucaucagacggggucccugacaagcuggaaugucuccauggauacccaggcccaacagcucauccugcacuucucuagccgcaugcaugcuacauuuuccgccgcuuggucucuucccggacugggccaggacacccucguuccucccguguacaccgugagccaggcccggggcuccagcccggucucucuggaucugauuaucccuuuccuuagacccggguguugcgugcuccugcacgccucccugagcucuccuggaggcgaggacgcuuggcucauugggguuggaggcuccgugcccagcggggucgcggugcgcuguccuguuugccuggaggcuccccuugugucuggaugucugcuccaaacaccgggcgcccuggauccuggcacggccgggccuccccaccccaccggaugcuguagcggcccgcaucugcccgccccuacaguccggcccgggccuuccgcugccagcgcgcccccugcuagaggaggccuugggggcgccgccgcucccggaggcucugccggguga

SEQ ID NO: 70703 - RNA, 1011 nt, Artificial Sequence
  derived and/or modified sequence opt5 from IL17REL__Homo_sapiens__NP_001001694
augagcagauccgugcuggaggcccucaccucuagcacagcuaugcagugcguccccuccgacggcugugccaugcugcuucggguucgcgcgucuaucacgcugcacgaaagacuccgggggcuggaggcuugcgccaugagccuugauacccaagaaacacagugucaguccguguggguggcccgcgcuucucauagacagcaaggaggccagcagcugcagguccacuucgggugcuuugccgugagcguugcucaacaucucuacgugacccugcggacaauuccucacuucuguggaguccagcuggaccagcgccaucucguggaggccggcaagcuguccuauuggguugauagacggcgcaaagcgauccuugugcaggucccgagagccagcgggucucccgacuacuaucugcggcucugccugaagcgcuuuaccugugaagaugcuggagccccugugagagugacagcuaacuccgucagccaagccguuuuccuucccuacucucaggagcugccuugccucugucuggagggcugguccgcgacccccgacgccgugcggauucagaucugcccuuuugaaaaugauacggaggcucuggaagugcucugggacaccgucuauuaccacccggagagccaaacacugucuugggagcccgccuguccuguguccggccacguuagccuuugcuggcgccccgggccuggagcuggcugcagaaaacugcagcaguccucucagcucgugcaucggagaguccaauauccccugguggauacccagccgcagcuuugucugaaguucagcacauccugggggagcuggguucgcugcccuuuugaacagcggagauuccccaccccucccacgucucgcuguacaugcgugaccggaggcucccacagcucucuccccgccaacgcccauagccggccugcuagaucccugcaaccgcaggucacauggcagcccccucugcuccugcccucuuga

SEQ ID NO: 70704 - RNA, 585 nt, Artificial Sequence
  derived and/or modified sequence opt5 from IL18BP__Homo_sapiens__NP_001034749
augaccaugagacacaacuggacacccgaccugagcccucucugggugcugcuucugugcgcccaugucguuacgcuccuggugcgggcuaccccggugucccagacaaccacagccgcgaccgcuucuguccgcagcacaaaggaucccuguccuucccaacccccuguguuccccgccgccaaacagugcccugcucuugagguuaccuggccggaaguggaggucccccugaauggcacgcucucucugagcuguguggccugcuccagauuuccuaacuucucuauccuguacuggcucgggaauggcagcuuuauugaacaucugcccggacggcuuugggagggguccaccagccgcgaaagaggaucuacaggcacccagcuguguaaggcucucguucuggagcagcuuaccccugcccugcacuccacaaacuucagcugcgugcucgucgaccccgagcaaguggugcagcggcacgucguucuggcgcagcugugggccgggcuccgcgcuacgcugccgccuacacaggaagcccuucccucuucccauagcucuccucaacagcagggauga

SEQ ID NO: 70705 - RNA, 570 nt, Artificial Sequence
  derived and/or modified sequence opt5 from IL18__Homo_sapiens__NP_001230140
auggccgcugagcccguggaagacaacugcaucaauuucgucgccaugaaguuuauugauaacacccuguacuucaucgagaaucucgaaagcgacuauuuuggcaaacuggaguccaagcucucuguuauuagaaaccugaaugaucaggugcuuuucaucgaccaagggaaccggccucuguuugaagauaugacagacagcgauugucgcgacaaugcgccgagaacgauuuucaucaucuccauguacaaagauucucagccccggggaauggcugugaccauuagcgucaagugcgagaaaaucuccacacuuucuugugagaacaagauuaucagcuuuaaggaaaugaauccucccgacaacauuaaagauaccaaguccgacaucauuuucuuucagcgcagcgugccuggccacgauaauaaaaugcaguucgagucuuccagcuaugaaggguacuuucuggccugcgagaaggagagagaccucuucaaacugauccugaagaaggaagacgagcucggagaucggucuaucauguuuacaguucaaaacgaagacuga

SEQ ID NO: 70706 - RNA, 1626 nt, Artificial Sequence
  derived and/or modified sequence opt5 from IL18R1__Homo_sapiens__NP_003846
augaacugcagagagcugccccucacccugugggugcuuaucagcgucuccacagccgaaucuuguacgagccggccucacauuaccguuguggagggcgaaccguucuaccugaagcauugcuccuguucucucgcucacgagaucgaaacaaccacaaaaagcugguauaaguccucugggagccaggagcauguggagcugaauccccgcuccagcucuagaauugcccuucacgacugcguccuggaauuuuggccuguggagcucaacgauaccggauccuacuucuuucaaaugaaaaauuauacacagaaguggaaacugaacguuauccggcgcaauaagcauagcuguuucaccgaaagacaggugacgucuaagauugucgaggugaaaaaguuuuuccagauuaccugcgagaacuccuacuaucaaacacugguuaauagcaccucucucuacaaaaacuguaagaaacugcuucuggaaaauaacaagaaucccacaaucaagaaaaacgcggaguuugaagaccagggcuauuacuccugcgugcacuuccuccaccauaaugggaagcuguuuaacaucaccaaaacguucaauaucacaauugucgaggaucggagcaacaucgugccugugcuucugggacccaagcucaaccacgucgcuguugaacugggcaaaaaugugcgccugaacuguuccgcccuccugaaugaggaggacgugauuuacuggauguuuggggaagagaacggaucugauccuaauauccaugaagagaaggaaaugagaauuaugaccccggagggcaaauggcacgccagcaagguccuucggaucgagaacaucggcgaauccaaucugaacgugcucuauaauugcacaguugcuagcaccgggggaaccgacacaaagucuuucauucuggugcgcaaagccgauauggcugacauccccggccacgucuuuacgagagggaugauuaucgccgugcuuauucugguugcgguggucugucucgugaccgucugcgugaucuaccggguugaucuggugcuguucuaucgccaucucacaagacgggacgagacccugacagauggaaagaccuacgacgccuucgucuccuaucuuaaagaaugccgcccugagaacggcgaagaacacacguuugcuguggagauccugcccagaguucucgaaaagcauuucggguacaaacuguguauuuuugagcgggauguggucccuggaggcgccgugguggacgaaauccacagccuuauugagaagucuagacgccugaucauuguucucagcaaguccuauaugucuaaugagguccgguacgaacuggagagcggccugcaugaagcucucguggagagaaaaaucaagaucauucugaucgaguucacacccgugaccgacuuuaccuuccuuccgcagucccugaaacuccuuaagagccaccgcguccugaaauggaaggccgauaagucucuguccuacaacagccgguuuuggaaaaaucuccuguaucugaugccugcgaagacagugaaacccgggagagacgagccugagguucuccccgugcugucugaauccuga

SEQ ID NO: 70707 - RNA, 1800 nt, Artificial Sequence
  derived and/or modified sequence opt5 from IL18RAP__Homo_sapiens__NP_003844
augcugugccucggcuggaucuuccuguggcuuguggccggggagagaauuaagggauuuaacaucagcggcuguuccaccaaaaagcugcucuggacauacucuacgcggagcgaagaggaguucguccuguuuugcgaccuucccgagccucagaaaucccacuucugucaucgcaauagacugucuccgaagcaaguucccgaacaccucccuuuuauggggagcaacgaucuguccgacgugcagugguaucagcagcccucuaauggagauccucuggaggacauucggaaaagcuacccccauaucauucaagauaagugcacccuccacuuccugacaccuggcgugaacaauuccgggagcuauaucugucgcccgaagaugaucaaaucucccuacgacgucgcuugcugugugaagaugauucuugagguuaaaccucagaccaacgccuccugcgaauauagcgcgucucauaagcaggaucugcuccugggauccacaggcagcaucucuugucccucccuuagcugccaguccgacgcucaaucuccugccgugaccugguacaaaaauggcaagcugcucagcgucgagagauccaaccggauugugguugaugaaguguaugacuaccaccaggggacauacgucugugauuauacccagagcgacacggugucuuccuggaccgugcgcgccgucguucaggugagaacaaucgugggagauaccaagcugaaacccgacauucuggacccggucgaggauacacucgagguggaacugggcaagccucuuaccaucagcugcaaagcucgguuuggguucgagcgcguuuuuaaucccgugauuaagugguacaucaaagacucugaucuggaaugggaggucagcgugccugaagccaaguccaucaaaucuacgcucaaggacgagauuaucgagagaaacauuauccuggaaaagguuacacaacgggaucuucgcagaaaauucgugugcuuuguccagaauagcauuggaaacaccacacaguccgugcaacugaaggagaaacggggcgucgugcuccuguauauccugcucgggaccaucggaacccugguugcugugcuugccgcgagcgcccugcucuaccgccacuggauugaaaucguccugcuuuauagaacauaccagucuaaggaccagacgcugggcgauaaaaaggacuucgaugcuuuuguguccuaugccaaguggagcucuuuccccuccgaggcuaccagcucccucucugaagaacaucuggcccugagccucuuccccgacguucuggagaauaaauacggcuacucccuuugucugcucgaacgggauguggcgccugggggagucuaugccgaggacauugugucuaucauuaagagaagccgccggggcaucuuuauccuguccccgaacuacgugaaugggcccagcauuuucgaacugcaggcugccguuaaccuugcucucgacgaucaaacacugaaacugauccucauuaaguuuugcuauuuccaggagccugaaucucugccccaccuugucaaaaaggcccugagagugcucccuaccgugacauggcgcggacugaaguccgugcccccgaacagccgguuuugggccaaaaugagauaccauaugccugucaaaaauucucagggcuucaccuggaaccagcugcgcaucacgucccggauuuuucaauggaaggggcuuagcagaacagagaccaccggacgcucuagccagcccaaggagugguga

SEQ ID NO: 70708 - RNA, 534 nt, Artificial Sequence
  derived and/or modified sequence opt5 from IL19__Homo_sapiens__NP_037503
augaagcugcagugcgugagccucuggcugcuuggcaccauccugauucucuguuccgucgacaaccacgggcugagacggugccuuaucucuacagauaugcaucacauugaggagagcuuccaagaaaucaaacgcgccauucaggcuaaggacacguuucccaauguuaccauccuguccacacucgaaacccugcagaucauuaaaccucuggauguguguugcgugacaaagaaccuccuggccuucuacgucgacagaguguuuaaagaucaucaggagccgaaucccaagauccuucggaagauuucuagcaucgcgaacuccuuccuguauaugcagaaaacccuccgccaaugucaggaacagagacaaugccacugucggcaggaggcuacaaaugccacccgcguuauucaugacaacuacgaucagcuggaggugcacgccgcugccaucaagucucuuggagaacuggacgucuuucucgcuuggauuaauaaaaaccacgaggugauguucagcgccuga

SEQ ID NO: 70709 - RNA, 816 nt, Artificial Sequence
  derived and/or modified sequence opt5 from IL1A__Homo_sapiens__NP_000566
auggccaaggugcccgacauguucgaggaucugaaaaacugcuacagcgaaaaugaggaagacuccucuagcaucgaucaccucucccugaaccagaagucuuuuuaucaugucagcuacggcccucuucacgagggguguauggaccaauccguuucucugagcauuuccgaaaccagcaaaacaucuaagcucacguucaaagaguccauggugguggucgcuaccaauggaaaggugcugaagaaaagacggcuuagccugucucaguccaucacagaugacgaucucgaggccauugcgaacgacagcgaagaggaaaucauuaagccgcgcucugcucccuuuuccuuccugagcaauguuaaauauaacuuuaugagaaucaucaaguacgaguucauucugaaugaugcccucaaccaguccaucauucgggccaaugaccaguaucugaccgcugccgcccuucauaaccuggaugaggcugugaaauuugacaugggcgcguacaagucuagcaaggaugacgccaaaaucacagucauucuccgcaucuccaagacccaacuguaugugacagcucaggacgaagaucagccuguucuucugaaagagaugcccgaaauuccuaagaccaucacggggagcgagaccaaucuccuguucuuuugggaaacacacggaaccaaaaacuacuucacaucuguggcccaucccaaucuguuuaucgcuaccaagcaggacuacugggucugccucgccggcgggccuccguccauuacggauuuccaaauccuggagaaccaggcguga

SEQ ID NO: 70710 - RNA, 810 nt, Artificial Sequence
  derived and/or modified sequence opt5 from IL1B__Homo_sapiens__NP_000567
auggccgaggugcccgaacuggcuagcgagaugauggccuacuauuccggcaacgaagacgaucucuucuuugaggcggacgggccuaagcagaugaaaugcucuuuccaagaucuggaccuuuguccgcuggauggaggcauccagcucagaauuagcgaccaccauuacuccaagggguuucggcaggcugccucugucguuguggccauggauaaacugcgcaagaugcuugugcccugcccucagaccuuccaagaaaaugaccugagcacauuuuuccccuuuaucuucgaggaggaaccuaucuuuuucgauacgugggacaacgaggcuuauguccacgaugcccccgugagaucccucaauuguacccugcgggacucucagcagaaaagccugguuauguccggaccuuacgaacucaaggcucugcaucuucagggccaagauauggagcaacagguggucuuuagcaugucuuucgugcagggggaggaauccaacgacaagauuccgguugcccugggacucaaagagaagaaucuguaucuuagcugcgugcugaaagacgauaagcccacacuccagcuggaaucugucgacccuaaaaacuaccccaagaagaaaauggagaagcgcuuuguguucaauaaaauugaaaucaacaauaagcuggaguucgaguccgcgcaguuuccuaacugguauaucagcaccucucaggccgaaaauaugcccguguuccucggcggcacaaaagggggacaagauauuaccgacuuuacaaugcaguucgucuccagcuga

SEQ ID NO: 70711 - RNA, 459 nt, Artificial Sequence
  derived and/or modified sequence opt5 from IL1F10__Homo_sapiens__NP_115945
augugcagccugcccauggccagauacuauaucauuaaguacgcugaccagaaagcccucuauacccgggauggccaacugcuugugggggacccugucgcggauaacuguugcgcugagaagaucuguauucugccgaaucgcggacucgccagaacaaaaguucccaucuuccugggcauucaagggggaucccggugccuugccuguguggaaacggaggaaggcccuucucugcagcucgaggacgugaacaucgaggaacuguacaaagggggagaggaagcuacccgcuuuacauucuuucagagcuccucuggcagcgccuucagacuggaggcugccgcguggcccggcugguuucucugcgggccugccgaaccccagcagccuguccagcugaccaaggaguccgagccgucugcucggacaaaguucuauuuugaacagagcugguga

SEQ ID NO: 70712 - RNA, 1710 nt, Artificial Sequence
  derived and/or modified sequence opt5 from IL1R1__Homo_sapiens__XP_011509420
augaaggugcugcucagacugaucugcuucauugcccuucugaucagcucccucgaggcugacaaauguaaggaacgggaggaaaagauuauccuggucucuagcgccaacgagauugauguucgccccugcccucuuaauccgaacgaacacaagggcaccaucacaugguacaaagacgauuccaagacgcccgugucuaccgagcaggcgagcagaauccaucaacacaaggagaaacugugguuugugccugcuaaggucgaagacuccgggcauuauuacugugugguucgcaauucuagcuauugccuccggauuaaaaucuccgccaaguucguggagaacgaacccaaucuguguuacaacgcccaggcuauuuuuaaacagaagcugccugucgccggagauggcgggcucgugugccccuauauggaguucuuuaagaaugagaacaaugaacugccuaaacuucagugguacaaggacuguaaaccgcugcuccuggauaacauccacuucagcggaguuaaggacagacuuauugugaugaaugucgcugagaaacaucggggcaacuauacaugccacgccucuuacaccuaccuggggaagcaauaucccaucacacgcgugauugaauuuaucacccucgaggaaaauaaaccuacaagacccgugaucgucuccccugcgaacgagaccauggagguugaucugggaagccagauucagcugaucuguaaugugacgggccagcucucugacauugccuacuggaaguggaacggcuccgugaucgaugaagacgaucccguccugggggaggacuauuacagcguggaaaacccggcuaauaagcggcgcucuacccuuauuacaguucugaacaucuccgagaucgaaagcagauucuauaaacacccuuuuaccugcuucgccaagaauacacauggaauugacgcugccuacauccaacucauuuaucccgugaccaacuuucagaaacacaugaucggcauuugugucacgcugacagugaucaucguuugcuccguguucauuuacaagaucuuuaaaauugauaucguccuuugguaccgggacucuugcuaugauuuccugccuauuaaggcgagcgacgggaagaccuacgaugccuauauccucuaccccaaaacagugggagagggcuccaccagcgacugugauauuuucgucuuuaaggugcugcccgagguucuggaaaaacagugcggguauaaacucuucaucuacggacgcgacgauuaugugggcgaggacaucgucgaagugauuaaugagaacguuaaaaagucuagacggcugaucauuauccuugugcgcgaaaccuccggcuuuagcuggcucgggggaucuagcgaggagcagauugcuauguacaaugcccugguccaagauggcaucaagguggugcugcuugaacuggagaaaauccaggacuacgaaaagaugccugaguccauuaaauucaucaagcagaaacauggggcuauuagauggucuggagacuuuacacaaggcccgcagagcgccaagacgcgguucuggaagaacguuagauaucacaugcccguccagcgccgguccccuagcucuaaacaccagcuccugucccccgccaccaaggagaaacugcaaagagaagcucaugugccucucggguga

SEQ ID NO: 70713 - RNA, 1197 nt, Artificial Sequence
  derived and/or modified sequence opt5 from IL1R2__Homo_sapiens__NP_004624
augcugagacucuacgugcuggucaugggcguuagcgccuucacccuucagcccgcugcccacacaggggcggcucgguccugccgcuuuagaggacggcauuauaagcgcgaguucagacuggaaggcgagccuguggcccuccgguguccgcaagugcccuacuggcugugggccucugucagcccucgcaucaaccuuacguggcacaaaaaugacuccgcuagaaccgugcccggggaagaggaaacacggaugugggcccaggauggagcucuguggcuccugccugcccugcaggaggacucuggcaccuauguuugcacaacccgcaacgcgagcuacugugauaagauguccauugagcucagaguguuugaaaauacagacgccuuccugcccuuuaucucuuauccucagauucuuacccugagcacguccgggguccucgugugcccggaucugagcgaguucacccgggacaaaacagauguuaagauccaaugguacaaagacucucuucugcucgauaaggacaacgaaaaguuucuguccgugcgcggaaccacacaucugcucguccacgauguggcucuggaggacgccggcuauuacagaugugugcuuaccuucgcucaugagggccagcaguacaauauuacgcggagcaucgaacugcgcaucaaaaagaaaaaggaggaaacaauucccgucaucauuucuccucucaaaaccaucuccgccagccuggggucuagacuuacaauucccugcaagguuuuucugggaaccggcaccccucucacaacgaugcugugguggaccgcgaacgauacacacaucgaguccgccuaucccgggggacgggugaccgaaggcccgagacaggaguacagcgagaauaacgaaaauuauauugaggugccucugaucuucgaccccgucacacgcgaagaccuccacauggauuuuaagugugugguucauaacacccuguccuuccaaacgcuucggacaaccgugaaagaggcuucuagcaccuuuuccugggggaucguccuggccccucucagccuggcuuuccuugugcugggaggcauuuggaugcacagacgcugcaagcaucggacaggcaaagccgacgggcucaccguucuguggccccaccaccaggauuuccagucuuaccccaaguga

SEQ ID NO: 70714 - RNA, 1713 nt, Artificial Sequence
  derived and/or modified sequence opt5 from IL1RAP__Homo_sapiens__NP_001161401
augacccugcucuggugcguggucagccuguacuucuauggcauccuucaguccgacgccucugagagaugugaugacugggggcuggauacaaugcggcaaauucagguuuuugaagacgagcccgcucgcaucaagugcccucucuucgaacacuuucugaaauucaacuacagcacggcccauuccgcgggacuuacccugauuugguauuggacaagacaggaucgggaccucgaggaaccgaucaauuuucgccugcccgagaacagaauuucuaaggagaaagaugugcugugguuccggccuacccuccugaaugacacaggcaacuacaccuguaugcuucgcaauacaaccuauugcagcaagguggcuuuuccccuggaagucgugcagaaagauuccuguuucaacucuccuaugaagcuccccguucacaagcuguacaucgaguaugggauccaaagaauuacgugcccuaauguggacggauacuuuccgagcuccgucaaacccaccaucacaugguacaugggcuguuauaagauucagaacuucaauaacgugaucccugaagggaugaaucuuagcuuucugauugcccucaucucuaacaauggaaacuauaccugcguugugacauaccccgagaauggccggaccuuccaucugacgcgcacacugaccgucaaaguggugggcuccccuaagaacgccguucccccggucauucacagcccuaacgaucaugugguguacgagaaagaacccggggaggaacuccugaucccuuguacagucuauuuuucuuuccuuauggacuccagaaaugaggugugguggaccaucgauggaaagaagcccgacgacauuaccaucgauguuacaauuaacgaaagcaucucucacucccggacggaggacgagacccgcacacagauucugagcaucaaaaaggugaccuccgaagaucucaaaagaucuuacgucugccacgcucggagcgccaagggcgagguggcuaaagccgcgaagguuaaacagaaggugcccgccccucgcuauacagucgaacuggcuuguggguucggagccaccgugcuucuggucgugauccucauuguuguguaccaugucuacuggcuggagauggugcuguuuuauagagcucacuucggcacggacgaaacaauccucgaugggaaggaguacgacauuuauguuuccuacgcccggaaugcggaggaagaggaauuugugcugcuuacccugagaggaguccucgagaacgaguucggcuauaaacugugcaucuuugaucgcgacagccuuccgggcgggauugugaccgaugaaacacugucuuucauccaaaagucccggagacuccuggugguucugagccccaauuacguccuccagggaacccaggcccugcuugagcugaaagcuggccucgaaaacauggccucucgcgggaauaucaacgugauucuggugcaguauaaggcugucaaagagacaaaggugaaggaacugaaacgggccaagacgguucuuaccgugaucaaauggaagggagagaaaagcaaguacccucaaggcagauuuuggaagcagcuccaggucgccaugcccgugaaaaaguccccucgccggucuagcuccgacgagcaagggcugagcuacucuucccugaaaaauguuuga

SEQ ID NO: 70715 - RNA, 2091 nt, Artificial Sequence
  derived and/or modified sequence opt5 from IL1RAPL1__Homo_sapiens__XP_005274498
augaaggcccccaucccucaccugauucuccuguacgcuaccuucacacagagccuuaaaguggucacgaagagaggcuccgccgacgggugcaccgauuggucuaucgacauuaaaaaguaucaaguucuggugggagagccggugcggaucaaaugugcgcucuuuuacggcuauauucgcacaaacuacagccuggcucaguccgccgggcuuucucugaugugguauaagagcuccggacccggcgauuucgaagaaccuaucgccuuugacgggucuagaaugagcaaggaagaggauuccaucugguuccggcccacccuccugcaggacagcggacuguacgcuugcgucauucgcaauucuacauauuguaugaaaguguccaucagccucaccguuggcgaaaacgauacaggccugugcuacaauucuaagaugaaauacuuugagaaggccgagcuuuccaaaagcaaggaaauuucuuguagagacaucgaggauuuccugcucccuacccgggaacccgagauucugugguauaaggagugccgcacgaaaaccuggagaccuuccaucguguuuaagcgggacacacuucugauucgcgaagucagagaggaugacaucgggaacuacaccugugaacucaaauauggaggcuucgugguucggcgcacaaccgagcugacggugacagcuccgcugaccgauaagcccccuaaacuccuguaccccauggaaagcaagcucacaauccaggagacccaacugggggacuccgccaaucuuaccugcagagcguuuuucggauauucuggcgacgucagcccucugauuuacuggaugaaaggggagaaguuuaucgaagaucuugacgagaaccgggugugggaauccgauauucgcauccugaaggagcaucucggagaacaggaggugagcauuucucugaucgucgacuccguugaggaaggcgaucugggcaauuauagcuguuacguggagaacgggaauggaagacggcacgccucugugcuccugcauaaaagagaacuuauguacacagucgagcuggcuggcgggcucggagccauccugcuucugcucgugugccugguuacgauuuauaaguguuacaaaaucgaaauuaugcuguucuaucgcaaccacuuuggcgcugaggagcucgacggggauaauaaggacuacgaugccuaucugagcuacaccaaaguggaccccgaucaguggaaccaggaaacaggagaggaggagcgguucgcgcuugagauccugccggacaugcucgaaaagcauuauggcuacaagcuguucauuccugacagagaucugauccccaccggcacauacaucgaggacgucgcccgcugcguggaucaauccaaacggcuuauuaucguuaugaccccuaauuauguggucagacgcggguggucuauuuuugaacucgagacgcggcugagaaacaugcuggugacaggagaaaucaaggucauucucaucgagugcagcgagcugcgcggcauuaugaauuaccaggaaguggaggcucuuaaacacaccaucaagcugcucaccguuaucaaauggcacgggcccaaguguaacaagcugaacuccaaauucuggaagcggcugcaguaugaaaugcccuuuaaaagaauugagccuaucacacaugaacaggcccuugacgugagcgagcaaggaccguucggcgagcuccagaccgucucugcuauuuccauggccgccgcuacaagcacggcgcuggccaccgcucaccccgaucugcgcucuacauuucauaauaccuaccacucccagaugcggcaaaagcacuauuacagaagcuaugaauacgacgugccucccacagggacccucccucugacguccaucggcaaccagcauaccuacugcaauauucccaugacacuuaucaacggacagcggccgcagaccaaaucuagccgcgagcaaaauccugaugaagcccacacaaacuccgccauccugccccuccugccuagagagaccucuauuagcuccguuaucugguga

SEQ ID NO: 70716 - RNA, 2061 nt, Artificial Sequence
  derived and/or modified sequence opt5 from IL1RAPL2__Homo_sapiens__NP_059112
augaagcccccuuuccugcucgcccugguggucugcagcguuguguccaccaaccuuaaaauggugucuaagagaaauagcgucgacggcuguaucgauugguccguggaccugaaaacauacauggcucucgccggggagccgguucgggugaagugcgcgcuguuuuauucuuacauucgcacgaacuauagcaccgcucaguccacaggacuuagacugaugugguacaaaaauaagggcgaucucgaggaacccaucauuuucucugaaguccggaugagcaaggaggaagacuccaucugguuucacagcgccgaggcccaagauucuggguucuauaccugugugcugcgcaacuccacauacugcaugaaaguuagcaugucucugaccguggcugagaaugaauccggacucuguuauaacagccggauuagauaccuggagaagucugaagucacaaaacgcaaggagaucuccugcccugacauggaugacuuuaaaaagagcgaucaggagcccgacguggugugguacaaggaauguaaaccuaagauguggagauccaucauuauccagaaaggcaaugcccuucugauucaggagguccaagaagaggaugggggaaacuauaccugcgaacucaaguacgagggcaaacugguucggcgcacgaccgagcuuaaggugacagcucugcucaccgacaaacccccuaagccgcuguuccccauggaaaaucagccuucugugaucgauguccagcugggcaagccccucaacauuccuuguaaagccuuuuucggguuuagcggagaguccggccccaugaucuauuggaugaagggggaaaaauucauugaggaacuggcgggacauaucagagagggcgagauccggcuucugaaggaacaccucggggagaaagaaguggagcuggcccuuauuuuugacagcguuguggaagcugaccuggccaauuacacaugccaugucgagaaccgcaauggaagaaagcacgcuucugugcuccugcggaagaaagaucugaucuauaagauugagcucgccggcggccugggggcgaucuuccuucugcucguucugcuuguggucauuuacaaauguuauaacaucgaacugaugcucuuuuaccgccagcauuucggagccgacgagaccaaugaugacaacaaggaauacgaugcuuaucuguccuacacgaaaguggaccaagauacacuggacugcgauaacccggaggaggaacaguucgcccucgagguccugccugacgugcuugaaaagcacuauggcuacaagcuguuuauccccgagagagaucucauuccuagcgggaccuauauggaagaccugacacgguacguugagcagucuagacgccugaucauugugcuuacccccgacuauauccuccggagaggauggagcauuuucgagcuggaaucccgccugcacaauaugcucgucucuggcgagaucaaagugauccugauugaaugcaccgagcuuaaggggaaaguuaacugucaggaaguggagagccugaagcgguccaucaaacuccugagccugauuaaguggaagggaucuaaauccagcaaacuuaauucuaaguuuuggaagcaucucgucuacgagaugcccaucaaaaagaaagaaaugcugccuagaugccacgugcuggauuccgcugagcaaggccucuucggcgaacugcagccgauucccagcaucgccaugacauccacgucugccacccuugugagcucccaggcugaccugccugaguuucaucccucugauagcaugcaaauucgccacuguugccggggguacaagcacgaaaucccugcgacaacccuccccguuccgucccugggaaaccaucacacauauuguaaucugccucuuacccuccugaacggccagcugccccucaauaacacgcugaaggacacacaggaguuccauagaaauagcucucuucugccucucuccagcaaagagcugucuuuuaccuccgauaucugguga

SEQ ID NO: 70717 - RNA, 636 nt, Artificial Sequence
  derived and/or modified sequence opt5 from IL1RL1__Homo_sapiens__NP_001269337
auguacagcaccguguccggcucugagaagaacagcaaaaucuauugccccacaauugaccuguacaauuggacggccccucucgaaugguucaagaacugucaggcucugcaaggguccagauaucgggcccacaaaucuuuucuugucaucgauaauguuaugaccgaggacgcgggagauuacacaugcaaguucauucauaacgaaaauggcgcuaacuauagcgugaccgccacacgcuccuuuaccgugaaagacgagcagggguucucucuguuuccggucaucggagcccccgcucagaaugaaauuaaggagguggagaucggcaagaacgccaaucucacauguagcgcuugcuucgggaaaggaacccaguuucuggccgcgguucuuuggcaacugaacggcacgaagaucaccgauuucggcgaaccucggauucagcaggaggaagggcagaaucaauccuuuagcaacggacucgccugucuggacauggugcugagaaucgcugaugucaaagaggaggaccuccugcuucaguacgauugccuggcccucaaucugcacggccuucgcagacauacagugcggcugucucgcaagaaccccuccaaagaauguuucuga

SEQ ID NO: 70718 - RNA, 1728 nt, Artificial Sequence
  derived and/or modified sequence opt5 from IL1RL2__Homo_sapiens__NP_003845
auguggagccugcuccugugcggccuuuccaucgcccugccccucucugugaccgcugacggguguaaggauauuuucaugaaaaacgagauccugagcgccucccagccuuuugcguucaauugcacauuuccgcccauuacgucuggagaagucagcguuaccugguacaagaacuccucuaaaaucccugugagcaagauuauccaauccagaauccaccaggacgagacauggauucuuuuccugcccauggaauggggcgauagcgggguguaucagugugucaucaaaggaagagacucuugccaucgcauucacgugaaucucaccguuuuugagaagcauuggugugauacauccaucggcgggcugccuaaccugagcgacgaauacaagcagauucuccaccugggaaaagaugacucucuuaccugccaucugcacuuccccaaguccugugugcucggcccuaucaaaugguauaaggauugcaaugagauuaaaggcgagagauuuacaguccuggaaacccggcuucuggugagcaacguuucugcugaggaccgcgggaauuacgccugucaagccauccucacgcacuccggaaagcaguaugaagugcugaacggcaucaccgucagcauuacagagagagcuggguacggaggcuccgugccgaagaucauuuaucccaaaaaucauucuaucgaggugcagcuggggaccacacucauugucgauugcaacguuaccgacacgaaggauaauacaaaccugcgguguuggcgcgugaauaacacccuuguggacgacuacuacgaugaaagcaaaagaauccgggagggagucgaaacacacguguccuuccgcgagcauaaucuguauaccguuaacaucaccuuucucgaagugaagauggaggacuacggccugccuuucaugugccacgccggcgucagcacagcuuauauuauccuucagcugcccgccccugauuuuagagcguaccucauugggggacugaucgcccugguggcuguugccgugucugucguguauauuuacaacaucuucaaaaucgacauuguccucugguaucgguccgcuuuucacagcacggagaccaucguggauggcaagcuguacgacgccuacguucuuuaucccaaaccgcauaaggaaucucaacgccacgcgguggaugcccugguccucaauauucugccugaggugcuugaaagacagugcggguacaagcuguucaucuucggacgggacgaguuucccggccaggcuguugccaacgugauugaugaaaaugucaaacucugucgcagacugaucgugauugugguuccugagagccugggguucggacuccugaagaaccuuuccgaggaacagaucgcugucuauucugcccugauccaagacggcaugaaagugauucucaucgagcuggaaaagauugaggauuacacagugaugcccgaaagcauccaguauauuaaacagaagcauggcgccauccgguggcacggggacuuuaccgagcaaucccagugcaugaagacaaaauucuggaagaccgucagauaccauaugcccccucgccgguguagaccguuucccccugugcagcugcuucagcacacgcccugcuaucgcacagcuggaccugagcucggcagccggcggaaaaaguguacccugaccacaggguga

SEQ ID NO: 70719 - RNA, 480 nt, Artificial Sequence
  derived and/or modified sequence opt5 from IL1RN__Homo_sapiens__NP_000568
auggcccuggagaccaucugcagacccagcggccggaaguccucuaaaaugcaggcuuuccgcauuugggacgugaaccaaaagacauuuuaccucagaaauaaccagcuggucgccggguaucuucagggaccuaauguuaaccuggaagagaaaaucgauguggugccgauugaaccccacgcucucuuccugggcauccaugggggaaagaugugucuuagcugcgucaaauccggcgacgagacgcggcugcagcucgaagcggugaauauuaccgaucugucugagaaccgcaagcaagacaagagauuugccuucauccggagcgauuccgggccuacaaccucuuuugagagcgccgcuugucccggaugguuccugugcacagccauggaagcugaccagccuguuucccucaccaauaugcccgaugagggcgugauggucacaaaauuuuacuuccaggaagacgaguga

SEQ ID NO: 70720 - RNA, 531 nt, Artificial Sequence
  derived and/or modified sequence opt5 from IL20__Homo_sapiens__NP_061194
augaaggccagcucccuggcuuucucucuccugagcgccgcguuuuaccuucuguggacccccuccacaggccucaaaacgcugaaccuugggucuugcgugaucgcuaccaaucugcaggagauuagaaacggauucagcgaaauccggggcuccguccaagccaaggacgggaauauugauauccgcauucucagacggacagagucucugcaggacaccaaaccugccaaccgcuguugccugcucagacaucugcuucggcuguaucucgaucgcguuuuuaagaauuaccagacaccggaccacuauacccugagaaaaaucagcucccuugcuaacagcuuccugacaaucaagaaggaucuccggcugugucacgcccauaugaccugccacuguggagaagaggcuaugaaaaaguacucucagauucugucccauuuugaaaaacucgagccccaagccgcgguggugaaggcccugggcgagcuugacauccugcuccaguggauggaagagacggaauga

SEQ ID NO: 70721 - RNA, 1515 nt, Artificial Sequence
  derived and/or modified sequence opt5 from IL20RA__Homo_sapiens__NP_001265651
augaagaacgugcugcaguggacacccccugagggccuccaaggggucaaaguuaccuacacggugcaguauuucaucuacggacagaagaaauggcugaauaagagcgaaugcagaaacauuaaucggaccuauugugaccuuuccgccgagacaucugauuacgaacaccaguauuacgcuaaagugaaggccaucuggggcaccaagugcagcaaaugggcggaguccgggcgcuuuuauccguuccuggaaacacaaauuggacccccugaggucgcucucaccacagacgagaagucuaucagcgugguucugaccgcccccgaaaaauggaagagaaacccugaggaucuucccguguccaugcagcagauuuacucuaaucugaaauacaacgucagcgugcucaauacgaaguccaaccggaccuggagccaguguguuacaaaucauacccuggugcugacauggcucgaaccuaacacccuguauugcguccacguggagucuuuugugccggggcccccucgcagagcccaacccuccgagaagcagugugcucggacgcuuaaagaccagagcucugaguucaaggccaaaaucaucuuuugguacguccugccuauuuccaucacaguuuuccucuuuagcgugaugggcuauucuauuuaccgcuauauccaugugggaaaggaaaaacaccccgcuaaucugauucuuaucuacggcaacgaauuugauaagagauucuucgucccggccgagaaaauugugaucaauuuuaucacccugaacauuuccgacgauagcaagaucucccaucaggacaugucucuccugggcaagagcuccgauguuagcucucugaaugacccucaacccuccgggaaccuccggccuccccaggaagaggaggaagugaaacaccugggauaugcgagccaccuuauggagauuuucugcgauucugaagagaacacagaaggcaccagccugacccagcaagagucccucucucgcacaauucccccugacaagacggucaucgaguacgaauacgaugugagaaccacagacaucugugccgggccggaggaacaggagcugagccuucaggaagagguuuccacccagggaacacugcucgagagccaagcugcccuggcugugcugggcccccagacccuccaguauucuuacacgccucagcugcaagaccuugauccccuggcccaggaacauacagacuccgaggaagggccugaggaggaacccagcaccacccucgucgauugggacccgcagacaggacggcugugcaucccuucucuuuccagcuuugaucaggacuccgagggcugugaacccucugagggcgaugggcugggagaagagggccuccugagccgccuguaugaggaaccugcgcccgacagaccucccggggagaaugaaaccuaccucaugcaauucauggaggaauggggacuguaugugcagauggagaacuga

SEQ ID NO: 70722 - RNA, 936 nt, Artificial Sequence
  derived and/or modified sequence opt5 from IL20RB__Homo_sapiens__NP_653318
augcagaccuucacaauggugcuggaggaaaucuggacgagccucuuuaugugguucuuuuacgcccugauucccugccuucugaccgacgaggucgcuauccucccugccccgcaaaaccuguccguucuuucuacaaauaugaagcaucugcucauguggagccccgugauugcgccuggcgaaaccguguauuacuccgucgaguaucagggggaauacgagucucuguauacaagccacaucuggauucccuccucuugguguagccugaccgagggaccugaaugcgaugugacagacgauaucaccgcuacgguucccuacaaccucagagugcgggccacccugggcucccagacaagcgccuggucuauccuuaaacacccuuucaaucgcaacuccaccauucugacaagaccggggauggagaucaccaaggacggauuucaucucgucauugaacuggaggaucuuggcccccaguucgaguuucugguggcuuauuggcggcgcgaaccuggggccgaggaacacguuaaaauggugagaagcggaggcauccccguccaucucgagacgauggaaccuggcgcugccuacugugugaaggcgcaaacauucgugaaagccauugggcgguacucugcuuuuucccagaccgagugcgucgagguucagggagaagccaucccccuggugcuggcucucuucgccuuugugggcuucaugcugauucuugucgugguuccgcuguuuguguggaagauggggcgccuccugcaguauagcuguugcccugucgugguucuucccgacacacugaagaucaccaauucuccucaaaaacucaucuccuguagacgggaggaaguggaugcgugcgccaccgcugucaugagccccgaggaacugcugcgcgccuggauuuccuga

SEQ ID NO: 70723 - RNA, 489 nt, Artificial Sequence
  derived and/or modified sequence opt5 from IL21__Homo_sapiens__NP_068575
augagaagcucccccggcaacauggagcggaucgugauuugccugauggucaucuuccucgggacccugguucacaagucuagcucccagggacaagaccgccauaugauuagaaugcggcagcuuaucgauauuguggaccagcugaaaaauuacgugaacgaucucgucccugaauuucugccggcccccgaggacguggaaacaaauugugaguggucugcuuucagcugcuuucagaaggcccaacuuaaauccgcgaacacgggcaauaacgaacgcaucaucaauguuucuauuaagaaacugaagagaaagccucccagcaccaacgcugggcggcgccagaaacacagacucacauguccuuccugcgauagcuaugagaagaaacccccuaaggaguuccuggaacgguuuaaaucucugcuccagaagaugauccaucagcaccuguccagccgcacccauggaucugaggacuccuga

SEQ ID NO: 70724 - RNA, 1617 nt, Artificial Sequence
  derived and/or modified sequence opt5 from IL21R__Homo_sapiens__NP_068570
augcccagaggcugggccgcuccucugcuccugcuucugcuccaagggggauggggcugcccggaccugguguguuacaccgauuaucuucagacagucaucugcauucuggagauguggaaccuccaccccagcacgcugacccugacauggcaggaccaguacgaagaacucaaggaugaagccaccuccuguucucugcaucggagcgcgcacaaugcuacacaugccaccuauacaugccacauggacguuuuccauuuuauggccgaugacaucuucuccgugaacauuaccgaucagucugggaauuacagccaagaguguggauccuuucuucuggcugaaucuaucaaaccugcgcccccuuucaacgugacggucaccuuuagcggccaguauaauauuuccuggcgcagcgacuacgaggaucccgcuuucuauaugcucaaggggaaacugcaguacgagcuucaguacagaaaccggggagacccuugggccgugucuccgcgcagaaagcugaucuccguugauagccggucugugucccuccugccccuggaauuucgcaaagacagcucuuaugagcuccaagucagagcgggcccuaugcccggcuccagcuaccaggggacaugguccgaauggucugauccugugaucuuccagacccagagcgaggagcugaaggaaggauggaauccccaccuucugcuccugcuucugcucguuauuguguuuaucccggccuucuggucccugaagacacacccucuguggcggcucuggaaaaagauuugggcuguccccagcccugagcgcuuuuucaugccccuguauaaaggcugcucuggggacuuuaagaaaugggugggagcccccuucaccggcuccagccuugaacuggggccuuggucuccggaggugcccagcacgcucgaagucuacuccugucauccucccagaucuccugcuaagcggcugcaacuuacagagcugcaggagcccgccgaacucguugagagcgacggagugccgaagccuuccuucuggcccaccgcgcagaacagcggcggcucugccuauuccgaggagcgcgauagaccuuacgggcuggugagcaucgacacagucaccgugcuggaugcugaaggacccugcaccuggccuuguucuugcgaggacgauggcuaucccgcccucgaccuggaugcugggcuugagccguccccuggacuggaagacccccuccuggaugccggcacaacgguucugagcugugggugcguguccgccggaucucccggccuuggcgggccucucggaagccugcuggaccggcucaaaccgccccuggcugauggcgaggacugggccgggggacuuccuuggggcgggcgcucccccggcggagucucugaaagcgaggccggcuccccucuggcugggcucgacauggauaccuuugacagcggauucgugggcucugauugcuccagccccguugaaugugacuuuacaucuccuggggaugagggacccccgagauccuaccugcggcaauggguggucauuccucccccucugagcucucccggcccgcaggccagcuga

SEQ ID NO: 70725 - RNA, 540 nt, Artificial Sequence
  derived and/or modified sequence opt5 from IL22__Homo_sapiens__NP_065386
auggccgcucugcagaaaagcguguccucuuuccucaugggcacccuggccacaagcugccuucugcuccuggcgcuucugguccaagggggagcugccgcccccaucuccucucacuguagacucgacaagagcaacuuucagcagccuuacauuacgaaucggaccuucaugcuggcuaaggaggccucccuggcugauaacaauacagacguucgccucaucggcgaaaaacuguuucauggggugucuaugagcgagagaugcuaucuuaugaaacaggugcugaacuucacccucgaagagguccuguuuccgcaauccgaucgguuccagcccuacaugcaggaagugguuccuuuucuugcccgccugagcaauagacucucuacaugucacauugagggagacgaucugcauauccagcggaacgugcaaaagcugaaggacaccgucaagaaacucggcgaguccggggaaauuaaggcgaucggagagcuggaucuucuguucaugagccuccgcaaugccugcaucuga

SEQ ID NO: 70726 - RNA, 792 nt, Artificial Sequence
  derived and/or modified sequence opt5 from IL22RA2__Homo_sapiens__NP_443194
augaugcccaagcacugcuuccugggcuuucucaucagcuucuuucugaccgggguggccggaacacaguccacgcaugagucucuuaaaccucaaagaguccaguuccagagccggaacuuucacaauauucugcaguggcaaccgggccgcgcucucaccgggaacuccucuguuuacuucgugcaguauaagaucauguuuagcuguuccaugaaaucuagccaucagaagcccuccggaugcuggcagcacauuagcuguaauuucccuggcugcagaacacuggccaaauacgggcaacggcaguggaagaacaaggaagacuguuggggaacccaggagcuuucuugcgaucugacauccgaaaccagcgacauccaggagcccuauuacggccgcgugagagcggcuucugccggcuccuauagcgaauggucuaugacaccucgguuuacccccuggugggagacgaaaauugauccuccggucaugaauaucacccaagugaacgggucccuccugguuauccugcaugcccccaaucucccuuaccgcuaucagaaggagaaaaacgugagcauugaagacuacuacgagcugcuuuauagagucuucaucauuaauaacucccuggaaaaggagcagaaaguguacgagggagcucaccgggccguugaaaucgaggcucucacaccccacucuagcuauuguguggucgccgaaauuuaccaaccuaugcuggaucgcagaucccagcggagcgaggaacgcugcguggagauccccuga

SEQ ID NO: 70727 - RNA, 570 nt, Artificial Sequence
  derived and/or modified sequence opt5 from IL23A__Homo_sapiens__XP_011536779
augcugggcagcagagccgugaugcuccugcuucugcuccccuggaccgcucaggggcgggccgucccuggaggcuccucuccggcguggacacaaugccagcagcugagccagaagcuguguacgcuugcuugguccgcccacccccucguugggcauauggaccugcgcgaggaaggagaugaggaaaccacaaacgacgugccucacauccaaugcggcgaugggugugacccccagggacugagagauaauucucaguucugccuccagcggauucaucaaggccugaucuuuuacgagaaacuucugggcagcgacauuuucaccggggaaccuucccuccugcccgauucuccugugggacagcuucacgccagccugcucggccugucccagcugcuccagccggaggggcaucacugggagacacaacagauccccagccugucuccuucccagcccuggcaacgccuucugcucagauuuaagauucugcggagccuucaggcuuucgucgccguggcugcccgcguuuuugcgcacggagccgcuacccugucuccuuga

SEQ ID NO: 70728 - RNA, 1980 nt, Artificial Sequence
  derived and/or modified sequence opt5 from IL23R__Homo_sapiens__XP_011539091
augcugcucugccacggcauccuguuccccuggauucagguguuugccagaaaacuucaagaggggaacagccuguuccuccugccugacaugaaucaggucaccauccagugggaugcuguuauugcccuuuacauccuguuuuccuggugucauggaggcauuacaaacaucaauugcucugggcacaucuggguggaaccggcgacgauuuucaagaugggaaugaacaucagcauuuauugucaggcugccaucaagaauugccaaccccggaaacuccauuuuuacaagaacggcauuaaagagcgcuuccagaucaccagaauuaauaagacaaccgcccggcugugguauaagaacuuucuggaaccucacgcuuccauguacuguacagccgagugccccaaacauuuccaggaaacccucaucugugggaaggacaucucuagcggauauccucccgauauuccugacgaggugacaugcgucaucuacgaguauuccggcaauaugaccuguacguggaacgcuggcaaacugaccuacauugauacaaaguacgugguucacgugaaaucucuugaaaccgaggaagaacagcaauaucugacaagcuccuacaucaauauuagcaccgacucucuccaagggggaaagaaguaucuggucugggugcaggccgcgaacgcccuuggcauggaggaauccaaacagcugcagauccaccucgaugacaucguuauuccgagcgcugccgugaucucucgcgcugagacgauuaaugccacaguccccaagaccaucauuuacugggauucccagacaaccaucgaaaaagugagcugcgagaugagauauaaggcgaccacaaaccagacguggaaugugaaagaauuugacaccaacuucacauacguccaacagucugaguuuuaucuggagccuaacaucaaguacguuuuccaggugcggugucaggaaaccgggaaacgcuacuggcaacccugguccagccuguuuuuccauaagacaccugagaccgugccccaggucacguccaaggccuuccagcacgauacauggaacucuggacucaccguggcuagcauuuccaccggccaucugacaagcgacaauagaggggauaucggacuucugcucggcaugauuguuuuugccgugaugcugucuauccuuucccugauuggcaucuucaaucggagcuuucgcaccgggauuaaaagacggauccuccugcugaucccgaaguggcucuaugaagacauuccuaacaugaaaaauucuaacgucgugaagaugcugcaggagaauagcgaacuuaugaacaauaacuccucugagcaaguucuguacguggaccccaugaucacagagauuaaagaaaucuucauuccugagcacaagcccacggauuauaagaaagaaaauaccggaccccucgagacacgcgacuacccucagaacagccuguuugauaauaccacagucguguauaucccggaccuuaacaccggcuacaagccccagaucuccaauuuccugccugaagggagccaccucucuaacaacaaugagauuacgucccugacccugaaacccccugucgauagccucgacucuggaaacaaucccagacugcagaagcauccgaacuuugcuuucuccgugagcuccguuaauucucuuagcaacacaaucuuucugggcgagcucucccugauucugaaucaaggggaaugcucuagcccugauauccagaacuccguggaggaagagaccacaaugcuucucgagaaugacagccccucugaaaccauuccugagcagacgcugcugcccgaugaguucgucuccugccucggaaucgugaacgaggaacugccuagcaucaauacauauuuuccccagaacauucuugagucucacuucaaucggaucucccugcucgagaaauga

SEQ ID NO: 70729 - RNA, 624 nt, Artificial Sequence
  derived and/or modified sequence opt5 from IL24__Homo_sapiens__NP_001172085
augaacuuccagcaaagacugcagagccucuggacccuggccucccggcccuuuugcccuccgcuucuggcuacagccucucagaugcagauggugguccuccccugucugggcuucacgcuucugcucuggagccaaguuuccggggcgcagggacaggaguuucacuucggcccuugccaggugaaggggguggucccccaaaaacugugggaggcuuuuugggccgugaaggacaccaugcaggcccaggauaauaucacaucugcucgccugcuccagcaagaaguucugcagaacgugagcgacgccgaauccuguuaccuuguccauacccugcucgaguucuaucugaaaacaguguuuaagaauuaccacaacagaaccguugaagugcggacacuuaaaucuuucagcacccuggcuaauaacuuuguccucauugugucccagcugcaaccuagccaggagaaugagauguucucuauccgcgauuccgcccauagacgguuucuucucuuccgcagagcguuuaagcagcuggacguggaagccgcucuuacgaaggcccugggagaggucgauauucuccugaccuggaugcagaaauucuauaagcuguga

SEQ ID NO: 70730 - RNA, 534 nt, Artificial Sequence
  derived and/or modified sequence opt5 from IL25__Homo_sapiens__NP_073626
augagagagcggccccgccugggcgaagacagcucccucaucucucuguuccuucagguggucgccuuucuggcuaugguuauggggacccacacauacagccauuggccuuccugcuguccgucuaagggacaagauacgagcgaggaacuccugagaugguccaccgugcccgugccuccccuugagccugcccggcccaaccgccacccugaaucuugcagagcgagcgaggacggcccgcucaauucccgggcuauuagccccuggcgcuaugagcuggauagagaccugaaccggcugccucaggaucucuaccaugcccgcugucugugcccccacugugucucucuucagacagggucccauauggacccuagaggaaauagcgaacugcucuaucacaaccagaccguguucuaccggcgccccugccacggcgagaaagggacacauaagggauauugucuggaaagacggcuuuaccgcguuucucuggccugcgugugugucagaccgcgggugaugggcuga

SEQ ID NO: 70731 - RNA, 516 nt, Artificial Sequence
  derived and/or modified sequence opt5 from IL26__Homo_sapiens__XP_011536870
augcuggugaacuucauccucagaugcggccugcuucuggucacccucagccuggccauugcuaagcacaaacaguccucuuuuacaaagagcuguuacccccgggggacgcuuucccaagccguugacgcgcuguauaucaaagcugccuggcucaaggccaccauuccugaggaucgcaucaaaaauauuagacugcugaagaagaaaacaaagaaacaguucaugaagaacugccaguuucaggaacaacuccugucuuucuuuauggaggacguguucggacagcuucagcugcagggcuguaaaaagauccgguuuguggaagauuuccauagccuccgccaaaagcugucccacugcaucucuugugcuagcuccgccagagagaugaaaagcauuacccggaugaagcgcaucuuuuacagaauugggaauaaaggaaucuauaaggcuauuucugaacuugacauccugcucuccuggauuaaaaagcugcuggagagcucucaguga

SEQ ID NO: 70732 - RNA, 732 nt, Artificial Sequence
  derived and/or modified sequence opt5 from IL27__Homo_sapiens__NP_663634
augggccagaccgccggggaccugggauggagacucagccugcuucugcucccccugcuucuggugcaagcuggcgucuggggguucccucggccgcccggacgcccucagcucucccugcaggagcugagacgggaauuuacaguuucucuccaccuggcccgcaagcugcugagcgaggugagaggccaggcgcaucgguucgcugaaucccaccuccccggggugaaccuguaccuucugccucucggagagcaacugcccgaugucucucugacguuucaggccuggcgcagacucagcgacccugaacggcugugcuucaucuccaccacacuucagccguuucaugcccugcucggcggccuggggacccagggacgcuggacaaauauggagagaaugcaacuuugggcuaugcggcuggaucuccgcgaccugcagagacaccuucgguuccaggugcucgccgcuggcuuuaaccugcccgaggaagaggaagaggaggaagaggaagaggaagaggagcgcaaagggcuucugccuggagcccucggcucugcgcugcaggggcccgcccaaguuagcuggccucagcuucuguccaccuauagacuccugcauagccuggaacucgugcugucucgggcugucagagagcuucugcuccuguccaaggccggacacagcguguggccccugggcuucccgacacuuucuccucagcccuga

SEQ ID NO: 70733 - RNA, 1911 nt, Artificial Sequence
  derived and/or modified sequence opt5 from IL27RA__Homo_sapiens__NP_004834
augagaggcgggcggggagcccccuucuggcuguggccucucccgaagcuggcccuucugccccuccugugggugcuuuuucagcgcaccagaccucaaggcagcgccgggccccugcagugcuacggagucggcccucucggggaccugaacuguuccugggagccccugggagaucucggcgcgccuucugaacugcaccuucagagccagaaauaucgguccaauaagacacaaacgguugcuguggccgccggccgcucuuggguggcuaucccgagagagcagcugaccaugagcgacaaacuccuggucugggggacaaaggccggacagccccuuuggccucccguguucguuaaccuggaaacccagaugaaaccuaaugcuccccggcucggcccggauguggacuuuuccgaggaugacccucuggaagccacaguccauugggcgcccccuaccuggcccucucacaaggugcugauuugccaauuccauuaccgcagaugucaggaggccgcuuggacacuccuggagcccgaacuuaagaccaucccucugacgccgguugagauucaggaucucgaacuggccaccggguauaaaguguacggacggugccgcauggagaaggaggaagaccuuuggggcgaguggagccccauccuguccuuucagacaccucccagcgcuccuaaagaugucugggugucugggaaccucuguggaacccccggcggcgaggagccgcugcugcucuggaaggccccugggcccugcgugcaagucuccuauaaaguuugguucugggugggaggcagagaacugagcccugaggggauuacauguugcuguucucuuauccccuccggagcggagugggcccgggugagcgcugucaaugccaccucuugggaaccucugacgaaccucucccuggugugccuugacagcgcuuccgccccgcgcucuguugccgugagcuccaucgcuggcagcacagagcugcucgucaccuggcagcccgggccuggagaaccccuggagcacgugguugauugggcgagagacggcgauccccuggaaaagcucaauugggugcggcugccuccgggcaaccuuucugcccugcuccccgggaauuuuacagucggagugccuuaccgcauuaccgucaccgcuguguccgccagcggccuggccucugcuagcuccguuuggggguucagagaggagcuggcuccccuugugggaccuacacucuggcggcugcaggacgcgcccccuggcacgcccgcuaucgccuggggagaagucccgagacaucaacugcgcggccaccucacccacuauacacugugugcccagucuggaaccagcccuuccgugugcaugaacguuagcggcaauacacagucugugacccuucccgaccugccuugggggcccugcgagcucugggucacggcuuccacaauugccggacagggcccgccugggcccauccugcggcugcaucuuccugauaacacccucagauggaaggugcugcccgggauucuguuucucuggggccuguuccuucugggguguggccucagccuggcuaccucuggacgcugcuaccaucugcggcacaaagugcuucccagauggguuugggaaaaggucccugacccggccaauuccagcuccggccaaccccacauggaacaggugccugaagcgcagccccucggggaucugccuauccuggagguggaggaaauggagcccccuccggucauggaaucuagccagcccgcccaagcuacagccccucucgacuccggauacgagaaacacuuucugcccaccccugaggaacuuggccugcucgggcccccgcgcccucaggugcuggcuuga

SEQ ID NO: 70734 - RNA, 462 nt, Artificial Sequence
  derived and/or modified sequence opt5 from IL2__Homo_sapiens__NP_000577
auguacagaaugcagcugcucagcugcaucgcccugucccuugcucuggugaccaacucugcccccacaagcuccucuacgaagaaaacccaacuccagcuggagcaccuucugcucgaccugcagaugauucugaauggcaucaacaauuauaagaacccuaaacucacacggaugcugaccuucaaguuuuacaugccgaaaaaggcgacagaacuuaagcaucugcagugucucgaggaggaacugaaaccccuugaagagguccugaaucucgcucaaagcaagaacuuccaccuccgcccuagagaucugauuuccaauaucaacguuauugugcuggagcugaaagggucugaaaccacauuuaugugcgaguaugccgacgaaaccgccacgaucguggaguuccuuaaucgguggaucaccuuuugucagagcauuaucuccacacugaccuga

SEQ ID NO: 70735 - RNA, 819 nt, Artificial Sequence
  derived and/or modified sequence opt5 from IL2RA__Homo_sapiens__NP_000408
auggacagcuaccugcucauguggggccugcuuaccuucaucauggugcccgggugccaggccgagcugugugaugacgauccuccggaaauuccccacgcuacauuuaaggccauggcguauaaagagggaacgaugcucaacugcgaauguaagagaggcuuccggcgcaucaaauccgggucucuguacaugcuuugcaccggaaauagcucccauucuagcugggacaaccaaugucagugcacauccucugcuaccagaaauacaaccaagcaggucacaccucagcccgaggaacaaaaagagcggaagaccacggagaugcagagcccuaugcagcccguugaucaggccucccugccuggccacugucgcgaaccgcccccuugggagaacgaagccaccgagagaauuuaucauuuugugguggggcaaauggucuacuaucagugcgugcagggauaccgggcucuccaccgcggccccgccgagagcguuuguaagaugacacauggcaaaaccagauggacacagccucaacugaucugcaccggggaaauggagacgucucaguuccccggagaagagaagccgcaggcuuccccugaaggccggcccgagagcgagacaucuugucuggugaccacaaccgacuuucaaauucagaccgaaauggccgcgacaauggagacguccaucuucaccacagaauaucaggucgccguggcugggugcguuuuucuccugaucagcgugcuucugcucucuggacugaccuggcagcgcagacaacggaaaucccgcagaacaauuuga

SEQ ID NO: 70736 - RNA, 1656 nt, Artificial Sequence
  derived and/or modified sequence opt5 from IL2RB__Homo_sapiens__NP_000869
auggccgcucccgcccugagcuggagacucccucugcuuauccugcuccugccgcuugcgaccuccugggcuucugccgccgugaacggcacaagccaguucacgugcuuuuacaauucccgggcuaacauuucuugugucuggagccaagacggggcccugcaggauaccuccugccagguucacgcuuggcccgaccgcagacgguggaaucagacaugugagcuccugccugugucucaagccagcugggcgugcaaccugauccucggagcccccgauucccagaagcugaccacaguggacauugucacccuucgcgugcuguguagagaaggcguucgguggcgcgugauggcuauccaggauuucaaaccuuuugagaaucucagacugauggcccccauuagccuucaggucgugcauguugaaacacaccggugcaacaucucuugggagaucucccaagcuagccauuauuucgaacgccaccuggaguuugaggccagaacccucucuccugggcauacgugggaagaggcgccgcugcugacccucaagcagaaacaggaauggauuugucuggagacacuuacccccgacacacaguacgaguuccaagugcgggucaagccucugcagggagaauuuaccacguggucccccuggagccagccucucgccuuccgcacaaaacccgcugcccugggcaaggauaccaucccguggcuugggcaucugcucgugggacugucuggcgcuuuuggcuucauuauccugguguaucuccugauuaauugcagaaacacagggccuuggcuuaagaaaguccugaaguguaauacccccgacccuuccaaauuuuucagccaacucuccucugagcacggaggcgauguucagaaguggcugagcucccccuuucccuccucuuccuucagcccugggggacuugccccggaaaucucuccccuggaggugcucgaacgggacaaagugacccagcugcugcuccagcaagauaaggucccugagcccgccagccuguccucuaaccacagccuuacauccugcuucacgaaucagggcuacuuuuucuuucaucugccugacgcucucgagauugaagcgugucagguguauuucaccuacgaucccuauagcgaggaagacccggacgaggggguugccggagcuccuacaggcucuagcccccagccucugcaaccccugagcggcgaagaugacgccuacugcaccuuuccuucucgcgaugaccuucuccuguucucccccagccugcucgggggaccguccccucccucuacagcccccggcgggagcggagcuggcgaggagagaaugccuccgucccugcaggaacgggugcccagagauugggacccucagccccuugggccucccaccccuggaguccccgaucugguggacuuucagccgccucccgagcucguucugcgcgaagccggcgaggaagugccugaugcgggcccccgggagggggucucuuucccguggagcagaccucccggacaaggcgaguuucgcgcucugaacgcccggcuuccucucaauacggacgccuaccugucccugcaggaacuccaggggcaggaucccacacaccugguguga

SEQ ID NO: 70737 - RNA, 1110 nt, Artificial Sequence
  derived and/or modified sequence opt5 from IL2RG__Homo_sapiens__NP_000197
augcugaagcccagccucccuuucaccucccugcuuuuucugcagcucccgcugcuuggcguggggcugaacacaacgauccucacccccaauggaaacgaggacacaaccgccgauuucuuucugacaaccaugccuacagacucucugagcgucuccacccucccccugccugaaguucaaugcuucguguuuaauguggaguacaugaacuguacguggaacucuagcuccgaaccccagccuaccaaucuuacacugcacuauugguacaaaaauucugauaacgacaagguccagaaaugcagccauuaucucuucuccgaggaaaucaccagcggcugucagcugcaaaagaaagagauccaccuuuaccagacauuugugguucagcugcaggauccgagagagccccggcgccaagccacccagaugcucaagcugcagaaucuggugauuccuugggcccccgaaaaccucacgcugcauaaacuuucugagucccagcuggaacucaauuggaacaauagauuccugaaccacugccuugagcaucugguccaauaucggacagacugggaucacagcuggaccgagcagucuguggacuaccgccacaaguuuucccucccuagcguugaugggcagaagagauauacauuccgggugcgcucuagauuuaauccccuguguggauccgcgcaacauuggagcgaauggucccacccgauccauuggggcucuaacaccagcaaagagaacccuuuccuguuugcucucgaagccgucgugauuuccguggggagcaugggacugaucaucucucuucugugcgucuacuucuggcucgagcggaccaugccccgcauuccuacacugaagaaucuugaagaccugguuacggaguaccacggcaacuucuccgccuggagcggcgugucuaaagggcucgcugagagccugcagcccgauuauuccgaaagacugugucucgugucugagauucccccuaagggaggcgcccugggggaaggaccgggcgcuagccccugcaaucagcacuccccuuacugggcucccccuuguuauacccuuaagcccgagacauga

SEQ ID NO: 70738 - RNA, 495 nt, Artificial Sequence
  derived and/or modified sequence opt5 from IL31__Homo_sapiens__XP_011536628
auggccagccacuccggccccucuaccagcgugcuguuccucuuuugcugucuugggggauggcuggcuucccauacacugccugucagacuccugcggccgucugacgauguucagaagaucguggaggaacuucaaagccuguccaaaaugcuccugaaggacguggaggaagagaaaggcguccuggugucucagaacuacacgcuccccugccugagcccugaugcccagcccccuaauaacauucacucccccgcgauccgcgcuuaucuuaagaccauuagacagcuggacaauaaaagcguuaucgaugaaauuaucgagcaucucgacaagcugaucuuccaagaugccccugagacaaacauuucugugccgaccgacacacacgaauguaagcgguuuauccuuaccauuucccagcaguucagcgagugcauggaucuggcccucaaaucucugacauccggggcucagcaagccaccacguga

SEQ ID NO: 70739 - RNA, 2238 nt, Artificial Sequence
  derived and/or modified sequence opt5 from IL31RA__Homo_sapiens__NP_001229565
augaagcugagcccccagccuuccugcgugaaccucggcaugauguggaccugggcccuguggaugcuuccgucucuguguaaauucagccucgcugcccugcccgcgaagccugagaauaucuccugcgucuacuauuaccggaaaaaccuuacauguacguggucucccgggaaggaaaccagcuauacacaauacaccguuaaaagaacauaugcuuuuggagagaagcacgacaauugcaccacaaacuccucuaccagcgaaaaucgcgccuccuguagcuucuuucugccuagaauuacgauccccgauaacuacaccauugagguggaagccgagaauggcgacggggugaucaagucucauaugacauauuggcggcucgagaacauugcuaaaaccgaaccuccgaagaucuuccgcgucaaacccgugcugggaaucaagagaaugauucagaucgaguggauuaaaccugaacuggcccccguuuccagcgaucucaaguacacacugcgguuucgcaccgucaauucuacguccuggauggaggugaacuucgcuaagaauagaaaagacaagaaccagacauacaaucuuaccggccugcagccuuuuacagaguaugugaucgcccuccggugcgcgguuaaagaaagcaaguucuggucugauuggucccaagagaaaauggggaugaccgaagaggaagcccccuguggacuggagcuuuggcgcgugcugaagccggcugaggccgacggcagacggccuguccgccuccuguggaaaaaggcuagaggcgcccccgugcuggaaaagacccucggguacaacauuugguauuacccugagagcaauacaaaccugacggaaaccaugaacacaaccaaucagcagcuugagcugcaccucggaggcgaauccuuuugggugucuaugaucagcuauaacucccuggggaaaagccccgucgcgacacuucggauucccgccauccaggagaagucuuuccaaugcaucgagguuaugcaggcuuguguggccgaagaucagcugguggucaaauggcaguccagcgcucucgacgugaauaccuggaugauugagugguuuccugauguugacucugaaccgacgacacugagcugggaguccgugucucaagccaccaacuggaccauccagcaggauaagcugaaacccuucuggugcuacaauauuagcgucuauccuaugcuccaugacaaggugggagaacccuacuccauccaagccuacgcuaaggagggcguuccuagcgaggggcccgaaacaaaaguggagaacauuggagucaagaccgugacaaucacguggaaagaaaucccgaagucugagcgcaaaggcauuaucuguaauuauaccaucuuuuaccaggcggagggcgggaagggauucuccaagacagucaacagcucuauucugcaguauggccuugaaucccugaaaagaaagaccagcuacauugugcagguuauggccuccacaucugcugggggaaccaauggcacgagcaucaacuucaaaacccucuccuuuucuguguucgagaucauucugaucacaagccuuauugggggaggccugcucauccugauuauccugaccgucgccuauggccucaagaaaccuaauaagcugacacaccuuugcuggcccaccgugccuaaccccgccgaauccagcauugcuacguggcauggggaugacuuuaaggacaaacugaaucucaaggagucugaugacuccguuaacacagaagaucggauccugaaaccuugcagcacccccucugacaagcuggugaucgauaaacuugucgugaauuucggaaacgugcuccaagagauuuuuacagacgaggccagaaccggccaggaaaacaaucucgggggagagaagaacggcuacguuaccuguccguuccgcccugauugcccccuggggaaauccuuugaggaacugcccgucagcccugaaaucccgccccggaagucucaguaucugagaagccgcaugccugagggcacacggcccgaggcgaaggaacagcuucuguucuccggacaaagccucgugccugaccaccugugugaggaaggcgcucccaauccuuaccugaaaaacucugugacggccagagaguuucuugucuccgaaaagcuccccgagcacaccaaaggggagguguga

SEQ ID NO: 70740 - RNA, 396 nt, Artificial Sequence
  derived and/or modified sequence opt5 from IL32__Homo_sapiens__NP_001012651
augugcuuccccaaggugcugagcgacgauaugaaaaagcucaaagcccggaugcaccaggcuaucgagcgguuuuacgacaagaugcaaaacgccgaauccggccgcgggcaggucaugucuagccuggcggagcuugaagaugacuucaaagagggauaucuggaaaccguugcugccuacuaugaggagcagcauccugaacucacaccgcugcuugagaaggaaagagauggccugcggugucgcgggaauagaucccccgugccugacguggaggaucccgccacggaggaaccuggagagucuuuuugcgacaagagcuacggcgcucccagaggggauaaagaggaacucaccccucagaaguguuccgaaccgcaaucuagcaaauga

SEQ ID NO: 70741 - RNA, 687 nt, Artificial Sequence
  derived and/or modified sequence opt5 from IL33__Homo_sapiens__NP_001186569
augaagcccaaaaugaaguacagcaccaacaaaaucuccacagccaaguggaaaaauacggcuucuaaggcccugugcuucaagcucggcaaaagccagcaaaaggcgaaagagguguguccuauguauuuuaugaagcugagauccgggcuuaugauuaaaaaggaggcuugcuacuuccggcgcgaaaccacaaagagaccgucucugaaaaccggacggaagcacaaacgccaucucguccuggccgccugucagcagcagagcacaguugaaugcuuugcuuucggcaucuccggggugcaaaaguauaccagagcccuucacgacucuagcauuacagauaaagugcugcucuccuacuaugagagccagcaucccucuaacgaauccggagacggcgucgaugggaagaugcugauggugacccugagcccuacgaaagacuuuuggcuccacgcuaauaacaaggagcauucuguugagcugcacaagugugaaaaaccccuuccugaucaggccuucuuugugcugcacaauaugcauuccaacugcgucagcuucgaguguaagaccgaccccggaguguuuaucggcguuaaagauaaucaccucgcgcugauuaagguggacucuuccgaaaaccuuugcacagagaauauccuguucaaacucagcgagaccuga

SEQ ID NO: 70742 - RNA, 729 nt, Artificial Sequence
  derived and/or modified sequence opt5 from IL34__Homo_sapiens__XP_011521205
augcccagaggcuucaccuggcugcgguaccucgggaucuuucugggaguggcccuuggcaacgagccucuggaaauguggccgcucacacagaaugaggaaugcacggucaccggguuccugcgcgacaaacuucaauauagaagccggcugcaguacaugaagcacuauuuucccauuaacuacaagaucuccguuccuuaugagggaguguuccgcauugcuaaugugacaagacuccagcgggcccaggucucugaacgcgagcugagauaccugugggugcucguuagccuguccgcgaccgagucugugcaagauguccuucuggaaggccaucccagcuggaaauaucuccaggagguggaaacacugcuucugaacguucagcaggggcucaccgacguggaggucuccccuaagguggagucugugcugagccugcucaaugcucccggaccuaaccugaaacuuguccggccgaaggcccugcucgauaauuguuuucgcguuauggaacugcuuuacugcuccuguugcaagcaaagcucugugcugaacuggcaggacugugaggugcccuccccucagagcugcucucccgaaccuucccuccaguacgccgcuacacaacuguaucccccgccucccuggagcccuucuuccccuccccacagcaccggcuccgucagacccgugcgggcccagggcgaggggcugcucccguga

SEQ ID NO: 70743 - RNA, 477 nt, Artificial Sequence
  derived and/or modified sequence opt5 from IL36A__Homo_sapiens__NP_055255
auggagaaggcccugaaaaucgacacaccccagcaaggcagcauucaggauaucaaccacagaguguggguccuccaggaccagacccugauugcuguuccucggaaggaucgcauguccccggugacgaucgcccuuauuucuugcagacauguggagacccuggagaaagaccgggggaaucccaucuaccucggacugaacggccuuaaucugugucucaugugcgcgaaggucggggaucaaccuacacugcagcugaaagaaaaggacaucauggaucucuauaaccagcccgagccuguuaagagcuuccuguuuuaccacucccagucuggacgcaauagcaccuucgaauccguggcuuuucccggcugguucauugccgugucuagcgaagggggauguccucuuauccugacacaagagcucggcaaagccaacaccacagacuuuggccugaccaugcuuuucuga

SEQ ID NO: 70744 - RNA, 495 nt, Artificial Sequence
  derived and/or modified sequence opt5 from IL36B__Homo_sapiens__NP_055253
augaacccccagagagaggccgcuccuaagagcuacgccauccgggacucccgccaaaugguguggguccugucuggcaauagccucauugcggcuccgcuguccagaucuaucaaacccguuacccuucaccugauugccugccgggauacagaauuuagcgacaaggagaaagggaacaugguguaucucggaaucaagggcaaagaucugugucuuuucugcgccgaaauucaggggaagccuacgcugcagcucaagcugcagggaucccaagacaauaucggcaaagauaccuguuggaagcugguggggauccauacaugcauuaaccucgacguccgcgagucuuguuucaugggaacccuggaucaguggggcaucggcguggggcggaaaaaguggaaaagcuccuuucagcaccaucaccuuagaaagaaggacaaagauuucagcucuaugcgcacaaauauuggaaugcccggcagaauguga

SEQ ID NO: 70745 - RNA, 510 nt, Artificial Sequence
  derived and/or modified sequence opt5 from IL36G__Homo_sapiens__NP_062564
augagaggcacccccggggacgccgauggaggcgggcgggcuguguaccagagcaugugcaagccuaucacaggaacgauuaacgaccugaaucaacaggucuggacccuccagggccagaaccugguugccgugccgcgcuccgauucugugacacccgucaccguggcgguuaucacauguaaauauccugaggcucuugaacaagggagaggagaccccauuuaccugggcauccagaauccugagaugugccucuauugugaaaaggugggcgagcagcccacccugcagcuuaaagaacaaaagauuauggaucuguacgggcagccugagccggucaaacccuuccucuuuuaucgggccaagacaggacgcaccagcacgcuggaguccguggccuucccugacugguuuaucgcuucuagcaagagagaucagcccaucauucugaccuccgaacucggcaaaucuuacaacacagccuucgagcugaauaucaacgacuga

SEQ ID NO: 70746 - RNA, 468 nt, Artificial Sequence
  derived and/or modified sequence opt5 from IL36RN__Homo_sapiens__NP_775262
auggugcugagcggcgcccucugcuucagaaugaaggacuccgcucugaaaguccuuuaccugcacaacaaucagcuccuggccgggggacuucaugcgggcaagguuaucaaaggggaggaaauuucuguggugcccaaccgguggcuggaugcuagccucuccccugucauccugggagugcaaggcgggucucagugucugagcugcggaguuggccaggagccgacccucacacuggaacccgugaauauuauggagcuuuaucugggcgccaaggaauccaaaucuuuuacguucuaccgcagagacauggggcucaccagcuccuuugagagcgccgcuuauccuggaugguuccuguguacaguccccgaggccgaucagccugugcggcuuacccaacugcccgaaaacggcggguggaaugcuccuaucacagacuuuuacuuccagcagugcgauuga

SEQ ID NO: 70747 - RNA, 657 nt, Artificial Sequence
  derived and/or modified sequence opt5 from IL37__Homo_sapiens__NP_055254
augagcuucgugggcgagaacuccggggucaagaugggaucugaagacugggagaaagaugaaccccagugcugucuggaggacccugccggcagcccgcucgaacccgggccuucccugcccaccaugaauuuuguucacacaucuccuaaggugaaaaaccuuaaucccaagaaauucagcauccaugaucaagaccacaaggugcugguccucgauuccggaaaccugauugcugugccugacaagaauuacaucagaccggagaucuuuuucgcccuugcgucuagccuguccagcgcuucugccgagaaaggcucccccauucuccuggggguuagcaagggagaauuuugccuguauugugauaaagacaagggccagucucauccuucccuccagcugaaaaaggagaaacuuaugaagcuggccgcucagaaggaaagcgcccggcgccccuucaucuuuuacagagcucaagugggcucuuggaacaugcucgaguccgccgcgcacccugggugguucauuugcacgagcuguaauugcaacgagcccgucggagugaccgauaaauuugaaaaucggaagcauaucgaguucuccuuucagccgguuuguaaagccgaaaugucuccuagcgagguguccgacuga

SEQ ID NO: 70748 - RNA, 459 nt, Artificial Sequence
  derived and/or modified sequence opt5 from IL3__Homo_sapiens__NP_000579
augagcagacugcccgugcuccugcuucugcagcuccuggugcggccuggccuucaagccccgaugacccagacaacgccccugaagaccuccuggguuaacugcucuaauaugaucgacgagauuaucacacaccucaaacagccuccccugccucugcucgauuucaacaaucugaacggggaagaccaggauauucuuauggagaauaaccugcgcagacccaaucucgaggcuuuuaaccgggccgucaagagccugcaaaaugcguccgcuaucgaaucuauucuuaaaaaccugcucccuugucugccgcuggccaccgccgcucccacacgccauccuauccacaucaaggacggagauuggaaugaguucagacggaaacucaccuuuuaccugaagacacuugaaaacgcccaggcucagcagaccacgcugagccucgccauuuucuga

SEQ ID NO: 70749 - RNA, 903 nt, Artificial Sequence
  derived and/or modified sequence opt5 from IL3RA__Homo_sapiens__NP_001254642
auggugcugcucuggcugacccuucugcucaucgcccugcccugccuucugcagacaaaggagggcgggaaaccuugggcuggagccgaaaaccucacguguuggauucacgacgucgauuuccugagcugcuccugggcgguuggcccgggggcucccgccgacgugcaauacgaucuguaucucaauguggccaacagacggcagcaguacgagugucugcauuauaagaccgacgcucagggaacacgcaucggcugcagauuugaugacauuucucggcuuagcuccgggucucaaagcucccacauccugguccgcggaagaucugccgcuuucggcauuccuuguaccgauaaauuugugguuuucagccagaucgaaauccucacacccccuaauaugaccgccaagugcaacaaaacacauuccuuuaugcacuggaagaugcggagccauuucaaucgcaaguuuagauacgagcugcagauucagaaacggaugcaacccgugaucaccgaacagguccgcgacagaacgucuuuccagcuucugaacccuggcaccuauacagugcagauucgggcgcgcgagagaguuuacgaguuucucuccgccuggagcaccccgcaacgguucgaaugugaucaggaggaaggggcuaauacacgcgccuggagaaccucucugcugaucgcucucggaacgcugcuugcccuggugugcgucuuugugauuugucggagauaucucgugaugcagcgccuguucccccggaucccucacaugaaggaccccauuggcgauuccuuucaaaacgacaaacuugucguuugggaggcggggaaggccggacuggaggaaugccucgugacagaggugcaggucgugcagaaaaccuga

SEQ ID NO: 70750 - RNA, 462 nt, Artificial Sequence
  derived and/or modified sequence opt5 from IL4__Homo_sapiens__NP_000580
augggccugaccagccagcuccugcccccucuuuucuuucugcucgccugcgcugggaacuucgugcacggacauaagugugacaucacacugcaagagauuaucaaaacgcuuaauucccugaccgaacagaagacacucugcaccgagcugacagucaccgauauuuuugccgcgucuaaaaacacaaccgaaaaggagacguucuguagagcugccaccguucugcggcaguuuuacagccaccaugaaaaagacacacgcugccucggcgccaccgcucagcaauuccacagacauaagcagcugauccgguuucuuaagcgccuggauagaaaucucugggggcuggccggacuuaacuccuguccggugaaagaggcuaaucagucuacacuggagaacuuccucgaacggcugaagaccauuaugcgcgagaaauauagcaagugcuccucuuga

SEQ ID NO: 70751 - RNA, 1770 nt, Artificial Sequence
  derived and/or modified sequence opt5 from IL4I1__Homo_sapiens__NP_001244947
augcccaacgacgauuucugcccuggccugaccaucaaggccaugggggcugagagagccccgcagcggcaacccuguacacuccaucugcuugugcuggucccuauucuccugagccuuguugcgucccaggacuggaaagcugaacgcucucaggaucccuuugagaagugcaugcaggacccugauuacgaacaacugcucaaaguggugacguggggacugaauagaacccugaagccccagcgggucaucgugguuggcgccgggguggccggacucgucgcugccaaagugcugagcgacgcuggccacaagguuacaauucuugaggccgauaaccgcaucgggggaagaauuuucaccuaucgggaccagaauacaggcuggaucggcgaacugggggcgaugcgcaugccuuccucucacagaauccuccauaagcugugucagggacuuggccugaaccucaccaaauuuacacaauacgauaagaauaccuggacggaggugcacgaggucaaacugcggaacuaugugguggaaaaggucccggagaaacugggguacgcccuccgcccccaggaaaagggacauagcccugaggacauuuaucagauggcucugaaucaggcccuuaaggaucugaaagcucucggcugcagaaaggccaugaaaaaguucgagcggcacacccugcuugaauaccugcucggggagggaaaccugucccgccccgcgguucaacugcucggcgacgugaugucugaagauggcuuuuucuaucugagcuuugccgaggcucuuagagcccacuccugucugagcgaccggcuccaguacucucgcaucgucgggggaugggaccugcuuccuagagcucugcucuccagccugucuggccuggugcuccugaaugcccccgugguugccaugacacaggggccgcaugaugugcacguccaaauugaaaccuccccucccgcucggaaccuuaaagugcugaaggcggacguugugcuccugacagccagcggaccugcugucaaaagaaucaccuucucuccuccccugccccgccauaugcaggaggcccuucggagacuccacuacgugccggccacgaaggucuuucuguccuuccgccggcccuuuuggagagaggaacacauugagggcgggcauagcaauacagaucgcccuucccggaugaucuucuaucccccucccagagaaggagcucugcuccuggccucuuacaccuggagcgacgcggcugccgccuuugcuggccuuucccgcgaggaagcccugcggcucgcucuggaugacguggccgcgcugcacggcccgguugugagacagcuuugggaugggacaggagucgugaagcgcugggccgaggaccagcauagccaaggcggguucguugugcagccucccgcucucuggcagaccgagaaagaugacuggaccgucccuuauggacggauuuacuucgccggcgaacacacagcuuauccccauggguggguggagacggccgugaagucugcgcugagagccgcuaucaaaaucaacucccggaagggcccugccagcgauaccgcuucucccgaaggacacgccagcgacauggagggccaggggcacguucauggagucgccuccucuccgagccacgaccuggcuaaagaagagggcucccauccucccgugcaagggcagcucagccugcagaauacaacccacacacgcaccucucacuga

SEQ ID NO: 70752 - RNA, 2433 nt, Artificial Sequence
  derived and/or modified sequence opt5 from IL4R__Homo_sapiens__NP_001244336
augcagaaggacgccagacgggagggcaacaugaaagugcugcaagagccgaccugcgucagcgauuacauguccaucucuacaugugaguggaagaugaaugggccuacgaacugcagcaccgaacuccgccugcuuuaucagcugguuuuccuccuguccgaggcucacacauguauuccggaaaauaacggaggcgccgggugcgugugucaucuucugauggacgauguggucucugcggacaauuacacccucgaucugugggcuggacagcagcugcucuggaaaggcagcuuuaagcccuccgagcacgugaaaccuagagcccccgggaaccugacaguucauaccaaugugucugacacacuucugcucaccuggagcaacccuuaucccccugauaauuaccuguauaaccaccuuacguacgccgucaauaucugguccgagaacgacccggcugauuuccggauuuauaaugugaccuaccuggaacccagccuccgcaucgccgcuucuacacugaaguccggaauuagcuacagagcccggguucgcgcgugggcccaaugcuauaacaccacauggucugagugguccccuagcaccaaguggcauaauucuuacagagaacccuuugagcagcaucugcuccugggcguguccgucagcuguaucgugauccuugcugugugccugcucuguuaugucuccauuacgaaaaucaagaaagaguggugggaccagauuccuaaccccgcccggucucgccugguugcuaucauuauccaggaugcccaaggcagccagugggaaaagagaucccgggggcaggagccggcgaaaugcccucacuggaagaacugucuuacaaagcugcuccccugcuuccuggaacacaauaugaaacgcgacgaggauccucacaaggccgcuaaagaaaugcccuuucagggaagcggcaagucugccuggugccccguggagauuuccaaaaccgugcuguggccugagagcaucucugucgugagauguguugaacucuucgaggcuccgguggaaugcgaggaagaggaggaagucgaggaagagaaggggagcuuuugugccucccccgaaucuagccgggacgacuuccaagagggacgcgagggcaucguggccagacugacagaaucccuuuuucuggaucuccugggggaggaaaacggaggcuucugccagcaggacaugggcgagagcugucuucugccucccucuggguccaccagcgcucauaugccuugggaugaguuucccucugcgggaccgaaagaagccccucccuggggcaaggagcaaccucuccaccuggaacccuccccucccgcuagcccgacccaguccccugacaaucugacaugcacggagacaccccucguuauugccgggaaccccgccuaccggucuuucagcaauucccugucucagagcccuuguccgagagaacuuggacccgauccucugcucgcucgccaccuggaggagguggaacccgagaugccuugcgucccccagcuguccgaaccuaccaccgugccccaaccggagccugaaacaugggagcagauccuucggagaaacguccuccagcauggcgccgcggcugcccccgugagcgccccuaccucuggguaucaggaguuuguucacgcuguggaacaaggaggcacgcaggccuccgcugucgugggccuggggcccccgggagaggccggcuacaaggcguucagcucucugcucgccuccagcgcuguuucuccugaaaaauguggguucggagccagcuccggcgaggaaggguauaagcccuuucaggaccugauuccuggcugccccggagaucccgcuccugugccggucccccuuuucacauuuggccuggaccgcgagccuccccggagcccucagucuucccaucuccccagcuccucuccugagcaccuggggcuggaaccgggagagaaaguggaagauaugcccaagccuccccuuccucaagagcaggccaccgacccccucguggauagccugggcuccgggaucguuuacucugcgcugaccugucaucucugcggacaccugaaacagugccacggccaggaggacgggggccaaacaccggucauggccagcccuuguugcggauguugcuguggcgacagauccucuccucccaccacaccccuucgcgcucccgauccuagccccgggggagugccccuggaagccucccucugcccugcuagccuggcccccucuggcauuuccgaaaagagcaagucuuccagcucuuuccauccugcccccgggaaugcucaguccagcucccagacgccgaaaaucgugaacuuugucagcgugggaccuaccuacaugcggguuucuuga

SEQ ID NO: 70753 - RNA, 528 nt, Artificial Sequence
  derived and/or modified sequence opt5 from IL5__Homo_sapiens__XP_006714664
augggcguggucguuggguggaucggagaccccggcagcgggaccgauaacaagcugacaggagacgccgugcucuacuaugcucugucccuuccuaaagccaaugcggagagauuccgggcuaugcgcaugcugcuccaccugucucuucuggcccucggcgccgcuuacguguaugccauuccgacggaaauccccaccagcgcucuggucaaggagacacuggcccuccuguccacccauagaacacuucugauugcgaacgaaacccuccggaucccugugcccguucacaaaaaucaucagcugugcacagaggaaauuuuucaagggaucggaacccuugagucucagacggugcagggcggcaccgucgagcgccuguucaagaaccucagccugaucaaaaaguacauugaugggcagaagaaaaaguguggagaagagagacggcgcgugaaucaauuucuggacuaucuccaggaguuccugggcguuaugaacacagaauggaucauugaguccuga

SEQ ID NO: 70754 - RNA, 1263 nt, Artificial Sequence
  derived and/or modified sequence opt5 from IL5RA__Homo_sapiens__NP_000555
augaucauuguggcccacguccugcucauccugcuuggcgcuaccgagauucugcaggccgaccuccugcccgaugaaaagaucagccuucugccuccgguuaacuucacaauuaaagugacggggcucgcgcaagugcugcugcaguggaagcccaauccugaccaggagcagagaaacgucaaucucgaauaccaagugaaaaucaacgcucccaaggaggaugacuaugaaacccggaucacagaguccaaaugcguuaccauucugcauaagggauuuucugccagcgugcgcacaauccuucagaaugaucacucccugcucgccucuagcugggcuuccgccgagcugcaugcuccucccggcucuccugggaccagcauugucaaccuuacauguaccacgaauaccacagaagacaacuacuccagacugcggagcuaucaggugucucuccacugcaccuggcugguuggaacagaugccccggaggacacccaguacuuccuguauuaccgcuauggcuccuggacggaagagugucaagaguacagcaaggauacacucgggagaaauaucgcgugcugguuuccccggaccuucauucugucuaaaggacgcgacuggcuugccgugcuggucaacggcuccagcaagcauucugcuaucagaccuuuugaucaacucuucgcccugcacgcuauugaccagaucaaucccccucuuaacgugacagccgaaaucgagggcacccggcuguccauucagugggaaaaacccgugagcgcguuuccgauccacuguuucgauuacgaggucaagauucauaauacccgcaacggguaucuccagaucgaaaaacugaugacaaaugccuuuauuuccaucaucgacgaccugucuaaguacgauguucaggugagagcugccgugagcuccaugugccgggaggcuggacucuggagcgaguggucucagccuauuuaugucggcaacgacgaacacaagccccugcgcgagugguucgugaucguuauuauggccacgaucuguuuuauucuucugauccucucccugaucugcaaaauuugucaucuuuggaucaagcuguucccucccauucccgccccuaaaagcaacaucaaggaucucuuugugaccacaaauuacgaaaaagcugggucuagcgagaccgaaauugaggucaucugcuauauugagaagccgggaguggaaacacuggaggacuccguuuucuga

SEQ ID NO: 70755 - RNA, 639 nt, Artificial Sequence
  derived and/or modified sequence opt5 from IL6__Homo_sapiens__NP_000591
augaacagcuucuccaccucugccuuuggccccguggcuuucagccuggggcuccugcuuguccugccugccgcguuuccggcucccguuccucccggagaggacuccaaggauguggccgccccucacagacagccccucacaucuagcgaacggaucgacaaacaaauucgcuacauccuggauggcauuuccgcucuuagaaaggagacgugcaauaaaucuaacaugugugaaagcuccaaggaggcccuggcugaaaauaaccucaaucugccuaaaauggccgagaaggacgggugcuuccagagcggauuuaacgaggaaaccugucuggugaagaucauuacaggccuccuggaguucgaagucuaucuugaguaccugcagaaucgguuugagucuuccgaagaacaggcgcgcgccgugcaaaugagcaccaaaguucucauccaguuccugcagaagaaagcuaagaaccuugaugccaucacaaccccggaccccacaaccaaugcuucucugcucacgaaacugcaggcccaaaaccaguggcugcaggauaugaccacacaucucauucugagauccuuuaaggaguuccuucagagcucucugcgggcgcuccgccaaauguga

SEQ ID NO: 70756 - RNA, 1407 nt, Artificial Sequence
  derived and/or modified sequence opt5 from IL6R__Homo_sapiens__NP_000556
augcuggccgugggcugcgcucuccuggccgcgcuucuggcugcccccggggccgcucucgccccuagacgguguccggcucaggaggucgcccgcggaguucugaccagccuucccggcgacuccgugacacugacgugcccugggguggaacccgaggauaacgcgaccguccacugggugcucagaaagccugccgcuggaucucaucccagccggugggccggcauggggcgcagacugcugcuccgguccguucaacugcacgacucuggaaauuacagcuguuaucgcgcuggcagaccugccggcacagugcaucuucuggucgaugugccgcccgaagaaccucagcucuccugcuuccggaaaucuccccugagcaacguugugugugaaugggggccucgcuccacccccagccuuacaaccaaggcgguccugcucgugagaaaauuucaaaauucuccggccgaggacuuccaggagccuugccaguacucccaggaaagccagaaguuuucuugucagcuggcugugcccgagggagauuccagcuucuauaucgucucuaugugcguugccuccagcgugggcuccaaauuuucuaagacacaaaccuuccagggguguggcauucugcagccugacccucccgcuaacaucacggugaccgccgucgcccggaauccccgcuggcucagcgugacauggcaggauccgcacuccuggaacagcucuuuuuacagacugcgguucgaacuucgcuauagagcugagcgguccaagaccuuuacaaccuggaugguuaaagaccugcaacaucacugcgugauucacgaugcguggagcggacucagacaugucgugcagcugcgcgcccaggaggaguucgggcaaggagaguggucugaauggagccccgaggcuaugggcacgccuuggacagaaucccggucucccccugccgagaaugagguuagcacccccaugcaggcccuuacaaccaacaaggacgaugacaauauccuguuuagagauuccgcuaacgccaccagccucccggugcaggacucuuccagcgucccucugcccacauuccugguggcgggcgggucucucgcuuuuggaacgcugcuuuguauugccaucguccugcgcuucaaaaagaccuggaaacuccgggcccugaaggaaggcaagacauccaugcacccucccuacagccuugggcagcuggugccugagagaccccgcccgaccccuguucucgugccccugaucucucccccugucuccccgagcucccugggaucugacaauacaagcucccauaaccggcccgaugcuagagacccucgcagccccuaugauauuucuaauaccgacuacuucuuuccucgguga

SEQ ID NO: 70757 - RNA, 2574 nt, Artificial Sequence
  derived and/or modified sequence opt5 from IL6ST__Homo_sapiens__NP_001177910
augcugacccuccagacauggcuggugcaagcccuuuucaucuuucugacgaccgagagcacaggcgaacuccuggaccccugcggguacauuuccccugagucuccggucguucagcuucacagcaacuucaccgcugugugugugcugaaggaaaaaugcauggauuauuuucaugucaaugccaacuacaucguguggaagacaaaucacuucaccauucccaaagagcaguauacaaucauuaacagaaccgcguccucuguuacguuuaccgacaucgcuagccucaauauccagcugacauguaacauucugaccuucggacaacucgaacagaauguguacggcaucacaauuaucuccgggcugccucccgagaagccuaaaaaccuuucuugcauugucaaugagggaaagaagaugcggugugaaugggauggcgggcgcgagacccaucuggaaacgaacuuuacacucaaaagcgagugggccacccacaaguucgccgacugcaaagcuaagagagauacacccaccuccuguaccguggacuauagcacaguuuacuuugugaauaucgaggucuggguggaagccgagaacgcucugggaaaagugacgucugaucauauuaauuucgacccugucuauaagguuaagccgaaucccccucacaaccuuuccgugaucaacagcgaagaacugucuuccauccucaaacugaccuggacaaaccccagcauuaagucugugaucauucugaaauacaauauccaguaccggaccaaggaugccuccacauggagccagauuccucccgaagacaccgcguccacgcgcucuagcuuuacaguccaagaucucaaaccguucaccgaguauguguuuagaauccggugcaugaaggaggacggcaaaggcuacugguccgauuggagcgaagaggccucugggaucaccuaugaagaccgcccuuccaaggcucccagcuucugguacaagauugacccuucucacacacagggauauagaaccguucagcugguguggaaaacacuuccucccuucgaggccaacggcaagauccuggauuacgaagucacgcucacccgguggaaaagccaucugcagaauuauacagugaacgcuaccaaacuuacaguuaaucugaccaacgaccgcuaccucgccacgcugaccgugagaaaucuggucgggaaguccgaugcggccgugcucacaauucccgcuugugacuuucaaggaaaccuggccgagucuaagugcuaccuuaucaccgucacaccgguguaugcugauggccccgggagcccugaguccauuaaggccuaccugaaacaggcucccccuagcaagggacccaccguucggacgaaaaaggugggcaaaaaugaagccguccucgagugggaccagcugccgguggauguucaaaacggcuucauccgcaauuauacaaucuuuuacagaaccauuaucgggaacgaaacagcggugaaugucgacucuucccacaccgaguauacccuuagcucucugacauccgauacgcucuacauggugcggauggccgcuuauaccgacgaaggaggcaaggaugggccugaguucacauuuaccacacccaaguucgcccagggagagauugaagccaucgugguuccugucugucuggcuuuucugcucaccacgcugcuuggcgugcuguucugcuuuaacaaacgcgaccucauuaagaaacauaucuggcccaaugugccugaccccagcaagucccacauugcccaguggucuccgcacacaccucccagacauaacuucaacagcaaagaucagauguacuccgacgggaauuuuaccgaugucucugugguugagaucgaagcgaacgacaagaagcccuucccugaggaucugaaaagccuggaccuuuuuaagaaagagaagaucaauaccgaaggacacuccagcggcauuggcgggucuuccugcaugucuagcucccggccgagcaucucuagcuccgaugagaacgaaagcucucaaaauacauccagcaccgugcaguacuccacagucgugcauucuggauauagacaccagguucccagcgugcaggucuucucccgcucugagagcacgcaaccucuccuggacuccgaggagcggcccgaggaucugcagcucguggaccauguugauggcggggacggcauucugccuagacagcaguacuucaaacaaaacuguucucagcacgaaagcucccccgauaucagccacuuugagcgcucuaaacagguguccagcgucaaugaagaggacuucgugcggcuuaagcagcaaauuucugaccauaucucccagagcugcggaucugggcagaugaagauguuucaagaaguguccgcugccgaugccuucggcccuggaaccgagggccaggucgagagauuugaaacaguugggauggaggcugccaccgacgaaggaaugcccaagagcuaucugccgcagacagugcgccagggcggguacaugccucaauga

SEQ ID NO: 70758 - RNA, 402 nt, Artificial Sequence
  derived and/or modified sequence opt5 from IL7__Homo_sapiens__NP_001186815
auguuccacgugagcuuuagauacaucuucggccugcccccucucauucugguccuucugccgguugccuccucugacugcgauaucgaggggaaggacggaaaacaguaugaaagcgugcucaugguguccauugaucaacugcuugacucuaugaaggagaucggcagcaacugucugaauaacgaauuuaauuucuuuaaacggcauauuugcgaugcuaacaaggucaaagggcgcaagcccgccgcgcucggagaggcucagccuaccaagucccuggaagagaauaaaucucugaaggagcagaaaaagcucaacgaccuguguuuccuuaaaagacugcuccaggaaaucaagacaugcuggaauaagauccugaugggcacgaaagagcacuga

SEQ ID NO: 70759 - RNA, 1380 nt, Artificial Sequence
  derived and/or modified sequence opt5 from IL7R__Homo_sapiens__NP_002176
augaccauccugggcacaacguucgggaugguguuuagccuccugcaggucguuuccggagagucuggcuacgcccaaaacggggaccuugaagaugcugagcuggacgauuauagcuucuccugcuacucucagcucgaagugaauggaagccagcacucccugaccugugccuuugaggaccccgaugugaacauuacaaaucuugaguucgaaaucugcggcgcgcuggucgaggugaagugucucaacuuuagaaaacugcaggaaauuuauuucaucgagaccaagaaauuucugcucauugggaagucuaauaucugcguuaaagugggagaaaagagccugacauguaagaaaaucgaccuuaccacaauugucaagccugaggcuccguucgaucuguccgugguuuaccgggagggcgccaacgacuuuguggucaccuucaauacgagccaucuccagaaaaaguaugugaaagugcugaugcacgaugucgccuaccgccaagaaaaggacgagaacaaguggacccauguuaaucuuucuuccacaaaacugacccuccugcagagaaagcugcagcccgcugccauguaugaaaucaaagugcggagcauuccugaucacuacuuuaagggcuucuggucugaguggucccccagcuacuauuuucgcacaccugaaaucaacaauucuuccggggagauggaccccauucuccugaccaucagcauucuuuccuucuucucuguggcucugcucgucauccuggccugcgugcuuuggaaaaagagaaucaaaccuauuguuuggccgagccugcccgaucauaagaagacgcucgagcaccuguguaaaaagccucggaaaaaccugaauguguccuuuaaccccgagagcuuccucgacugccaaauccaccgcgucgacgauauucaggcgagagacgaaguggaaggauuucugcaggauacauucccucagcaacuugaggaaucugagaagcagcggcugggcggggacguucagucccccaauuguccgagcgaggauguggucaucaccccugaaucuuuuggacgcgacagcucccucacaugccuggccggcaacgugucugcuugugaugcccccauucuuagcuccagcagaucucuggacugccgggaguccgggaaaaacggaccucaugucuaccaagaucuccugcugagccucggcaccaccaauucuacacugcccccucccuucucccuucagagcggcauccugacgcucaacccgguggcucaggggcagcccauccugaccucccugggaucuaaucaagaagaggccuauguuacaaugagcuccuuuuaccagaaccaguga

SEQ ID NO: 70760 - RNA, 435 nt, Artificial Sequence
  derived and/or modified sequence opt5 from IL9__Homo_sapiens__NP_000581
augcugcucgccauggugcugaccagcgcucugcugcucugcuccgucgccggccaggggugucccacacuggcgggaauccuugacauuaacuuccugaucaauaagaugcaagaagauccugcuucuaaaugccacuguagcgccaacguuacguccugccucugucugggcauuccgucugacaauugcaccagacccuguuuuagcgaacggcugucccagaugacaaacaccacaaugcagacccgcuacccucucaucuucucuagagugaagaaaagcguggagguccugaagaauaacaaaugccccuauuuuuccugugaacagccuugcaaucaaacaaccgccgggaacgcucuuacguuccuuaagagccuccuggagauuuuucagaaggagaaaaugcggggaaugcgcggcaagaucuga

SEQ ID NO: 70761 - RNA, 1566 nt, Artificial Sequence
  derived and/or modified sequence opt5 from IL9R__Homo_sapiens__NP_002177
augggccuggggagaugcaucugggagggauggacccucgaaagcgaggcccugcggcgcgacaugggcacauggcuucuggcuuguauuugcaucuguacgugcgugugucucggggucuccguuaccggagaaggccaggggcccagaucucggacauuuaccugccugacaaacaauauucuucgcaucgauugucacuggagcgccccugagcugggacaaggcuccucuccguggcuccuguucaccagcaaccaggcgcccggcgggacacauaagugcauucugagaggauccgaauguaccguggugcucccucccgaggcuguccuggugccuucugacaauuucacgaucaccuuucaccauugcaugagcggccgggagcagguuucccuuguggaucccgaauaccugccucgcagacacgucaaacucgacccgcccagcgaucugcagucuaacaucuccagcgggcauuguauucuuacauggucuaucuccccugcccuggagcccaugaccacacuccugagcuaugaacuggccuucaagaaacaagaggaggcuugggaacaggcccagcaccgggaccacauugugggaguuaccuggcucauccuggaggcuuuugaacuugauccuggcuucauucaugaggcccgccugagagugcagauggcgacgcucgaagacgaugucguggaggaggaacgguacacagggcaauggucugaguggucccagcccgugugcuuucaggccccgcagcgccaaggaccucugauucccccuuggggcuggcccggcaauacccuugucgcuguuagcaucuuccugcuccugacagggcccaccuaucugcucuuuaagcuguccccuagagugaaacggaucuucuaccagaacgugccgucucccgccauguuuuuccagccucuuuauagcguccacaauggaaacuuucaaaccuggaugggcgcucauggggccggagugcugcucucccaggacugcgcgggcacaccccagggggcccuggaaccuuguguucaggaggcuacggcccuucugaccugcggacccgcucgcccguggaagucuguggcccucgaagaggagcaagaaggcccuggcacaagacugcccgggaaucugucuuccgaggauguccucccugccggauguaccgaauggcgggugcagacacuggcuuaccuuccccaggaggacugggcgccuaccagccugacgagacccgccccgccugauucugaaggcagccgcuccucuagcuccagcagcuccagcaacaauaacaauuauugcgcucucggguguuacggaggcuggcaccugucugcccugcccgggaacacacaguccagcggccccaucccugcccuugcuugcggacucuccugugaccaccaaggccuggagacccagcaggggguugccugggugcuggcgggacauugccagcggccgggccuccacgaggaccugcaagggaugcuucugcccucuguccucagcaaggcuagauccuggaccuucuga

SEQ ID NO: 70762 - RNA, 1641 nt, Artificial Sequence
  derived and/or modified sequence opt5 from ILDR1__Homo_sapiens__NP_001186728
auggccuggcccaagcugccugcuccguggcuccugcuuugcaccuggcugcccgccggcugucucagccugcuugugacaguccagcacacggagagauacguuacccuguucgcguccaucauucucaaaugcgacuauacaaccucugcucaacugcaggaugugguggucacauggcgguuuaagagcuucuguaaagacccuaucuuugauuacuauuccgccucuuaccaggccgcucugagccucgggcaggaccccuccaacgauugcaaugacaaccaacgcgaagugagaauuguugcccagcggcgcggacagaaugagccugugcugggcgucgauuauagacagcggaagaucaccauucaaaaccgcgcugaccuugugaucaaugaaguuauguggugggaucaugggguguacuauuguacaaucgaggcccccggagacaccucuggcgauccugacaaagaagucaagcugauugugcuccacuggcugacggugaucuucauuauccuuggggcgcugcuccugcugcuccugauuggagucugcuggugucagugcuguccgcaguacugcuguugcuacaucagaugccccuguugcccugcccauuguugcugucccgaggaggcucuugcccggcaccgcuauaugaagcaggcucaagcccugggcccucagaugaugggcaaaccccucuacuggggagcggauagaagcucccagguuagcucuuauccgaugcauccucugcuucaacgggaccugucccuccccagcucucugccucagaugcccaugacccagacaaccaaccagcccccuauugccaauggggugcuggaauaccucgagaaggaacugcgcaaccuuaaucuggcucaaccgcugcccccugaccucaaaggcagauuugggcaccccugcuccaugcuuagcucucugggauccgagguggucgagcggcgcaucauccaccucccuccccugauuagagaucugagcuccucucggagaacaagcgacucccuccaucagcaguggcugaccccgaucccuagccgccccugggaucuucgggaaggcagaucucaccaucacuauccugacuuccaccaggagcugcaagaucgcgggcccaaguccugggcccucgaacggagagagcuggacccuagcuggucuggacgccaucggagcuccagacugaacggcucucccauucacuggagcgaucgcgacucccuuagcgaugugccgucuuccagcgaagcucgguggagaccuucucauccucccuuucgcucccggugucaggagagaccccggcgcccgagccccagagaguccacgcagcggcacggcagacgccggagacaucgcucuuacagcccuccccucccuuccgggcugucuagcugguccagcgaagaggacaaagaaagacagccccaaucuuggcgggcccaccgcagaggaucccacagcccucauuggcccgaggaaaagccgccuucuuaucggucccuggauaucacacccggcaagaauagccgcaaaaaggggucuguugagagacggagcgagaaagacuccagccacucuggacgcuccguggucauuuga

SEQ ID NO: 70763 - RNA, 1920 nt, Artificial Sequence
  derived and/or modified sequence opt5 from ILDR2__Homo_sapiens__NP_955383
auggacagagugcugcuccgguggaucagccuguucuggcuuaccgccauggucgagggccugcagguuacagugcccgauaagaaaaagguggcuaugcucuuucaaccuacgguccugcgcugccacuucuccaccucuagccaucagccggccgugguucaguggaaauuuaaguccuacugucaggacagaaugggggaaucucuuggaaugagcuccacacgggcgcaaucucugagcaaacgcaaccucgagugggaucccuaucuggacugccuggauuccagacggaccgugcgcgucguggcuagcaagcagggcucuacaguuacccucggggacuucuacagaggacgggaaauuacaaucgugcacgaugccgaccugcagauuggcaaacuuauguggggagauuccgggcuguauuacuguaucauuaccacgccugacgaucucgagggcaaaaaugaagacagcgucgagcugcuugugcugggccgcaccgggcuccuggccgaucugcuccccucuuuugcuguggagaucaugccugaaugggucuucguuggacuggugcuucugggcguguuucucuucuuuguccugguggggaucugcuggugucagugcuguccccauuccugcuguugcuauguuagauguccuugcugcccggacagcuguugcuguccccaagcccuuuacgaggcuggaaaggccgcgaaagccggcuauccucccucuguguccggggucccuggacccuacagcauuccguccgugccucugggcggcgcucccucuagcgggaugcucauggacaagccucacccuccgccccuggcccccuccgauagcacaggaggcucucauuccguucggaaaggguaccgcauccaggcugacaaggaaagagauagcaugaaggugcuguauuacgucgagaaagagcucgcccaguucgaccccgcgcggcgcaugagaggacgguauaacaauaccauuucugaacugagcucccuucacgaggaagauucuaacuuuagacagagcuuccaccaaaugcgcuccaagcaguuuccugugagcggcgaccuggagucuaaucccgauuacugguccggggucaugggaggcagcucuggcgccucccgggggccuagcgcuauggaauauaacaaagaggacagagaguccuuccgccauucucagccccggagcaaguccgaaaugcucucuagaaagaauuucgccacaggagugccggcuguuagcauggaugagcuggccgccuuugcugacuccuacggccaacgcccucggagagcggaugggaacagccacgaagcccgcggaggcucucgguucgagagauccgaaagccgcgcucauucuggguuuuaucaggacgacucccuugaggaguacuacggccagcggagcagaucucgggaaccccugaccgaugccgaccgcggaugggccuucagcccugcuagacggagacccgccgaggaugcgcaccucccucgccuggugucccggacgcccggcacagcuccgaaguaugaccacagcuaccuggggucugccagagaacgccaggccagaccugagggagcuucccggggcgggagccucgaaacccccuccaaacgcucugcccaacugggacccagaagcgcuuccuauuacgccuggucuccuccgggcacauauaaggcggggagcucccaggaugaccaggaggaugccucugacgaugcccuucccccuuacagcgagcuggaacucacccggggccccuccuaucgcggaagagaccugccuuaccauagcaauucugagaagaaacggaagaaagaacccgcuaagaaaaccaacgauuuuccuacacgcaugucccuggucguguga

SEQ ID NO: 70764 - RNA, 1059 nt, Artificial Sequence
  derived and/or modified sequence opt5 from ILF2__Homo_sapiens__NP_001254738
auggccuuccccagagugaagccugcuccggacgagaccagcuuuuccgaagcccugcucaaacggaaccaggaucuggcgcccaauucugcugagcaagccagcauccuuucccuggucacaaagauuaacaauguuaucgacaaccucauuguggccccuggcacguucgaagugcagaucgaggaaguccgccagguggggucuuacaaaaagggaaccaugacaaccggccacaauguugcugaucugguggucauucuuaaaauccugcccacacucgaggccguggcugcccuggggaacaagguuguggagagccugagagcgcaggacccuuccgaaguccucaccaugcugacaaaugagaccggauuugaaaucucuagcuccgaugccacggugaagauucuuaucaccacagugcccccuaaccugcggaaacucgacccggagcugcaucuugauauuaagguccugcaaagcgcucucgccgcuauccgccacgccagaugguucgaggaaaaugcgucucaguccaccguuaaagugcugauucggcugcucaaggaccugcgcaucagauuucccggcuucgagccucuuacacccuggauucuggaucuccuggggcauuaugccgugaugaacaauccuacccggcagccccuugcucugaacgucgccuaccgcagaugccuccagauccuggcugccggacuguuucucccgggcagcgugggcaucacggacccuugugaaucugggaauuuccggguucacacagugaugacccuggagcaacaggauauggucugcuauacagcccagacccuugugcgcauucugucccauggaggcuuuagaaaaauccucgggcaggaaggagacgcuagcuaccuggcgucugagauuuccaccugggauggcguuaucgugacacccagcgagaaggccuaugaaaagccucccgagaaaaaggaaggggaggaagaggaggaaaacacggaggaacccccucaaggagaggaagaggaguccauggaaacccaggaguga

SEQ ID NO: 70765 - RNA, 2121 nt, Artificial Sequence
  derived and/or modified sequence opt5 from ILF3__Homo_sapiens__NP_001131145
augagacccaugcggaucuucgugaacgacgaucgccacgucauggccaagcauagcuccguuuacccuacccaggaggaacuggaggcugugcaaaauauggugucucacacagaaagagcccucaaagcggucagcgacuggauugaugagcaggaaaagggcuccucugagcaggcugagagcgacaacauggaugugccgcccgaagacgauuccaaagagggggccggagaacagaagacggagcauaugacccggacacugcgcggcguuaugagaguggggcuugucgccaaaggacugcuccugaagggcgaccuugaucuggagcucgugcugcugugcaaggaaaaaccuaccacagcucuccuggacaagguugccgauaaucuugcuauccaacuggccgcggugaccgaggacaaauaugaaauucuccagucugucgaugacgccgcuaucgugauuaagaacacaaaagagcccccucugagccuuaccauccaccugacgucccccgugguccgggaagagauggagaagguucucgccggggaaacccugagcgugaaugacccuccggaugugcuggaccgccagaagugucucgcugcccuggcgucucuuagacaugccaaaugguuucaggcucgggccaacggacugaaguccugcgucaucgugauucgcguucucagagaucuguguacacgggugcccaccuggggcccucuucgcggcuggccccuggagcuccugugcgagaaaagcaucgggacagcuaauagaccuaugggagccggcgaggcccugcggcgcguccucgaaugucuggcuucugggauugugaugcccgacggauccggcaucuacgauccgugcgagaaggaggcgaccgacgccauugggcaccuugauagacaacagcgggaagacaucacgcagagcgcucagcacgcccugagacucgccgcuuucggacaacugcauaaaguucuuggcauggauccucugcccucuaagaugccuaaaaagcccaagaacgagaaucccguggacuauacaguccagauuccuccguccaccacauacgccaucacccccaugaaacgcccuauggaagaggauggcgaagaaaagagccccuccaaaaagaaaaagaagauccagaaaaaggaggaaaaagcggagccuccccaagcuaugaacgcccucaugcggcugaaucagcugaagccggggcuccaguauaaacuggugucucagaccggaccuguccacgcccccauuuuuacaaugagcguggaaguugacggcaacuccuucgaggcuagcgggccuucuaagaagacggccaaacuucauguggcugucaaggugcugcaagacaugggacuccccaccggcgccgaggggagagauuccagcaaaggagaagacucugcggaggaaacagaggccaagccugcuguuguggcccccgcuccggucguggaagccgugagcaccccuuccgcggccuuucccucugaugcuacagccgagaauguuaaacagcagggccccauccugaccaagcacggcaagaacccugucauggagcugaaugaaaaacgccgggggcuuaaguacgagcucauuagcgaaacgggaggcucccacgacaaaagauucgugauggagguggaagucgaugggcagaaguuucaaggagcuggcagcaacaaaaagguggccaaagccuaugcugcgcuggccgcucuggagaaacucuucccggacacaccccuggcccuugaugccaacaagaagaagcgcgcuccuguucccgugagagggggcccuaaauuugccgcgaagccccauaauccuggauucggcaugggagggcccaugcacaacgaggucccgccucccccuaaucugcggggccgcgggcggggaggcucuaucagagggcgcggccggggaagaggcuuugggggagcuaaccauggcggguacaugaaugccggagccggcuacggguccuauggcuacggaggcaacagcgcuaccgccggguauucugacuucuuuaccgauuguuacggauaucacgacuucggcuccagcuga

SEQ ID NO: 70766 - RNA, 1359 nt, Artificial Sequence
  derived and/or modified sequence opt5 from ILK__Homo_sapiens__NP_001014795
auggacgauaucuucacccagugcagagagggcaacgccguggcuguccggcuguggcucgacaauacagaaaacgaucugaaucaaggggacgaucacggauuuagcccccuucauugggccugucgcgagggcagauccgcgguuguggaaaugcugauuaugcgcggggcucggaucaacgugaugaauagaggagacgauacgccucuccaccuggccgccucucauggccaccgggacauuguccagaaacuucugcaguacaaagcugauaucaacgccgugaaugagcaugggaacguuccgcuccacuaugcuugcuucuggggacaggaccaaguggccgaagaucuggucgcgaauggcgcccuggugagcauuuguaacaaguacggcgagaugcccguugacaaagcuaaggccccucuccgcgagcugcuuagagaacgggcugagaaaauggggcagaaucugaaccgcauccccuauaaggauaccuuuuggaagggaacaaccagaacacggccucgcaauggcacccucaacaaacacuccgggaucgacuucaagcagcugaauuuucuuacaaaacugaacgaaaaccauucuggagagcucuggaagggcagauggcaggggaaugacauuguggucaaagugcugaaggugcgggauuggagcacccgcaaguccagagacuucaacgaggaaugcccccggcugagaaucuuuucucacccuaauguccucccgguucugggagccugucaaagcccucccgcgccccauccuacgcuuauuacccacuggaugcccuacggcucccuguauaacgugcuccacgagggcacaaauuucguggucgaucagagccaggccgugaaauuugcucuggacauggcccgcgggauggcuuuccuucauacccuggaaccgcucaucccucggcacgcccugaacucuagauccguuaugauugaugaggacaugacagcccgcaucagcauggcugaugugaaguuuucuuuccagugccccggacggauguacgcgccugccugggucgcucccgaagcccugcaaaagaagcccgaggacaccaauagacgcuccgccgauauguggagcuuugcugugcuccugugggagcuuguuacgcgggaagugccuuucgccgaccugucuaacauggagauuggcaugaaagucgcgcucgaagggcugagaccgacaauucccccuggaaucuccccucauguguguaaacuuaugaaaaucugcaugaaugaggaucccgcuaagcgccccaaguucgacaugaucgucccgauucuggaaaagaugcaggacaaguga

SEQ ID NO: 70767 - RNA, 501 nt, Artificial Sequence
  derived and/or modified sequence opt5 from IMMP1L__Homo_sapiens__NP_001291203
augcugagaggcgugcucgggaagaccuuccggcuggucggauacacaauccaguauggcugcauugcccacugugcuuuugaguacguugggggaguggugaugugcagcggccccuccauggaaccuacgauccaaaacucugacauugucuucgccgagaaucuuagccgccauuuuuaugggauccagagaggagauauugugaucgcgaaauccccgucugaccccaagagcaacaucuguaaacggguuauuggccuggaaggcgauaagauccucaccacauccccuucugacuucuuuaaaagccacuccuacgugcccauggggcaugucuggcuggagggagauaaucuucagaacagcaccgacucucgcugcuauggcccuauucccuacgggcugaucagaggacggauuuucuuuaagaucuggccucucuccgauuucggcuuucugcgcgcuagcccgaaugggcacagauucucugacgauuga

SEQ ID NO: 70768 - RNA, 528 nt, Artificial Sequence
  derived and/or modified sequence opt5 from IMMP2L__Homo_sapiens__XP_005250687
auggcccagagccaaggcugggugaagagauacaucaaggcuuucugcaaaggguuuuucgucgccguucccguggcggugaccuuucuggaccgggucgcuuguguggcccgcguugagggagccuccaugcagccuucucucaacccgggcgggagccaguccucugaugugguccugcuuaaucacuggaaagugagaaacuucgaaguucaucggggagacauugugagccuggucucccccaagaauccugagcagaaaaucauuaagcgcgugaucgcucucgaaggcgauauugugagaacaaucgggcacaagaaccgguaugucaaaguuccccgcggacauaucuggguggagggcgaccaccauggccacucuuuugauagcaauuccuucgggccugugagccugggacuucugcacgcccaugcuacgcacauucucuggcccccugaaagauggcaaaagcuggagucuguccugccgcccgagcggcucccugugcagcgcgaagaggaauga

SEQ ID NO: 70769 - RNA, 2274 nt, Artificial Sequence
  derived and/or modified sequence opt5 from IMMT__Homo_sapiens__NP_001093639
augcugagagccugccagcucagcggcgugaccgcugccgcgcaauccugucugugcgggaaguucguccuucggccccugcgcccuuguagacgguacucuacaagcggauccucuggccucacgaccgggaaaaucgcuggagccggccugcuuuuuguugggggaggcauuggcgggacaauccuguaugccaagugggacagccacuuccgcgaguccguggagaaaaccauuccguacucugauaagcucuuugaaauggugcugggacccgcugccuauaacgucccucugcccaaaaagagcauccaguccggcccucucaagauuagcucuguguccgaaguuaugaaagagagcaagcagcccgcuucucagcugcaaaaacagaagggggacacacccgccuccgcgaccgccccgacagaagcugcccagaucaucagcgcugccggagauacccuuucugugcccgcgccugccguccagcccgaggagucccugaaaacggaccauccugaaauuggcgaggggaagcccaccccggcucucagcgaagccuccucuagcuccaucagagagcggccucccgaggaaguggcugcccgccuggcccaacaggagaagcaggaacagguuaaaauugagagccuugcuaagucucuggaagaugcgcucagacaaacagccuccgugacccugcaggcuaucgccgcccagaaugcugccguccaagcggugaacgcucacagcaauauucugaaagccgccauggacaacucugagaucgcuggagagaagaaaagcgcccaguggcggacaguggaaggcgcucucaaggagcgcagaaaagccgucgaugaagcggccgacgcucugcuuaaggccaaggaggaacuggagaaaaugaaguccguuauugagaaugcuaaaaagaaagaaguggccggcgcgaagccucauaucaccgccgcugaggggaagcuccacaacaugaucguggaucuggacaaugucgugaaaaagguucaggccgcucagucugaagccaaaguggucagccaauaccaugagcuugugguucaggcccgggaugacuucaagcgcgaacuggauuccauuacgcccgaggugcuccccggauggaaaggcaugagcgucucugaccuggcugacaagcuguccacagaugaccucaacagccugaucgcgcacgcccacagacggauugaucagcuuaaucgcgagcuggcugaacagaaggccaccgagaaacaacauaucacacucgcccuggaaaagcagaaacuugaggagaagagagcuuuugacucugccguggcgaaagcucuggaacaccaucgguccgagauucaggccgaacaggauagaaagaucgaggaaguccgcgacgccauggagaacgagaugcggacccaacucagacgccaggcugccgcgcacaccgaucaucugcgggacgugcugagaguucaggaacaggagcucaagagcgaguucgaacaaaaucuguccgaaaaacuuucugagcaggagcugcaguuucgccggcucagccaagaacagguggauaacuucacacuggacaucaauacggcuuaugccagacugcgcgggauugagcaggccguccagucccacgcuguggccgaagaggaagcucggaaggcccaccaacuuuggcucucuguugaggcgcugaaauacagcaugaagaccuccagcgccgagacaccuaccaucccgcugggaucugcuguggaagccauuaaagcuaacugcuccgauaaugaguuuacacaggcccucaccgccgcuaucccuccugaaagccugacgagaggcgucuauucugaggagacacuucgcgcgcgguucuacgccgugcagaagcuggcuagacggguggccaugauugacgaaacccgcaacucccucuaccaguauuuucugagcuaccugcaaucucuucuccuguuucccccucagcagcugaaacccccgccugagcucugucccgaagacaucaacaccuucaagcugcuuagcuaugccuccuacugcaucgagcauggggaucuggaacucgcugccaaguucguuaaucagcugaaaggagagagcagacgggucgcgcaagacuggcugaaggaggcuagaaugacacuugaaaccaaacagauuguggagauccucacagccuaugccucugcugugggcauuggcacgacccagguccaaccugaauga

SEQ ID NO: 70770 - RNA, 555 nt, Artificial Sequence
  derived and/or modified sequence opt5 from IMP3__Homo_sapiens__NP_060755
auggugagaaagcugaaauuccacgagcagaagcuccugaaacaagucgacuuucuuaacugggaaguuaccgaucauaaucugcacgagcuccgggugcugcgcagauaccggcuucagcgcagagaagacuauacacgguacaaccagcugagccgcgccgugagagagcucgcucggcgccugagagaucugcccgaacgggaccaguuccgcgucagagccuccgcggcucuccuggauaaacuuuaugcccugggccucgugccuacgcgggggucucuggagcuuugcgacuuuguuaccgccagcuccuucugucgcagacggcugccgacagugcuccugaagcugagaauggcucaacaucuccaggccgcugucgccuuuguggagcagggacacguucgcgugggccccgaugucgugaccgacccugcguuccuggugacacggucuauggaagauuuugucaccuggguugacagcuccaagaucaagagacaugugcuugaguacaaugaggaacgcgaugacuucgaucuggaggccuga

SEQ ID NO: 70771 - RNA, 1011 nt, Artificial Sequence
  derived and/or modified sequence opt5 from IMPA1__Homo_sapiens__NP_001138350
augggccagagacccgggccugugcugccggccgucgcuguucucggacaaguggccaagcggaaaguggcguggcugcuucgcuggaaggcugucaccagaacagagacggccggcaacagcuccgggguguacggauucggcaaaaugaagaucuuuguuaaauauuuccagaagauggccgaccccuggcaggaaugcauggauuacgcugugacccuggcccggcaggcuggggaggucgugugugaagccauuaagaaugagaugaacguuaugcucaaaucuagcccuguggaccuggucacagcgaccgaucaaaagguggagaaaaugcuuaucuccucuauuaaggagaaauaucccagccacuccuuuaucggagaggaaucuguggccgcuggcgaaaagagcauucugacagacaauccuaccuggaucaucgaucccauugacggcacaaccaacuucguccaucgcuuuccuuucguugccguguccaucggguuugcugugaauaagaaaauugaguucggagucguguacagcugcguugaaggcaagauguauacggccagaaaagggaagggagcguuuuguaacggccagaaacuccaggugucucagcaagaggauaucaccaagucccugcuggucacagaacucgggagcucucggaccccggagacagugcgcaugguucuguccaauauggaaaaacuuuucugcauucccgugcacggaaucagaagcgucggcaccgccgcugugaacaugugucuggucgccacgggcggggcugacgccuacuaugagaugggcauucauugcugggauguggccggagcugggaucaucguuacagaagcgggaggcgugcucauggacgucaccgggggaccuuuugaucugaugucucggcgcgugauugccgcuaauaacagaauccuugccgagcggauugccaaggagauccagguuauuccccugcagcgcgacgaugaagacuga

SEQ ID NO: 70772 - RNA, 867 nt, Artificial Sequence
  derived and/or modified sequence opt5 from IMPA2__Homo_sapiens__NP_055029
augaagcccagcggcgaggaccaggccgcucuggccgcggggccuugggaagagugcuuccaagcugccgugcagcucgcccugagagcuggacagaucauucggaaagcccuuaccgaagagaagcgcgucuccacaaaaacgucugcugccgaucugguuaccgaaacagaccaccucguggaggaucugaucauuagcgagcuuagagaacgguuuccgucccaucgcuucaucgcggaggaagccgcugccucuggcgcuaagugugugcugacccacagccccacauggauuaucgacccuaucgaugggaccugcaacuuuguccauagauuccccacaguggccguuuccauuggauuugcggugcggcaggagcucgaguucggcgucaucuaccacuguaccgaggaacgccuguauacggggagacggggacgcggcgccuuuugcaauggccaaagacugcgggugucuggggaaaccgaccucagcaaagcucugguucuuacagagauuggaccuaagcgcgaucccgccacccugaaacucuuccuguccaacauggaaagacuucugcaugcuaaggcccacggcgugcgggucaucgggagcucuacacucgcccugugucaccuggcuuccggagcggccgacgcuuacuaucaguuuggccuccauugcugggaucuggccgccgcuaccgugauuauccgcgaggccgggggaauugugaucgacacgagcggcggcccucuugaucugauggcguguagagucguugcugccucuacacgggagauggccaugcucaucgcucaggcccugcagaccauuaauuacgggagagacgaugaaaaguga

SEQ ID NO: 70773 - RNA, 963 nt, Artificial Sequence
  derived and/or modified sequence opt5 from IMPACT__Homo_sapiens__NP_060909
auggccgagggcgacgcugggagcgaucagagacaaaacgaagagaucgaagccauggcggcuauuuacggagaggaauggugcgugaucgacgauugugccaagauuuucugcauccggauuuccgacgauaucgacgaucccaaauggacccugugucuccaggucaugcugccuaaugaguauccgggcacagcucccccuaucuaccagcuuaacgcccccuggcugaaggggcaggagcgcgccgaccucucuaauagccuggaagagauuuauauccaaaacauuggagaauccauccuuuaccuguggguugagaaaauuagagaugugcucauccagaagucucagaugacggagccuggccccgacgugaaaaagaagaccgaagaggaagaugucgagugcgaagacgaucugauucuggcuugucagccugagagcuccgugaaagcccucgacuuugacaucucugagacacggaccgaaguugagguggaagaacugccgcccaucgaucacgggauuccuaucacagaccgcagaagcaccuuccaagcgcaucuugcccccgucgugugcccuaagcagguuaaaauggugcuguccaagcucuaugaaaauaaaaagauugcuagcgccacacacaacaucuacgcuuaucggauuuacugugaggauaagcagaccuuucugcaggacugcgaggaugacggagaaacggccgcgggcggccgccuucugcaucucauggagauccugaaugucaaaaacgugaugguggucguuucuagaugguacgggggaauccugcucggccccgaucgguucaagcacauuaauaacugugcccgcaauauccugguggagaaaaacuauaccaauuccccggaggaaagcucuaaggcucuugggaaaaacaagaaagugagaaaggacaagaaacggaaugagcauuga

SEQ ID NO: 70774 - RNA, 1080 nt, Artificial Sequence
  derived and/or modified sequence opt5 from IMPAD1__Homo_sapiens__NP_060283
auggcccccaugggcaucagacugagcccucucgggguggcugucuucugccugcuuggacugggcguucucuaccaccuguauuccggguuucuugccggacgguucucucuguuuggccucgggggagagccgggcggcggggcggcuggacccgccgccgcugccgacggcgggaccguggaucugcgcgaaaugcuggcugugagcguccucgccgcggugagaggaggcgacgagguucggcgcgugagagaauccaacguccugcaugagaagucuaaagggaagacacgggaaggagccgaggauaaaaugacgagcggcgacgugcuuuccaaucgcaagauguucuaccugcucaaaaccgcuuuuccuucuguucagauuaacacagaggaacacguggaugccgcugaccaagaggucauccugugggaucauaagauucccgaagacauccuuaaggaggugaccacaccuaaagaggugcccgccgaaagcgucaccguuuggauugauccucuggacgcgacacaggaguauaccgaagaucucagaaaguacgugacgaccauggugugugucgccgugaauggcaaaccgaugcuggggguuauccacaagcccuucuccgaguauacagcuugggccaugguggacggaggcagcaacgucaaagcucggucuuccuacaaugaaaagaccccucgcaucgugguuagcagaucucauuccgggauggugaagcaggucgcccugcagacauuuggaaaccaaaccacgauuauccccgccggcggggcuggauauaaagugcucgcgcugcuugaugucccugacaagagccaggagaaagccgaccuguacauucacgugacauacaucaagaaaugggauauuugcgcuggcaaugccauccucaaggcccugggcgggcacaugaccacacuuucuggagaggaaauuuccuauaccggcagcgacgggaucgagggaggccugcucgcuuccauccggaugaaccaucaggcccugguucgcaaacugcccgaucucgaaaagaccgggcacaaguga

SEQ ID NO: 70775 - RNA, 1800 nt, Artificial Sequence
  derived and/or modified sequence opt5 from IMPDH1__Homo_sapiens__NP_000874
auggagggcccccugaccccuccgccccuccaagggggaggcgccgcugccgugccugaacccggggcgagacagcacccuggacaugagacagcugcccagcgguacagcgcccgccugcuucaggcuggcuaugaacccgaguccccuagacuggaccucgccacgcacccgaccacaccccggucugaacugagcuccgucguucuucuggcuggggugggagugcagauggaucgccucagacgggccucuauggcggacuaccugaucagcggcggcaccggguaugucccugaggauggacugacagcccaacagcucuuugcuuccgccgacggccugaccuacaacgauuuucuuauucugcccggguucaucgacuuuauugcugaugagguggaccucacaucugcccugacccgcaagaucacgcuuaaaaccccucugauuagcucccccauggauacaguuaccgaagcggacauggccaucgcuauggcccucaugggaggcaucggguucauucaucacaauugcacaccggaguuucaggcuaacgaagugagaaaggucaaaaaguucgagcagggauuuaucaccgauccugugguucugagccccucucauacggugggcgacguccuggaggccaaaaugcggcacggcuucuccgggauuccuaucacagaaaccggaacaaugggcagcaagcucguggggauugugaccucucgcgauaucgacuuucuggccgagaaggaccacaccacacuucuguccgaagucaugacgcccagaauugagcucguuguggcucccgcgggagugacccugaaagaagccaaugagauccuucaacggagcaagaaaggcaagcugccuaucgucaacgauugugacgagcucguggcuauuaucgcccgcacagaucugaaaaagaauagagacuauccgcuggccucuaaggauucccagaaacagcuccugugcggggcugccguuggaacccgggaagacgauaaguaccgccuugaccugcucacacaggcgggcguggaugucauugugcuggacagcucccaaggcaacucuguuuaucagaucgcuauggugcauuacauuaaacagaaguacccccaccuucaagucaucgggggaaauguggucaccgccgcccaggcuaaaaaccugaucgaugccggcguggacgggcucagaguuggaaugggcugugggagcauuugcaucacgcaggaggugauggcuuguggccggccucagggaacagccgucuauaagguggcggaauacgccagacgcuucggcguucccauuaucgcugacgggggcauucaaaccgugggacaugucgugaaagcccuggcucugggggccuccaccgugaugaugggaagccuccuggcggccacaaccgaggcuccuggcgaauauuucuucucugaugggguucggcuuaagaaguacagaggcaugggaucccuggacgccauggagaaaagcucuagcucccagaagcgcuauuuuucugagggcgauaaagucaagaucgcucagggggugagcggauccauccaggacaaaggcagcauucaaaaguucgugcccuaccucaucgccgggauucagcacggaugccaggauaucggcgcccggucucuguccguccugagaagcaugauguauucuggggaacuuaaguucgagaaacgcacaauguccgcucagauugaaggcggagugcacggccuccauagcuacgagaagcggcuguacuga

SEQ ID NO: 70776 - RNA, 1545 nt, Artificial Sequence
  derived and/or modified sequence opt5 from IMPDH2__Homo_sapiens__NP_000875
auggccgacuaccugaucagcggcgggaccuccuaugugcccgaugacggacucacagcucagcaacuguucaacugcggcgaugggcuuacguacaaugacuuucugauucucccuggauauaucgauuucaccgccgaccaggucgaucugacaucugcgcuuaccaagaaaauuacacugaagaccccgcucguuagcucccccauggacacagugaccgaggcuggcauggccaucgccauggcucugacgggaggaauuggcuuuauccaccauaacuguaccccugaguuccaggccaaugaagugagaaaagucaagaaauacgaacagggcuuuaucacagaucccgugguucugucuccuaaggaccgggugcgcgaugucuucgaggcuaaggccagacacggguuuugcgggauucccaucaccgacacaggccggauggggagccgccucgugggaauuaucuccucuagagauauugacuuccugaaagaagaggagcaugacuguuuucuugaagagaucaugaccaagcgggaagaucugguuguggcgccugccggcauuacgcucaaagaggcuaacgagauccugcaacgcagcaagaaagggaaacuuccgaucgucaaugaagacgaugagcugguggccauuaucgcuagaacagaccucaagaaaaaccgggauuauccccuggccuccaaggacgcgaaaaagcagcugcucugcggagccgcuauuggcacccacgaagaugacaaauaccgccuggaucuucuggcccaggcuggcguggacgucguugugcucgauagcucucagggaaauuccaucuuccaaauuaacaugaucaaguauaucaaagacaaguacccuaaucuucaggugauuggaggcaacgucgugacagccgcccaggcuaagaaucugaucgacgcggggguugaugcccugagagugggaaugggcagcgggucuauuuguaucacccaggagguccucgcuugcggacggccccaagccaccgccguguacaaaguuuccgaauaugcucgcagauuuggcgugccugucauugccgacggcgggauccagaacgugggacauaucgcgaaggcucuggcccugggcgccagcacagucaugauggggucucuccuggcugccacgaccgaggcucccggagaguacuucuuuuccgauggcauucggcuuaaaaaguaucgcgggaugggcagccuggacgccauggauaaacaccucuccucucagaauagauacuucagcgaagcggacaagaucaagguggcccaaggaguuuccggcgcugugcaggauaaagggagcauucacaaguucgucccguaucugaucgccgggauucagcauucuugucaggacaucggcgcuaaaucccuuacacaagugcgggccaugauguacagcggggagcugaaguuugaaaagagaaccucuagcgcgcagguugagggaggcgugcacucccuccauucuuaugaaaagcgccuguucuga

SEQ ID NO: 70777 - RNA, 2160 nt, Artificial Sequence
  derived and/or modified sequence opt5 from IMPG1__Homo_sapiens__NP_001269297
auguaccuggagaccagacgggccaucuucguguuuuggauuuuccuccagguccaaggcacaaagguuugccaggaagcugugugggaggccuaucgcaucuuucuggaccggauucccgauacgggggaauaccaggacugggugagcaucugucagcaagagaccuucugccuuuuugauauuggcaaaaacuucuccaauucucaggaacaccuggaccuccugcagcagagaaucaagcaacgcagcuuuccugauagaaaagacgagaucuccgcggagaagacacuuggcgaaccgggggagaccauugucaucucuacagauguggcuaacguuagccugggacccuucccucucacccccgacgauacacugcugaaugaaauucucgacaacacccugaaugauacgaaaaugccuaccacagagcgggagaccgaauuugccgugcuugaggaacagcgcgucgagcuguccgugucucucguuaaccagaaguucaaggccgaacuggcugacagccagucccccuauuaccaagagcuugccggcaaaagccagcugcagaugcaaaagaucuuuaaaaagcucccuggguucaaaaagauucaugugcugggauuuagaccgaagaaagagaaggauggaucuuccagcacagaaaugcagcugaccgcuaucuucaaacggcacucugccgaggcgaagucccccgccagcgaccuccugucuuucgacuccaauaaaauugaaagcgaggaagucuaucauggcacgauggaggaggauaagcagccugaaaucuaccuuacagcuaccgaccugaaacgccucaucuccaaggcccuggaggaggaacagucucuugauguggggacaauucaauuuaccgacgaaaucgcuggaagccugcccgccuucggcccugauacccaguccgagcuccccacgagcuuugcggugauuacagaggacgccacccugucuccggaacugccucccgucgagccucagcucgaaacaguugauggggcugagcacggacugcccgacaccuccuggucucccccugccauggcuagcacaagccuuuccgaggccccgcccuucuuuauggccucuagcaucuucucccugaccgaucagggcacgacagacaccauggcuaccgaucaaacaaugcucgugccugggcugaccauucccacaagcgacuauucugcgaucucccagcuugcccugggaaucagccauccucccgcuucuuccgacgauagcagauccucugccggcggcgaagacauggugcggcaccucgaugagauggaccugagcgauacgccggccccuuccgaaguccccgagcugucugaauacgugagcguuccugaccacuuucucgaggauaccacacccguguccgcucugcaguacauuaccacaagcucuaugaccaucgccccuaaggggcgcgagcuugucguguucuuuucccugagaguugcgaacauggcuuucagcaaugaccucuuuaacaaaucuucccuggaauaucgggcccuggagcagcaauucacgcagcuucucgugcccuaccugcgcagcaaucugaccggauuuaagcagcucgaaauucugaacuucagaaauggcucugucaucgugaacagcaaaaugaaguucgccaaauccgucccguauaaucuuacaaaggcugugcaugggguucuggaggauuuucggagcgccgcugcccagcaacuccaccuggaaauugacucuuacucccugaacaucgagccugcggaucaggccgaccccuguaaguuccuugcuugcggagaguuugcccagugugugaaaaacgaaagaaccgaggaagcugagugccgcuguaagcccggcuaugauagccaagggucccucgacggacuggaaccuggccugugcggcccggggacaaaagagugugagguccuccagggaaagggcgcccccugccggcugccugaccauucugaaaaucaggcguacaaaaccagcgugaagaaguuccagaaccaacagaauaacaaaguuaucuccaagagaaauucugagcuucugacgguggaauaugaggaguuuaaccaccaggauugggaagggaauuga

SEQ ID NO: 70778 - RNA, 3726 nt, Artificial Sequence
  derived and/or modified sequence opt5 from IMPG2__Homo_sapiens__NP_057331
augaucauguucccccuguuuggcaagauuagccucgggauccugauuuucgugcuuaucgagggagacuuuccuucccugaccgcccagacauaccucucuauugaagagauccaagaaccgaaaagcgcugucuccuuccugcuucccgaggaaucuacggaucugagccucgccaccaagaaaaagcagccucuggacagacgggagacagagcgccaguggcugaucagacggcgcagauccauucucuuucccaacggcguuaaaaucugcccugaugaaucuguggcggaggcuguggccaaucacgucaaguauuucaaggugcggguuugucaggaagccgugugggaggcuuuucgcaccuucugggacagacugcccgggcgggaggaauaccauuauuggaugaaccuuugcgaggauggagucacaagcauuuuugaaaugggcaccaauuucuccgagagcguggaacaccgcucucugaucaugaaaaagcucacauacgccaaagagaccguuuccagcucugagcuguccagcccugugccggucggggacacgucuacccuuggagauacaacccuguccgugccccauccugaaguggacgcuuaugagggcgccagcgaauccucucucgagagacccgaagagagcauuuccaacgagaucgaaaaugucauugaggaagcgacaaagccugccggcgagcaaaucgcugaauuuagcauccaucugcuggggaaacaguaccgggaggagcuccaggauucuuccagcuuccaccaccagcaccuggaagaggaauuuauuucugagguugagaacgccuucaccggacuucccggcuauaaggaaauccgcgugcuggaguucagaagcccgaaggaaaaugacuccgggguggaugucuacuacgcugugacguuuaacggagaggccauuucuaauacaaccugggaccucaucagccugcauuccaacaaaguugaaaaucacggccuuguggagcuggaugacaagccuacagucguguauaccauuagcaacuuccgggacuacaucgcggagacccuccaacagaauuuucugcuggggaacucuucccucaaucccgauccugacagccugcagcuuaucaacguucgcggagugcugagacaucagacagaagaucucgucuggaacacgcaaucuuccagccugcaggccacccccuccucuauucuugacaauacauuccaggcugccuggcccagcgcugaugaguccaucaccucuagcauuccuccgcuggacuuuuccagcgggcccccuucugccacaggccgggaacucugguccgagagcccccugggcgaucuggugucuacccacaaacucgccuucccuuccaagaugggacugagcucuagccccgaaguccuugagguguccagccugacgcuccacucuguuacaccggcugugcugcaaaccggccugccugucgcguccgaggaaagaaccagcgggucccaucuuguggaggacggacucgccaacguugaagagucugaagauuuucugagcaucgacucccugcccucuagcuccuucacacagccugugcccaaagagaccauuccuucuauggaggauagcgacgucucccucacaagcucucccuaucugacguccagcaucccguuuggccuugacucucugaccuccaaggugaaagaucagcucaaggugagcccuuuccugcccgacgcuucuauggaaaaggagcugaucuuugaugggggacuuggcuccggcagcgggcagaaaguugaccucauuacauggcccugguccgaaaccagcucugaaaagagcgccgagccucuguccaaaccguggcuggaagaugacgauucucuccugcccgccgagaucgaagacaagaaacuuguccugguggauaagauggacagcacagaucaaauuuccaagcacucuaaauacgagcaugacgaucgcagcacccacuucccugaagaggagccccucuccggaccugcugugcccaucuuugccgacacggcggcugaaucugccagccugacccugccuaagcauauuuccgagguccccggcguggacgauuauagcguuacaaaagccccgcuuauccucaccucuguggcuauuuccgccagcacagacaagucugaucaggcugacgccauccugcgggaagauauggagcagaucaccgaauccagcaauuacgagugguucgacuccgaggucucuauggugaaaccugauaugcagacgcuguggacaauucuccccgaaagcgagagaguuuggacccgcacauccagccuggaaaaacuuucucgggacauccuggcguccaccccucaaagcgccgauagacucuggcugucugugacccagagcacaaagcugcccccgacgaccauuuccacacuucucgaggacgaagucaucaugggggugcaggauauuucucuggagcuggaccgcaucggaaccgauuauuaccagccugagcaaguucaggaacagaacggcaagguggggagcuacgucgagauguccacaucugugcacagcaccgaaaugguguccgucgcuuggcccacggagggcggagacgaccucagcuauacacagaccucuggcgcccugguuguguucuuuucccuucgggugaccaauaugauguucagcgaggaucuguuuaacaaaaauucccucgaauacaaggcucuggagcaaagauuccuggaacuucuggucccuuaucuccagucuaaccugacaggguuucagaaucucgagauccugaacuuccgcaauggaagcauugugguuaacucccggaugaaguuugccaauucugugccucccaacgucaauaacgcgguguacaugauccuugaagacuucuguaccacagccuauaacacgaugaaucuggcuauugauaaauacagccucgacguugaguccggcgaugaggccaaccccugcaaguuucaggcuuguaaugaguucagcgagugccuggugaacccguggucuggggaagccaaguguagaugcuuucccggauaucuguccgucgaggaacgcccuugucaaagccuuugcgaccugcagcccgauuucugucucaaugacggcaaaugcgauaucaugccugggcacggcgccauuugccgguguagagugggagagaacuggugguaccggggcaagcauugcgaggaauuuguuucugagcccgugaucaucgggauuaccaucgcuuccgucgugggacugcucgugauuuucagcgcgaucauuuacuucuuuauccgcacacugcaggcccaccaugacagaucugaacgggagagcccuuucuccggcucuagcagacaaccggauucccuuagcuccaucgaaaaugcugucaaauauaaccccguuuacgagucucaccgcgccgggugugagaaguaugaaggaccuuacccccagcacccuuuuuauagcuccgccucuggcgacgugauugggggccugagccgggaggaaaucagacagauguacgaguccucugagcucagccgcgaagagauucaggaaagaaugcgggugcuggagcuguaugcuaaugaccccgaguucgccgcguuuguccgcgaacaacagguggaggaaguuuga

SEQ ID NO: 70779 - RNA, 5739 nt, Artificial Sequence
  derived and/or modified sequence opt5 from INADL__Homo_sapiens__XP_011538767
augcccgagaacccugccaccgacaagcugcaggugcuccaaguccuggauagacuuaaaaugaagcugcaggaaaaaggcgacacaagccagaaugagaagcucuccauguucuacgaaacgcugaaaucuccgcuuuuuaaccagauccugacccuccaacagagcauuaagcagcugaaggggcagcugaaucacauccccuccgauugcucugcuaacuucgacuuuagccggaaaggacuccugguuuucacagauggcuccauuaccaaugggaacgugcaucgcccuucuaauaacagcacaguguccggacuuuuucccuggaccccuaagcugggcaaugaggacuucaacagcgucauccaacagauggcccaggggagacagauugaauauaucgauaucgagcggcccucuacaggaggccucggcuuuuccgugguugcgcugcgcagccaaaaucuugggaaaguggacauuuucgucaaggaugugcagccuggaucuguugcugacagagaucagcggcugaaagagaacgaccaaauccucgccauuaaucacaccccgcuggaucagaacaucucccaucagcaggccauugcucugcuccaacagacgaccggcagccugcgccuuaucguggccagagaacccguccacacaaagucuuccaccagcuccucucugaaugacacaacccucccugagacgguguguugggggcauguggaagaggucgagcugauuaacgacggaagcggccuuggguuuggaaucguuggcggcaagacauccgggguggugguccggaccaucgugcccggaggccuggcugaucgcgacgggagacuccagacaggagaucacauucugaaaaucggcgggaccaacguucagggaaugaccagcgaacaaguggcccagguccugcggaauugcggcaacucugugcgcaugcucguugcgagagacccugccggcgauauuuccgugacacccccggcuccugccgcucugcccgucgcccuuccuacgguggcgagcaaggggcccggaucugacagcucccuguucgagaccuacaaugucgaacucgugcggaaagauggccagucucuggggauccgcauuguuggauaugugggcacaagccacaccggggaggccuccggcaucuacgucaagagcaucauucccggaucugcugccuaucauaacggccacauccaggugaaugacaaaauuguugcuguggauggggucaacauccaaggauuugccaaucaugacgugguggaaguucuuagaaacgccggccaggucgugcaccugacacucgugcggagaaagaccuccagcucuacguccccucuggagccgcccagcgaucgcgggacagucguggagccucugaaacccccugcucucuuccugaccggagcgguugaaaccgagacaaauguggacggcgaagacgaggaaauuaaggagcggaucgauacccuuaagaacgacaauauccaggcccuggagaaacucgaaaagguccccgauuccccggagaacgaacugaaaucuagaugggagaaucugcuugggccugacuacgaagugaugguugcuacacucgauacgcagauugccgacgaugccgagcugcaaaaguauagcaaacugcuccccauccacacccugcgccuuggcguggaggucgacuccuuugauggacaucacuacauuucuagcaucguguccggcgggccuguugacacacugggacuccugcagcccgaagaugagcugcuugaagugaacggcaugcagcucuacgggaagagccggagagaggcugucucuuuccugaaggaggugccucccccguucacccugguguguugccgccggcucuuugacgaugaagccuccgucgacgagccuagacgcacagaaaccagccugcccgagacggaaguugaccauaauauggaugugaacaccgaggaggacgaugacggagaacuugcgcuguggucucccgaggugaaaauugucgaacucgugaaggauuguaaaggccugggguucuccauccuggacuaucaagauccucuugacccgacacggagcguuauugugaucagaucucucgucgcugauggcguggccgagcgcagcggaggccugcugcccggggaccggcucguuuccgugaacgaauacugccuggauaauaccagccuugccgaggcugucgagauccugaaggccgugccucccggacucguucaccugggcauuuguaaaccucugguggaagacaacgaggaagagucuugcuauauccuucauuccagcuccaaugaagauaagacagaguuuucugggaccauucacgacaucaacagcucccucauucuggaggcucccaagggauucagagacgaaccuuacuuuaaagaggaacuggucgaugagcccuuccucgaccugggcaagucuuuucacagccagcagaaagagaucgaacaguccaaggaggccugggaaaugcaugaguuccuuacgccgcggcugcaagaaauggaugaggagcgcgaaauccucguggacgaggaauaugagcuguaccaggauccuucucccagcauggaacuguauccucuuucccacauucaggaggcgacacccgugccgagcgucaaugagcugcauuuugggacccaguggcuccacgacaacgaaccuucugagucccaagaagccagaacaggccggaccguuuacagccaggaggcucagcccuacggauauuguccugaaaaugugaugaaagagaacuucgugauggagucucugcccuccguccccagcaccgaaggcaauucucagcaagggagauuugaugaccucgagaaccugaauucccuugccaagacaagccuggaucucggaaugaucccuaacgacgugcagggcccgucccugcugauugaucuucccguuguggcucagcgccgggaacaagaggaccugccucucuaccagcaccaggccacgagagucaucagcaaggcgucugccuauaccgggaugcugagcucccgcuacgcuacagacaccugcgagcuccccgaaagagaggaaggagagggcgaagagacaccuaauuucucucauuggggccccccucggauuguggagaucuuucgcgaaccgaacguuagccuggggaucuccauugugggaggccagaccgucaucaaaagacuuaagaauggggaggaacugaaaggaauuuucaucaagcaagugcucgaggauucucccgccggcaaaacgaacgcucugaagacaggggacaaaauucuggaagucagcggaguggaucuucagaacgccucccacucugaggccguugaggcuaucaagaaugcgggcaacccuguggucuucaucgugcagagccuguccagcaccccccggguuauuccuaaugugcauaacaaggccaauaaaaucaccggcaaccagaaucaagacacacaggaaaagaaagagaagcgccaggggaccgcucccccgccuaugaaacucccccccccuuauaaggcccugacagaugacucugaugaaaacgaggaagaggacgccuuuacggaucagaagauuagacaacgguacgcugaccuccccggagagcugcacaucauugaacuugagaaagauaagaauggccuggggcugucccucgccggaaacaaagaccgcagcagaaugucuaucuucgucgugggcauuaauccugaagggccggcggcugccgauggacggaugcgcaucggcgacgagcugcuugagaucaacaaucagauucuguauggcagaucccaucagaacgccagcgcuaucauuaagaccgcccccuccaaagugaagcucguuuuuauccggaaugaagacgcggucaaccagauggcugugacaccuuuccccgugccuucuagcucccccagcucuauugaggaucaauccgggaccgaaccgaucagcucugaggaagacggaagcgucgaggugggcaucaagcagcugccugaguccgaaucuuuuaaacucgccguuagccagaugaagcaacagaaauaccccacaaagguguccuucucuagccaggagauuccucuggcccccgcuuccagcuaccacucuaccgaugccgacuuuacgggguauggaggcuuccaggcuccucuuuccgucgaucccgccaccuguccgaucgugccugggcaagaaaugauuaucgagauuagcaaaggaagauccggccugggccugucuaucguugggggaaaggacacaccccucuuuuggcgccugggcagcccccgggcguggucccagcaccuugugagagccuucaugcugcaucacccugucaccgaaguggaggggcagaacgcuaucguuauucaugagguguacgaagagggagccgcugcccgcgauggccggcucugggccggggaccagauccuggaagucaauggaguggaucucagaaacucuagccacgaggaagcuauuacagcgcugcgccaaaccccgcagaaggugcggcuugucguuuauagagacgaggcccauuaccgcgaugaggaaaaucuggagaucuuucccguggaccugcagaaaaaggcuggccggggccucgggcuguccauugugggaaaaagaaacggcagcggggucuucaucucugauauugugaagggaggcgccgccgaccuugacgggcggcugauccagggagaucaaauccucuccguuaauggcgaagacaugcgcaacgcuagccaggagacaguggccaccauucugaaaugcgcgcagggccucguccaacuggagaucgggagacuucgggcuggaucuuggacguccgcccgcacaaccagccagaauucucagggcagccagcaauccgcccacucuagcugccacccuuccuuugcucccgugauuaccgggcugcagaaccugguuggaacaaagagagugagcgauccuucccagaaaaauucuggcaccgacauggaaccccggacggucgagaucaacagagaacucagcgaugcccuggggauuuccaucgcgggaggccgcggcucuccucuuggggacaucccgguguucauugcuaugauccaggccagcggagucgccgcucggacacaaaagcugaaggugggcgauagaauuguuuccaucaaugggcagccccucgacggacugucucaugccgauguggugaaccugcucaaaaaugcuuauggccgcauuauccuucaggucguugccgacaccaacaucagcgcgauugccgcucagcuggagaauauguccacaggguaccaccugggcagcccuaccgccgaacaucaccccgaggauacagagaccccucccccgaagaucauuacgcucgaaaaaggaucugagggccugggguucuccaucgugggaggcuaugggagcccucacggagaccuucccauuuacgugaagaccgucuuugcuaaaggcgccgccgcugacgaugggcggcugaagagaggcgaccaaauccucgcggugaacggagaaacacuggagggcguuacccaugaacaggccguggcuauucugaagcaccagcgcgggacagucacccucacggugcuuucuuga

SEQ ID NO: 70780 - RNA, 1500 nt, Artificial Sequence
  derived and/or modified sequence opt5 from INA__Homo_sapiens__NP_116116
augagcuucggcuccgagcacuaccugugcucuagcuccucuuauagaaagguguuuggggacggaagccggcucuccgcccgccugucuggcgcugggggagccggcggguucagaagccagucccuuagccggucuaacgucgcguccagcgcugccuguucuuccgccagcucucugggacucggccuggcuuaccgcagacccccugccuccgauggccuugaccugagccaagcugccgcgcggaccaaugaauauaaaaucauucgcacaaacgagaaggaacagcuccaggggcugaaugauagauuugccguuuucaucgagaaagugcaucagcuggaaacgcaaaaccgggcucucgaggccgagcuggcugcccuucgccagagacacgcggaaccgucccgggugggagagcuguuucagcgcgaacucagagaccugcgggcccagcuugaggaggcuucuagcgcccgcucccaagcucugcucgaaagagauggccuggccgaggaaguccagcggcugagagcccgcugcgaggaagagagccgggggagagagggagcugaacgcgcgcucaaggcccagcagcgggacguggauggcgcuacccuggccagacuugaccuggagaaaaagguugaaucucuccuggaugagcuugccuucgugcgccaaguccaugacgaagagguggcugagcugcucgccacacugcaggcguccagccaggcugccgccgaaguugaugugaccgucgcuaagcccgaccugacaucugcccuccgggagauuagagcucaauacgaaagccuggccgcgaaaaaucuucaguccgccgaggaaugguauaagucuaaauuugcuaaccugaaugagcaggccgcucgcagcaccgaggccauccgggcguccagagaagagauucacgaauaccgccggcagcuccaagccagaacaaucgagaucgaggggcugcggggagcuaacgaaagccuugagcgccagauucuggaacucgaggaaagacauucugccgagguggcuggcuaucaggauuccaucggccagcuggagaaugaccugcggaacaccaagagcgaaauggccagacaccuccgcgaguaccaagaccugcuuaaugugaaaauggcccuggauauugaaaucgcugcguaccggaagcuccuggagggggaagagacgagauucucuaccuccggacugagcauuuccggccuuaacccucuccccaauccuucuuaucugcugcccccucgcauccucagcgccacaaccuccaaggucucuagcacagggcugucccuuaaaaaggaggaagaggaagaggaagcuagcaaaguugccucuaagaaaaccucccagauuggagagagcuuugaggaaauccuggaggaaacggugaucucuacaaagaaaaccgagaaguccaacauugaggaaacaaccaucagcucucagaagauuuga

SEQ ID NO: 70781 - RNA, 2757 nt, Artificial Sequence
  derived and/or modified sequence opt5 from INCENP__Homo_sapiens__NP_001035784
augggcaccacagcccccgggccuauccaucugcucgagcugugcgaccagaaacuuauggaguuccuguguaauauggauaauaaagaccucguguggcuggaggaaauucaagaggaagcugagagaauguuuacgcgggaguucagcaaggaaccggagcuuaugcccaaaaccccuucccagaagaaccgccggaaaaagagacgcaucucuuacguccaggaugaaaauagagaccccauucggcgcagacugagccggcgcaaguccagaucuagccagcucuccucucggcgccugagaagcaaagauuccguugagaagcuggccacaguggugggagagaacggcagcguccuccggcgcgugaccagagcggcugccgccgcugccgcugccacaauggcgcuggccgcuccuucuucccccaccccugaaagcccgacaaugcuuaccaaaaagcccgaggacaaucacacgcaaugccagcugguuccuguggucgaaaucgggauuucugagcggcagaacgccgaacagcacgugacccaacucauguccacagagccccugccuagaacccuuagccccacaccggcuucugccaccgcgccuacgucccagggaauccccacaagcgaugaggaauccaccccuaaaaagucuaaggcccgcauccuggagagcauuacaguuuccagccucauggcuacaccccaggaccccaaaggccagggggugggaaccggccggucugccuccaagcugagaaucgcucaagucagcccuggcccgcgcgauucucccgccuuuccugacagccccuggcgggaaagagugcuggccccuauucuccccgauaauuucuccaccccgacggggucucgcaccgacagccaguccgugcggcauagcccuaucgcucccucuuccccuagcccccagguccuggcgcaaaaauauucucuuguugccaagcaggaguccguggugagacgcgcuagccggagacuggccaaaaagacagccgaagaaccugcugccuccggacgcauuaucugucacucuuaccucgagcggcugcuuaacgucgaagugccccagaaaguuggcagcgagcagaaggaaccgccugaggaagcggagcccguggcugccgccgagcccgaagucccugagaauaacgggaauaacuccuggccgcauaaugauaccgaaauugcuaacucuacacccaauccuaagcccgccgcuagcuccccugagacccccagcgccggacaacaggaggcgaaaacggaccaggccgacggcccuagagaacccccgcagucugcucggcgcaagagauccuauaaacaagccgugagcgagcuggaugaagaacagcaccucgaagacgaggagcugcagccuccccggucuaagacaccuuccagccccugcccggcuucuaaaguugugagaccucugcgcaccuuucuccacaccguccagcggaaccaaaugcugaugacacccaccagcgccccuagauccgugaugaagucuuucaucaagcgcaacacaccccuuagaauggaucccaaauguucuuuugucgaaaaggagcggcagcgccuggaaaaucucagacggaaagaggaagcggagcagcugcgcagacagaagguggaggaagacaaacggcgcagacuugaggaaguuaagcugaagcgggaggaacgccucagaaaagugcugcaagcccgggagagagucgagcagaugaaggaagagaaaaagaaacagaucgaacaaaaguucgcucagauugaugagaagacggagaaagccaaggaggagcgccuggcugaagagaaagccaagaaaaaggccgcugcgaaaaagauggaagagguggaggcccggagaaagcaggaagaggaagcucgccggcucagauggcugcagcaagaggaagaggagcgccggcaucaggaacuucugcagaaaaagaaagaggaggaacaggaaagacuccgcaaggccgccgaggcuaaacggcuggccgagcaaagagaacaggagcggcgcgaacaggagagacgggagcaggaacgcagagagcaagaacggagagagcaggaacgccgggagcaggagagacaacuggcggaacaggagcgccggagagaacaggagcgccuucaggcugaacgggagcuccaagagagagaaaaggcccugcgccugcagaaggagcagcuccagagagaacuggaggaaaagaagaaaaaggaggagcaacagcggcuugccgaacgccagcugcaggaggaacaagagaaaaaggcuaaggaggccgcgggggcuuccaaagcccucaacguuaccguggacguccagagcccugccugcacauccuaccagaugaccccgcagggacacagagcucccccuaagaucaaucccgauaacuauggcauggaccugaauagcgaugacagcacagaugacgaagcccauccucggaaacccauuccuaccugggcucgcggcacgccgcugucccaagccaucauucaccaguacuaucaucccccuaaccuucucgagcuguuugggaccauccugccccucgaccuggaagauaucuucaagaaaucuaagccuagauaccacaagcggacaagcuccgcgguguggaacucucccccgcuucagggagccagagugccuagcucccuggcuuacagccucaaaaagcacuga

SEQ ID NO: 70782 - RNA, 3723 nt, Artificial Sequence
  derived and/or modified sequence opt5 from INF2__Homo_sapiens__NP_001026884
augagcgugaaggagggcgcccagagaaaaugggcugcccugaaggaaaaacucgggccccaagacuccgauccuaccgaggcgaaccuggaaucugcugacccggagcuuugcauccggcugcuccagaugcccagcgucguuaauuacuccggacugcgcaagagacuugaaggcucugaugggggauggauggugcaguuccuggagcagagcggccucgaccugcugcucgaggcccuggcccggcuuuccgggcgcggaguggcuagaauuucugaugcccugcuccaacugacaugugucagcugcgugcgggcuguuaugaacucccgccagggcaucgaauauauucuuagcaaucagggcuacgugagacagcugucucaagcccucgacacguccaacgucauggugaaaaagcagguuuuugagcugcuggcggcccucuguaucuauagcccugaagggcacgugcugacccuugaugcucuggaccauuacaagacagucugcucucagcaguaucgguucuccauugugaugaaugagcucagcggaucugauaacgugcccuacgucguuacccugcuuuccgugaucaaugccgugauccugggcccugaggaccuccgcgcuagaacacaacugcggaacgaauuuauugggcugcagcuccuggauguccuugcccgccugagagaccucgaggaugcggaccugcuuauccagcuggaagccuucgaggaagcuaaagccgaggacgaggaggaacuccugcgggugagcggaggcguugauauguccucucaccaagaaguguuugcuagccuguuccauaaggucuccuguagccccgugucugcccagcuccuguccguucuucaggggcugcuccaccuggagccuacccugcgcagcucucagcuucucugggaagcccuggagagccuggugaauagagcuguccuccuggcguccgacgcccaagagugcacacuugaagagguggucgaacggcugcucucugugaaaggaagaccgcgccccagcccucugguuaaggcucauaaauccgugcaggccaaccuggaucagagccagcggggcucuagcccccaaaauaccacgaccccuaagcccagcgucgagggccagcagccggccgcugccgcggcuugugaaccuguggaccacgcccagucugaguccauucuuaagguuagccaacccagagcccucgagcagcaggcuuccacaccucccccucccccgcccccuccccugcugccugggucuagcgccgaacccccgccucccccucccccucccccgcucccuuccgugggagcuaaagcccugcccaccgcgcccccuccgcccccucuucccggccugggggccauggcuccucccgccccuccccucccgccuccccugccuggaucuugcgaguuucugcccccgccucccccuccccuucccggccucggguguccuccgcccccucccccucugcugcccggaaugggcuggggcccuccgcccccucccccuccccuccugccgugcacauguagcccucccgucgcugggggaauggaagaggugaucguggcccagguugaucacggccuuggguccgcguggguccccagccaucgccgggugaacccucccacccugagaaugaagaaacucaauuggcaaaagcugccuucuaacguggcccgcgagcacaauuccaugugggcuagccugucuuccccggacgccgaagcugucgagcccgauuucagcucuauugaacggcuuuuuagcuucccugccgccaaacccaaggagccuacgaugguggcucccagagcgcgcaaagaaccgaaggagaucacauuucucgacgccaagaaaucccugaaccugaacauuuuccucaagcaguuuaaaugcagcaaugaggaaguugcugccaugauccgggccggagauaccacaaaguucgacguggagguccugaaacagcuucugaagcuccugccugaaaagcaugagaucgaaaaccugagagcuuucaccgaggagcgcgccaaacuugcgucugcugaucacuuuuaucugcuccugcucgccauucccugcuaccaacugcggaucgaauguaugcuucugugcgagggcgccgcugccgugcucgacaugguuagaccuaaggcgcagcuggugcuggcugccugugaaucccuucugaccagccggcagcuccccauuuucugccagcugauccuccgcauugggaauuuucugaacuacggcucccacacaggagacgccgauggcuucaaaaucucuacgcuucugaagcucaccgagacaaaaagccaacagaauagagucacccugcugcaucacgugcuugaagaggcugagaagucccauccugaccugcuccagcugccccgggaucucgaacagccgucucaagccgcugggaucaaccuggagauuaucagaagcgaagccuccucuaaucuuaagaaacugcuggagacagagcgcaagguuagcgcguccguggccgaaguccaggagcaguauaccgaacggcuccaggcuagcauuucugccuuuagagcucuggacgagcuuuucgaagccaucgagcaaaaacagcgcgagcuggccgauuaccucugugaagacgcucagcaacugucccucgaggauacguuuagcacaaugaaggcguucagagaccuguuucuucgggcccugaaagaaaacaaggaucgcaaggagcaggcugccaaagccgaaagacggaagcagcagcuggcugaggaggaagcccgcagaccucggggagaggacggcaaacccgugcgcaaggggcccggaaaacaagaagaggugugcgucauugaugcgcuccuggcugacaucagaaagggcuuccagcuucggaaaaccgcccgcgggagaggcgauaccgacggaggcucuaaggccgcuuccauggacccuccgcgggccacagaacccguugcgaccagcaauccugcuggggaucccgugggaucuacaagauguccugccuccgagcccggccuggacgccacgaccgcuagcgagucccgcgggugggaucucguggacgccgucacaccuggaccgcagcccacccuggaacagcucgaggaaggcgggccucggccccuggagagacgcagcucuugguauguggaugcuagcgacguucuuacaaccgaggauccucaaugcccccagccgcuggaaggcgccuggccugugacgcugggagacgcgcaggcccucaagccccugaaauuuuccucuaaccagcccccugcugccggcagcucccggcaagaugcuaaggaccccaccucucuucuggggguccuccaggccgaggccgauagcacauccgaaggacuggaggacgcugugcacucuagaggcgcgcgcccuccggccgcugggcccggaggcgaugaagacgaggacgaggaagauaccgccccugagagcgcccucgacacaucccuggauaaauccuucucugaagacgcuguuaccgauuccagcgggucuggcacgcuuccccgggccagaggacgcgcguccaagggcacagggaaacggagaaagaagcggccuagccgcucccaggagggacugagaccccggccgaaagcuaaguga

SEQ ID NO: 70783 - RNA, 789 nt, Artificial Sequence
  derived and/or modified sequence opt5 from ING1__Homo_sapiens__NP_001254657
augagcuucguggagugccccuaccacuccccugccgaaagacuggucgcugaggccgacgaaggcgggccgucugcgaucaccgagauucucaaggaacuggaugaguguuaugagcgguuuagccgcgaaacagacggagcucagaaaagacggaugcuucauugcguucaacgcgcccugaucagaucccaggagcucggcgaugaaaagauucagaucgugucucagaugguggagcuggucgagaaccggacgcgccaaguggacagccacguugaacuuuucgaggcccagcaggaacugggggauaccgcuggaaauuccggcaaagccggggcugacagacccaagggagaggccgcggcccaggcugauaaaccuaacucuaagcggagccgcagacaacggaauaacgaaaaucgcgagaacgccuccagcaaucaugaccacgaugacggcgcuucuggcacacccaaggagaaaaaggccaaaaccuccaagaaaaagaagagaagcaaagcgaaggccgaacgggaggcuucuccugccgaucuccccauugacccuaacgaaccgacauacugucugugcaaucagguguccuauggggagaugaucggaugugauaacgacgaaugccccaucgagugguuucauuucagcugugucggccugaaucacaaaccuaaggggaaaugguacugccccaagugucgcggagagaacgagaaaaccauggacaaggcucucgaaaagucuaaaaaggaaagagccuauaaucgguga

SEQ ID NO: 70784 - RNA, 723 nt, Artificial Sequence
  derived and/or modified sequence opt5 from ING2__Homo_sapiens__NP_001278888
auggaccaggauggcgaccaacagcuggggcccagcagaauccucgccccucagacccugaaggagauugaugacguguacgaaaaauauaagaaagaggaugaccuuaaccagaagaaacggcugcaacagcuccugcagcgcgcucuuaucaauucccaggaacugggagaugagaagauucaaaucgucacacagaugcucgaacugguugagaacagagcccggcagauggagcugcacucucagugcuuccaagacccggcggaaagcgagcgcgcuuccgauaaggccaaaauggacucuagccagcccgaaagauccucucggcgcccuagacggcagcgcacgagcgaguccagagaucucugucauauggccaauggcauugaggacugcgaugaccaacccccuaaggagaaaaagagcaaaucugcuaagaagaaaaagcgguccaaagccaagcaggaacgcgaagcuagccccguggaguuugccaucgacccuaacgaaccgaccuacugucugugcaaucaggugucuuauggggagaugaucggaugugauaacgagcagugccccauugaaugguuccacuuuuccugugucagccuuacauacaaaccuaagggcaaaugguauugccccaaguguagaggggacaaugagaagaccauggauaaaucuacagaaaagaccaaaaaggaccggcgcuccagauga

SEQ ID NO: 70785 - RNA, 1257 nt, Artificial Sequence
  derived and/or modified sequence opt5 from ING3__Homo_sapiens__NP_061944
augcuguaccucgaggacuaucuggaaaugaucgagcagcuucccauggaucugagagaccgguucaccgaaaugcgcgagauggaucuccaagugcagaacgccauggaccagcuggaacagagagucagcgaguuuuucaugaaugcuaagaaaaacaagccugaguggcgggaggaacaaauggccuccauuaaaaaggauuacuauaaagcgcuugaagacgcugaugagaagguucagcuggccaaucagaucuacgaccucguggaucgccaccugagaaagcuggaccaggagcucgccaaauuuaagauggaacuggaggcugauaacgccggcauuacagaaauccuugagcggcgcucucuggaacucgacacgccgagccaacccgugaauaaccaucacgcucauucccacaccccugucgagaaaagaaaguauaaucccacaucucaucacaccacaaccgaucacauuccugagaaaaaguucaagagcgaagcccugcuuuccacacugaccucugacgcgagcaaagagaacacgcucgggugccggaauaacaauuccaccgccagcucuaacaaugcuuacaacgugaauagcagccagccccugggaucuuauaacaucggcucccugagcucugggacaggagccggcgcuaucaccauggccgcggcccaggcuguucaggccacagcucaaaugaaggaagggcgcagaaccuccagccucaaagccuccuacgaggccuuuaagaacaaugacuuccagcugggaaaagaauuuucuauggcucgggagacggugggcuacagcuccagcucugcgcuuaugacaacccugacacagaacgccuccagcucugcugccgauagccgcuccggcagaaagucuaaaaauaacaauaagagcuccagccaacagucuuccuccucuuccagcuccucuagccucuccucuuguagcuccagcucuaccgucgugcaggagauuucccagcaaaccacaguugugccugaaagcgacucuaacucccaggucgauuggacguaugacccgaaugagccccgguacugcaucuguaaccaggugagcuauggggaaauggugggaugcgauaaucaggacuguccuauugagugguuccauuacggcugcgucgggcugaccgaagcccccaagggaaaaugguauuguccucaaugcacagcugccaugaagcgcagaggcucucggcacaaauga

SEQ ID NO: 70786 - RNA, 750 nt, Artificial Sequence
  derived and/or modified sequence opt5 from ING4__Homo_sapiens__NP_001121054
auggccgcuggcauguaccuggagcacuaucucgacagcaucgaaaaccugcccuucgagcuucagagaaauuuucaacugaugcgggaucucgaccagcgcaccgaagaucugaaggccgagauugacaaacuugcgacagaauacauguccucugcuagaagccuguccucugaggagaagcucgcccugcugaaacagauccaggaagccuaugggaagugcaaagaguucggagaugacaaggugcaacucgcuaugcagacguacgaaauggucgauaagcauauucggcgccuggacaccgaucuugccagauuugaggcugaccugaaagagaagcagaucgaaagcuccgauuaugacucuagcuccagcaaaggcaagaaaaaggggcggacacagaaggagaaaaaggccgcgcgcgccagaucuaaaggaaagaacuccgaugaagaggcuccuaaaaccgcccaaaagaaacucaagcugguucggacaagcccggaauacggcaugcccucugugaccuucggguccgugcacccuagcgacguccuugacaugcccguggauccuaaugagcccacauauugucugugccaucagguuucuuacggagagaugauuggcugugacaacccugauugcuccaucgaaugguuucacuucgcuugugugggccucaccacgaagccgcgcgggaaaugguuuugccccagauguagccaggagcggaagaaaaaguga

SEQ ID NO: 70787 - RNA, 723 nt, Artificial Sequence
  derived and/or modified sequence opt5 from ING5__Homo_sapiens__NP_115705
auggccaccgcuauguaccuggagcacuaucucgacagcaucgaaaaccugcccugcgagcuucagagaaauuuccaacugaugcgggaacucgaucagcgcacagaggacaagaaagccgaaauugauauccuggcggcugaguacauuuccacggugaagacccuuucuccugaccagagagucgagcggcugcagaaaauccaaaacgccuauagcaaguguaaagaauacuccgaugacaagguucagcucgccaugcagacauaugagaugguggauaagcauauucgcagacuggacgcugaucuggcccgguuugaagcugaccucaaagauaagauggagggcucugacuucgagagcuccgggggacgcggccugaaaaaggggagaggacagaaagaaaagcggggcucucgcgggagaggacggcgcaccagcgaggaagauacaccgaagaaaaagaaacacaagggcggcuccgaguuuaccgacacaauccuuagcgugcaucccucugacguccuggauaugccuguggaccccaaugaaccuaccuacugccucugucaccaaguuuccuauggggagaugaucggaugcgauaaccccgacuguccuauugagugguuccauuuugccugcguggaucugacgaccaaaccgaagggcaaaugguucugucccagaugcguccaggaaaagcggaagaaaaaguga

SEQ ID NO: 70788 - RNA, 1101 nt, Artificial Sequence
  derived and/or modified sequence opt5 from INHA__Homo_sapiens__NP_002182
auggugcugcaccuccugcuuuuccugcuccugacaccccagggcgggcauagcugccaaggacuugagcuggccagagaacucguccuggcuaagguucgggcccuguuucucgacgcgcugggcccuccggcugugacccgcgaagggggagaucccggcgugagacggcuuccucgcagacacgcccucgggggauucacgcaucggggcuccgaacccgaggaagaggaggacgucucucaggccauccuguuuccugcuaccgaugccagcugugaagacaaauccgcugcccgcggccuggcgcaggaggccgaagaggggcuuuucagauacauguuucggcccucucagcacacacgcagcagacaagugaccuccgcucagcugugguuccauacaggacucgaucggcagggcaccgccgcuucuaacagcuccgagccucugcuggggcuccuggcccuuagcccgggaggccccguugcggugccuaugucucuggggcacgcucccccucacugggccguccuccaucuggccacauccgcucuuagccugcucacccaccccgugcugguucugcuccugcgcugcccgcuuuguacgugcucugccagaccugaagccacccccuuucugguggcucauacacggacccgcccucccuccggaggcgagagagcgcggagaagcacaccccucaugucuuggccuugguccccgagcgcccugcgccuucugcagcggcccccugaggagcccgcugcccacgccaauugucacagagucgcucucaacauuuccuuccaagaacugggcugggagcgcuggaucguguauccucccucuuuuauuuuccauuacugccacgggggauguggccugcauaucccgccuaaucucagccugcccgugccuggggcgcccccuacccccgcccagccguauucccuucugccuggagcucagcccugcugugccgcccuccccggcacgaugcggccucugcacgucagaacaaccagcgacgggggauacucuuuuaaguaugagacaguuccgaaccugcuuacccagcauugcgcuuguauuuga

SEQ ID NO: 70789 - RNA, 1281 nt, Artificial Sequence
  derived and/or modified sequence opt5 from INHBA__Homo_sapiens__NP_002183
augccccugcucuggcugagaggcuuccuucuggccagcugcuggaucauugugcgguccucuccuaccccggggagcgagggacacuccgcugcccccgacuguccuucuugcgcgcucgcugcccugcccaaggaugucccuaacagccagcccgaaaugguugaggccgugaaaaagcauauccuuaauaugcugcaccucaaaaagcgcccugacgugacacaaccgguccccaaagcugcccugcugaacgcuauuagaaagcuccaugugggcaagguuggggaaaauggauacguggagaucgaagaugacauuggccggcgcgccgagaugaacgagcugauggaacagacguccgagaucaucaccuuugcggaaucugggacagccagaaaaacccuucacuucgagauuagcaaggagggauccgaucugagcgucguggaacgggcugagguuuggcucuuucugaaagugccuaaggccaaucgcacaagaaccaaagucacaauccggcuuuuccagcagcaaaagcauccccagggcucucuggacaccggcgaagaggcugaagagguggggcucaagggagagcgcuccgaacugcugcucagcgagaaaguggucgaugccagaaagucuacguggcacguuuuuccuguguccagcucuauucagcggcugcuugaccagggcaaauccagccuggaugugcgcaucgcgugugaacaaugccaggaguccggggccucucucguccugcuuggaaagaaaaagaaaaaggaagaggagggcgaagggaagaaaaagggaggcggcgaagggggagcuggcgccgacgaggagaaagaacagagccacagacccuuccugaugcuccaggcucggcaauccgaggaucauccgcaccgcagacggagacgcgggcuggagugugacggaaaggugaacauuugcuguaaaaagcaguuuuucguuagcuuuaaggauaucggcuggaaugacuggauuaucgccccuucuggguaucaugccaacuacugcgaaggagagugucccucccacaucgcuggcaccagcggcucuagccuguccuuccacucuacagugauuaaucauuaucggaugagagggcacagcccuuuugcgaaccucaaauccugcuguguccccaccaagcugcgccccaugagcaugcuuuacuaugacgauggacagaauaucauuaaaaaggacauccaaaacaugauuguggaagagugcggcugcucuuga

SEQ ID NO: 70790 - RNA, 1224 nt, Artificial Sequence
  derived and/or modified sequence opt5 from INHBB__Homo_sapiens__NP_002184
auggacggccugcccgggagagcccucggagcugccugccugcuucugcucgcggcuggcuggcuggggccugaggccuggggaagcccgacacccccucccaccccugccgcucccccuccgcccccucccccuggcucccccgggggaucucaggauacguguaccagcugcggcggcuuccggcgcccggaggaacuugggagaguggacggagauuuucuggaagccgucaagcggcacauccucucccgccugcaaaugagaggccggccuaacauuacacaugcuguucccaaagccgcgauggugaccgcccugcgcaagcuccacgcugggaaagugagagaggacggacgggucgaaaucccucaucuggauggccacgccucucccggggcugacggacaggagcgcgugagcgagauuaucuccuucgccgaaacagauggccuugcgucuagcagaguucggcuguacuuuuucauuuccaaugagggcaaccagaaucucuuugugguccaggccagccuguggcuuuaucugaagcuccugcccuacgugcuggaaaaagggucucgcagaaagguucgggugaaggucuauuuccaagagcagggacauggcgaccgcuggaacaugguggagaaaagaguggaucucaagcgguccggguggcacaccuuuccucugacagaagcuauccaggcccuuuucgagagaggagaacgccggcugaaucucgacguccagugugauagcugccaagagcuggcuguugugccgguguuugucgaccccggcgaagagucucacagaccuuucgugguugugcaggcccgccuuggggauucccggcauagaauccgcaaacggggacuggagugugacggcagaaccaaccucugcugucgccagcaguuuuucauugacuuucggcugaucggcuggaaugauuggauuaucgcccccacgggguacuauggaaacuacugcgaaggcagcuguccugcuuaucuggcggggguccccggaucugccuccagcuuccacaccgcugugguuaaucaauacagaaugcgcggccucaacccggggacagucaauuccugcuguauuccuaccaagcugucuacaaugagcaugcuuuacuucgacgaugaguauaacaucgugaaacgggacgugcccaauaugauugucgaagagugcggcugcgccuga

SEQ ID NO: 70791 - RNA, 1059 nt, Artificial Sequence
  derived and/or modified sequence opt5 from INHBC__Homo_sapiens__NP_005529
augaccagcucccugcuccuggccuuccuucugcucgcucccacaacgguggccaccccuagagcgggcgggcagugcccggcuuguggaggccccacacuggagcuugaaucucaacgggagcugcuccuggaccuggccaagcgcagcauccucgauaaacugcaccuuacccagagaccuacacugaaccggcccgucucccgcgccgcucucagaaccgcccugcagcaucuucacgggguuccucagggagcucugcucgaagacaaucgggagcaagaaugcgagauuaucucuuuugccgagacaggccugagcaccauuaaccagacgcgccuggauuuccauuuuuccucugacagaaccgcgggggaucgggaagugcagcaggccagccucauguucuuugugcaacugcccuccaauacaaccuggacacuuaagguccgcgugcugguucucggaccucacaacaccaaucugacgcuugcuacacaguaccugcucgagguggacgccagcggcuggcaucagcugccgcugggccccgaagcucaggccgcguguucucaagggcaccucacccuggagcuuguccuggagggacagguggcccaguccagcguuauccucggcggggcugcccacagaccuuucguggcugcccggguccgcgugggaggcaaacaucaaauucacagacgggggaucgauugccagggaggcucucgcauguguugcagacaggaauuuuucguggacuuucgggagaucggcuggcaugauuggauuauccagcccgaaggguaugccaugaacuucuguauuggacaaugcccucugcacaucgcuggcaugcccgggauugcggccuccuuucacacagcuguccuuaaucugcucaaggccaacaccgccgcuggaaccacaggcgggggaagcuguugcguuccgacggccagacgcccucugucucugcucuacuaugaccgggauuccaauaucgugaaaaccgacauucccgauaugguggucgaggcguguggcugcagcuga

SEQ ID NO: 70792 - RNA, 1053 nt, Artificial Sequence
  derived and/or modified sequence opt5 from INHBE__Homo_sapiens__NP_113667
augagacugcccgacgugcagcucuggcugguccuucugugggcccucguucgggcucaaggcaccgggagcgugugcccuuccuguggaggcucuaagcuggccccgcaggcggagcgcgcucuugugcuggaacucgccaaacagcagauccuggaugggcugcaccucacaagcagaccccggauuacgcauccucccccucaagccgcucugacccgcgcccuuagacggcugcagcccggauccgucgcuccuggcaacggggaggaagugaucucuuucgccacaguuaccgacagcacauccgcguacucuagccuccugaccuuucaccuuuccacaccgcgcagccaucaccuguaucaugccagacucuggcugcacgugcugcccacccucccuggaacgcugugccuucggauuuuccgcuggggccccagacggcgcagacagggcucucggacccugcucgcugagcaccauaucacaaaucugggguggcacacccuuacacugccuuccagcggacuccgcggcgaaaagucugggguccugaaacugcagcucgauuguagaccccuggagggaaacuccaccgugacgggccaaccgcggagacuucuggacacagccgggcaucagcagccuuuucucgagcugaagauucgcgcuaaugaacccggagccggccgggcgagacgccggaccccuacaugcgagcccgccacaccccuuuguugcagacgcgaucacuacguugacuuccaggaacugggcuggcgggauuggauccuccaaccugagggguaucagcugaacuacuguagcggacagugcccgccccaccuggcuggcucuccugggaucgccgcuuccuuucauagcgccguguucucccuccugaaagccaauaaccccuggccugcuucuaccagcuguugcguccccaccgcgagacgcccgcuuucccugcucuaucuggaccacaauggaaacguggugaagacggaugucccugacaugguuguggaggccuguggcugcagcuga

SEQ ID NO: 70793 - RNA, 1071 nt, Artificial Sequence
  derived and/or modified sequence opt5 from INO80B__Homo_sapiens__NP_112578
auguccaagcuguggagacggggcuccaccucuggggccauggaggcucccgaaccuggagaggcccucgaacugagccuugcgggcgcucacgggcauggagugcacaaaaagaaacauaagaaacacaagaagaaacauaagaaaaagcaccaccaggaggaagacgccggcccgacacaacccuccccugccaaaccccagcugaagcucaagaucaaacugggcggacagguccuuggcacgaagucuguuccuaccuucacagugauucccgagggcccucgcagcccgucuccccugaugguggucgauaacgaggaagaaccuauggaaggggugccccucgagcaguacagagcuuggcuggacgaggauuccaaucugagcccuagcccccuccgggaccuguccggaggccuugggggacaagaagaggaagaggaacagcgcuggcuggaugcccucgagaaaggcgagcuggacgauaacggggaccuuaagaaagaaaucaaugagagacugcucaccgcucggcagcgcgcccugcugcagaaggcgagaucucaaccguccccuaugcucccccugccuguugccgaaggaugcccuccgcccgcucuuacagaggaaaugcugcucaaacgggaggagcgcgccagaaagcggcgccugcaggcugccagacgggcggaggagcauaagaaccagaccauugaacgccuuacaaaaaccgccgcuacgagcggcagaggcgggcggggaggcgccagaggggagcgccggggaggcagagcugccgcccccgcucccauggugcgcuauuguucuggggcgcagggauccacccugagcuuuccucccggcgucccugcccccacagcugugucucaacggccguccccuagcgggcccccucccagaugcuccguuccuggguguccccacccgcgccgguacgccugcucuagaaccggacaggcccucuguagccugcagugcuaucgcaucaaucugcaaaugcggcucggcgggccugaaggacccggcagcccccugcuugcuacauga

SEQ ID NO: 70794 - RNA, 3084 nt, Artificial Sequence
  derived and/or modified sequence opt5 from INO80D__Homo_sapiens__NP_060229
auguacgagggcaagcacauccauuucagcgaaguggacaacaaaccccugugcuccuauucuccuaagcucuguaaacagagacggcugaauggguacgccuuuugcauucgccacguccuugaggauaagaccgcuccguucaaacaaugugaauauguugccaaguacaacagccagagaugcacaaaucccaucccuaaguccgaggaccggcgcuauuguaacucucaucuccaggugcugggauuuauucccaaaaaggaaagaaagaagaaaaaugauccuaucgacgaggugaagguccggcaccagauggauacgauggcguucagccugaccgugcccacacuugcucugaagaugccuaacggccucgacgggaugucccugucuccgcccggagcccgcguuccucugcauuaccucgagaccgaacuggaggaucccuuugccuucaaugaagaggacgaugaccuuaaaaagggcgcuacagugcggaaaaagcugcaaagcaaacucgcccagaacagacagcgccagagagagaccgaaauucugaagguccggcaagagcacuuuuccccucccccggcuccuagccagcagcagcccccucaacagcacucucaucuuagcccccuguccacaucucucaaacccccugccccgccccagggguccgugugcaagagcccucaaccccagaauaccucucugccuaugcagggaguugcgcccacgacccacacaaucgcccaggcucgccaacugucccauaagagaccgcucccucugcuucccagcucccgggccccuaccguggaucccccucgcacagacagaauccugaugaaagcuaccgccuucucuccccacuuuagcuguauuucccggcuccagagacuggucaaacuuugcacgcagaaacaccagcuggauacagaccucuucccgcaucugggccuggacuggagcgaagagucuggcgaagaaccugaggauuccgaacaagcgagccccuaucagguggccuggucuauccgcgagacccuccgguaccagagacacgcuagcgacgaugacgaugccgaaucccgcucuagccgggugacacagcuguguaccuacuuucaacagaaguauaaacaucuuugcagacuggagcgcgcugaaucccggcagaagaaguguagacacaccuuccgcaaagcccuccugcaggccgcuagcaaggagcccgagugcacagggcaacuuauucaggaacugcggagagcggccugcucucgcacguccaucagccggaccaaacucagagaggucgaaccugcugccuguucuggaacaguuaagggcgagcagugcgccaacaaagcucugccguuuacccggcauuguuuccaacacauucugcucaaucacucccagcagcuguucagcuccugcacagccaaguuugcggacgggcagcaauguucugugcccguguucgauaucacccaucagacgccucuuugcgaggagcacgcuaagaaaauggacaacuuucugcgcggagauaauagcagaaagguccagcaucagcaacagcggaaacccagaaagaaaacaaagccucccgcccucaccaagaaacacaagaaaaagcgccggagaggcccucgcagaccccagaaaccgauuccucccgccgugccucaggggaaccuguccaugcccgcuucuguuagccugccgguggaggccucccacauccggagcccuucuacccccgaacuuuccgcugacgagcucccugaugacaucgccaaugaaauuacagacaucccccaugaucuggagcugaaccaagaggacuucagcgauguccucccccgccugccugacgaucuucaggacuuugauuucuuugaaggaaagaacggcgaccugcucccgaccacagaggaagcggaggaacuggagagagcccugcaggcugugacgucucuugagugucucuccaccauuggcguucuggcccaaagcgauggggugcccguccaggaacugucugaccggggaaucggcguguucagcacagggaccggagcuuccggcauucagagccucucucgcgaggucaauacagaucugggggaacuucugaacggaagaaucgugcacgacaauuuuuccagccucgagcuggaugaaaaccugcuucgguccgccacccucucuaauccucccacgccucuggcgggccagauccaaggccaguucagcgcccccgcuaacguugggcugaccuccgccacacucauuucucagagcgcucugggagagcgcgccuuuccuggccaguuccaugggcuucacgacggaucccaugccucucaaagaccgcaccccgcucagcugcucagcaaagcggacgaucugaucaccucccggcagcaguacagcucugaccacucccauagcucuccucacggcucccauuaugauagcgagcacgugcccucuccuuacuccgaccauauuacaagcccccacaccacguccuauagcggggauaauauggccgcuacauuuucugccgaaaugccgaucauggcccaacaucugcuuccuacccagcucgaggucccccugggcggagugguuaacccccgcacacacuggggcaaucugccugugaaccucggggaccccagcccuuucuccaaucugcuuggagcugauggccaucugcucucuaccagccuguccaccccgcccacaacgucuaacagcgaaaccacacagccugccuucgcgaccgucacacccuccucuagcuccgugcugccugggcuuccccagaccagcuuuucuggaaugggcccguccgcugagcugauggccagcacgucuccuaagcaacagcucccccaguucuccgccgcuuuugggcaccaacugagcucccacucuggcauuccuaaggaccuccagcccagccacuccagcaucgccccucccacaggauucaccgugaccggcgcgacagcuaccucuacaaauaacgccuccagcccguuuccuucucccaauuga

SEQ ID NO: 70795 - RNA, 4671 nt, Artificial Sequence
  derived and/or modified sequence opt5 from INO80__Homo_sapiens__NP_060023
auggccagcgagcugggcgcuagagacgaugggggaugcaccgaacucgccaagccccuguaccuucaguaucuggagcgggcgcuccgccuggaccacuuccuuagacaaacauccgcuaucuuuaaccggaauauuucuagcgaugacuccgaagauggccuggacgauucuaacccucuccugccgcagagcggggacccccugauccaggugaaagaggaaccucccaauucccuccugggagagacgucuggcgccgggagcuccggaaugcuuaacaccuacagccugaauggcguccuccagucugaguccaagugugauaaaggcaaccuguauaauuucagcaaacuuaaaaagucucgcaaguggcugaaauccauucuccugagcgacgaaucuuccgaggccgauagccaauccgaagacgaugacgaggaggaacugaaccucucuagagaggaacugcauaauaugcuucggcugcacaaguacaaaaagcuccaucagaacaaauauagcaaggacaaggagcugcagcaguaccaauauuacuccgcugggcuucugagcacauacgauccuuuuuaugaacagcagcgccaccuccugggacccaaaaagaaaaaguucaaagaggagaagaaacugaaggccaagcucaaaaagguuaaaaagaaaagacggcgcgacgaggagcugucuuccgaagagagcccuagacggcaucaccaccagaccaagguguuugcuaaguucucucaugaugccccgcccccuggcacaaagaagaaacaccuuagcaucgaacaacugaaugcgcgcagacggaagguguggcucuccauugucaaaaaggagcugcccaaggccaacaaacagaaggcuucugcccgcaaucuuuuucugaccaacagcagaaaacucgcucaucagugcaugaaggaggugcggagagccgcgcugcaagcccagaaaaauuguaaggaaacacugccucgcgcucggagacucaccaaggagaugcugcuuuacuggaaaaaguaugaaaaaguugagaaggaacaccgcaaacgggccgagaaggaggcucuggaacagagaaaacucgacgaggaaaugcgcgaggccaagcggcagcaaagaaagcugaacuuccugaucacgcagaccgagcuuuacgcccacuuuaugucccgcaaacgggauauggggcaugacggaauccaggaagagauucucagaaagcuggaagauagcucuacacagcgccaaaucgacauuggcgggggaguggucgugaacaucacccaggaggauuaugacuccaaucacuucaaagcucaggcgcugaagaacgccgaaaaugcuuaccauauucaccaggcccggacacggagcuuugaugaggacgccaaagagucuagagcugccgcgcuccgcgcugccaacaaguccggcaccggcuucggggaaagcuauucccuggccaaucccucuaucagagcuggagaggacauuccgcaaccuacgaucuuuaacggcaaacuuaagggguaccagcugaagggaaugaauuggcucgccaaccuguacgaacagggcaucaaugggauucuggcugaugagaugggacuuggcaaaacaguucagagcaucgcccuccuggcgcaucuggccgaacgggagaacauuuggggccccuuccucaucauuuccccugcuucuacccugaauaacuggcaccaagaguucacaagauuugugcccaaguucaaaguccuucccuauugggggaauccucacgaccgcaaggugauccggagauuuuggagccagaagacccuguacacccaggaugccccguuccauguggucaucacauccuaucaacucguugugcaggacgugaaauacuuucagcgcgucaaguggcaguauauggugcuggaugaagcucaagcccugaaaagcagcuccagcguuagauggaagauucuucuccaguuccagugccggaaccgccugcugcucacgggaacccccauccagaauacaauggcggagcugugggcccuucugcacuuuauuaugccuacccucuucgacucucaugaagaguuuaacgaaugguucuccaaagauaucgagagccacgcugagaacaagucugccauugacgaaaaucaacugagcagacugcacaugauccuuaagcccuuuaugcuccggcgcaucaaaaaggauguggagaacgaacuguccgacaaaauugagauccugauguacugucagcucacaagcagacagaagcugcuuuaucaggcucugaaaaauaagauuucuaucgaggaucuccugcaauccagcaugggcuccacccagcaggcccaaaacacgacaucuagccugaugaaucuugucaugcaguuccggaaagugugcaaccauccugaacuguuugagcgccaggaaaccuggucccccuuccacauuucucucaagccguaccauaucagcaaguucauuuacagacacgggcagauccggguuuuuaaucauucccgcgacagauggcugcgggugcucucuccuuucgcccccgauuauauccaaagaagccuguuucaccgcaaaggaauuaacgaggaauccuguuucagcuuucuucgguucaucgacauuucuccugcugagauggcgaaucugaugcuccagggccugcuggccagauggcuugcucuguuucucucccugaaggccagcuaccgccuccaccagcugcggucuuggggcgcccccgagggcgaaucccaucagagauaucuucgcaacaaagacuuccugcucggagucaauuuuccucugagcuuccccaaccugugcucuuguccgcuucugaagucccucguguuuagcucccacugcaaagcugucagcggcuacucugaucaagugguucaucagcggagaagcgccaccuccucucugcgccggugucuccugacagagcuuccuagcuuccugugcguggcgucccccagagucaccgcugugccccuggacucuuauugcaaugaucggagcgccgaauacgagcgcagaguucucaaggaagggggaucccuggccgcuaagcagugucuucugaacggcgccccugagcucgcggcugacuggcugaaucggcgcucucaguuuuucccggagcccgccgggggacucuggagcaucagaccucaaaacggcugguccuucauucggauccccgggaaagaaagccugaucacagauucuggcaaacuuuaugcccuggacgugcugcucacgagacugaagucccagggacaccgcguccuuauuuacagccagaugacccggaugaucgaucugcucgaggaauacaugguguauagaaagcauacauacaugcgccuggacgggucuuccaaaauuagcgagcggagagauaugguggcugacuuucagaaccgcaaugauaucuucguuuuucuccuguccacccgggccgggggacuuggcauuaaccugacagcugccgacaccgucaucuucuaugauucugacuggaauccuacgguggaccaacaggcgauggauagagcccaccgccuggggcagaccaagcaagugacagucuacagacucaucugcaagggaaccauugaggaacggauccugcagcgcgcuaaagaaaagagcgaaauucagagaauggugaucuccggcgggaacuuuaaacccgacacacuuaagccuaaagagguugugagccugcuccuggaugacgaggaacucgagaagaagcugcggcuucgccaggaagagaaaagacaacaggaagagaccaaucgggucaaggaaagaaaacgcaagcgggagaaauaugccgagaagaagaaaaaggaagaugagcuggacggcaaaagacgcaaggaaggagugaaccugguuauucccuucgugccgucugcugauaauuccaaccucagcgccgacggcgaugacucuuuuaucagcgucgauuccgccaugccuucucccuucagcgagaucuccauuucuagcgaacugcacacgggguccaucccucuugacgagucuucuuccgacaugcuggugauuguugaugaccccgcuagcuccgcgccgcagucucgggccacaaauagcccugcuuccaucaccggaucugugagcgauacagucaacggcauuuccauccaggagaugcccgccgccgggagaggacauagcgcucggucucgcggcagaccuaaaggguccggcagcaccgccaagggagcgggcaaagggcggucucgcaaguccaccgcuggaagcgccgccgcuauggccggcgcgaaggcuggggccgccgcugccucugcugccgcguacgccgcuuauggauacaaugugagcaaaggcauuuccgccucuagcccccuccaaacaucccuggugagacccgcuggccuggccgacuuugggccuagcuccgccucuagcccgcucuccucuccccuuagcaagggaaacaaugucccuggcaaccccaaaaaucugcacaugacguccucucuggcuccugauagccucguucggaagcaggggaaaggaaccaaccccuccggcgggcgcuga

SEQ ID NO: 70796 - RNA, 1200 nt, Artificial Sequence
  derived and/or modified sequence opt5 from INPP1__Homo_sapiens__NP_001122400
augagcgacauccugagagagcuccugugcguguccgaaaaggccgcuaacauugcccgggcgugucgccagcaagaggcucuuuuccagcugcucaucgaagagaaaaaggaaggcgagaaaaauaagaaauuugccgucgauuucaagacccuggccgacguucuugugcaggaggugauuaagcagaacauggaaaauaaauuucccgggcuggagaagaacaucuucggagaagagucuaaugaguuuacaaacgauuggggcgagaaaauuacgcucagacugugcagcaccgaagaagagacagcugaacugcucuccaagguccugaaugggaacaaaguggccucugaggcucuugcccggguugugcaccaagacgucgcguucaccgauccuacacuggacagcaccgagaucaaugugccgcaggauauccucggaauuuggguugaccccaucgauuccacauaccaguauauuaagggcucugccgacaucaagagcaaccaggggauuuuuccuuguggacugcaaugcgugaccauccuuauuggcgucuacgauauccagacgggcgugccccugaugggggugaucaaucagccuuucgucucccgcgaccccaacacccucagauggaaaggacaguguuauuggggccugagcuacauggggacaaauaugcauucucugcaacucaccauuucccggcgcaacggaagcgaaacacacaccggcaauacggggucugaggcugccuuuuccccuagcuucucugcuguuaucuccacaagcgaaaaggagaccauuaaagccgcgcuguccagagugugcggagaucggaucuuuggcgccgcuggcgccggguauaagucucuuugugugguccagggacugguggacauuuacaucuucagcgaagacacaaccuuuaaaugggauuccugcgcugcccaugccauccuccgcgcuaugggcgggggaauuguugaccugaaggagugucuugagagaaacccggaaaccggccuggaucucccccagcugguguaucacgucgagaacgaaggggcggccggaguggaccggugggcuaauaaaggcggccugaucgccuaccgcagcagaaagcggcucgagacauuccugucucuucugguucaaaaccucgccccugcugaaacgcauaccuga

SEQ ID NO: 70797 - RNA, 2934 nt, Artificial Sequence
  derived and/or modified sequence opt5 from INPP4A__Homo_sapiens__NP_001127696
augaccgccagagagcacagcccccggcauggcgcucgcgccagagcgaugcagcgggcuuccacaaucgacguggccgccgauaugcuggggcucucucuggcuggaaacauucaagacccugaugaaccgauccuugaguucagccuggccugcuccgaacuccacacgcccucucuggaccgcaagccuaauagcuuugucgcuguuuccgugaccacacccccucaggccuucuggaccaaacaugcgcagacagagauuaucgaaggcaccaacaaucccauuuuucuuucuagcaucgccuucuuucaggauucccugaucaaccaaaugacacaggugaagcucagcgucuacgacgugaaagauagaucucaggggaccauguaucugcugggauccggcacguucauuguuaaggaccuccugcaggaucggcaccaucgccuucaccugacccucagaagcgcugagucugaccggguggggaauaucacagucauuggauggcaaauggaggaaaaauccgaucagcgcccuccggugaccagaagcguugacacagugaacggccggaugguccugcccguggaugagucucuuaccgaagcccugggcauccgcuccaaguacgcuagccucagaaaggacacgcugcugaaauccguguuugggggagccauuugucggauguaucgcuucccuacaaccgacggcaaucaccucagaauccuggagcagauggcggagucuguccuuagccugcauguuccccggcaguuugugaagcuccugcuugaagaggaugccgcuagagugugcgaacuggaggaacucggggagcuguccccuuguugggagagccugcgccggcaaauugucacacaguaccagaccaucauccucaccuaucaagaaaaccugacagaccuucaccaguacagaggacccucuuucaaagccuccagccugaaggcugauaaaaagcucgaguuugugccgacgaaucugcauauucagcgcaugcggguucaggacgauggcgggucugaccaaaacuaugauaucgugaccauuggagccccugccgcucacugccagggcuucaagagcggcgggcuucgcaaaaagcugcacaaauuugaagagacaaagaaacauuucgaagaguguugcaccuccucuggaugucagagcaucauuuacaucccccaggacgucgugagagcgaaggagaucauugcccaaaucaauacacucaaaacccagguuuccuacuaugcugaacggcugagcagagccgccaaggaucgcucugcuacgggccuggagcggacacucgccauucuggcggacaagaccagacagcuugugaccgucugcgauuguaaacugcucgcuaacuccauccacgggcugaaugccgcccgcccugacuacauugcuagcaaggccucucccacauccaccgaagaggaacaggugaugcugcggaacgaccaagauacacuuauggcuagauggacgggacggaauagccgcuccucucuccaggucgacuggcaugaggaggaaugggagaaaguguggcugaacguugauaagagccuggaaugcaucauccagagaguggacaaacuccugcagaaggagcggcuucacggcgaggggugugaagaugucuuccccugcgccggauccugcaccucuaagaaaggcaacccugacagccaugcguauuggauuagaccggaggaucccuuuugugacgugccuuccagccccugcccuucuacaaugcccuccaccgccugucacccgcaccugacaacccauugcagcccucccccugaagagucuucccccggcgaauggagcgaggcucucuacccucugcugacgacccuuacagauuguguugccaugaugucugacaaggcuaaaaaggccaugguguuccuccugaugcaagauagcgcgcccaccaucgccacauaucugucccuccaguaccgccgggacgucguguuuugccagacccugacggcucuuauuuguggguucaucauuaaacugagaaauugccuccacgaugacggauuucugcgccaacuguauacaaucggccuucucgcccaguucgagagccugcugucuaccuacggggaggaacucgcuaugcuggaagacaugucccuuggaauuauggaucugagaaacgugacauuuaagguuacccaggccaccagcuccgccucugcugacaugcucccggucaucacaggcaaucgggauggguucaacgugcgcgugccucugcccggcccccuguuugacgcgcuuccuagagagauccagagcggaaugcuccugcggguccaaccggugcuguucaauguuggcauuaacgaacagcagacgcucgccgagcgcuuuggggauaccucccugcaggaggugaucaaugucgaaucucuugugagacugaacagcuacuucgagcaauuuaaggaaguucuccccgaggacugucugccucggucccgcucucagacaugccugcccgaacuucugagauuccucggacagaaugugcaugcucggaaaaacaagaaugucgauauucuguggcaggccgccgagaucugucgcagacucaacggcgugcgguucaccagcugcaaauccgcuaaggacagaacagccaugagcguuacccuggagcaaugccuuauucugcagcacgaacacgggauggcgccucagguguuuacgcaagcucucgaguguaugcgcucugaaggaugccggagagagaauacaaugaaaaacgucggcucccgcaaguaugccuucaauagccugcagcugaaggccuuucccaaacauuaccggccucccgaggggaccuauggcaagguggaaaccuga

SEQ ID NO: 70798 - RNA, 2775 nt, Artificial Sequence
  derived and/or modified sequence opt5 from INPP4B__Homo_sapiens__NP_001095139
auggagaucaaggaagagggcgccagcgaagaggggcagcacuuccugcccaccgcucaagccaacgacccuggagauugccaguuuacauccauucagaaaacgccgaaugaaccccagcucgaguucauccuggcguguaaggaccuuguggcuccugucagagaucggaaacugaacacccucguucaaauuucugugauccaucccguggagcagagccugacacgcuacuccucuaccgaaauugucgagggcacaagagacccucuuuuucugaccggggugacauuccccagcgaauauccuaucuacgaggagaccaagaucaaacucacgguuuaugaugugaaggacaagucccacgauaccguccggacaucugugcugccggaacauaaagaucccccucccgagguuggacgcagcuuucugggcuacgccuccuucaaggugggggaacuccugaaaagcaaggagcagcuucugguccucucucugagaaccuccgacggaggcaaaguggugggcacaauugaagucagcguugugaagaugggggagaucgaggacggagaagccgaucacauuaccacggacgugcagggccaaaagugcgcucuugucugugagugcacagccccugaaucuguguccgggaaagauaaucugcccuuucucaacagcguucugaagaauccgguguguaaacuguaucgguucccuaccucugacaacaaguggaugcgcaucagagagcagauguccgaaagcauucucuccuuucauauccccaaagagcugauuucucuucacaucaaggaggaccugugccggaaucaggaaaucaaagagcucggagaacugagcccucacugggauaaccuucgcaagaauguccugacacauugugaccagauggugaacauguaccaagauauucucaccgagcuguccaaggaaaccggcagcucuuucaaauccagcucuagcaagggggagaaaacacuggaguuuguucccaucaaucuccaccuucagagaaugcaagugcauucuccccaccuuaaggacgcucuguaugaugucauuacggugggagccccugcggcccacuuccagggcuuuaaaaacggcgggcuccggaagcugcuucaucgcuucgaaaccgagagacggaauacaggauaccaguucaucuacuauuccccggaaaacaccgcuaaggccaaagagguccugagcaauauuaaccagcuccagccccugaucgcuacacacgccgaccugcuccugaacuccgcgagccaacauucuccugauucccuuaagaauagccugaaaaugcucucugagaagaccgaacuguuugugcacgccuucaaagaccagcugguucgcuccgcucugcucgcccuguacacggcuagacccggcgggauccugaagaagccucccagcccgaaauccucuacagaggaaagcuccccucaggaucagcccccugugaugcggggacaagacucuauuccccaucacagcgauuaugacgaggaagagugggacagagucugggccaacgugggcaagucccucaauugcaucauugccaugguugauaaacugaucgagcgcgacgggggaagcgaaggcucuggcgggaacaaugauggagagaaggaaccuucccuuaccgacgcuauucccagccacccgcgggaggauugguacgaacagcuguauccucucauccugacccugaaagacuguaugggcgagguggucaacagagcgaagcagucucuuacauuugugcuccugcaggagcuggccuacucccucccccaaugccugaugcuuacccugcgccgggauaucguguucagccaggcucucgccgggcugguuuguggauuuauuaucaagcugcagacaucucuuuaugaccccggcuuccuccagcaacugcauacggucgggcugauugugcaguacgaaggccuccugagcaccuacuccgaugagaucggaaugcuugaagacauggccgugggcauuagcgaucugaaaaaggucgcuuuuaaaaucauugaggccaagucuaaugacgugcucccuguuaucacagggagacgcgaacacuauguggucgaggugaaacugccggcgcggauguucgagucccugccccuucagaucaaggaaggacaacuccugcauguuuacccugugcuguuuaacgucggcauuaaugagcagcagacccucgcugaaagauucggggaugugagccugcaggaguccaucaaccaagagaauuuugaacuucugcaggaguauuacaaaauuuucauggaaaagaugcccccugacuauaucucucacuuucaggagcagaacgaccucaaggcccugcuggaaaaucuucugcaaaacauucagagcaaaaagcgcaaaaauguugagaucauguggcucgccgcuacaaucugccggaagcugaacggaauuagauuuaccugcuguaaauccgccaaggaucgcacgucuaugagcgugacccucgagcagugcuccauccugcgggacgaacaccagcuucauaaggauuucuucauuagagcucuggacuguaugcggcgcgagggcugcagaaucgaaaacguccucaaaaauauuaagugucggaaauacgccuucaacaugcugcaacugauggcguuucccaaguauuacagaccucccgaggggacauacggcaaagccgauaccuga

SEQ ID NO: 70799 - RNA, 1239 nt, Artificial Sequence
  derived and/or modified sequence opt5 from INPP5A__Homo_sapiens__NP_005530
auggccggcaaggcugccgcgcccgggaccgcugugcugcucgucacagccaacguuggaagccuguucgacgauccugagaaucuucagaaaaacuggcugagagaauuuuaccaaguggugcacacgcauaagccgcacuucauggcccuccauugccaggaguuuggcgggaaaaauuaugaagcuagcaugucucacgucgacaaguucgugaaagagcugcuuagcuccgaugccaugaaggaauacaaccgggcucgcguuuaucuggacgagaauuacaagucucaggagcauuuuaccgcccucggauccuucuauuuucugcacgaaucccugaaaaacaucuaccaguucgauuuuaaggcgaaaaaguauagaaaaguggccggcaaggagauuuacucugacacacucgaaagcacccccaugcuggagaaggagaaauucccucaagauuacuuucccgaauguaaguggucccggaaaggguucauccgcacaagauggugcauugcugacugugccuuugaucuugucaauauccaccuguuccaugacgcuagcaaccucguggccugggagaccucuccuuccguuuauagcggaauuagacacaaggcgcugggcuacgugcuugaucgcaucaucgaccagagauucgaaaaagucucuuauuuuguguucggcgauuuuaauuuccggcuggacuccaagagcguggucgagacacucugcaccaaagccacgaugcagaccguucgcgcugccgacacaaacgaaguggugaagcugauuuuuagagagucugauaaugaccggaaggucaugcugcagcucgagaaaaagcuguucgauuacuuuaaccaagaaguguuccgcgacaauaacgggaccgcccuucuggaguuugauaaagaacucuccguuuucaaggacagacuguaugagcuugauaucagcuuucccccuuccuacccguauucugaagacgcucggcagggagagcaguacaugaauacacgcugucccgccuggugcgaucggauucugaugagcccuuccgcuaaagagcucgugcugcggagcgaaucugaggaaaaggucgugaccuacgaccauaucggccccaacguuuguaugggggaucacaagccuguguuccuggcguuuagaauuaugcccggagccggcaaaccgcacgcucauguccacaagugcugugugguccaguga

SEQ ID NO: 70800 - RNA, 2250 nt, Artificial Sequence
  derived and/or modified sequence opt5 from INPP5B__Homo_sapiens__NP_001284363
augagcgccgcugccggcuccagagaacggaacaccgcugggggaucuaauuucgacggccugcgccccaacgggaagggagugccuauggaucagagcuccagaggccaagacaaaccggaaucucuccagccccggcagaauaagagcaaauccgagaucacagauaugguccgcucuagcacgauuaccguuuccgacaaggcgcacauccugagcaugcagaaauuugggcuuagagauacaauugugaagucucaucugcuccaaaaggaagaggacuacaccuauauccagaacuuccgguuuuucgccggaacauacaaugugaacggccaguccccuaaagaaugccugcgccuuuggcugagcaauggcauucaggcccccgaugucuauugugugggguuucaagagcucgaccugucuaaggaggcuuucuuuuuccacgauaccccuaaagaagaggaaugguuuaaggccguuuccgagggacugcaucccgacgcuaaauacgccaaggugaagcucaucagacuggucggcaucaugcuucugcucuaugugaaacaggagcacgcggccuacauuagcgaaguugaggcugaaacaguggggaccggaaucaugggccggauggggaacaagggaggcgucgccauucgcuuccaguuucauaauacgucuaucugcguggugaacucccaccuggcugcccacauugaggaauaugagagacggaaucaggauuacaaagacaucuguagccgcaugcaauucugccagccugauccgucccuucccccucugaccauuucuaaccaugacgucauccucuggcugggcgaccugaauuacagaaucgaggaacucgauguugagaaggugaaaaagcugauugaagagaaagacuuucagaugcuuuaugcguacgaucaacugaagauccagguggccgcuaagacagucuucgaaggguucaccgagggagagcucacauuucagcccaccuauaaauacgacacgggcagcgaugacugggauacauccgaaaagugucgggccccugcuuggugcgaccgcauucuguggaaagggaagaacaucacccagcuuagcuaucaaucucacauggcccugaaaacauccgaucauaagcccgugagcucuguuuucgacauuggagugagagucgugaaugaugagcucuaccggaagacccuggaagagaucguuagaagccuggacaaaauggaaaacgccaacaucccguccgugucucucagcaagcgcgaguuuuguuuccagaaugucaaauauaugcagcugaagguggaguccuuuaccauucacaacggccaggucccuugccacuucgaauuuaucaauaaacccgacgaggaaagcuacuguaagcaauggcuuaacgcuaauccuucucggggguuccugcuccccgauuccgacguggagauugaucuggagcuuuuuguuaacaagaugacagcgacgaaacugaauagcggagaagacaagaucgaggauauucucgugcugcaucuggacagaggcaaagauuacuuccucucugucuccggcaacuaucugcccagcugcuuuggguccccuauccacacccuuuguuacaugcgcgaaccgauccuggaccucccccuggagacaauuucugaacugacccuuaugccuguguggacaggagaugacggcagccagcucgauucccccauggagaucccuaaggagcuguggaugaugguugacuaucuguaccggaaugccgugcagcaggaagaucucuuccaacagcccgggcugagaucugaguuugaacauauucgcgacugccuugacaccggaaugaucgauaaccugagcgcuuccaaucacagcgucgccgaggcccuccugcuguuccuugaaucucucccggagccugugauuugcuauuccacguaccauaacugucuggagugcagcggcaauuauacagcuucuaaacaggugaucuccacccugcccauuuuccacaagaacguuuuucacuaccucauggccuuccugcgggaacuucugaagaauagcgcgaaaaaccaucucgacgagaacauccuggcuucuaucuuugggagccugcuucucagaaauccugccggccaccagaagcuggauaugaccgagaaaaagaaagcccaagaguucauucaucaguuucuguguaacccccucuga

SEQ ID NO: 70801 - RNA, 3570 nt, Artificial Sequence
  derived and/or modified sequence opt5 from INPP5D__Homo_sapiens__NP_001017915
auggugcccugcuggaaccacggcaauaucaccagaagcaaggccgaggaacugcucucccggacagggaaagacggaucuuuccugguccgcgcuagcgaguccauuucuagagccuacgcgcuuuguguucuguaucggaacugcguguacacguaucgcauccucccuaaugaagaugacaaguuuaccgugcaggcuagcgagggcgucuccaugagauucuuuacaaaacuggaucaacuuauugaguucuacaagaaagaaaacauggggcuggugacccaucuccaguauccgguuccccuggaggaagaggacacaggagaugacccugaagaggauaccguggagucugucgugucucccccugaacugcccccucggaauaucccgcucacagccuccagcugugaggccaaggaaguucccuuuucuaacgagaauccucgcgcuaccgaaacguccagacccagccugucugagacccuuuuccagcggcugcaguccauggacacaagcggccucccugaggaacaccugaaggccauucaagauuaccuuucuacccagcuggcucaggacuccgaguuugugaaaacagggagcuccucucucccccaucugaagaaacugaccacgcuccugugcaaggaacuuuauggagaggucauccgcacacugccgagccucgaaucccugcagagacuuuucgaucaacagcugagcccuggccuccggccccgcccucaggugcccggcgaggccaaccccaucaauauggugucuaaacugucccagcugaccagccuccugucuagcauugaggacaaggucaaggcgcuucugcacgaagggccugaguccccgcauagacccucucucaucccucccguuacauuugaagugaaagccgagagccugggcauuccucaaaagaugcagcuuaaaguggaugucgaauccggaaagcugaucauuaaaaagagcaaagacgggucugaggacaaguucuacucccacaagaaaauccuccagcugauuaagagccaaaaauuucugaacaagcucgugauccugguugagaccgaaaaagagaagauccuucggaaggaauacguguucgcugauucuaaaaagcgcgagggauuuugucagcugcuccagcagaugaaaaauaagcacuccgagcaacccgaaccggacaugauuaccaucuucauuggcacauggaacauggggaaugccccucccccuaaaaagaucacgagcugguuccuguccaagggacagggcaaaaccagagaugacucugcugauuauauuccccaugacaucuacgucaucggcacacaggaggauccucugagcgaaaaggaguggcuugaaauucucaaacacucccugcaggagaucaccucugugacauuuaagaccguugccauucauacgcuguggaacauccggauugugguccucgcgaaacccgagcacgaaaauagaaucagccacaucugcacagacaacgugaagaccgggauugccaacacccugggaaauaagggcgcugucgggguguccuucauguuuaacggaacaagccuuggcuucguuaauucucaucugaccuccgggagcgagaaaaagcuccgccggaaccaaaauuauaugaacauccugagauuucuggcccuuggagauaaaaagcucucuccguucaauauuacacaccgcuuuacgcaucuguucugguuuggcgaccugaacuaccggguggaucucccuaccugggaagcugagacaaucauucagaaaaucaagcagcagcaauaugccgaccugcuuucccacgaccagcugcucaccgaaagacgcgagcagaaagucuuccugcauuuugaggaagaggaaauuacauucgcccccaccuaccgguuugagagacugacgcgcgauaaguaugcuuacaccaagcagaaagcgacaggcaugaaguacaaucuucccagcuggugugaccgggugcucuggaaaucuuauccucugguucacguggucugccaaagcuacggguccaccagcgauaucaugacaucugaccacuccccgguguucgccaccuucgaagcuggagugacgagccaguuuguuuccaagaacggccccgggacagucgauucucagggacaaaucgaguuccugagauguuaugccacccucaaaacaaagagccagaccaaguuuuaccuggaguuccauuccucuugccuugagagcuuugugaaaucccaggaaggcgaaaaugaggaggggucugaaggcgagcugguggucaaguucggagaaacccucccuaaacugaagcccauuaucagcgacccugaguaucugcuugaucagcacauucucaucuccauuaaaagcucugacuccgaugaaagcuacggcgagggguguaucgcccugcgccuggaggcuacagaaacgcaacuccccaucuauaccccucugacacaucacggagagcuuaccggccacuuucagggggaaauuaagcugcagacaucucagggaaagacccgggagaaacucuacgacuucgugaagacggaaagagaugaguccagcggccccaaaacacugaagucucugaccucccaugacccgaugaaacaaugggagguuaccagccgggccccucccugcuccgggagcucuaucacagaaauuaucaacccuaauuacaugggcgugggacccuuuggcccgccuaugccccuucacgucaagcagacccugagcccugaucagcagcccacagcgugguccuaugaccaacccccuaaggacucuccgcucgggcccugccgcggagagagcccucccacgccucccggccagccuccgauuucccccaaaaaguuccugccuucuaccgcuaacagagggcugcccccucggacacaggaaagcagacccuccgaucucggcaaaaaugccggagacacccuuccgcaagaggaucugccucucacaaagcccgaaauguuugagaacccccuguacgggucucugagcuccuucccuaaacccgccccucgcaaggaccaggagagcccgaaaaugccccggaaggaaccucccccuugucccgagccgggcauccuuucuccuuccaucgugcugaccaaggcucaggaagccgauagaggagagggccccgggaaacagguuccugcuccccgccucagauccuuuacgugcagcagcagcgccgagggacgggcggccggcggggacaagucccaaggaaaaccuaagacccccgugucuagccaggcuccggucccugccaaacgccccauuaagcccuccagaagcgaaaucaaccagcagacaccuccgacccccacaccucggcccccucugcccgugaagucuccugcuguucuccaucugcaacacuccaaaggccgcgauuauagagacaauaccgagcuuccgcaucacgggaagcaccggcccgaagagggcccucccggaccucugggccgcacagccaugcaguga

SEQ ID NO: 70802 - RNA, 1935 nt, Artificial Sequence
  derived and/or modified sequence opt5 from INPP5E__Homo_sapiens__NP_063945
augcccagcaaggccgagaaccugagaccuuccgaaccggcuccccagccucccgagggccggacccuccaagggcagcugccuggagcgcccccugcccagcgcgcuggcucuccgcccgacgccccugggagcgaaucccccgcccuugcuugcucuacacccgccacgcccagcggagaggauccgccugcuagagccgcgcccaucgccccucggccucccgcucgcccuagacuggaacgggcccucucccuggacgauaaaggcuggcgcagacggcgcuucagagggucucaggaggaccuugaggcucggaauggaaccagcccgucccgcggcagcgugcaaucugaaggccccggggccccugcgcacuccuguucucccccuugccugagcacaucccuccaggagauucccaagagcagaggaguccugucuuccgaacggggcagcccguccucugggggaaacccucugagcggcguugccuccagcucucccaaucucccucaucgcgaugcugccguggcuggguccagccccagacugccuucucuucugcccccgcggccuccucccgcccucagccuggacaucgccuccgauucucuuagaaccgcuaacaaaguggacagcgaucuggcggacuacaagcuccgcgcccagccccugcugguccgggcucacuccagccucggaccgggcagaccccgcucuccucuggccugugaugacugcucccuucggagcgccaaaucuuccuuuagccugcucgcucccauuagauccaaggaugugcgcucucggagcuaucuggagggcucccuucuggccucuggggcgcuccugggagcugacgagcuggccagauacuucccugaccgcaauguugcccucuuuguggcuacauggaacaugcagggccaaaaggaacugcccccuagccuugaugaguuccugcuccccgccgaagcugacuaugcccaggaucuguacgucaucggggugcaggagggauguuccgaccggagagaaugggagacccgccuucaggagacacugggcccgcauuauguucuccugagcucugcggcccacggggugcuguacaugucccucuuuauucggagagaucugaucugguucugcagcgaagucgaguguucuaccgugacgacccggaucgugucccaaauuaaaacaaagggagcucuuggcaucagcuuuaccuucuuuggcacaucuuuccuguuuauuaccagccauuucacguccggggacggaaaagucgccgaacgccuccuggauuauacaagaaccguucaggcucuggugcuuccucggaaugugcccgacacaaacccuuacagaagcucugccgcggaugucaccacccgcuuugacgagguguucugguucggcgauuuuaauuuccggcucuccgggggaagaacaguuguggacgcccugcugugccagggccucgucguggacguucccgcucugcuucaacacgaucagcugauccgcgaaaugagaaaggggagcauuuuuaaaggcuuccaggagccggacauccacuuucucccuuccuacaaguucgauauuggaaaggacacguaugauucuaccagcaaacagcggacacccuccuacaccgaccgcgugcuguauagaucucggcauaagggcgauaucuguccugucagcuacuccucuugccccgggaucaaaacaagcgaccaccgccccguguauggacuguuuagagucaaggugcggccuggccgcgauaacauuccgcuugccgcugggaaauucgacagagagcucuaccugcugggaaucaagcggcgcauuuccaaagaaauccaaagacagcaggcccuccagagccaaaauucuuccaccauuuguagcguuucuuga

SEQ ID NO: 70803 - RNA, 1569 nt, Artificial Sequence
  derived and/or modified sequence opt5 from INPP5F__Homo_sapiens__NP_001230123
augugccacgacgugaucuucauggccuggcugaagcagcaauuuagcgaguguacccucauugaugcuacacauagagacgucgauguucugcuucugcucuccaacucugccuacuauguggcguacuaugacgaugaaguggacaaagucaaucaguaccagcggcugagccuugagaaccuggaaaagaucgagauuggccccgaaccuacccucuucgggaaaccgaaguuuuccugcaugcgccugcacuauagauacaaagaggcuucuggauauuuccauacgcugcgggccgugaugcgcaaucccgaggaagauggcaaggacacacuccaguguaucgccgagaugcugcaaauuaccaagcaggcuauggggagcgaucuuccuaucaucgagaaaaagcuggaaagaaaauccucuaagccccacgaggacauuaucggcauucggagccagaaccagggaucccucgcccaagggaaaaauuuucugaugagcaaguucucuucccuuaaccagaagguuaaacagacaaagagcaaugugaacaucggaaaucugcgcaaacucggcaacuuuaccaagccugaaaugaaagucaauuuccugaagcccaaccugaaagugaaucucuggaagucugauuccagccuggagacaauggaaaacaccggcguuauggacaaggugcaggcugagucugauggggacauguccagcgacaaugauuccuaccauucugacgaauuucuuacgaacagcaaauccgaugaggacagacaacuggccaacagccucgagucugucggaccuauugauuacgugcugccguccugcggcaucauugcgagcgcuccccggcuugggucucgcagccagucccugucuagcaccgacuccagcgugcacgccccuucugaaaucacagucgcccacggauccggccucgggaagggacaggagagcccccugaaaaagucuccuuccgcuggcgauguucauauccugaccggcuucgccaaacccauggacauuuauugucacagauuugugcaagaugcgcagaauaaggugacacaucucagcgaaacccgguccgucucucagcaggccagccaagagcgcaaccagaugacgaaucagguguccaacgaaacacagucugagagcaccgagcaaacaccguccagaccuagccagcuggacguuucucuuuccgcuaccgggccccaguuccugagcguggaaccugcccacucugucgcuucccagaagacccccacaagcgccucuagcaugcucgagcuggaaacgggacuucacgugacccccuccccuagcgagucuuccagcucccgggccguuucuccguuugcuaaaauccgcagcuccauggugcaagucgcgucuauuacacaggccggccugacccaugggaucaauuucgcugugagcaagguccagaaauccccucccgaacccgagauuaucaaccaggugcaacagaaugagcucaagaaaauguucauccagugccaaacaagaauuauccagauuuga

SEQ ID NO: 70804 - RNA, 1347 nt, Artificial Sequence
  derived and/or modified sequence opt5 from INPP5K__Homo_sapiens__NP_057616
augagcuccagaaagcugucuggccccaaagggcggcgccucagcauccacguggucaccuggaacguugccuccgcugccccuccgcuggaccuuucugaucugcuccagcugaauaacagaaaucuuaaccuggacauuuacgugaucggacuccaagagcugaauagcggcauuaucucccugcucucugaugcggcuuucaacgacagcugguccagcuuucugauggaugugcuuucuccccuguccuucauuaaggucagccaugugcggaugcaggggauccuccugcuuguuuuugccaaauaucagcaccucccuuacauccagauucugucuacaaaguccacgcccaccggacuguucggcuauugggggaauaaaggaggcgugaacaucugccugaagcucuacggcuauuacgucagcauuaucaauugucaucugccuccccacauuucuaacaauuaucaacgccuugaacauuuugacagaauccuggagaugcagaacugcgaagggcgggauauuccuaauauccucgaccacgaucugaucauuugguucggagacaugaacuuucgcaucgaggauuucggccuucacuuugugagagaauccauuaagaaucgguguuacgggggacugugggagaaagaccagcucagcaucgccaagaaacaugauccgcugcugcgcgaguuccaggaaggcagacuccuguuucccccuacauacaaguucgaccggaacuccaacgacuaugauaccucugagaaaaagcgcaagcccgcuuggacagaccggauucuuuggagacugaaacgccaaccuugcgccgggcccgauaccccgaucccucccgcuagccacuuuucccucagccugagaggauacucuucccauaugacauauggcaucagcgaccacaagccuguuucuggcaccuucgaucuugaacugaaaccccucgugagcgcgccccugauuguccugaugccugaggaccucuggacgguggagaaugauaugaugguguccuacucuagcaccuccgacuucccgagcucucccugggauuggaucgggcuguauaaggucggacuucgggacguuaacgauuacguguccuaugccugggugggcgacagcaaagucucuuguuccgacaaucugaaccagguguacauugauaucagcaauauuccuacaaccgaagacgaguuucuccugugcuacuauuccaacucucugagaagcguuguggggaucucccgccccuuccagaucccucccggaucucuucgggaagauccgcucggcgaggcccagccucaaauuuga

SEQ ID NO: 70805 - RNA, 3777 nt, Artificial Sequence
  derived and/or modified sequence opt5 from INPPL1__Homo_sapiens__NP_001558
auggccagcgcuugcggcgcccccgggccuggaggcgcgcuggggucccaggcuccgucuugguaccacagagaccucagccgggccgccgcugaggaacugcuugcccgcgcuggaagagauggcuccuuccuggugcgggacucugagagcgucgccggggcguuugcccucuguguucuguaucaaaagcaugugcacaccuaccgcauccuucccgauggagaagacuuccuggcugugcagacaucccagggcgucccugugagacgguuucagacgcucggcgagcugauugggcuguaugcccaacccaaccagggacucguuugcgcucugcuucugccuguggaaggcgagcgcgagcccgauccuccggacgauagagacgccucugauggggaagacgagaaacccccucugcccccucggagcggauccaccagcaucucugcgcccacaggcccguccagcccucuccccgccccugaaacccccacagcucccgccgcugagucugccccuaaugggcuuuccaccgucagccaugauuaccugaagggaucuuauggccucgaccuggaggccgugcgcggcggggcuucccaucugccgcaccucacaagaacccuggcgacgagcugucggcgccuucacuccgaaguugauaaagugcugucuggacucgagauucugagcaaggucuucgaccagcaguccagccccauggugaccagacuucugcaacagcagaaccucccucagacaggcgaacaagagcuggaaucucuggugcucaaacuguccguccuuaaggacuuucugagcgggauccagaagaaagcccucaaggcucugcaggauaugucuagcaccgcucccccugcgccccaaccguccacacggaaagccaagaccauuccuguucaggccuucgaggugaaacuugacgugacgcugggagaucucacaaagaucggcaagucucagaaauuuacccugagcgucgacguggaagggggacgccugguucuccugagacggcagagagauucccaagaagacuggacaaccuucacccacgaucgcauccggcagcuuauuaagagccagagagugcagaauaaacugggcgucguguuugagaaggaaaaagaccgcacacaacggaaggauuucaucuuuguuucugccagaaaacgcgaggcuuucugccagcuccugcagcugaugaagaacaagcauuccaaacaggacgaacccgauaugauuagcguguuuaucggcacguggaauauggggucugucccucccccuaagaacgugaccuccugguucacaagcaaaggacuuggcaagacccucgacgaggucacagugaccauuccccacgacaucuacguuuucgggacgcaagaaaauuccgugggagaucgggaauggcuggaccugcucagaggcgggcugaaagagcuuacagaucuggacuaucgcccgauugccaugcagucucucuggaacaucaaggucgccgugcugguuaagccugaacaugagaaucggaucagccacguguccaccucuagcgucaaaaccggcauugcuaacacacugggaaauaagggcgccguggggguguccuuuauguucaacggaaccagcuuuggcuucguuaauugucaccuuacaucugggaacgagaaaacggcuagacgcaaucagaacuaccucgauauccugcggcugcucucccugggagacagacagcuuaacgccuuugauauuagccugcgguucacccaucucuuuugguucggcgaccugaauuaccgccuggauauggacauccaagagauucuuaacuauaucucuagaaaggaguuugaaccccuccugcgggucgaucagcugaaucucgagagagaaaaacacaagguguuccugcgcuuuuccgaggaggaaaucagcuuucccccuacauaccgguaugagagagggucucgcgacaccuacgcguggcauaagcagaaaccgacaggcgugagaaccaacguccccagcuggugcgaucggauucuuuggaaguccuauccugaaacgcacaucauuuguaauagcuacggaugcaccgacgacaucgugacaucugaucauucccccguuuucggcaccuucgaggugggggucacaagccaauucauuuccaaaaagggacugucuaaaaccagcgaccaggccuauaucgaauuugaguccaucgaggcuauugugaagacggccucucgcacaaaguucuuuaucgaguucuacagcaccugucucgaggaauacaaaaaguccuuugagaacgaugcucagucuagcgacaauauuaacuuccugaaaguucagugguccagcagacaacugccuacacuuaagcccauccucgccgauauugaauaucugcaggaccagcaucugcuccugaccgugaaaucuauggauggcuacgaguccuauggggagugcgucguggcgcuuaagagcaugaucggaucuaccgcccagcaauuucugacauuccucucccaccggggcgaagagacggggaauauucgcggcagcaugaaaguuagagugccuaccgaacggcugggaacacgcgagagacuguacgaauggaucucuaucgacaaggaugaggcuggcgccaaguccaaagcucccagcgucucccgggggagccaggagccgcgcucuggaagcagaaagccugccuuuaccgaagccuccuguccccuuucucggcuguucgaggaaccugagaaacccccgccuacaggcagacccccugcuccuccccgcgcggcuccccgggaggaaccgcucacccccagacugaagccugagggggcccccgaaccugagggaguggccgcucccccuccgaaaaacagcuuuaauaaccccgccuauuacgugcucgaaggcgucccucaccagcugcuucccccugagcccccguccccugcccgcgcgcccguucccucugcuacgaagaauaagguggccauuacagugccugcuccccagcuggggcaccaucggcacccuagagucggcgagggaagcuccucugacgaagagagcggcgggacccucccgcccccugauuuucccccucccccgcugccugacuccgccaucuuccugcccccuagccuugauccccugccuggacccgugguucgcggcagagggggagccgaagcgagaggcccgccuccucccaaagcucacccccgcccgccccucccucccggcccuucucccgccuccaccuuccugggggagguggccagcggagacgaccggucuugcuccguccuccaaauggcuaagacacugagcgaaguggauuaugccccugcuggcccggccagauccgcgcuucugcccgggccucucgagcugcagcccccucggggacugcccucugacuacggccgcccgcuuagcuucccuccuccccggauucgggaguccauccaggaagaucuggccgaggaagcucccugccuccaagggggacgcgccagcggccugggcgaggcugggaugucugccuggcucagagccauuggacuggaacgguacgaggagggccuuguucauaacgggugggacgaucuggaauuucuguccgacaucaccgaggaagaucucgaggaggcuggagugcaggaccccgcgcacaaaagacugcuucuggauacacuccagcugagcaaguga

SEQ ID NO: 70806 - RNA, 1740 nt, Artificial Sequence
  derived and/or modified sequence opt5 from INSC__Homo_sapiens__NP_001027024
augagacggcccccuggcaacggggaggccgcuagcgaaggaccgggcggguggggacuguggggcgugcaggagucccgcagacucugcugugccgggcacgaccggugcaagcaagcgcugcuucagaucggaauuaauaugauggcucugcccggcggccgccaucucgauucugucacccugccugggcagagacuucaccugaugcagguugacagcgugcaacgguggauggaagaucucaaacugaugacagagugugaaugcaugugugugcugcaggccaagcccaucucccucgaggaggacgcccagggagaucugauucuugcuggcgggccuggacccggcgacccucugcagcuccugcuuaaacgcgggugggucaucucuacggaacugagacggauuggacaaaagcucgcccaggaucgcugggcuagagugcauagcauguccguucggcugaccugccacgcccgcucuauggugagcgaguacuccgcggucagcagaaacucucugaaagaaaugggcgagaucgagaagcuccugauggaaaaguguuccgagcuuagcgccgugacagaacggugccugcagguugagaaugaacaugugcucaaaucuaugaaggcuugugucuccgagacccugagcaugcuuggccagcacuucgggcaacugcucgagcuggcccugacacgcgaagugcaggcucucgugagaaaaaucgacgccucugauaacauuuauaccacagaguccaccacgggaaaucuguuuagccuuacccaggaaggcgcgccgcugugccggaucauugccaaggaagggggagucguugcucucuucaaaguguguagacaagacuccuuucgcugccuguacccccaggcccuucggacacuggcuucuaucugcuguguggaagagggcguccaccagcucgagaagguggaugggguucugugccuggccgacauucucaccgauaacagccauuccgaagccacaagagcugaggcggccgcuguggucgcccaggugaccagcccucaucugcccguuacgcaacaccuuucuuccuuccuggaaagcauggaggaaaucgugacagcccucgucaagcugugucaggaggcuucuagcggagagguguuucugcuugccuccgcggcucucgccaauauuaccuucuuugacacaauggccugcgaaaugcugcugcagcucaacgcuauccgcguccugcuugaggccuguucugacaaacagcggguggauaccccuuauaccagagaccaaaucguuacaauucuggcuaauaugagcgugcucgaacagugcgccuccgauaucauucaggagaacggcguccagcugaucaugggcaugcugagcgagaagccccgcucugggacgccggcggaaguggccgcuugugagcggguucaacagaaagccgcugugacccuugccagacucucccgcgacccugaugucgcgcgggaagccgugagacugagcugcaugucucgccugauugagcucugucggucccccagcgaaagaaauuccucugacgcugugcugguugccugccuugcugcccugcggcgccucgccggagucuguccugagggccugcaggauagcgacuuccagcaacuggugcagcccagacuuguggauuccuuucuccugugcucuaacauggaggagagcuucgucuga

SEQ ID NO: 70807 - RNA, 333 nt, Artificial Sequence
  derived and/or modified sequence opt5 from INS__Homo_sapiens__NP_001278826
auggcccuguggaugagacuccugccccuucuggcucuccuggcccuuuggggcccugacccggcggcugccuucgugaaccagcaccugugcgggagccaucucgucgaggcccuguaccugguuuguggagaacggggcuuuuucuauacccccaagacacgcagagaggcugaagaucuccaaguggggcaaguggagcugggaggcgggccuggagccggcucccuucagccccuggcucucgaaggcucucugcagaaacgggggaucgucgagcagugcuguacgagcauuugcucccuuuaccagcuggagaauuauuguaacuga

SEQ ID NO: 70808 - RNA, 834 nt, Artificial Sequence
  derived and/or modified sequence opt5 from INSIG1__Homo_sapiens__NP_005533
augcccagacugcacgaccauuucuggagcugcuccugugcccacucugcucggcgcagaggcccuccgcgggccagcgcggcugggcucgccgccaaggugggagagaugaucaacgucuccguuucuggccccagccugcuugcugcccauggggcuccugaugccgaccccgcgccucgcggaagauccgccgcuaugucuggccccgaaccugggagcccguaccccaauaccuggcaccaucggcugcuccagcgcucccuggugcuuuuuagcgugggagucgugcuggcccucguucugaaccugcuccaaauucagagaaaugugacacuguucccugaggaagucaucgcuacgaucuuuucuuccgccuggugggugcccccuugcuguggcaccgcggccgcuguugugggccuucuguaucccugcauugauagccaccucggggagccgcacaaauucaagcgggaaugggccucugucaugcgcuguauugcuguguuugugggaaucaaccaugccuccgccaaacuggacuucgcuaauaacguccagcuuagccugacacucgcggcccugucucugggccucugguggaccuuugauagaucccggagcgggcugggacuuggcaucacaauugcuuuccuggccacccucaucacacaguuucugguuuacaaugggguguaucaauacaccuccccugacuuccuuuauauucgcucuuggcugcccugcaucuuuuucagcggaggcgugacggucggcaacauugggagacagcucgccaugggagugccugagaagccccacuccgauuga

SEQ ID NO: 70809 - RNA, 678 nt, Artificial Sequence
  derived and/or modified sequence opt5 from INSIG2__Homo_sapiens__XP_011509594
auggccgagggcgaaaccgagagccccgggccuaagaaaugcggaccguacaucuccucugugacaagccaguccgucaaccugaugauuagaggcguuguccucuucuuuaucgggguguuccuggcucuugugcugaaucuccugcaaauucagcggaacgugacgcuuuuucccccugacguuaucgccucuauuuucagcuccgcguggugggugcccccuuguugcggaaccgcuucugccgucaucggccugcucuaucccuguaucgaucgccaccugggggaaccucauaaguuuaaaagagaguggagcuccgugaugcggugcguugccguguucgucggaauuaaucacgcuagcgccaagguggacuuugauaacaauauccagcugucucucacacuggcugcccuuuccauuggccugugguggaccuucgaccgcagcagaucuggcuuugggcucggagugggcaucgcguuccuggccacagucguuacccagcuucugguguacaacgggguguaucaauacacauccccggauuuucucuauguccggagcuggcugcccuguauuuucuuugcuggaggcaucaccauggggaauauuggacgccagcuggccauguacgaaugcaaagugaucgcugagaagucucaucaggaguga

SEQ ID NO: 70810 - RNA, 603 nt, Artificial Sequence
  derived and/or modified sequence opt5 from INS-IGF2__Homo_sapiens__NP_001035835
auggcccuguggaugagacuccugccccuucuggcucuccuggcccuuuggggcccugacccggcggcugccuucgugaaccagcaccugugcgggagccaucucgucgaggcccuguaccugguuuguggagaacggggcuuuuucuauacccccaagacacgcagagaggcugaagaucuccaagccuccgcucugucucuuagcuccucuacgagcaccuggccugaggggcuggacgccacagcgcgggcucccccugcccucguggugaccgccaauaucggacaggcuggcggguccucuagccgccaguuuagacagcgggcccugggaacauccgauagccccguccuuuucauucacugcccuggcgcggccggcaccgcucaagggcuggaauaccgcggaagacgggugacaaccgagcucguuugggaggaaguggacucuuccccgcagccccagggcagcgagucucugccugcccagcccccugcucaacccgccccgcagccugaaccccagcaggcccgcgagccuucccccgaggucagcuguugcgggcuguggcccagacggccucaacgcucucagaacuga

SEQ ID NO: 70811 - RNA, 474 nt, Artificial Sequence
  derived and/or modified sequence opt5 from INSL3__Homo_sapiens__NP_001252516
auggaccccagacugccugccugggcucucgugcugcuuggcccggcccuggucuucgcgcucgggcccgcuccuacccccgagaugcgggaaaagcugugcggacaccauuuuguucgcgcccuugugagaguguguggcgggccucgguggagcacagaggcccgcagacccgcuacgggaggcgaucagcgggaaucccacucugucagccaagccgggcugaaacuccuguccucuagcaacccuccgacccugacauuccaguccgugggaaucucugacguuagcugcuacuccggcuggcgcgaugacauuuguagcaugggcugguggcccaccgugaucucuagaugggaucucgcuugcuccccuuguccccggccucugacaauuaccgccacaaccguccagcuucccccgacgcugcaugcgaccgccgcuagcguggccguuccuaauaagacaugcuga

SEQ ID NO: 70812 - RNA, 420 nt, Artificial Sequence
  derived and/or modified sequence opt5 from INSL4__Homo_sapiens__NP_002186
auggccagccuguucagauccuaccuccccgcuaucuggcugcuucugucucagcuccugcgggagagccuugccgcggaacugcgcggcugcgggccuagauuuggaaagcaccuccuguccuauuguccgaugcccgagaaaaccuucacaacgaccccuggcggguggcugcucgaaucuggacggcccaaggagauggugagcacauccaacaauaaagacggccaagcucuggggaccacaucugaauuuauuccuaaccuuagccccgagcugaagaaaccucucuccgagggacagccgagccugaagaagaucauucuuucucgcaaaaagagauccggccggcaucgcuucgaucccuuuugcugugaagucaucugcgacgauggcaccagcguuaaacuguguacauga

SEQ ID NO: 70813 - RNA, 642 nt, Artificial Sequence
  derived and/or modified sequence opt5 from INSL6__Homo_sapiens__NP_009110
augcccagacugcuccggcugagccuucuguggcucggccugcuucuggugcgcuucuccagagagcucucugacaucagcuccgcccggaagcugugcgggcgcuaccuggucaaagaaauugagaagcucuguggacacgcuaacuggucucaguuuagauucgaagaggaaaccccuuuuagccggcugaucgcccaagcguccgagaaaguugaggcuuauucuccguaccaguucgaaagcccccagacagccuccccugcccgcggcagagggacgaaucccgugagcaccucuugggaggaagcugugaacuccugggagaugcagagccuuccugaguauaaggauaaaaagggauacucuccccugggcaagacacgggaauuuuccagcucucauaauauuaacgucuauauccacgagaaugccaaauuccaaaagaaacgcagaaacaagauuaaaacccucuccaaucuguuuugggggcaucacccucagcggaagcgcagaggauacagcgaaaagugcugucuuacaggcugcaccaaagaggaacuguccaucgcuugucucccguauaucgacuucaagcggcugaaagagaagcgcucuagccuggugacaaaaauuuacuga

SEQ ID NO: 70814 - RNA, 1533 nt, Artificial Sequence
  derived and/or modified sequence opt5 from INSM1__Homo_sapiens__NP_002187
augcccagaggcuuccuggugaagcggagcaaaaaguccaccccugucucuuaccgcguuagagggggagaggacggcgaucgggcccuccugcuuagcccguccugcgggggagcucgcgccgaacccccugcgcccucuccugugcccggcccucugccgcccccucccccugcugagagagcccacgccgcucucgccgcugcccuggcgugugcccccgggccgcagccucccccucaaggaccccgggcugcccauuuuggcaaccccgaagcugcccacccugcgccgcuuuauagccccacacgcccuguguccagagagcaugaaaaacacaaguacuucgagcggucuuuuaaucugggcagccccgucuccgccgagagcuucccuacgcccgcugcccuccugggcggaggcgggggaggcggggcuucuggagccggcggcgggggaaccugcggcggggacccgcugcucuuugccccugcugaacugaaaaugggaacagcguucuccgccggcgcugaggccgcccgcgggcccggaccugggcccccucuucccccggcugccgcgcugagaccucccggcaagcggcccccuccgcccaccgcugccgaaccucccgccaaggcugugaaagccccuggggcuaagaaacccaaggccauccgcaaacuccauuuugaggaugagguuacaaccagcccugugcugggacuuaagauuaaggaaggccccgucgaggcgccgagagggcgggccggaggcgcugcccgcccucugggggaguucaucugucagcucugcaaagaagaauaugcugaccccuuugcccuggcgcagcacaaguguucuagaauugugcggguugaguacagaugcccugagugugccaaaguguucuccugccccgcuaaccuggccagccaccgccgguggcauaagccgagaccugcucccgccgccgcucgcgcgccugaacccgaggccgcugcccgggccgaagcuagagaggcccccggcggaggcucugaucgcgacacaccuucccccgggggagucagcgaauccggcucugaggaugggcucuaugagugucaccauugcgcgaaaaaguuucggagacaggcuuaccugcgcaaacaccuucuggcccaccaucaagcccuccaggcuaagggagccccgcuggcgccucccgcugaagaccuucuggcccucuauccuggccccgaugagaaggccccucaggaagcugccggggacggcgagggagcuggcgugcuggggcugagcgccuccgcggaaugucaccucugcccggugugcggagagagcuucgccucuaaaggcgcucaggagcggcaucugagacuucugcacgccgcucaagucuuucccuguaaguacugcccugccaccuucuacuccagccccgggcucacgcgccauaucaauaaaugucacccuucugaaaaccggcagguuauucugcuucaggugcccgugagaccggccugcuga

SEQ ID NO: 70815 - RNA, 1701 nt, Artificial Sequence
  derived and/or modified sequence opt5 from INSM2__Homo_sapiens__NP_115983
augcccagaggcuuccuggugaagcggaccaaacgcacagggggacucuacagaguccggcuggccgagcgcguuuuuccucuucugggcccgcagggggcucccccuuuccucgaagaggcccccagcgcgucccugccuggagcugaaagagccacgcccccuacccgggaggaaccgggcaaggggcuuacagccgaggcugcccgcgagcaaucuggaagccccugcagagcugccggcguguccccuggcaccgggggacgggaaggcgcggaguggcgcgccgggggaagagaaggccccgggccuucucccagcccguccccuucucccgcuaaaccugccggagcugagcugcggcgcgccuuucucgagagaugucugagcucccccgugagcgcggaaucuuuccccggcggcgccgcugccgucgcugccuuuuccugcagcguggccccugcugcggccccgacacccggggagcaguuccugcucccucugcgggcucccuuuccugaacccgcccuucagccggacccugcuccccugucugccgcccuccagucccugaagcgcgcggcuggaggcgagagacgggggaaagccccuaccgauugugccagcggacccgcugccgcuggcaucaagaagccuaaagccaugagaaaacuuucuuucgcggacgaaguuacaaccucccccgugcuggggcucaagauuaaggaggaggaaccgggagccccuagccgcggccugggcgggucccggacgccccugggagaguuuaucugccaacucuguaaagaacaguaugcugaucccuucgcccuggcucagcacagaugcucucgcauuguccggguggaguacagauguccugaaugcgacaagguuuuuagcuguccggccaaccuugcgucccaucgccgguggcacaagcccagaccugccgcugccaaugcugccaccgugagcucugccgauggcaaacccccuuccagcucuagcuccucuagccgcgacuccggggcuaucgcgagcuuccuggccgagggaaaggagaacucucggauugaaagaacagcugaucagcauccccaagcccgcgacuccagcggcgccgaucagcacccugacucugcuccccggcaggggcuccagguccugacccauccggagccuccccuuccucaaggccccuauacagaaggagugcugggcagacgggugccggucccuggguccaccagcggaggccgcggguccgagaucuuuguuugccccuacugucacaaaaaguucagacggcaggccuaucucagaaaacaccugucuacgcaugaagcgggaagcgcucgcgcccuggccccuggcuucggguccgagcggggcgcuccccucgccuuugcgugcccccugugcggagcucacuucccuacagccgauaucagagagaagcaucgccuuuggcacgccgugagagaggaacugcuccugccggcucuugccggcgcucccccugaaaccucugggcccagcggaccuuccgacggcagcgcccagcaaaucuuuucuuguaaacacugccccuccacauucuuuagcucuccugggcugacccggcauauuaauaagugucacccguccgagagccgccaggugcuccugcugcagaugccccucagaccuggaugcuga

SEQ ID NO: 70816 - RNA, 4149 nt, Artificial Sequence
  derived and/or modified sequence opt5 from INSR__Homo_sapiens__NP_000199
auggccaccggcgggagacggggagcugccgcggcuccccugcucguggccgucgccgcucugcuucugggcgccgcugggcaccucuacccuggagagguuugcccgggcauggacauccgcaacaaucugacaagacuucaugaacuggagaacuguagcgugauugaagggcaccuccagauccugcugauguucaagacgcggcccgaggauuuucgcgaccucuccuucccuaaacugauuaugaucaccgauuaucuucugcucuuuagaguguacggacuggaaucucuuaaggaccuguuccccaaucucacagucauucggggcagccgccuguuuuucaacuaugcccuggugaucuuugagaugguucaucucaaagagcugggccuuuacaaucugaugaacaucaccagaggguccgugcggauugaaaagaauaacgagcucugcuaucuggcgacaaucgauuggucucgcauucuugacagcgucgaagauaauuacaucgugcugaacaaagacgauaaugaggaguguggagacauuugcccuggcaccgccaaggggaagacaaacugucccgcuaccguuaucaauggacaauucguggaaagaugcuggacgcacucccauugucagaaagucugcccuaccauuuguaagucucacggcugcacagccgaggggcucuguugccacagcgaaugccugggaaacuguucccagccggaugaccccaccaaaugcguggcuugucggaauuuuuaucuggauggccgcugcguggagacauguccucccccuuacuaccauuuccaggacuggagaugcgucaacuuuagcuucugucaagaccuccaccauaagugcaaaaacucucggcgccagggcugucaccaguauguuauccacaauaacaagugcauccccgaauguccguccggguacaccaugaauagcucuaaccugcuuugcacgccuugccugggacccuguccuaaggugugccaucuccuggagggcgagaaaacaauugauuccgugaccagcgcccaggaacuuagaggguguacagucaucaauggaucucugauuaucaacauucggggcgggaauaaccucgcggccgagcuggaagcuaaucugggacucaucgaggaaaucuccggcuaucugaagauuagacgcagcuacgcccuugugucccugagcuuuuuccggaaacucagacugauccgcggcgagacccuggagauugggaacuauagcuucuacgcucuugacaaucaaaaccuccggcagcugugggauugguccaagcacaaucugaccaucacacagggaaaacucuuuuuccauuauaaccccaagcugugccuuagcgaaauucacaaaauggaggaaguuucuggcacgaaggggagacaggagcgcaaugacaucgcccugaagaccaacggagaucaagccuccugugaaaacgagcuccugaaauuuagcuacauccggacaucuuucgacaagauucugcuuagaugggagcccuacuggccuccggauuuucgcgaccuccugggcuucaugcuguuuuauaaagaagcucccuaccagaaugugaccgaguucgaugggcaggacgcgugcggcagcaacuccuggacagucguggauaucgacccuccccuccggucuaaugacccuaagagccaaaaccaucccggauggcugaugagaggccuuaaaccguggacccaguaugccauuuuuguuaagacgcuggugacauucuccgaugaacgccggaccuacggggcuaagagcgacaucauuuauguccagaccgaugccacaaauccuucugugccccucgacccuaucuccgucagcaacucuuccagccagauuauccugaaauggaagcccccuuccgaucccaauggaaacaucacccacuaccugguguuuugggagagacaagccgaggacucugaacuuuucgagcucgauuauugucugaaaggccugaagcucccgagccggacaugguccccucccuuugaaucugaggacagccagaaacacaaucaguccgaauacgaggauagcgcuggggagugcuguucuugccccaagacggacucccagauucugaaggaacuugaggaaagcucuuuccgcaaaaccuucgaggauuaccugcauaacguuguguuugucccuagaaagacauccagcggaaccggcgccgaagacccgcggcccucuagaaaacgccggagccucggggaugugggcaauguuacaguggcggucccuaccguggcugccuuccccaacacguccagcaccucugugccuacaucccccgaggagcacagaccuuuugaaaagguugucaauaaagagagccuggugaucuccggacugcgccauuucaccggcuauagaauugaacuucaagccuguaaccaggacacacccgaggaacggugcucuguggcugccuacgucagcgcucgcaccaugccggaggccaaggcggacgauaucguggggccuguuacgcacgagauuuuugaaaauaacgugguccaccucauguggcaggagcccaaggaaccuaacggacugaucgugcuguaugagguuuccuacagacgguauggcgacgaggaacuccaucugugcgugucucgcaaacacuucgcccuugagagagggugucggcugcgcggacucagccccggcaauuacuccgucagaauccgggcuacaucucuggccgggaacggcagcuggaccgaaccgacauauuuuuacgugaccgauuaccuggacguuccuuccaauauugcuaagaucauuaucggaccccuuauuuucguguuucuguucagcgucgugaucggcucuaucuaucucuuucugcgcaaaagacagccugaugggccccucggaccccuguacgccuccagcaacccugaguaucuuucugcguccgacguguucccgugcagcgucuacguucccgaugaaugggaggugucucgggagaagauuacccugcucagagaacugggccaaggguccuuuggaaugguguaugagggcaaugcccgcgacaucauuaaaggggaagcugagacacgggucgccgugaagacgguuaacgaaagcgcuucccugagagagcgcaucgaguuccuuaaugaagccagcgugaugaaaggcuucaccugucaucacgucgugcggcugcucggaguugugucuaagggccagccuacacuggucgugauggagcucauggcccauggggaucugaagucuuaccuuagaucccugcgccccgaagcugagaacaauccuggacggcccccuccgacccuccaggaaaugauucagauggcggccgagaucgcugacggcauggccuaucugaacgccaaaaaguuuguucacagagaucuggcugcccgcaauugcaugguggcgcacgacuucacagucaaaaucggggauuuuggaaugacccgggacauuuacgagacggacuacuauagaaagggcggcaaagggcuucugcccgugcgguggauggcuccugaaucucucaaggauggaguguucacaaccagcuccgacauguggucuuuuggcgucguucugugggagaucaccagccucgccgaacaacccuaccaggggcuguccaacgaacaggugcuuaaguucgugauggauggaggcuaucuggaccaaccugauaauugucccgagcgcgucacagaccugaugagaaugugcuggcaguuuaacccgaaaaugcggccuaccuuccucgagauugugaaucugcuuaaggaugaccugcaucccucuuuucccgagguuagcuucuuucacuccgaagagaacaaagccccugaaagcgaggagcucgaaauggaguucgaagauauggagaacgugccccuggacagaucuucccauugucagcgcgaagaggcugggggacgggauggcggcagcucucucggguucaagagauccuacgaggaacacaucccuuauacacauaugaauggaggcaaaaagaacgggcgcauucugacgcuuccgcggagcaaucccuccuga

SEQ ID NO: 70817 - RNA, 3894 nt, Artificial Sequence
  derived and/or modified sequence opt5 from INSRR__Homo_sapiens__NP_055030
auggccgugcccagccuguggccuuggggcgcuugccucccggucaucuuccugucccuuggguuuggacuggacaccguugaggugugucccucucucgauauuagaagcgaaguggccgagcugcggcagcuugaaaacugcuccgucguggagggccaucugcaaauccuccugauguucacagcgacgggggaagacuuucgcggacugucuuucccuagacucacccagguuacagauuaccugcuucuguuucggguguauggccucgagagccugcgcgaccuuuuccccaaucuggcugucauuagagggacccggcucuuucugggauacgcccuggugaucuucgagaugccucaccuccgcgauguugcccugcccgcucuuggcgccgugcugagaggcgcuguccggguggaaaagaaccaggagcucugucaccuguccacaauugacugggggcuucugcagccugccccgggagcgaaucauaucgugggcaacaaacucggggaagagugcgccgaugucugucccggaguucugggcgcugccggggagccuugcgcuaagaccacauuuucuggacacaccgacuaucgcuguuggacgagcucccauugccaaagagugugucccugcccucacggcauggccuguaccgcgcggggcgaaugcugccacacagagugucugggaggaugcagccagcccgaagauccgcgcgccuguguggcuugcagacaucucuacuuccagggcgccugucugugggcuugcccucccgggaccuaucaguacgagucuuggcggugugucacagccgaacgcugcgccucccuucacagcgugccugggagagcuucuaccuuuggcauccaucaaggguccugucuggcgcagugccccagcggauucacgagaaauucuuccagcaucuuuugucacaaaugcgagggccucugccccaaggaguguaaaguuggcacaaagaccauugacuccauucaggccgcucaggaucugguggggugcacacacgucgaaggaucucuuauccugaaccuccggcaaggcuauaaucuggagccucagcugcagcauagccucgggcugguggaaaccauuaccggauuccuuaagaucaaacacuccuucgcccugguuagccucggcuuuuucaagaaccugaaacugauucgcggggacgccaugguggauggcaauuacacacuuuacguccucgacaaccaaaaucugcagcagcugggaucuuggguggcugccggccucacgaucccggucgggaagaucuauuuugcguucaacccccggcugugucuugagcauauuuacagacuggaagaggugaccggaacacgcggccggcagaauaaagcugagaucaacccuagaaccaauggggaccgcgccgccugccaaacacggacccucagauuuguuuccaacgugacggaagcugaucgcauucugcugcggugggagagauaugaaccccuugaggcccgcgaccuccugagcuucaucgucuacuauaaggaaucuccuuuucagaacgcuacagagcacgugggacccgaugccuguggcacccagagcuggaaucugcucgacguugagcugccgcuuucccggacccaggaaccuggggugacacuggcgucucucaagcccuggacccaauacgccgucuucgugagagcuauuacacugacgaccgaggaagauagcccucaucagggcgcccagucccccaucguguaucugcggacacuuccugcugcccccaccguuccgcaggacgucaucagcacaucuaacuccagcucucaccuccuggugcgcuggaaaccucccacccaaagaaauggaaaccugacguacuaccucgugcuguggcagcggcuugcggaggauggcgaccuguaucucaaugauuacugccacagagggcugcgccugcccaccuccaacaaugacccucgguuugauggagaggacggcgacccggaagccgagauggaaagcgauuguugccccugucagcauccucccccugggcagguccuucccccucucgaggcucaagaagccuccuuccagaagaaauuugagaacuuccugcacaaugcuauuacaauccccauuucuccguggaaggugaccagcaucaacaaauccccucagagagacucuggacgccauagacgggccgccggcccccugcgccucgggggcaauagcuccgauuuugagauucaagaagacaagguuccuagagagcgggcugugcugagcggacuucgccacuucacagaauauagaaucgauauccacgcgugcaaccaugccgcucacaccgucggcuguucugccgccacguucguguuugcucggacaaugccccaucgcgaggccgacgggauuccgggaaaaguugcgugggaggcuuccagcaaaaauucugugcugcucagauggcuggagccucccgauccuaacggccugauccuuaaguacgagauuaaauaucggcgccugggggaagaggccaccguccucugcguguccagacugcgguacgccaaguucggaggcguucaccucgcucugcuuccucccgggaauuauagcgccagagugcgcgcgacaucucuggcuggcaacggaagcuggaccgacuccgucgccuuuuacauccucggccccgaagaggaagaugccgggggacugcaugugcugcuuaccgcuacaccggugggccugacgcuccugauuguccucgccgcucugggguucuuuuacggaaagaagcggaacagaacccuuuaugccagcguuaaucccgaguacuucucugcguccgacauguaugugccugaugagugggaagugccccgcgagcagaucagcauuauccgggaacugggccagggcuccuuugggauggucuacgagggacucgccagaggccuggaggcuggggaagagucuacaccuguggcccugaaaaccguuaacgaacuugcuagcccccgcgagugcaucgaguuccugaaggaagccuccgugaugaaggccuuuaaaugucaccacgucgugcggcuccugggaguugugucucagggccaaccuacacucgucauuauggagcugaugaccagaggggaccuuaagagccaucugcgcucccugcggccggaagcugagaauaaccccggacucccucagcccgcgcugggcgaaaugauccagauggccggcgagauugcugaugggauggccuaucuugccgcuaauaaauucgugcacagagaccuggccgcgcggaacugcaugguuucucaggacuuuacggugaagaucggagauuucggcaugacacgcgacgucuacgaaaccgauuauuacagaaaagggggaaagggccuccugccugugcgguggauggcucccgagagccucaaggacgggauuuuuaccacacauuccgauguguggagcuucggagucguucugugggagaucgugacccuugccgaacaaccguaccagggccugucuaaugaacaggugcugaaauucgucauggacggcggggugcucgaggaacuggaaggauguccucuucagcugcaagagcucaugucccgcugcuggcagcccaaccccagacugcggccuagcuuuacacacauccucgauucuauucaggaggaacugagacccuccuuccgccuucugagcuuuuauuacucuccugagugucggggcgccagagggucccugccgacgaccgacgcugaacccgauagcuccccuacaccccgcgacugcagcccucaaaauggaggccccgggcauuga

SEQ ID NO: 70818 - RNA, 1389 nt, Artificial Sequence
  derived and/or modified sequence opt5 from INTS12__Homo_sapiens__NP_001135943
auggccgcuaccgugaaccuggagcucgaccccaucuuccugaaggcccuuggcuuucugcacagcaaauccaaggauucugcggaaaaacucaaggcucugcuugacgagagccuggccagagggauugauuccucuuaccggccuagccagaaagacgucgaaccgcccaagaucuccucuacaaagaauauuagcaucaaacaagagccuaagauuuccagcucucuccccuccggaaacaauaacggcaaaguucugacgaccgaaaaggugaaaaaggaggccgagaagcgcccugcugauaaaaugaaaagcgacaucacagaagggguggauauccccaaaaagccuagacuggagaaaccggaaacccagucuucccccauuacaguccagagcucuaaggaccucccuauggccgaucuguccagcuucgaggagaccuccgcugacgauuuugccauggaaaugggacuugcgugcgugguuugucggcagaugaugguggccucuggcaaucaacuggucgagugccaggaaugucauaaccucuaucaccgcgacugccauaaaccccaggugacagauaaggaggcuaaugacccuagacugguuugguacugugcccggugcacccgccagaugaagagaauggcucaaaagacgcagaagcccccgcagaaaccugcccccgcgguggucagcgugaccccugccgugaaggacccccuugucaaaaagcccgaaacaaagcugaaacaggagaccacauuccucgcuuuuaagcggaccgagguuaaaacguccacagugaucagcgggaacucuuccagcgccucugugagcuccucugucaccagcggacugacaggcugggcugccuucgccgcuaagaccuccagcgcgggcccuucuaccgccaaacuguccagcacaacgcaaaauaacaccgggaagccggcuacaucuuccgccaaucagaagcccgugggacucaccggccuggccacaagcuccaaagggggaauuggcucuaagaucgggagcaacaauuccaccacgccuacaguuccccuuaaaccucccccgccucugacccucggaaagaccggccugucucgcagcguguccugugauaacgucagcaaagugggccuucccucuccuuccagccugguucccgggucuuccagccagcucucuggaaauggcaacagcgggacauccggaccuagcggcucuaccacauccaagacgaccagcgaauccucuagcucccccucugcuagccugaaggggccgacaucccaagagucucagcugaacgccaugaaaagacuccagauggugaagaaaaaggcggcucagaaaaagcugaaaaaguga

SEQ ID NO: 70819 - RNA, 6573 nt, Artificial Sequence
  derived and/or modified sequence opt5 from INTS1__Homo_sapiens__NP_001073922
augaacagagcgaagcccaccacagugcggcgcccuagcgcugcugcgaagccguccggccaucccccucccggggacuucaucgcucugggaucuaagggccaggcuaaugagagcaagacggccuccacccuccugaagccugcucccucugggcuuccuagcgaaagaaaacgggaugccgcugccgcgcuguccucugccagcgcucucacaggacugaccaagcgcccgaaacuuuccagcacacccccucugucugcccucggcagacuggcugaggccgcggucgccgaaaaacgggcuauuucccccagcaucaaggagccuucuguugugcccauugaagugcugccgaccguccuccuggacgagaucgaggccgcugaacuugaggggaacgaugaccgcauugaaggagugcugugcggcgccguuaaacaacucaaggugacaagagccaaaccugauuccacccuguaccuuagccugauguaucucgcuaagaucaagcccaauaucuuugcgacggagggcgucauugaggcccuguguucucugcuccggcgcgacgcuuccaucaacuucaaagccaaggggaauagccugguguccguucuugccugcaaccugcucauggcugccuacgaagaggaugaaaauuggccugagauuuuugugaaagucuauaucgaagacucucugggagagagaauuuggguggauagcccccacuguaagaccuucguggacaacauccagacagcguuuaauacccggaugcccccucgcuccguccuucugcagggcgaggcugggagaguugccggagaucucggcgccgggagcucuccgcaccccucccugacagaagaggaagacagccagaccgagcugcucauugcugaagagaaacugucuccugagcaagaaggacagcuuaugccccgguacgaggaacuggccgagagcguggaagaguaugugcucgauaugcugcgcgaccagcuuaacagacggcagccuaucgacaaugucuccagaaaccugcuccgccugcugacgucuacaugcggcuacaaggaggugcggcuccuggcuguucaaaaacuugaaauguggcugcagaaucccaagcucaccagaccggcccaggaucugcugaugagcguguguaugaacugcaauacacacggcuccgaggacauggaugucaucagccaccuuauuaagauccgccucaaaccuaaggugcugcugaaccauuucaugcucuguauucgggaacugcuuucugcgcacaaagacaaccuggggaccaccaucaagcucguuauuuuuaaugagcuguccagcgccagaaaccccaauaacaugcaagugcuguauacagcccuucagcacucuuccgagcucgccccuaaauuccuggcuauggucuuucaggaucugcucacgaauaaggacgauuaccugcgcgccagccgggcgcuucugagagaaaucaucaagcagaccaaacaugagauuaacuuccaagccuuuugccucggacugaugcaggaacgcaaggagccccaguaccuggaaauggaguucaaagagcgguuugugguccacaucacagacgugcuugcuguuuccaugaugcucggcauuaccgcccaggugaaggaagcugggaucgccugggauaaaggagagaagagaaaucuggaaguccugcgcucuuuccaaaaccagauugccgcuauccagcgggacgcggugugguggcuccauacaguugugccuagcaucuccaagcuggcccccaaagauuauguccacugucuucacaaggugcuguucaccgagcagccggaaacguacuauaaaugggacaauuggccucccgagucugacagaaacuuuuuccuccggcugugcagcgaggugcccauucuggaagauacacuuaugcgcauccucguuauuggccuguccagagagcugccucucgggccggcugacgccauggaacuggccgaucaucuugucaagcgggcugccgcggugcaagcugacgauguggagguccugaaagugggaagaacccagcucaucgacgccguucugaaucuguguaccuaccaccaucccgaaaacauucagcuuccucccggcuaucagccucccaaucuggccaucagcacacucuacuggaaggcuuggccucugcuccugguggucgccgcguuuaaccccgagaauauuggccuugcugccugggaggaauauccgacccugaagaugcucauggagauggugaugacaaacaacuacucuuacccucccugcacgcugaccgaugaagagacacgcaccgagaugcugaaucgggaacuucaaacagcccagagagagaaacaggaaauccuggcuuucgaggggcaccucgccgcugccuccaccaagcagacgaucaccgaauccucuagccugcuccugagccaacuuacaucucuggacccucagggacccccgcgcagaccucccccucauauucucgaucagguuaaaagccugaaccaaucccugcggcuuggccaucugcuuugccgcagcagaaaucccgacuuucugcuccacaucauucagcggcaggcgucuucccagagcaugcccuggcuggccgaucuugugcaauccucugaggggagccuggacguccugccugugcagugucucugcgaguuccugcuucacgaugcuguugacgacgccgcuuccggagaagaggaugacgaaggcgagucuaaggaacagaaagccaagaaacgccagagacaacagaagcagcggcagcugcucgggcgccugcaagaucuccugcuuggcccgaaggccgacgagcagaccacaugugaggugcuggauuauuuucugagacggcucggaagcucccaggucgcuucucgcgugcuggcgaugaaaggccuuagccuggugcucuccgaagggagccugagagacggagaggaaaaggagcccccuauggaagaggaugucggcgacaccgauguucuccaaggguaccaguggcugcuucgggaccugcccagacugccucucuucgauucugugcgcuccacgacagcccuggcccuucagcaggccauccacauggagaccgacccccaaacaauuagcgccuaucugaucuaccucucucagcauaccccuguggaggaacaggcucagcacuccgaucuggcccucgacgucgcgcggcuggugguugaaagaagcaccaucaugucucaccucuuuuccaaacugagcccguccgcugccagcgacgccgugcugucugcucuccugagcauuuucucccgcuauguccggagaaugcgccaaucuaaggagggagaggaaguguacagcugguccgagucucaggaucagguuuuucuucgguggagcuccggcgaaacagccacgaugcauauccuggugguccacgcgauggugauucuccugacccuggggcccccuagagcugacgauucugaguuccaggcccuccuugacaucugguuucccgaagagaaaccucugcccacagccuuccugguugauaccagcgaggaagcucuccugcuuccggacuggcugaagcuccgcaugauucgguccgaggugcugagacuggucgaugccgcucuccaagaccuugaaccucagcagcugcuccuguucgugcagagcuuuggcauccccgugucuuccaugagcaagcugcuucaauuccuggaucaggccgucgcgcaugacccccagacacucgagcaaaacaucauggauaaaaauuauauggcccaccugguugaagugcagcaugagcggggagcuucuggcgggcagaccuuucacucccugcucacggccagccuuccuccccgcagagacuccacagaggcuccuaagccgaaaucuagccccgaacagccuauuggacaaggccggauccgcguggggacccagcugagaguccugggacccgaggacgaucucgccggcauguuccugcagauuuuuccucuuucccccgacccgcgguggcagucuagcuccccuagacccguggcccuggcucuccaacaggcgcuggggcaggaacuggcccgcguugugcagggcagcccugagguccccggaaucaccgugcggguucuccaagcucuugccacacugcugucuagcccucacggcggggcccucgugauguccaugcauagaucucacuuccuggcuugcccccuucugcgccagcucugucaguaccaacggugcgucccgcaggauaccggauuuagcucccuguuccugaaggugcuccuucagaugcugcaguggcuggacucuccuggcgucgaagggggaccccucagagcccaacugcgcaugcuugcgagccaggcuuccgccggccggagacugagcgaugugcgcgggggccuccugagacuggccgaggcucucgccuuucggcaggaccuugagguugugucuuccacaguccgcgcggugauugccacgcugagaagcggagaacaguguuccguugagcccgaucugaucucuaaagugcuccaaggccugaucgaaguccggagcccucaucuugaggagcugcucaccgcuuucuuuuccgccacagcugacgccgcuucuccguuccccgccugcaagccuguggugguugucagcucccugcugcuccaggaagaggaaccccuugccgggggaaagccuggcgccgaugggggaagccuggaggcugugcgccugggccccucuuccggccuccugguggacuggcuugaaaugcuggauccugaggucgugagcucuuguccggaccuccagcugagacugcucuuuucccggagaaaagggaagggacaggcccaaguucccagcuuccgcccuuaccuucugacccuguucacacaccagucuagcuggcccacccuccaucagugcauucgggugcugcuuggcaaauccagagagcagcgcuuugauccuucugcuagccuggacuuccucugggccuguauccacgucccccggauuuggcaagggagagaccagcggacgccgcagaagcgcagagaggaacuggugcugcggguucaaggaccugaacucaucucccuuguggagcugauucuggccgaagcugagacccgcagccaggauggcgacacagcggccugcucccucauccaggcuagacugccccuucugcucucuugcuguugcggggaugacgagagcguccggaaagugaccgaacaccuguccggauguauucagcaauggggcgauucuguucugggccgcagaugccgggaccuccugcuucagcuguaucuccagcgccccgagcugagagugccuguccccgaagugcuucugcauagcgagggggccgccuccucuagcguguguaagcucgauggacugauccaccgguuuaucacacugcucgcugacaccuccgauagcagagcccuggaaaaccgcggcgcggacgccucuauggcuugccggaaacuugccgucgcucauccucugcuccugcuuagacaucugccgaugauugccgcgcuccugcacgggcgcacacaucugaauuuccaggaguuucggcaacagaaccaccucuccuguuuccugcauguucuuggacugcucgagcugcuucagccccacguguuuagaagcgaacaucagggcgcccugugggauugccuccugucuuucauccgccugcuccugaauuaccggaaauccagcagacaccuugcugccuuuauuaacaaguucgugcaauuuauccacaaauauauuaccuacaaugcuccugccgcuaucucuuuccugcagaagcaugccgacccccuccacgaucuguccuucgacaacagcgaccuugucaugcugaaaucccuccuggcggggcugagccucccuucucgcgaugaccggacggauagaggacuggacgaggaaggcgaggaggaaagcuccgccggcucucuuccccuggugagcguuucccucuuuacaccgcugaccgcugccgagauggcuccuuauaugaagcgccuuucucgggggcagaccguggaagaucugcucgagguccugagcgacaucgaugaaauguccagacgcagacccgagauucugucuuucuuuagcacaaaucuccaacggcugauguccagcgccgaggaauguugccgcaaccuugccuucucucuggcgcucagauccaugcagaauagcccuucuaucgcugccgcuuuucugcccaccuucauguacugucuuggaucccaggacuuugaggugguucagacggcccugcggaaccucccugaauaugcccugcugugccaagagcaugcugccgugcuccugcacagagcguuccuugucggcauguacgggcagauggaucccagcgcccagauuuccgaagcucugcggauccuccacauggaggccgugauguga

SEQ ID NO: 70820 - RNA, 3615 nt, Artificial Sequence
  derived and/or modified sequence opt5 from INTS2__Homo_sapiens__NP_065799
augaaggaccagcaaaccgugaucaugacagagugcacgagccugcaguucgucucccccuuugccuucgaagcuaugcagaaaguugauguggugugucucgccucucugagcgacccugagcuuagacugcuccugccgugccuuguccggauggcgcugugugcucccgccgaucagucccaaucuugggcccaggacaagaaacucauucugcgccugcucagcggcguggaagcuguuaacuccaucguggcccugcuuucugucgauuuucacgcucuggagcaggacgccagcaaggaacagcaacucagacauaaacuugggggaggcuccggggagagcauucuugugucucagcugcagcacggacucacccuggaguucgaacauuccgauagcccucggcgccugagacucguucugucugagcuucuggcgaucaugaauaagguguccgaaagcaacggcgaguuuuucuuuaagucuuccgaacucuucgaaagccccgucuaccuggaggaagccgcugacgugcuuugcauucugcaggccgagcucccuucccugcugcccaucguggaugucgcugaagcccuccugcacguucggaauggggcgugguuucuuugucugcucguggccaacgugccugacucuuucaaugaggucugccgcggacugaucaaaaacggcgagagacaagaugaagagagccuuggcgggcggcgcagaacagacgcucugcgguuucucuguaagaugaauccgucccaggcccugaaagugcgcggaaugguuguggaagagugccaucugcccggccucggggucgcucugacccuugaucacacaaagaacgaagccugugaggacggagugagcgaccugguuugcuucgugucuggccuccugcuggggaccaaugccaaagucagaacaugguuuggaaccuucauucggaacggccagcaacgcaagagagagacguccagcucugugcuuuggcagaugcggagacagcuccugcuggaacucaugggcauccugccuaccguccgcagcacacggauuguggaggaagcugauguugacauggagcccaauguguccgucuauucugggcuuaaggaggagcacgugguuaaagcgagcgcccugcucagacuguacugugcucugaugggaaucgccggccuuaagccuaccgaggaagaggccgaacagcuccugcaacugaugacaucccggcccccggcuaccccugccggggugcgcuucgucagccucucuuuuugcaugcugcuugcguucuccacgcuggugagcacacccgagcaggagcagcucauggugguuuggcugucuuggaugauuaaagaagaggcuuauuuugaauccaccagcggagucuccgccucuuucggcgagaugcugcuucucguggccauguacuuucauagcaaccagcuguccgcuaucauugaucuggugugcucuacacucgggaugaagaucgucaucaaaccuagcucccugagcagaaugaagaccauuuucacccaagaaaucuuuacagaacaggugguuacggcccacgcugugcgcguccccgugaccucuaaucuuuccgccaacauuacaggauuccugcccauccauuguauuuaucagcuccugcggagcagaucuuuuaccaaacacaagguuuccaucaaggacuggaucuaccgccagcugugcgagacaagcaccccucuucacccgcaacuccugccccugauugauguguauaucaauucuauucucacgccugcgagcaaauccaaccccgaagccacaaaccagccugucaccgagcaggaaauccugaauauuuuccagggcgugaucggcggggacaacauccggcuuaaucaaagauuuagcauuaccgcucagcugcucguucuguacuacauccugucuuaugaggaagcccuucuggcuaacacaaagacccucgccgcgaugcagcgcaaacccaaguccuacagcuccucucugauggaucaaauuccgaucaaauuccucauucggcaggcccagggacugcagcaagagcuuggcgggcugcauagcgcucuccugagacugcuugccacaaauuauccucaccuguguaucguggacgauuggauuugcgaggaagagaucacgggaaccgacgcucuccugcggcgcaugcuccugacaaacaaugccaagaaccauucccccaagcagcuucaggaagccuuuucugcugucccugugaaucacacccaggugaugcaaaucauugagcaucugacacuccugagcgcguccgaacugauccccuacgccgagguccuuaccucuaacaugagccagcugcucaauuccggcguuccuagacggauucugcagacggugaacaaacucuggauggugcugaauaccgucaugcccagacgccuuugggugaugacaguuaacgcucugcagccgagcaucaaguucgugcggcaacagaaauauacccagaaugaucugaugauugacccucucaucguccugagaugugaccaacgcgugcacagaugcccuccccuuauggauaucacacugcacaugcucaacggguaccugcucgccucuaaggccuaucuguccgcucaucuuaaagagaccgaacaggaccggcccagccagaacaauacgauuggccugguuggacagacagaugccccggaggugacccgcgaggagcugaagaacgcgcuccuggcugcccaagacucugccgcuguccagauccuucuggagauuugucuccccacagaagaggaaaaggccaauggcgugaacccugauucccugcucagaaauguucagagcgugaucaccaccucugcgcccaacaaagggauggaggaaggagaggacaaucugcuuugcaaccugcgggagguccagugucugauuugcugucuccugcaccaaauguacaucgcugauccuaauaucgccaagcuggugcauuuccagggcuaccccugcgaacugcucccucugacaguggccgggauucccuccaugcacaucugccucgacuuuauuccggagcugaucgcucagccugaacuugagaaacagauuuucgccauccaacugcugagccaccucuguauccaguaugcucugcccaagucccuuagcgucgcccgccuggcgguuaacgugaugggaacgcuccugaccgugcugacacaggccaaaagauacgccuuuuucaugccuacccuccccucucuugucagcuuuugccgggcuuucccgccucuguaugaagauauuaugucccugcucauccagauuggccaagugugugcuucugacguugccacacagacccgcgauaucgaccccauuaucacgagacugcagcaaauuaaggagaagccuagcggguggucccagaucugcaaagauucuagcuacaagaauggcucccgggacacaggaucuauggaccccgaugugcagcuuugucauugcaucgagcgcaccgucauugaaaucauuaacaugagcguguccggcaucuga

SEQ ID NO: 70821 - RNA, 3129 nt, Artificial Sequence
  derived and/or modified sequence opt5 from INTS3__Homo_sapiens__NP_075391
auggagcugcagaagggcaaaggggccgcugccgcggcugccgccagcggagcugccggcgggggaggcgggggagcuggcgccggcgcgcccgggggaggcagacuccugcuuuccaccucucuggacgccaaggaugaacucgaggaacggcuggagcgcugcaugagcaucgugacauccaugacggcuggggucucugaaagagaggccaacgacgcucuuaaugccuacguuuguaaaggacugccucaacacgaggaaauuugccucggccuguucacccugauccucacagagccggcgcaggcccagaaguguuaucgggaucuggcucuugugagccgcgacgggaugaacauugugcugaauaaaaucaaccagauucucauggaaaaguaccugaagcugcaagauaccugcagaacacagcuggucuggcucgugcgggagcugguuaaauccggagugcugggcgccgacggcgucuguaugaccuuuaugaagcagaucgcugggggagaugugacagccaaaaauaucuggcucgccgagucuguucuggacauucuuaccgaacagcgcgagugggugcuuaagagcuccauccucauugcuauggcggucuauacguaccugagacuuaucguggaucaucacggcaccgcccaacugcaggcucuccggcagaaagaaguggacuucugcauuagccugcugcgcgagagauuuauggaaugucucaugaucgggcgggaucugguccgccuucugcagaacguugcccggauucccgaguucgagcuccuguggaaggacaucauccauaauccucaagcccuuucuccccaguuuacaggcauucugcagcuccugcaauccagaaccagccgcaaguuccuggcuugcagacucacaccugauauggaaaccaaacugcuuuuuaugacgucucgggugagauucggccagcagaagcgcuaucaggacugguuucaacggcaguaccuguccacacccgacagccagucucucagaugugaucugauccgcuauauuugcggggugguccacccuuccaacgaggugcugagcuccgacauccuuccgcggugggccauuaucggauggcuccugaccacauguaccucuaauguugcggcuagcaacgccaaacuggcccucuucuacgauuggcuguuuuucucccccgacaaggauagcaucaugaauauugaaccugcuauccuugugaugcaucacucuaugaaaccccacccugccauuaccgcuacacugcucgacuuuaugugcagaaucauucccaacuucuacccgccucuggagggccauguccgccagggcguguucuccagccugaaucacaucguugaaaagcgggugcuugcccaucucgcgccccuguuugauaacccuaaacuggacaaggagcucagagccaugcugcgcgagaaguuccccgaauuuugcucuagccccuccccuccggucgaggugaaaaucgaggaacccgucucuauggaaauggauaaucacaugagcgacaaggaugaguccuguuaugacaacgcugaggccgcuuucagcgacgaugaagaggaccuuaacucuaaagggaagaaacgggaauuuagauuccacccuauuaaggagacggugguugaggaacccguggauaucaccccuuaccuggaccaacucgaugagucccugcgcgacaagguccugcagcuucagaaaggaagcgauacagaagcccagugcgaggugaugcaagaaauuguugaccaggugcucgaggaggauuuugacucugaacagcuguccguccuggcgagcugucuccaggagcuguucaaggcccauuuucggggcgaagugcuucccgaggaaaucaccgaggagucccuggaagagucuguggggaaaccgcucuaucugauuuucagaaaucugugccaaaugcaggaagauaacagcuccuuuucucuucuccuggaccugcucagcgagcuguaccagaagcaaccuaaaaucggauaucaccuucuguacuaucuccgggcuuccaaggccgcugccggcaagaugaaucuguacgagagcuucgcccaggcuacacagcugggggaucuucauaccugucugaugauggacaugaaagcgugccaggaagacgauguucgccuccugugucaccucacgcccucuauuuacacagaguuuccugacgaaacccugagauccggcgagcuucugaacaugaucgucgccgugaucgauagcgcucaacuccaggaacuggugugccaugucaugaugggaaaucuggugauguuccggaaggacucuguucuuaacauucugauccagucccucgauugggagaccuucgagcaguauugugccuggcaacuguuucucgcccacaauauuccccuggaaacaaucauuccuauccuucagcaccugaaauacaaggagcaucccgaagcucucagcugccugcugcuucagcugagacgcgagaaaccgucugaagagauggugaagaugguccucagccggccuugucaccccgacgaucaguucaccacauccauccugagacauuggugcaugaagcacgacgagcuccuggccgaacacauuaaaagccuucugaucaagaacaauucucugccccgcaaaagacaaucccuccggagcuccucuagcaagcuggcgcagcuuacgcuggagcagauucucgaacaucuggauaaccuccgccugaaucuuaccaacacaaaacaaaacuuuuucucccagaccccuauccugcaggcucugcagcacgugcaagccucuugcgacgaggcccauaagaugaaauuuagcgaucucuucucccuggcugaagaguaugaggacucuagcacaaagccgcccaaguccagacggaaagccgcgcuuagcucuccucgcuccagaaagaaugcuacccagcccccuaaugccgaagaggaaagcggaucuuccagcgccucugaggaagaggauacgaaacccaagccuaccaaacggaagcgcaagggguccagcgcuguuggauccgacagcgacuga

SEQ ID NO: 70822 - RNA, 2892 nt, Artificial Sequence
  derived and/or modified sequence opt5 from INTS4__Homo_sapiens__NP_291025
auggccgcucaccugaagaaaagaguguacgaggaguucaccaaggucguucagccccaagaggaaaucgccacaaagaagcuccggcugacgaaaccuagcaaguccgcggcccuucauauugaccugugcaaggcuaccucuccggccgaugcucuccaguaucugcuucaguuugcccgcaaacccguggaggcugaaagcguggagggcgucgugagaauccugcucgagcacuacuauaaggaaaacgacccuuccguucggcugaaaauugccucucugcucgggcugcuuagcaagacagcgggauucucccccgauuguaucauggacgaugccauuaauauccugcagaacgagaaaucucaucaagugcucgcucagcugcuugacacccugcucgccaucggcacaaagcugccugaaaaucaggcuauucagaugcgccuggucgauguggccugcaagcaccucaccgacacaagccaugggguuagaaacaaaugucugcaacuucugggaaaucucggcucccuggaaaagagcgugaccaaagaugcggaggggcuugccgcucgggacguccagaagaucauuggagauuacuuuucugaccaggauccccgcgugagaacggccgcuaucaaagccaugcugcagcuccacgaacggggccugaagcugcaccaaaccauuuauaaccaggccugcaaacuccuguccgacgacuacgaacaggugcgcagcgcugcgguccaacuuaucuggguugugucucagcuguauccugaauccauugugccgauccccagcucuaaugaggaaaucagacucgucgaugacgccuucggcaagauuugucauaugguguccgaugggagcuggguugugcggguccaggcugccaagcugcuuggauccauggaacaggugucuagccacuuucuggagcaaacacucgacaaaaagcugauguccgaucugcgcagaaaacggaccgcccaugaacgcgcuaaggagcucuacagcucuggcgaguucuccagcgggagaaaauggggagacgaugccccuaaggaggaaguugacacaggcgcggugaaccugaucgagucuggggcuugcggagccuuuguccacggccuugaggaugaaauguacgaggugcggauugccgcugucgaagcccuguguaugcucgcucagagcucccccucuuucgccgagaagugccuggacuuucugguggauauguucaaugacgaaaucgaggagguuagacuucagagcauucacaccaugcgcaaaaucuccaacaauaucacgcuccgggaagaccagcuggauacagugcuggcgguccucgaggacagcucuagagauauucgcgaagcccugcaugagcuucuguguugcaccaacguguccacaaaggagggcauccaccucgcucugguugaacugcuuaaaaaucucaccaaguauccuaccgaccgggauagcauuuggaaaugucugaaguuucuggggucuagacaucccacacucgugcugccgcuugucccugagcugcucuccacgcaccccuucuuugacaccgccgaaccugauauggacgaucccgcuuacaucgccgugcuggugcugauuuucaacgcggccaagacaugccccaccaugccugcucuuuucagcgaccauacauuucgccacuaugccuaccuccgggauucccugucucaccugguuccggcucucagacugcccggacgcaaacuugucagcuccgccgugucuccuagcaucaucccccaagaggacccuucccagcaguuccugcagcaaagccucgaacggguguauucucugcagcaucuggauccccagggcgcccaggagcuucucgaguuuaccauuagagaccugcaacgccugggggaacuccaguccgagcuggcuggagucgcggacuucagcgccacguaccuucggugccagcugcuccugaucaaggcucugcaagaaaaacuuuggaauguggccgccccgcuguaucucaagcagucugaucuggcuuccgccgcggcuaaacagauuauggaggaaacauacaagauggaguuuauguacagcggcguugagaacaaacagguggucaucauucaccauaugagacuccaagccaaagcccugcagcuuaucgugaccgcucggaccacacgcgggcuggacccucucuucggaaugugugaaaaguuucugcaggagguugauuucuuucagagauauuucauugccgaccugccccaccuucaagauucuuuuguggacaaacugcucgaucugaugccucggcucaugaccagcaagcccgcggaagucgugaaaauccugcagacaaugcuuagacaguccgcuuuccugcaccucccucugcccgagcagauccauaaggccagcgccacgauuaucgaaccggcuggcgagucugacaacccucugcgcuuuaccuccggccuuguuguggcccuggaugucgacgcuacacucgagcacgugcaagauccccagaauaccgugaaaguccagguucuguaccccgacgggcaagcccagaugauucauccuaagccggcggauuuccggaaccccggaccuggcagacaccgccucaucacacagguguaucugagccauaccgccuggacggaggcuugccagguggaggucagacuucugcuggccuacaauuccucugcucggauucccaaguguccuuggauggaagggggagagaugagcccccaaguggagaccuccaucgaaggcacaaucccuuucucuaaacccguuaagguguauauuaugccgaaaccugcccgcagauga

SEQ ID NO: 70823 - RNA, 3060 nt, Artificial Sequence
  derived and/or modified sequence opt5 from INTS5__Homo_sapiens__NP_085131
augagcgcccugugcgacccgccuggcgcuccggggcccccuggacccgccccugcgacccacggccccgcuccucucuccgcccaggagcugucucaagaaaucaaggccuuccuuacagggguggauccgauucugggacaucagcucagcgcuagagagcacgcccgguguggccugcuucugcuccgcucccugcccccugcuagagccgcgguccuggaccaucuccgcgggguuuuugaugaaucugugcgggcccaccuggcugcccuugacgagacgcccguggcuggaccuccccaucugagaccgccucccccuagccacguccccgccggcggccccgggcucgaagaugugguucaggaggugcagcaaguccuguccgaguucauccgggcgaacccuaaagccugggcuccggugauuucugccuggagcaucgaccuuaugggacagcuguccagcaccuacucuggccagcaccagcgcguuccccaugcuacaggggcccucaaugaacugcugcaacucuggaugggaugcagagccacccggacacugauggauauuuaugugcagugucuuuccgcucugaucggcagcugcccugacgcgugugucgaugcccuccuggacaccucugugcagcacagcccccauuuugauuggguggucgcucacaucggguccucuuucccuggaacaauuaucucccgcguucuuagcugcggccugaaggacuuuugugugcacggcggggccggaggcggggccggauccucuggcgggagcuccagccagacccccucuacggauccguucccuggaucccccgcuauuccugccgagaaaagagugcccaagaucgcgagcgucgugggcauucucggccaucuggcuucucggcacggggacagcauccgcagagaacugcuccggauguuucaugacucccuggccggaggcucugggggacgcagcggcgauccuucccuucaagccaccguucccuuccugcuccagcuggcugugaugagcccggcccuucuggggacagucucuggcgagcucguggacugccugaaaccucccgcuguucugucccagcuccaacagcaucugcagggauuucccagagaggaacuugauaacaugcugaaucucgccgugcaccuggucagccaggcgucuggcgccggggcuuaccggcugcuucaauuccucguggacaccgccaugccugcuuccgucauuacaacccagggacuggccgugccggauacgguuagagaggcgugugaccgccugauccagcuccugcuucugcaccuccagaagcuggugcaccaucggggcgggagccccggagaaggcguccuggggccucccccucccccuagacuugugcccuuucucgaugcccugaagaaccacguuggcgagcugugcggagaaacacuccgccuggagcggaaaagauuccuuuggcaacaucagcugcucggccugcuguccguguauacccgcccgucuugugggccugaggcucuuggacaccuccugagccgggccagaucccccgaggagcugucucucgcuacacagcuguacgccggccuugucgugagccuguccgggcuccugccucuggccuuucgcagcugccuugcucgggugcacgcgggaacccuccagcccccguucaccgccagauuccugcgcaaucuggcucuccugguuggcugggaacaacaagggggcgagggaccugccgcccuuggcgcucauuuuggggaaucugccuccgcgcaccugagcgaccucgcuccccugcugcuucauccugaggaggaagucgccgaggccgcugccucucugcucgcgaucugccccuuccccuccgaagcucugagcccuucucagcuccugggacuugugcgggccggcgugcacagauuuuucgccagccugcggcuccaugggccgcccggagucgcuuccgccugucagcugcugacacgccuuagccagacgucuccugcuggccugaaggccgugcuccagcugcucguugagggggcgcugcacagaggcaacaccgaacuuuuuggaggccagguggauggggacaaugagacacuguccgucgugagcgccucccucgcuucugccagccugcuggauaccaaccggagacacacagcugccguucccggaccuggcgggauuugguccguguuccaugccggagucaucggccgcggccuuaaacccccuaaguuugugcaaucucggaaucagcaggagguuauuuauaacacccagagccugcucucccugcucgugcacugcuguucugcucccgggggaacggaaugcggcgaguguuggggagcgcccauccugagcccugaagccgcuaaagccgucgccgugacacuuguggaguccgucugccccgacgcugccggggcggagcuggcuuggccucccgaggagcaugccagagccaccguugaacgcgaccugagaauuggccggcgcuucagagagcaaccgcuccuguuugaacuucugaagcucguggcugccgcgccucccgcucuguguuacugcagcgugcuccugcgggggcuucuggccgcccugcucggacacugggaggcuucucgccaucccgauaccacacacuccccuuggcaccuggaggccagcuguacccuugucgcugugauggccgaaggcucucugcugcccccugcgcucggcaauaugcaugagguuuucucccagcucgccccguuugaagugagacugcuucugcugagcgucuggggguuccuccgggagcacggaccccugccucagaaguuuaucuuccagucugaacgcggcagauucauccgggacuuuucccgcgaagggggaggcgaagggggaccccaucuugcugugcugcacagcguucuccacagaaacauugaucggcugggccucuucuccggcagauuucaagccccuagccccucuacacugcuucgccaggggacguga

SEQ ID NO: 70824 - RNA, 2625 nt, Artificial Sequence
  derived and/or modified sequence opt5 from INTS6__Homo_sapiens__NP_001035026
augaaccagagaagccaccugggcaccacauaccucgacacggccaagggggcuguggagaccuucaugaaacugcgggcccgcgaucccgcguccagaggagaccgguauaugcuugucacauuugaagaaccuccguacgcuaucaaggccggcuggaaagaaaaucaugccaccuucaugaacgagcugaagaaucuccaagcugaagggcugacaacccuuggacagucucugcgcacagccuuugaucuccugaaccugaauagacucguuaccggcauugacaacuaugggcagggacggaaucccuucuuucuggagccugcuaucauuaucacgauuaccgauggcagcaaacuuacaaccacauccggcgugcaggacgagcugcaccucccccugaacucuccucuucccgggagcgaacugaccaaggagccuuuccgcugggaucaaagacucuuugcccuggugcugcggcucccgggaacgauguccgucgaaucugagcagcugacaggcgugccccuugacgauagcgcgaucaccccuaugugcgagguuacagggggacgcuccuacagcguguguucucccagaaugcugaaucagugccucgaaucccugguccagaaggugcaaagcggcguugugaucaacuucgagaaagccgggccugaccccucuccggucgaagauggacagccugacauuucccggcccuuuggcagccagccuuggcauucuugucacaaacuuaucuaugugcgccccaaucccaagaccggcgugccuauugggcauuggccgguccccgaguccuucuggccugaucagaacagccccacccugccucccagaacaucccacccgguugugaaguuuucuugcacggacugugaaccuauggugaucgacaaacuccccuucgauaaguacgagcuggagccuagcccccugacccaauuuauucucgaacggaaguccccucagacaugcuggcaggucuaugugagcaauucugcuaaauacuccgagcugggacaccccuucggcuaccuuaaggccagcaccgcucugaacuguguuaaucucuucgugaugccguauaacuacccuguccugcuuccccugcucgacgaucuguuuaaagugcauaaggccaaacccacacugaaguggcgccaaucuuucgaaagcuaucucaaaaccaugccuccguacuaucuggggccccuuaagaaggcgguuagaaugaugggagccccuaaccugaucgcugacuccauggaguacggccucucuuauagcgugauuuccuaccugaaaaagcugagccagcaggccaaaaucgaaucugaucgggucaucggguccgugggaaagaaagucgugcaggagacgggcauuaagguuagaagccgcucucacggccuuuccauggcuuaccggaaggacuuucaacagcuccugcaggggaucagcgaggaugugccccauagacugcucgaccugaauaugaaagaauauacaggauuccaggucgcccuucugaacaaggaucucaaaccucaaaccuuucgcaaugccuacgacauuccccggagaaaccugcuggaucaccuuacccgcaugcgguccaaucuccugaagucuacaagacgcuuccugaaaggccaggacgaggaccaggugcacagcguuccuaucgcucagauggggaacuaucaagaauaccucaaacaggugcccuccccgcugcgggagcuugauccugaccagcccagacgccugcauaccuuuggaaauccuuucaagcucgauaagaagggcaugaugauugacgaagcggaugaguuugucgccgggccccagaacaaacacaagcggccgggcgagccuaauaugcaaggaauccccaaaagacggcgcugcaugucuccucugcugagaggccggcagcagaaccccguggugaauaaccauaucgggggaaaggggcccccugcuccgacaacgcaagcccagcccgaccuuauuaagccucucccccugcacaaaaucagcgaaaccacaaaugauuccauuauccaugacguugucgagaaccacguggccgaucagcugagcucugacauuaccccuaaugcuauggauacagaguucuccgccagcucucccgcgucccuccuggagagaccuaccaaccacauggaggcucuuggccaugaccaccugggaacgaacgaucucaccgugggcggguuucuggaaaaucaugaggaaccgcgcgacaaggagcagugugccgaagagaacauccccgccagcucucugaauaaaggcaagaaacuuaugcacugccggagccacgaggaagucaacacagagcucaaggcucaaaucaugaaagaaauuagaaagccuggacgcaaguaugagagaaucuucacccugcugaaacaugugcagggcucccuccagacacggcugauuuuucuucagaauguuaucaaggaagccagccgcuucaaaaagagaaugcugauugagcaacucgagaacuuccuggacgaaauccaccggcgcgcuaaucagauuaaccauaucaauucuaacuga

SEQ ID NO: 70825 - RNA, 2742 nt, Artificial Sequence
  derived and/or modified sequence opt5 from INTS7__Homo_sapiens__NP_001186738
auggccagcaacuccaccaagucuuuccuggcugacgccggcuacggggagcaggaacucgaugcgaauagcgcucugauggagcuugacaaaggacugagauccggcaagcucggggaacaaugcgaggccgugguccgguuuccccgccuguuccagaaauauccuuuuccgauccuuauuaacucugccuuccugaagcucgcugauguuuuuagagugggaaugcugggcagccuggccuccaucauucccgaacggaaaaaugcucaccauucuauccgccagagccucgacucccacgauaacguggaggucgaggccgcgguguucgccgcugccaauuuuagcgcucagucuaaggacuucgccguugggauuuguaacaagaucuccgaaaugauccaaggacuggcgacaccuguggaucuuaaacugaagcucauucccauccugcagcauaugcaccaugacgccauucuugcuagcucugccagacagcugcuccagcaacuggucacguccuacccuagcaccaaaauggugaucguuucucugcacacauuuacccuccuggcugccuccagccuuguggauacacccaagcagauucagcugcuccugcaguaucuuaaaaaugacccucggaaggccgucaagcgccuggcuauccaagaucucaaacugcuggcgaacaagaccccgcacacaugguccagagagaauauucaggcccucugcgaaugugcucugcagacccccuacgacucucuuaaacugggcaugcucagcgugcuguccacgcuuagcggcaccaucgccaucaagcauuauuucucuauugugccugggaacgucuccagcucuccccggagcuccgaucugguuaaacucgcccaagagugcuguuaccacaauaaccgcggaaucgcugcccauggcgugagagugcugacaaauauuaccgucucuugccaggagaaggaccugcucgcgcuggaacaggacgcuguguuugggcuugagagccugcucguucuguguucccaggaugacagcccuggagcccaagccacacugaaaaucgcucuuaacugcauggugaagcucgccaagggccggccccaccugucucaguccgucguggaaacccugcucacgcagcugcacagcgcucaggaugccgcgcgcauucuuaugugucauugccuggccgcuaucgccaugcaacucccgguucugggggacggaaugcugggcgaucuuauggagcucuauaaagugaucggcagaucugcuacagacaagcagcaggaacugcuggucucccucgccaccgugauuuucgucgcgagccagaaagcccuguccguggagucuaaggcuguuaucaaacaacagcuugagagcguguccaauggguggacagucuaccggauugcccgccaggcuucuagaaugggaaaccacgauauggccaaggaacuguaccagagccuccugacccaaguggccuccgagcauuuuuauuucuggcugaacagccuuaaggaguucucucacgcugaacagugucucaccggccugcaggaagagaauuacuccagcgcgcugucuugcaucgccgagucccucaaauuuuaucauaaggggauugcuagccugacagccgccucuacgccucuuaacccccugagcuuccaaugcgaauuuguuaaacuccggaucgaccugcugcaggcuuucucccagcuuaucuguaccugcaauagccucaagacaucuccuccucccgccauugcgaccacaaucgcuaugacccugggaaacgaucugcagagauguggccgcauuuccaaucaaaugaaacagagcauggaggaauuucggucccucgccucuagauacggggaccuguaucaggccagcuucgaugcugacuccgccacgcuucgcaacguggagcugcagcaacagucuugccuccugaucagccacgcgauugaagcucugauccuugaccccgaguccgccucuuuucaggaguacggaagcacaggcaccgcccacgcugauuccgaauaugagcggagaaugaugagcgucuacaaucaugugcuggaagagguggagucucucaaccgcaaguacaccccgguuuccuauaugcacacagccugucugugcaaugcuauuaucgcccuccugaaggucccccuuagcuuccagcgguacuuuuuccaaaaacugcagucuaccuccaucaagcucgcgcugagcccuucucccagaaacccugccgaacccauugcugugcagaauaaccaacagcuggcccuuaaaguggagggcgucgugcagcauggguccaagccgggacuguuucgcaaaauccagagcguuugucucaauguguccagcacacugcaaucuaagagcggccaggacuauaagauuccuaucgauaacaugacgaaugaaauggagcagcgggucgaaccccacaacgacuacuucuccacccaguuucuccugaacuucgcuauucuugggacacacaauaucaccguggagucuagcguuaaagaugccaacggaaucguguggaagacaggcccuagaaccacgauuuucgucaaaucccuggaggaccccuauucucaacagauccgccuccagcagcaacaggcccagcagccucugcaacagcagcaacagcggaaugcuuacaccagauuuuga

SEQ ID NO: 70826 - RNA, 2988 nt, Artificial Sequence
  derived and/or modified sequence opt5 from INTS8__Homo_sapiens__NP_060334
augagcgccgaggcugccgacagagaagcggcuaccuccucucggcccugcacaccuccgcagacguguugguucgaguuucugcucgaagagagccugcuugaaaagcaucugcgcaaacccugcccugaucccgccccugugcaacucaucguccaguuccuggagcaggccuccaagcccucuguuaacgagcagaaucaagugcagccuccgcccgacaacaaaagaaaucggauucuuaagcugcucgcucugaaaguggccgcucaccugaagugggaucucgacauccuggaaaagagccuuuccgucccugugcugaacaugcuccugaaugagcuucuguguauuucuaaaguucccccuggcaccaagcacguggauauggaccucgccacacugcccccgaccacagcgauggccguccugcucuacaaccgcugggcuaucagaaccauugugcagagcuccuuuccuguuaaacaggccaagcccgggccuccccaacugagcgugaugaaucagaugcagcaggaaaaagagcuuacagagaacauccugaagguccucaaggaacaagcugccgauucuauccuggugcuugaggcggcccugaaacucaauaaggaccuguaugugcauaccaugcggacgcuggaucuccuggcuauggaacccggaauggucaacggcgagaccgaauccagcacagccgggcuuaaaguuaagaccgaggagaugcagugccagguguguuacgaccugggagcugccuauuuccaacagggcucuacaaauuccgccguguacgaaaacgcucgcgagaaauuuuucagaaccaaggaacucauugcggagaucgggagccugucucuucacugcacgauugaugaaaaacggcuggccggauauugucaggcuugcgacguccucgugccuuccagcgauuccacaucucagcaacugaccccguacagccagguucauaucugucugcgcuccggcaauuaucaggaggugauucagaucuuuauugaggacaaccucacacugagccuucccguccaauucagacagucugugcugcgggaacucuuuaagaaggcccagcagggcaaugaggcccuggacgaaaucugcuucaaaguuugugcuugcaacaccgugcgcgauauccuggaggggagaaccauuuccguccaauuuaaccagcuuuuccuccggccuaauaaggagaaaaucgacuuucugcuggaagugugcagccgcucugucaaccucgagaaggccagcgaaucccugaaaggaaauauggcggcuuuccuuaagaacgugugucugggccucgaggaucugcaguacguuuucaugauuucuagccacgaacuguuuaucacacuucucaaggacgaggagagaaaacugcugguggaucagaugcggaagagaagcccccgcgucaaucucugcauuaaaccugugacguccuucuacgacauccccgccucugccuccguuaacaucgggcaacuggaacaccagcuuauucugagcguggauccguggcggaucagacagauucucaucgagcugcauggaaugaccucugaacgccaauuuuggacagucuccaauaagugggaggugccuagcguguauuccggcguuauucuggggaucaaagacaaccuuacccgggaucucgucuacauccugauggcuaagggacugcacuguucuacagugaaggacuucagccaugccaaacagcucuuugcugccugccuggaacuugugaccgaguucucccccaagcugagacaggucaugcucaaugagaugcugcugcuugauauucacacgcacgaagcgggcacaggccaggccggggagcgcccucccucugaccucaucagccgggugagaggauaucuggaaaugcgccugccugacauuccccuccggcaaguuaucgcugaggaauguguggccuuuaugcugaacuggagagagaaugaguaccuuacccugcaggucccggcuuuccuccugcaguccaacccuuaugugaaacugggccagcuucuggccgcgaccugcaaggaacuccccgggcccaaagagagccgccggacagccaaggaucugugggaaguugugguccaaauuuguucuguguccagccagcauaagagaggaaaugacggccggguuucucucaucaaacagcgcgaguccacccuggggauuauguacagaagcgaacuucugucuuuuaucaagaaacuccgggagccucuggugcugacaaucauucuuagccuguucgucaagcuccacaacgugagagaggauaucgugaaugacauuacggcugaacauaucuccauuuggccgagcucuauccccaaccugcaguccgucgauuuugaggccguugcuaucaccgugaaagaacucgugcgcuauacacugagcauuaacccuaauaaccacuccuggcuuaucauucaagccgacaucuacuucgccaccaaucaguacucugcugcgcugcauuauuaccuccaggccggagcugucugcagcgacuuuuucaacaaggccgugcccccugauguuuauacagaucaagugauuaaacggaugaucaaguguugcucccugcugaauugucacacccaggucgccauccuuugccaguuccugagagagauugacuacaagacggcuuuuaaaucucuccaggagcaaaacagccacgaugccauggacuccuauuacgauuauaucugggacgugaccauucuggaauaccucacauaccugcaucacaagcgcggcgagaccgacaaaagacagaucgcgauuaaggcuaucggccagacagaacuuaaugccucuaaccccgaggaaguucugcagcuggccgcucaacggcgcaaaaagaaguuccuccaggccauggcgaaacuguauuuuuga

SEQ ID NO: 70827 - RNA, 2829 nt, Artificial Sequence
  derived and/or modified sequence opt5 from INTU__Homo_sapiens__NP_056508
auggccagcguggcuuccugcgacucuagacccagcuccgaugagcugccuggcgacccgucuagccaggaagaggaugaagacuacgauuucgaggaccgggucuccgauucugggagcuauuccagcgccucuuccgacuacgaugaccucgaacccgaguggcuggauagcguucaaaagaacggagagcuguuuuaucuggaacucucugaggacgaagaggagucccugcuuccugaaacccccacagugaaucacgugcgcuucagcgagaacgaaaucauuaucgaggaugacuacaaagaaagaaagaaauaugagccuaagcugaaacaguuuacgaagauucuccggcgcaagagacugcugcccaaacgguguaauaagaaaaacucuaaugacaacggcccugucuccauccucaagcaucagagcaaucagaaaaccggggugauuguucaacagcgcuacaaggaugugaacgucuaugugaauccgaagaaacugacaguuaucaaggcgaaagagcagcuuaagcugcucgaagugcuggucggaaucauucaccagaccaaaugguccuggagacggacaggcaagcaaggggacggagagcgccuuguggugcauggccugcuccccggcgggucugcuaugaaaagcggacagguccugaucggcgauguucugguggccgugaacgacgucgaugugaccacagaaaauauugagagaguucucuccugcaucccugggcccaugcaagugaagcugaccuucgaaaacgccuacgacgucaagcgggagacgagccacccucgccagaaaaagacccagucuaauacauccgaucuugugaaacugcucuggggagaggaaguugagggcauucagcagagcgggcugaacacaccccauaucauuauguaccuuacccugcaacucgacucugaaaccagcaaggaggaacaggagauccuguaucacuacccgauguccgaggcuucucagaaacuuaagagcgugagaggaaucuuucucacgcugugugauaugcuugaaaaugucacaggcacccaggugacauccagcucucugcuccugaacggcaagcaaauucacgucgccuauuggaaagaguccgacaaacuucugcucaucgggcugccugcugaagaggugccccugccucggcuccgcaacaugauugagaauguuauccagacccugaaauucauguacggaagccuugauucugccuuuugccagauugaaaacgugcccagacuggaccauuucuuuaaucucuucuuucagcgggcgcugcaacccgccaagcugcacuccagcgcuuccccuucugcccagcaguaugacgcuagcuccgccguccuucucgauaaccugccgggcgugagauggcugacccucccccuggagaucaaaauggaacuugacauggcgcugucugaucucgaggccgcugacuucgccgaacugagcgaggauuacuaugacaugcgccggcuguacacaauccuuggguccagccucuuuuacaagggauaucugauuuguucucaucugccuaaggaugaccucaucgauauugcuguuuacugcagacacuauugucugcuuccccuggccgccaaacagcgcaucggccaacucauuaucuggcgggagguguucccucagcaccaucugagaccccuggcugacuccagcacggaagucuucccggagccugaagggcgcuacuuucuucucguggugggacugaagcacuauaugcugugcguucuccuggaggcgggcggcugugccucuaaagcuaucgggucccccggaccugauugcgucuacguggaccaggugaagaccacacuucaucagcuggauggcgucgacagccggauugacgaaagacucgccucuagccccgugccuugucuguccugcgccgauugguuccugaccgggagccgcgagaaaacagacucucuuaccacgucccccauccucagccggcugcaaggaacauccaagguugcuaccucuccgaccugcagacgcacacuguuuggcgauuauagccucaagacccggaaaccuucccccucuuguagcuccgggggcucugacaauggaugcgagggcggggaagaugacggauucagcccccacacaacgccugaugccgugagaaagcagcgggagucccagggcagcgacgggcuggaagagucuggaacccuucugaaagucacaaagaaaaaguccacccucccgaaccccuuucaucugggcaaucugaaaaaggaucuuccugaaaaggagcuggagauuuacaacacagugaaacucaccagcgggcccgaaaauacgcuguuccacuacguugcgcucgagaccgugcaaggcaucuuuauuacaccuacccuggaagaggucgcucagcuuucuggauccauccacccccagcugauuaagaacuuccaucaguguugccucagcauccgcgccguguuucaacagacacugguugaggaaaagaagaaaggccuuaauucuggggaccacuccgauagcgccaaguccgugagcucucugaacccugucaaggagcauggagugcuguucgaauguagccccggcaauuggaccgaccagaaaaaggcuccgccugugauggccuauugggucguugggagacucuuucugcaccccaaaccucaggagcucuacgugugcuuccacgauuccgugacggaaaucgcuauugagaucgccuuuaagcuguucuucggacuuacacuguga

SEQ ID NO: 70828 - RNA, 3198 nt, Artificial Sequence
  derived and/or modified sequence opt5 from INVS__Homo_sapiens__NP_055240
augaacaagagcgagaaucuccuguucgccggcuccucucuggcuagccaggugcacgccgcggcugucaacggggacaaaggagcccuucaaagacugaucguuggcaauuccgcccucaaggauaaagaagaccaguuugggcggacaccccugauguacugcgugcuugcugaucgccuggacugugccgaugcucuccugaaggccggagcggacgugaacaaaacagaucauucucagagaacggcccugcaccucgcugcccagaagggcaauuaucgguucaugaagcugcuucugacccgcagagcuaacuggaugcaaaaagaccucgaggaaaugacaccucugcaucuuaccacacggcaccgcagcccgaagugccuggcccuccugcugaaauuuauggcgcccggggaggucgauacccaggacaagaauaaacagacagcccuccauugguccgcuuacuauaacaauccugaacacgugaagcugcuuauuaagcacgauucuaacaucggcauucccgacguugagggcaaaaucccucugcauugggccgcuaaucacaaggaucccagcgccgugcauaccgucagauguauucucgacgccgcuccuacggagucccugcuuaacuggcaggacuacgaaggccggaccccgcugcacuucgcgguggccgaugggaauguuacaguggucgacgugcucaccagcuaugagucuugcaacaucacauccuacgauaaucuguuucgcacgccccugcacugggcugcccuccugggacaugcccaaaucgugcaccuucugcucgaaagaaacaaaagcggcaccauuccuucugacucccagggggcuacaccccugcauuaugccgcgcagagcaacuucgcugagaccgucaagguuuuucuuaaacacccuucugugaaggaugacuccgaucuggagggacggaccagcuucaugugggccgccggcaaaggguccgacgaugugcuccgcaccaugcugucucucaagagcgacaucgauauuaauauggcugacaaguacggaggcaccgcccugcaugcugccgcgcuguccggccacgucagcacagugaaacuucugcucgaaaacaaugcccagguugacgcuacggaugugaugaagcacacaccccuguuuagagccugugagauggggcauaaagacgucauccaaacccugauuaagggaggcgcucggguggaucuuguugaccaggaugggcacucucuccugcauugggccgcgcugggaggcaacgccgacgugugccagauccucauugaaaauaaaaucaacccgaauguccaagauuacgcugggcgcaccccucugcagugugccgcuuauggaggcuacaucaacugcauggccgugcuuauggagaauaacgccgaccccaauauucaggauaaggaaggcagaacagcucugcacugguccuguaacaauggguaucucgacgcgaucaagcugcugcuugauuucgccgcuuuuccuaaccagauggagaauaacgaggaacgguacacgccccucgacuaugcccugcugggagagagacacgaagucauucaauucaugcucgagcauggcgcccugagcaucgcugccauucaggauaucgcggcuuuuaaaauccaggccguguacaagggguauaaaguucgcaaggccuuccgggaccgcaaaaaccuucugaugaagcacgaacagcucagaaaggacgcugccgcgaaaaagcgggaggaggaaaauaaaagaaaggaggcugaacaacagaaaggacgccggucucccgauagcugcagaccucaggcccugccgugucugcccuccacccaggacgugccuucucgccaaagccgggcccccuccaagcagccucccgcuggcaacgucgcccaggggccggagccuagagauagccgcggcucucccggaggcucccuugggggagcucuccagaaggaacaacaugugagcucugaccugcagggcacaaauucccggagaccuaacgagaccgcccgggagcacagcaaagggcaguccgcgugcguucauuuccgccccaaugaaggaucugauggcagcagacacccuggggugcccuccgucgagaagucucggggcgaaaccgccggagacgagagaugcgcuaaaggcaagggguuugugaaacaaccgagcuguauucgcguggccggaccugaugagaagggcgaagacucccggagagcugccgccagccugccgccccacgauucucauuggaaaccuucccgcagacacgacacagagccgaaggcuaagugcgcgccccagaaacggcgcacccaggaacucagagggggacgguguagcccugccggaucuucccgccccgggagcgcuagaggcgaggccguucaugccggacagaacccuccccaccaucggacaccucgcaauaaggucacgcaagcuaaacugaccggcgggcuuuacucucaucugccccagagcacagaggaacucagauccggagcccggcgccuggagaccagcacacugucugaagauuuccagguguccaaggagaccgacccggcgccuggcccccuuagcgggcaguccgugaacaucgaucuccugccugucgaacugagacuccaaauuauccagcgggagagacgccggaaagaacuguuuagaaagaagaauaaagcugccgccgugauucagcgcgcuuggcggucuuaccagcuuagaaagcaccugagccaccuccgccacaugaaacaacugggagccggcgacguugaccgguggagacaggaguccacggcgcugcuucuccagguguggcgcaaggagcuggaacugaaauucccccaaaccacagcugucucuaaggcccccaagagcccuuccaaagggaccucuggcacaaagagcaccaaacauuccgugcucaagcagaucuauggaugcagccacgagggcaaaauccaccaucccacgcggucuguuaaggccuccagcgugcugagacuuaacucugucuccaaucugcaguguauucaccuccuggaaaacagcgggcggucuaagaauuuuuccuacaaccugcagagcgcuacacaaccuaaaaauaagaccaaacccuga

SEQ ID NO: 70829 - RNA, 831 nt, Artificial Sequence
  derived and/or modified sequence opt5 from IP6K1__Homo_sapiens__NP_001006115
augcuggacggcaacagcgggcucuccucugagaagaucagccacaaucccuggucccugagaugccauaaacagcaacuuucucggaugcgcagcgaauccaaggauagaaaacuguacaaguuccuccugcuugagaacgugguccaccauuuuaaauauccuuguguucuggaccucaagaugggaacccggcagcacggcgaugacgccucugcugaaaaggccgcgcgccagaugagaaaaugcgagcagagcacauccgcuacgcugggggugcggguguguggaaugcaagucuaccagcuggauaccggccauuaucucugccgcaauaaguacuaugggagaggacugagcauugaaggcuuccggaacgcccuuuaccaguaucugcacaauggccucgaccugcgcagagaucuuuuugagccgauccugucuaaacuccgggggcugaaggccgugcuggagcgccaggcuuccuacagauucuacucuagcucccuccugguuauuuaugacggaaaagaaugucgggccgagagcugccuugaucgcagaucugaaaugcggcugaagcaccucgacauggugcugcccgaggucgcuuccagcuguggcccuuccacaucucccagcaacaccuccccugaggccgggcccagcucucaaccuaagguggauguuagaaugaucgacuuugcgcauuccacauucaaaggauuucgcgaugacccgaccgugcacgacggccccgaucggggguacgucuucggacuugaaaaucugauuagcaucauggagcagaugagagacgaaaaccaguga

SEQ ID NO: 70830 - RNA, 294 nt, Artificial Sequence
  derived and/or modified sequence opt5 from IP6K2__Homo_sapiens__NP_001005911
augagccccgccuucagagcuauggacguggagccucgggccaagggcguccugcucgaaccguuuguucaucaggucgggggacauuccugcgugcugcgcuucaacgagaccacacuuuguaaaccccuggugccuagagaacaccaauuuuacgagacgcuccccgcggaaaugcggaaguucaccccucaguauaaaggccagucucagcgcccccuggugagcuggccuucccuuccgcacuuuuuccccuggucuuuuccucuguggccccaagggagcguugcuuga

SEQ ID NO: 70831 - RNA, 1233 nt, Artificial Sequence
  derived and/or modified sequence opt5 from IP6K3__Homo_sapiens__NP_001136355
auggugguccagaacagcgccgacgcuggcgauaugagagccgggguucaacuggagcccuuccuccaccaggugggaggccauauguccgugaugaaguacgacgaacacaccgucugcaaaccucuggugucucgggagcagcgcuuuuaugaaagccuuccgcuggcgaugaagagauucacaccccaguacaaagggacgguuaccgugcaucucuggaaggauuccacaggacaccugucucuugucgcuaauccugugaaagagagccaagaacccuuuaagguuuccaccgagucugccgccguggcuaucuggcagacacugcagcagaccacaggcagcaacggguccgacuguacccucgcccaauggccucaugcucagcuggcccggagccccaaggagucuccugcgaaagcccugcuccgcuccgaaccgcaccugaauacgcccgcuuucagccuugucgaggauaccaacggaaaucagguggaaagaaagucuuuuaacccuuggggccugcagugccaccaagcccaucucacacggcuguguuccgaguaucccgagaauaaacgccacagauuccuucugcucgaaaacguggucagccaguacacccauccuugcguucuggaccugaagaugggcacacggcagcacggggaugacgcuucugaggagaaaaaggcccgccacaugagaaagugugcgcaauccaccagcgccugccucggagugcggauuuguggcaugcaaguguaucagacggauaaaaaguacuuucugugcaaagacaaguauuacgggcgcaaacuuuccgucgaaggauucagacaggcucuguaccaguuucuccauaauggcucucaucugcggcgcgaacuucuggagcccauccuccaccagcugagagcccugcucagcgugauucggucccagagcucuuauagauucuacuccagcucucugcuuguuaucuaugaugggcaggagccgccugaacgcgcucccggaagcccucacccccaugaggcuccccaagccgcccacggcuccucuccuggcgggcugacaaagguggacauucggaugaucgauuuugcgcacaccacauacaaaggauauuggaacgaacauaccaccuacgacggcccggaccccggguauaucuucggacucgagaaucugauuagaauccuucaggauauucaggaaggcgaguga

SEQ ID NO: 70832 - RNA, 1317 nt, Artificial Sequence
  derived and/or modified sequence opt5 from IPCEF1__Homo_sapiens__XP_005266979
augaccagcuacauggccaucgacggcuccgcucuccaggugccccugagacaaaagccucggcgcaaaacacagggguuccugacgaugucuagacggcgcauuagcugcaaggaucuuggacacgccgacugucagggcuggcuguauaaaaagaaagagaagggguccuuucucucuaacaaguggaaaaaguucugggucauccugaaaggaagcucccuuuacugguauucuaaucagauggcggaaaaggcugauggcuuuguuaaccugccggacuucaccguggagagagccagcgaaugcaaaaagaagcaugccuuuaaaauuucccacccccaaaucaagacauucuacuuugcugccgagaaugugcaggaaaugaacgucuggcucaauaaacuggggagcgcugugauucaucaggagucuaccacaaaggaugaggaauguuauuccgagagcgaacaggaggacccugagaucgccgcggaaacacccccucccccucacgccucucaaacacagucccugaccgcucagcaggccucuucuuccagcccgucccucucuggaacgagcuacuccuucagcucucuggagaacaccguuaaaacacccuccagcuuuccuucuagccuuuccaaggaacggcaaucucugcccgauaccgugaauagccucuccgcugccgaggacgaaggccagccuaucacauucgcgguccaggugcauagccccguuccgucugaggccggcauucacaaagcucuggagaacuccuuugugaccagcgaaucuggguuccuuaauucccugagcuccgaugacacgucuagccucuccucuaaccacgaucaucugacagucccugacaagcccgccggaagcaagaucauggauaaagaggaaaccaagguguccgaggacgacgaaauggagaaacuguauaagagccucgagcaagcuagccuguccccucuuggcgaucgcagacccagcaccaaaaaggaacugcggaagucuuuugugaaacgcugcaagaaucccuccauuaacgagaaacuccacaagaucagaacccugaauagcacccuuaaauguaaggaacaugaccuggccaugauuaaccagcuccuggaugacccuaagcugacagcccggaaauaccgcgaguggaaggucaugaauacgcuccugauccaggauauuuaccagcaacagagagcuucuccggcgcccgacgauaccgacgauacaccucaggaacuuaaaaagagccccuccagcccuucuguugagaacuccaucuga

SEQ ID NO: 70833 - RNA, 1251 nt, Artificial Sequence
  derived and/or modified sequence opt5 from IPMK__Homo_sapiens__NP_689416
auggccaccgagcccccuagcccgcugagaguggaagcucccggcccucccgagaugcggacauccccugccaucgaaucuacgcccgaggggaccccucagccggcgggaggccgccucagauuccugaacgggugcgucccccuuagccaccaaguugcuggacauauguacggcaaggacaaaguggggauucugcagcacccugauggaacagugcucaagcagcugcagcccccuccccggggcccgcgcgaacuugaguuuuauaauauggucuacgccgccgacuguuucgauggcgugcugcucgagcugagaaaauaucugccuaaguacuaugggaucuggucucccccuaccgcucccaacgaccucuaccugaaacuugaagauguuacacauaaguuuaauaagcccugcauuauggacgugaaaaucggacaaaaguccuaugauccuuucgccagcuccgagaaaauucagcagcaggucucuaaguacccgcugauggaagagaucggcuuucucgugcuggggaugcggguuuaccacgugcauagcgacuccuaugagaccgaaaaccaacacuacggacgcagccuuacaaaagagaccaucaaggauggcgucucuagauucuuucacaauggguauugucugcggaaggacgcuguggccgcguccauucagaaaaucgaaaagauucuccagugguucgagaaccagaaacaacugaauuuuuacgccagcucucuccuguucguguaugaaggauccagccagcccacgaccacaaagcugaacgaucgcacccuugcugagaaauuucugucuaagggccagcucuccgacacagagguccuggaauacaauaacaauuuccauguucuuagcuccaccgccaacggcaaaaucgagucuagcguggggaagucccugagcaagauguaugcuagacaccggaaaauuuacacgaagaaacaucacucucaaacaucccucaagguggaaaaucuggagcaggauaacggauggaaaagcaugucucaggaacaccugaauggcaacguccucagccagcuggagaagguguuuuaccaucuuccuaccgggugccaagagaucgccgaaguugaggugcgcaugauugacuucgcgcacgucuuccccuccaacacaaucgacgaaggauauguguacggccugaagcaucucaucucuguucugagaagcauucuugauaauuga

SEQ ID NO: 70834 - RNA, 3048 nt, Artificial Sequence
  derived and/or modified sequence opt5 from IPO11__Homo_sapiens__NP_001128251
auggugcagcccaucauucaccugggcuacgucguuuauagccuccuguaccuuggguauaagccugugcaacaugugaccgcccugaacacagucuccucuugccacaaaauggugagcauggaccucaauuccgcuucuacgguugugcugcagguccuuacccaggccacaagccaggauaccgcggugcugaagccggcugaggaacaacucaaacagugggagacacagcccggauucuacuccguucugcugaacaucuuuaccaaucauacacucgacauuaacgugagauggcuggccguccuuuauuucaagcacggcaucgaucgguacuggcgcagaguggccccucaugcucugucugaagaggagaaaaccacgcuccgggccgggcugauuaccaauuuuaacgagcccaucaaucagaucgcuacacaaauugccgugcuuaucgcgaaggucgcccgccuggacuguccuagacaguggcccgagcucauuccuacccugaucgaaagcguuaaggugcaggaugaccugcggcagcaccgcgcucuccugacauucuaucacgugaccaaaacgcuugccuccaagagacuggcugccgaucggaaacucuuuuacgaccuggcgagcggaauuuacaacuucgccugcucucuuuggaaucaucacacagauaccuuucugcaagaggucuccagcggcaacgaagcugccauccucucuucccuggagcgcacacugcucagccugaaggugcuuagaaaacugaccguuaauggguucguggagccgcauaagaacauggaagucaugggauuucuccacggcauuuucgagcggcugaagcaguuucuugaauguucucgcuccaucggcaccgacaaugugugcagagaucggcuggagaaaacaaucauucucuucacgaagguucugcuggacuuucucgaucagcaccccuucagcuucaccccucugauccaacgcucccuugaauuuucugugagcuaugucuucacagaggugggggagggagucaccuuugaaagauucauugugcaguguaugaaccugaucaaaaugauuguuaagaauuacgcuuauaaacccuccaagaacuuugaggacagcucuccugaaacacucgaggcccauaaaaucaagauggccuucuuuaccuaccccacgcugacagaaaucugccggagacuggugucccacuauuuccuucucaccgaggaggaacugaccaugugggaggaagacccggagggcuuuacagucgaagagaccgggggagauagcuggaaguacucucugcgcccuuguacagagguucucuucauugacaucuuucaugaauauaaccagacgcugacccccgugcuucuggagaugaugcagacacuccaaggcccuaccaauguggaagauaugaacgcucugcugauuaaagacgcggucuacaaugccguggggcuugcugccuacgaacucuucgauagcguggacuuugaucagugguucaagaaccagcugcugcccgagcuccagguuauccacaaucgguauaaaccccugagacgccgggucauuuggcuuaucggacaauggaucuccgugaaguucaaaucugaccugagaccuaugcucuacgaagccauuugcaaccugcugcaggaucaggaccuugugguccgcaucgagacagcuaccacgcucaagcugaccguggaugacuuugaguuccggacagaccaguuucugccguaucucgagaccauguucacacugcuuuuucaacugcuccagcagguuaccgaaugugauacgaagaugcaugugcugcacguccugagcugcgugauugagagaguuaauaugcagauccgccccuacgugggcugucuuguccaauaucucccucugcuguggaaacaguccgaggaacacaacaugcuccggugcgccauucugacaacccuuauccaucuggugcagggccucggggcggacagcaagaaucuguaccccuuccugcuuccuguuauucaacugucuacagaugugucccagcccccgcacgucuaucuccuggaggacggacucgaacuguggcuugugacccuggagaacagcccuugcaucacccccgaacuccugagaaucuuucagaauaugucuccucugcuugagcuguccagcgagaaccuccgcacauguuucaaaauuaucaauggcuacauuuuucuguccucuacggaguuccuccagaccuacgcuguggggcugugccagagcuuuugugaacuucugaaggaaaucacaaccgagggacaaguccagguucucaaagugguggaaaacgcccugaaggucaaucccauucugggcccucagauguuccaacccauccuuccguauguguuuaaggggaucauugagggagagcgguacccuguugugauguccacauaucugggcgucaugggcagagugcuccugcagaacaccucuuucuucagcucccuccugaacgaaauggcccauaaauuuaaucaggagauggaucagcuucuggggaacaugaucgaaauguggguugaccggauggauaauauuacgcaacccgagcgcagaaagcugagcgcucucgcccugcuuucucugcuccccuccgacaacagcgugauccaggauaaauucugcggaauuaucaauaucucugucgagggccugcacgacgugaugacagaagauccugagaccgggaccuacaaggacuguaugcucaugucccaccuggaagaaccgaaaguuacagaagaugaggagcccccuaccgaacaggacaagcggaagaaaaugcuugcucugaaggaccccgugcauacagucagccugcaacaguuuauuuaugagaaacucaaggcccagcaggaaaugcugggagagcaaggcuuccagucucuuauggaaacgguggauaccgagaucgugacacagcugcaggaguuucuccaaggguucuga

SEQ ID NO: 70835 - RNA, 1989 nt, Artificial Sequence
  derived and/or modified sequence opt5 from IPO13__Homo_sapiens__XP_011540763
auggaaaccagccacggcaucugcagaauugccguggcucugggggaaaaccauucccgggcccuccuggaccaggucgagcacuggcaaucuuuccuugcgcugguuaauaugaucauguuuuguacaggcauucccggacauuacccugugaacgaaacgaccagcucccucacacugaccuucugguauacacuucaggaugacauccugucuuuugaggcugaaaagcaggccguguaccagcaagucuaucgcccgguguacuuccagcucguugaugugcugcugcacaaagcccaguuucccagcgacgaggaguauggguucugguccucugaugaaaaggagcaguuuagaauuuaccgggucgacaucagcgauacccucauguauguguacgaaaugcugggagcugagcuucuguccaaucucuacgacaaacugggccgccuucugacaagcucugaggaaccuuauuccuggcaacauaccgaggcccuccuguacggguuccagagcaucgcugaaacgauugauguuaacuauucugacgugguccccggacugaucggccucauuccuagaaucuccauuagcaaugugcagcuggccgauaccgugauguuuacaaucggcgcgcuuucugaguggcuggccgaccaccccgucaugauuaacuccguucucccucuggugcuucacgcucuggggaauccggaacucagcguguccucugucagcacccugaagaaaaucugccgggaguguaaguacgaucugcccccuuaugccgcuaacaucguggccguuucccaggacgugcucaugaagcaaauucauaaaacaagccagugcauguggcugaugcaggcgcuuggauuccugcucucugcccugcaagucgaggaaauccuuaagaaucugcacucccucauuagccccuacauccagcagcuggagaaacuggcugaagagauuccuaaccccucuaauaagcucgccaucgugcauauccugggccuucugagcaaccucuuuaccacgcuggacauuucccaccacgaagaugaccaugaggggccggagcugcgcaaacuuccuguuccccagggaccuaaucccguggucgugguccuccaacagguguuccagcugauccagaagguucugucuaaguggcucaacgaugcucaaguggucgaagccgugugugccauuuuugagaaaagcguuaagacacugcuugacgauuucgcucccauggugccucagcugugcgaaaugcucggcagaauguauuccaccaucccgcaggcgagcgcccuggaccugacacggcagcuuguccacauuuucgcucaugagcccgcccacuuuccucccaucgaagcccucuuccugcuggugaccucugugacccucacacuguuucaacaggggccucgcgaucaucccgacaucguugauuccuucaugcagcuucuggcucaggcccucaaaagaaagccggaccuguuucugugugagcggcuugaugucaaagcgguguuccaaugcgcugugcucgcccugaaguuuccugaggcccccacggucaaagcuagcuguggauucuuuaccgaacugcucccucgcugcggcgagguggaaucuguuggcaaggugguccaggaggacgggagaaugcugcuuauugccgugcuggaggcuaucggaggccaggccucccggagccucauggacuguuucgcggauauucuguuugcccugaauaagcacugcuucucccuucucucuauguggaucaaagaagcucugcaacccccuggguuucccagcgcccgccuguccccggagcagaaggacacauucucucagcagauucucagagaacggguuaacaaaagacgcgugaaggagauggucaaagaguucacccugcuuugccggggacugcacggcacagauuacaccgcugacuacuga

SEQ ID NO: 70836 - RNA, 3117 nt, Artificial Sequence
  derived and/or modified sequence opt5 from IPO7__Homo_sapiens__NP_006382
auggaccccaacaccaucauugaggcccugagaggcacaauggauccugcucuccgggaagccgcggagcgccagcugaaugaagcucacaagagccuuaacuucguguccacgcugcuccaaaucaccaugucugagcagcuggaccuuccggucagacaggccgggguuauuuaccugaaaaauaugaucacacaguauuggcccgaucgggaaaccgccccuggagacauuagccccuacacaaucccugaggaggaucgccauugcaucagagaaaacauuguggaggcuaucauucacucccccgaacucauccgggugcaacugaccacauguauucaucacaucauuaagcaugacuauccuucucgcuggaccgccaucgucgauaaaaucggcuuuuaccugcagagcgacaauuccgcuugcuggcucgggauucugcuuugucuguaucagcucgugaagaacuacgaguauaaaaagccggaggaaagaucuccccugguugccgcgaugcagcacuuccuuccugugcugaaggaucgguuuauccaacuccugagcgaccaguccgaucagagcguccugauucagaaacaaaucuucaagaucuuuuacgcccucgugcaguacacgcugccccuugagcugauuaaucagcaaaaccucaccgaauggaucgagauucugaaaacaguugugaaucgcgacgucccuaacgaaacccuucagguggaggaggaugacagacccgaacugccgugguggaagugcaaaaagugggcucuccacauccuggcccggcuguucgagcgcuauggaucuccuggcaauguguccaaggaauacaacgaguuugcugaagucuuccucaaagccuuugcgguuggggugcaacaggugcugcuuaagguccuguaucaguacaaagagaagcaguauauggcccccagagugcuccagcagacacugaauuacauuaaccaaggaguuagccaugcucuuaccuggaaaaaucugaagccucacauccagggcauuauccaggacgugaucuucccccucauguguuauacggaugccgacgaggaacuguggcaggaggaucccuacgaauacauucggaugaaauuugacgucuucgaggauuuuaucucuccuacaaccgcugcccaaacacugcuguucaccgccugcuccaagcgcaaggaagugcugcagaaaaccaugggcuucuguuaucagauucuuacagagccgaacgcugaccccagaaagaaagauggggcgcugcauaugaucggaagccucgccgagauucugcugaagaaaaagaucuacaaggaccagauggaauauaugcuucaaaaccacguuuuuccucucuucucuuccgagcugggcuacaugcgggcuagagccugcugggugcugcacuauuuuugugaagucaaauucaagagcgaucagaaucuccagacggcccuggagcuuacccgccggugccugauugacgauagagagaugcccgugaaagucgaagcugccaucgcgcuccaagugcugaucuccaaccaggagaaggcuaaagaauacauuacaccuuuuauccgccccguuaugcaggcccugcuucauauuauccgggagaccgaaaaugacgaccucacaaacgugauucagaagaugaucugugaguauucugaggaagucaccccgaucgccguggagaugacgcaacaccuggcuaugacauucaaucagguuauucagaccgggccugaugaagagggaagcgacgauaaggccgugaccgcuaugggcauccugaacacaauugacacccuccuguccgucguggaagaucauaaagagaucacacagcaacuugaggggauuugccuccaggugaucggaacgguucuccagcagcacguccuggaauuuuacgaggaaaucuucagccuggcccauucucuuaccugccaacaggugagcccccagauguggcaacuccugccucugguguuugaggucuuccagcaggacggcuuugauuacuucacagacaugaugccccuccugcacaauuaugugaccguugauacagacacccuucuguccgauacgaaguaccucgaaaugauuuauucuauguguaaaaaggugcugaccggcgucgcgggggaggacgccgagugccacgcugccaaacugcuugaagugaucauucuccaguguaagggaagaggcaucgaucaaugcauuccucuguuuguugaggcugcccuggaacgccucacacgggaggugaagaccagcgagcugagaacaaugugucuucaggucgcgaucgccgcucuguacuauaacccccaucuccugcugaauacccuugaaaaccugcgcuucccgaauaacguggagccuguuacgaaucacuucaucacacaguggcucaacgacguggacugcuuucuggggcuccaugaucggaaaauguguguccugggacuuugcgcccugauugacauggaacagaucccccaagugcucaaucagguguccggccagauucugcccgcuuucauccugcuuuuuaacgggcugaagagagccuacgccugucacgcugagcacgaaaacgauucugacgaugacgaugaggcggaggacgaugacgaaaccgaggaacucggaagcgaugaggacgauauugacgaagacggccaggaguaucuggagauccucgccaaacaagcuggcgaagauggggacgaugaggacugggaagaggaugacgccgaagagacagcccuggagggauacuccaccauuaucgaugacgaagauaauccugucgacgaguaccagaucuucaaggcuauuuuucagaccauccagaaccgcaauccgguuugguaucaagcccuuacacauggccugaacgaggaacagcggaaacagcuccaagauauugcgacgcuggcugaccagagacgggccgcccacgagagcaagaugaucgaaaaacaugggggauacaaguucucugcucccguggugccuuccagcuuuaauuucggcgggcccgccccuggcaugaacuga

SEQ ID NO: 70837 - RNA, 2499 nt, Artificial Sequence
  derived and/or modified sequence opt5 from IPO8__Homo_sapiens__NP_001177924
auggagagccugacccucaagggcuacgcccugccccuucagcuggugaacaaucagacaaugacgaccuggauggaaaucuucagaacaauuaucgaccggaccgucccuccggagacacuccacauugaugaagacgaucgccccgagcugguuugguggaaaugcaagaaaugggcucugcauaucguggccagacuguuugaacgguauggguccccuggaaacgugaccaaggaguacuucgaguuuucugaguucuuucucaaaacauaugcggucggcauucaacaggugcugcugaagauccucgaccaguaccgccaaaaggaauauguugcucccagagugcugcagcaggccuucaauuaccuuaaccagggggucgugcacagcaucaccuggaaacaaaugaagccucauauucagaauaucuccgaagauguuaucuuuucugugauguguuauaaagacgaggaugaggaacuguggcaggaggaccccuacgaauacauucggaugaaguucgauauuuuugaggacuaugccagcccuacgaccgcugcccagacacuccuguacaccgcugccaaaaagcgcaaggaaguccuuccgaaaaugauggcguucugcuaucaaauccugacagaucccaacuuugacccuagaaagaaagauggagcccuccacgugauuggcucccuggcugagauccugcucaagaaaucucuguucaaggaccagauggagcuuuuucugcagaaucauguguucccccuccugcuuagcaaccugggguaccuccgggcccgcuccuguuggguccugcacgcuuucagcucucugaaauuucacaaugaacucaaccugagaaaugccguugagcuugcgaagaagucccugaucgaagacaaagagaugccugugaagguggaagccgcucucgcccugcaaagccuuauuucuaaccagauccaggcuaaagaguauaugaagccccauguccggccgauuaugcaggagcugcuccacaucgugcgcgaaaccgagaaugaugacguuacgaacgugauucagaaaaugaucugcgaauacucccaggaggucgccagcaucgccguggauaugacacagcaucuggcugaaauuuucggaaagguucugcagucugacgaguaugaggaaguggaggauaagaccgucauggcgaugggcauccuccacacaauugacaccauccugaccguggucgaagaucacaaagagauuacacaacagcuugagaauaucugucugagaaucauugaccucgugcugcagaagcauguuaucgaauuuuacgaggaaauucugucccuugccuacagccucacgugccacuccaucucuccucagauguggcaacugcugggcauucucuaugagguguuccagcaggauuguuuugaauacuucaccgacaugaugccccugcuucauaacuaugucacaaucgauaccgacacacugcucagcaacgcuaaacaccuggagauucuguuuaccaugugccggaaggugcuuuguggggacgccggagaggaugccgaaugccaugcugccaaacuccuggagguuaucauccugcaguguaagggccgcgggauugaccaaugcaucccucucuucgugcagcugguccuugaaagacugacgcggggagugaagacauccgagcucagaaccaugugccuucagguggcgauugcugcccuguacuauaaucccgaucuucuccugcacacccuggaacgcauccaacucccccacaacccuggcccgauuacaguucaguuuaucaaucaguggaugaacgacaccgauuguuuccuggggcaucacgaccggaaaaugugcaucauuggacuuagcauccugcucgagcugcagaauagacccccugccgucgaugcuguggugggccaaauuguccccucuauccuguuucuuuuccucggccugaaacaggugugugccacacgccagcugguuaaccgggaggacagauccaaggcugaaaaggccgauauggaggaaaaugaggaaauuagcucugacgaggaggaaacgaacgugaccgcgcaggccaugcaaagcaauaacgggcgcggagaggaugaagaggaggaagacgaugacugggacgaggaaguccucgaggaaacagcucuggagggcuuuuccaccccucuugaucuggacaauucuguggaugaguaccaguucuucacacaggcccucaucaccguucagagccgggacgcugccugguaucaacugcugauggcgccccuuuccgaagaucagagaacggcccugcaggagguguacacccucgcugaacaucgccggacagucgccgaggcuaaaaagaagaucgaacaacaagggggauuuaccuucgagaacaaaggcgugcugagcgccuuuaauuucgggacaguuccgucuaacaauuga

SEQ ID NO: 70838 - RNA, 3126 nt, Artificial Sequence
  derived and/or modified sequence opt5 from IPO9__Homo_sapiens__NP_060555
auggccgcugccgcggcugccggcgccgcuagcgggcugcccggaccuguggcccagggccucaaggaggcucuggucgacacccuuacagggauccuguccccgguucaagaagugagagccgcggccgaggaacagauuaaagugcucgaggucacggaagaguucggagugcaccuggcugagcuuaccguugauccccagggcgcccuggcuauccggcagcucgccucugugauucugaagcaauacgucgaaacacauuggugcgcgcagagcgagaaauuucgcccucccgaaaccacagagagagccaagaucgugauucgggagcugcucccuaacgggcugcgcgaauccaucucuaaaguuagaagcuccguggcuuaugccgucucugcuaucgcccacugggacuggcccgaggccuggccucagcuuuucaaucugcucauggaaaugcuggugagcggagaucuuaacgcugugcauggcgcgaugcggguccugaccgaguuuacacgcgaaguuaccgacacgcagaugccgcucguggcccccgugauucugccugagauguacaagaucuucaccauggcugaggucuauggcauuagaacacggucccgcgccguggaaaucuuuaccacaugugcccacaugauuugcaauauggaggaacuggagaagggggcugccaaaguucucaucuuccccgugguccaacaguuuaccgaagcguucgugcaggcucugcagauuccugauggacccacgagcgacucuggcuuuaagauggagguucuuaaagccgugacagcccuggucaagaacuucccgaaacauaugguguccagcaugcaacagauccucccuaucgucuggaauacccugacagagucugcugccuuuuacgugagaaccgaaguuaacuauaccgaggaaguggaggaucccgucgacuccgauggggaagugcuuggauucgagaaucugguuuuuagcauuuucgaguucgugcacgcucuccuggaaaacucuaaguuuaaguccacagucaaaaaggcccugccugagcucaucuacuauauuauccuguacaugcagauuacggaagaacaaaucaaaguguggaccgcgaauccccagcaguucguggaggacgaagaugacgauacauuuagcuacaccguucggaucgccgcucaggaccuucugcucgccgucgcuacagacuuccaaaacgaguccgccgcggcccuggcugccgcugccacccgccaccuucaggaagccgagcagacgaaaaauucuggcacagaacauugguggaagauucacgaggcuuguaugcuggcgcucgggagcgugaaggccaucauuaccgauuccgugaaaaacggaagaauccauuuugacaugcacggcuuccugaccaaugucauucuggcugaucucaaccugagcgugucucccuuucuucugggccgggcccucugggccgcuucccgcuucacaguugccaugagcccugagcugauccagcaauuucugcaggcgaccgugucugggcuucacgaaacacagccgcccagcgucagaaucuccgcugugcgggccauuuggggauauugcgaccagcucaagguuucugagagcacgcaugugcugcaaccuuuccugcccuccauccucgauggccugauucaccuugccgcucaguuuagcucugaaguccugaaucucgugauggagacccuguguaucguuugcacaguggacccugaguucaccgccuccauggagagcaagauuugucccuuuacaaucgcgauuuuccugaaauacucuaacgauccggucguggcuucccuugcccaggacaucuucaaggagcucagccagaucgaagccugccaagggccuaugcagaugagacugauucccacccugguguccaucaugcaggcuccugccgauaaaauucccgcuggacucugugccacggcgaucgacauucugaccacagucguucgcaacaccaagccuccccuuucucaacugcucaucugccaggccuuuccggcuguggcccaguguacacugcauaccgaugacaaugcuacgaugcagaacggcggggagugccugcgggccuaugugagcgucacacuugaacaaguggcccaguggcacgacgagcagggacauaauggccucugguacguuaugcaaguggucucccagcugcuggauccuagaaccucugaguucacagcugcguuugugggccgccucguuagcacccugaucuccaaagccgggcgggaacuuggagagaaccuggaccagauucucagagcuauccugagcaagaugcagcaggccgaaacccugucugugaugcaaucccuuauuauggucuucgcccaccucgugcacacacagcuggagccccugcucgaauuucugugcagccuucccggcccuacggggaagccggcucuggaguucguuauggccgaguggaccucucgccagcaucucuuuuauggacaauacgaaggcaaaguguccagcgucgcgcuguguaagcugcuucagcacgggaucaaugcugaugacaaacggcugcaggauauuagagugaagggcgaggaaaucuauucuauggacgagggaauccgcacacggagcaaauccgccaagaaccccgaaagauggaccaauauuccucuccuggugaagauccucaaacugauuaucaacgagcuuagcaaugucauggaggccaacgcugcccgccaggcgacacccgcugaauggucucaagaugacuccaaugauaugugggaggaccaggaagaggaagaggaggaagaggaagauggccuggccgggcagcuccugagcgacauucuggccaccuccaaguacgaggaagauuacuaugaggacgacgaggaagaugacccugaugcucuuaaagacccccuguaccagaucgaucuccaagccuaucugacggacuuccucugccaguuugcucagcagccuuguuacaucauguucucuggacaucugaacgauaaugagcggagaguucuucaaacaauuggcaucuga

SEQ ID NO: 70839 - RNA, 1797 nt, Artificial Sequence
  derived and/or modified sequence opt5 from IQCB1__Homo_sapiens__NP_001018864
augaagcccaccggcacagaccccagaauccugagcauugccgcugagguggccaaauccccggaacagaacguccccguuauccuccugaaacuuaaagagauuaucaauauuacgccucuggggucuagcgaacucaagaaaaucaagcaagauaucuacugcuaugaccugauucaguacugucuucuggugcucucccaggauuauucucggauccagggaggcuggaccacaauuagccaacugacccagauccugucccacugcuguguggggcucgagcccggagaagacgcggaggaguucuacaacgaacugcuuccuucugcugccgagaauuuucugguccucggccgccagcugcagacaugcuucauuaacgccgcuaaggccgaagagaaagaugagcuucugcacuuuuuccaaaucgugaccgacagccucuuuuggcugcuugggggacacguugaacucauucagaaugugcugcaguccgaucauuuccuucaucugcuccaggcugacaacguccaaaucggcagcgccgugaugaugaugcugcagaauauccuucagauuaacucuggcgaucugcucagaaucgggcggaaggcgcuguauuccauucuggacgagguuaucuuuaaacucuucagcacacccucuccugugauucgcuccaccgccacgaagcugcuucugcucauggcugaaagccaucaagagauccugauccuucugagacagucuaccuguuacaaaggacuccggcgccugcuguccaagcaggaaacaggcaccgaguuuagccaggagcucagacaacuggucgggcuucuguccccgaugguguaucaggaaguggaggaacagaagcuccaccaggccgcuugccugauucaagccuacuggaaaggauuccagacacggaagcgccugaaaaagcugcccucugcggucaucgcccuccagcggagcuuucgguccaaacgcagcaagaugcugcuggagauuaauagacagaaagaagaggaggaucucaagcugcaacuucagcugcagcggcagcgcgcuaugagacucucucgggaacugcaacuguccaugcuugagaucguucacccuggccagguggaaaagcauuacagagagauggaagagaaaagcgcccucauuauccagaagcacuggcgcggguaucgggagagaaagaacuuccaucaacagcgccagucucugaucgaauacaaggcugccgugacccugcagcgggccgcucucaaauuucuggcgaaguguagaaagaaaaagaaacuuuucgcccccuggcgcggacugcaagagcucacggacgcucggagagucgaacugaagaaacgcguggaugacuauguucggagacaccugggcagcccuauguccgacguggucucucgcgagcuucacgcccaggcccaggagcggcuccagcauuacuucaugggcagagcucuggaagagagagcccaacagcaccgcgaagcgcugauugcucagaucagcacaaauguggagcagcucaugaaggcccccucccugaaggaagccgaggggaaagagccggaacuuuuucugagcagaucucggccuguugcugccaaggcuaaacaagcccaucucaccacacugaagcacauucaggcgcccugguggaaaaagcugggagaggaauccggcgaugagaucgacgugccuaaggaugaacuuagcauugagcucgagaaccuguucaucgggggaaccaaaccucccuga

SEQ ID NO: 70840 - RNA, 1332 nt, Artificial Sequence
  derived and/or modified sequence opt5 from IQCG__Homo_sapiens__NP_001127907
auggaggaagacagccuggaggauuccaaccugcccccuaagguguggcacucugaaaugaccgucagcguuacaggcgagccgcccuccacgguggaagaggaggggaucccuaaagaaaccgacauugagaucauucccgaaaucccugagacacuggagccccuuucucugccugaugugcucagaauuagcgccguccuggaagacaccacagaucagcuuuccauccugaauuacaucaugccggugcaauaugagggacggcagucuauuugcguuaagagccgcgaaaugaaccucgagggcaccaaucuggacaaacugcccauggcuuccacaaucaccaagauuccuagcccccucaucacggaagaggggccuaaccugcccgagauuagacaucggggacgcuucgccguggaauuuaauaaaaugcaggaucuugucuucaagaagccgaccagacagacaaucaugaccacagagacccugaaaaagauucaaaucgaccggcaguuuuucucugaugugaucgcggacacgauuaaagaacuccaggauuccgcuacauacaacagccugcuucaggcccugucuaaggagcgcgaaaauaaaaugcacuuuuaugacaucauugccagagaggagaagggccggaagcaaaucauuucccuccagaaacagcugaucaacguuaagaaagaauggcaguucgaggugcaaagccagaaugaauacaucgcuaaccugaaggaucagcuccaagagaugaaagccaagucuaaucuggaaaaccgcuauaugaaaaccaauacagagcuucagauugcucagacccagaagaaguguaacagaaccgaggaacugcucgucgaggaaaucgagaaacugcggaugaagacagaggaagaggcccgcacgcauaccgaaauugagauguuucuuagaaaagaacaacagaagcuggaggagcggcucgaguucuggauggaaaaauacgacaaggacacagaaaugaagcagaaugagcugaacgcgcugaaagccaccaaggcuuccgaucucgcccaccuccaggaccuugcuaaaaugauccgcgaauaugagcaagugauuaucgaggauagaaucgaaaaggagcggagcaaaaagaaggugaaacaggaccugcucgaacugaaguccgucauuaaacuucaggccugguggagagggacaaugauccgccgggagauuggaggcuuuaagaugccuaaagauaagguugacucuaaggauagcaaaggcaaggggaaaggaaaggacaaaagacgcggcaagaaaaaguga

SEQ ID NO: 70841 - RNA, 3084 nt, Artificial Sequence
  derived and/or modified sequence opt5 from IQCH__Homo_sapiens__NP_001026885
auggcccagaacaccgagaaucacgaccccgugggcagcauccugauucaaauccaugaagaucucuaccagcugaaggagaaacuuacaaaguucuccccugaagagaaaggggaaacgcuggacauucagucucucgagaccgcuaucaagagaacagaggucggacugcggauucacaucgaaaaauaucuuaacguugugaaucagaacgugcugaccacaagcgucaaugaugagucccucuacaccccgcaagccucuaaguggcugcugcccacagugaucgaccaaaagagcuuuauuuucccucaggaauccgagggcaccuuuuggcagccccagcgccagcauucuagcucccucccuguuuuccccagagcgaaaaucaaggugagcaaacugauuaaggggucuaacaucuccagccuuacgguccugccuucuucccacugcaccgauccguauuuuacacccauuccugugcuccaggcugacgcccauaaaggaauccugagcaugauugagcggggccuuauucccccuaccgcccgcaucacauuccagaaucccccgaucaccccuagagcugcuccccugcacucuuuugaugaagcccggaagaucccuacgguugccacauucaccauuccccgcgagcccccuccgucccccgcggaagugaaguuuuucccuaaaaagcaaagaagcaaagggaagucccggcgcucuagaggacaccaugaccggaaagccaugaaggucaaaacaccccuccgcgcucucaagagccugugggauuacgacuuucugaucuaugauggcgugauugacaacaccgccccugauuuccuggcuuuuaaggagcacuucucccuugccuggggcgggaucuucagccugcucgaacauguggagaaauuucugagaaauuacgcgauccccgaggucaagauuaaaggaaacaaucuuguugcccugcucccggaguucgaacugaccaacaagcugacacgguaugaccuccugucugugcuugaagacccugcucacgugcagaugcugaucaaucuccccggccagcgcuacaaagggcaagauggaaacuccgaggccgcuaugaagauucaggccacguggaaguguuacaaagccagaaaguuuuuccuguuuuaucggcagcagaaaugggcuagcggcgucaucgcgauugccuggcuucuguacugccacaagaccagacucaaaaagauccugaaggaaucucgccaacggcaucuggagaauuucagaauccgcgcuaaacaccucgccgccaacuggaaccggauuagaacaagccgccggaccaucauucauaucccuucccugggguauucucagcccgugagagagcacauugcugacuuuaauacacagcagaacaugcaacuuggacgccugugugauauccucgacgccaauguuaacgugauuuacaucugcagccaucacaugaaugaugaacugguccuguauuacaagaaaauccuuucccuccacgcggcuguuaagagcggcaaccuggaggaccggucugaucugcaggacagauucaaaauuaucaccccugaagccgugaauauuuuucccaagcaucacaugugucucgccacgcaucugauguauuccccgaaggcuaucaaacgcauuaagaaccuuauccggggcacagaggccuacaucgugagcgggcugcuccacagagaugaccuggcugucgccgauaugcuggacauuccuauccuuggaucugaacccgagcucgcgcaccuguacuccaccaaaagcggcgggaagcggguguucgacuccgccaaugucgcugugcccccuggaauuuaugauaucuacucucagcagcaaaugauugagcagcugagccagcucaucaccgaccaucugcagauccaacgcuggcuuuuuaaaauggauuccgaguucagaggcaacgggacagccuuuugcgacauuccgucuuaucugaaguguuacaaauggguucucaaggaaagcucccgguauggacuggaagauuggagaaagaaaugggcucaggagcccgcccuggugaagaucagcgaggaacuugcgggcauucucgcccagcacgcucaaccugucaaugagaaacgcuuccccaccuggcggaaguuccugcagacauuucugucucagggcggggugaucgaagccuucccucccgcugacaacguuacgaaucucaccguggauaugcugauugagccuaacggaaaaaucuccguccuuagcacaggcgaccagcugcaugccgaaucucccuuuaucuccagcgggaccacagugccgcaaaccucuguggauccucagguucucacguaccugugccugcagauuggaaaggccuguagaaugcgcgacgucgugggcuauuucagcaucgaucuugugaccuuuauugaccccuccacacucgagcagcaagucugggcuaccgggcugaaucuggcguacagcgaucagcucgcccugacacagcuuacccuguaccucacgaacggccaccuggacugcucucuguccacacuugaggugccuagauucguucccaaggaacggaaaaagaccaaauguaugagcgcucuguccaugccgaugcucgccacaucucgcuaugccgugaugaccacccagcugagacauagcaaccucucccuggucuuucacuacguguuccuucaaaucugccgggcucacggaauuggcuaugaccuggaggaacgccaggggacaguuuuuauccucuacgagcaucugaagagacacaaacugggaaugcuuacgauuggcgaagaucugcagggggugcucaugaccuucgcccggcaucuguuuaucauccaccaagagauuucugcgccuaauaugcagggagagacaaacuucaagaccacaaucgcugacauugaaaccauccuccgcgucacgaaggagaauaaaaugagauuugaagaggaacagcagagcaaggaugacaaaaaccuguccaagcccaaaaaguga

SEQ ID NO: 70842 - RNA, 480 nt, Artificial Sequence
  derived and/or modified sequence opt5 from IQCJ__Homo_sapiens__NP_001036170
augagacuggaggaacucaagcggcugcagaacccccuugagcaagugaaugacggcaaauacagcuucgaaaaccaccagcuggccauggaugcugagaauaacaucgaaaaguauccucucaaucugcagccgcuugaguccaaagucaagauuauccagcgcgccuggagagaguaccugcaacggcaggaaccccucgggaaacgcucuccuagcccucccuccguuucuagcgagaagcuguccucuagcguguccaugaacaccuuuagcgacucuuccacacccuucgcgagagcuccugugggaaagauucauccguauaucagcuggcggcugcagucucccggcgauaaacucccugggggacgcaaggucauucugcuuuaccuggaccagcucgccagacccacgggcuuuauccacacccugaaagaaccucaaaucgagcggcuuggguuccugacacuccaguga

SEQ ID NO: 70843 - RNA, 1692 nt, Artificial Sequence
  derived and/or modified sequence opt5 from IQCJ-SCHIP1__Homo_sapiens__NP_001184042
augagacuggaggaacucaagcggcugcagaacccccuugagcaagugaaugacggcaaauacagcuucgaaaaccaccagcuggccauggaugcugagaauaacaucgaaaaguauccucucaaucugcagccgcuugaguccaaagucaagauuauccagcgcgccuggagagaguaccugcaacggcaggaaccccucgggaaacgcucuccuucucccccuuccguuucuagcgagaagcuguccucuagcguguccaugaacaccuuuagcgacucuuccacacccgauuauagagaagacggaauggaucugggcagcgacgcggggucuuccagcagcuccagccgggcuuccucucagagcaauuccacgaaggugaccccuugcagcgaguguaaaucuuccagcucuccgggaggcagccucgaucuggucuccgcccuugaggacuacgaagaacccuucccuguguaucagaagaaaguuauugaugaaugggcccccgaggaagacggggaggaggaagaggaagaggaugaacgcgaccaaagaggauaccgggaugaccgcucuccugcuagagagcccggcgacgugagcgcccggacacgcuccggcgggggaggcgggagaagcgcuaccacagccaugccgccucccgucccuaacggaaaucugcaucagcacgauccccaggaccuccggcauaacggcaaugugguuguggcggggcgccccucuugcuccagaggaccucggagagccauccagaagccgcaacccgcuggcggccgccggagcgggagaggaccugccgcuggcgggcugugucuucagcccccugauggagggaccugcguccccgaggaaccgccugugcccccuauggacugggaggcccuggaaaaacaccucgcgggccugcaguuucgcgagcaagaagugcggaaccagggacaggccagaacaaauucuaccuccgcucagaagaacgagcgcgagagcauucggcaaaagcuggcccucggcuccuucuuugaugacggccccgggaucuauacgucuuguagcaaauccggaaagccuucucugagcuccagacuucagagcggcaugaaucugcagaucugcuucgucaacgauucuggguccgacaaagauagcgacgcugaugacucuaagaccgaaacaucccucgacacaccccugagcccgaugucuaaacagagcuccagcuacucugaucgcgacaccaccgaggaagaguccgagagccuugaugacauggauuuucugacgcggcaaaagaaacuccaggccgaagccaagauggcucuggcgauggccaagccuauggcuaaaaugcagguugagguggaaaagcagaaccgcaaaaagucccccguggccgaccugcucccccauaugccucacauuucugagugucugaugaaaagaagccuuaagccgacagaucugcgggacaugaccaucggacaacuccaggucauugugaaugaucugcacucccagaucgaaucucuuaacgaggagcugguucagcuccugcugauuagagacgaacuccauacagagcaagaugccaugcugguggacaucgaagaucuuacccggcacgcugagagccagcagaagcauauggccgagaaaaugcccgcgaaguga

SEQ ID NO: 70844 - RNA, 864 nt, Artificial Sequence
  derived and/or modified sequence opt5 from IQCK__Homo_sapiens__NP_694940
auggccgcucccagacagaucccuagccacauugugcggcugaagccguccugcucuaccgacagcuccuucacacgcacgcccgucccuaccguuucucucgccagcagagagcugcccguguccucuuggcaagugacagaaccuagcuccaaaaaccuuugggagcagaucuguaaggaauacgaggcggaacagcccccuuuuccggagggcuauaaagucaagcaggagcccgugauuaccguugcuccuguggaagagaugcuguuccauggguuuagcgccgaacacuacuuccccgucucucauuuuacaaugaucucccggaccccuugcccccaagauaaaagcgagacaauuaauccgaagaccuguucuccuaaggaguaucucgaaacguucaucuuucccgugcugcuuccuggaauggccucccugcuccaccaggcuaaaaaggagaaaugcuucgaacgcaagagaaccaaauuuaucgccugugacuuccugacagaguggcuguacaaccagaaucccaagcgggcuggcgaacccuuuaccgaguucuuuagcauuccuuucguugaggaacgccucaagcagcauccgagacccccuaucccccugucucuucugcucacagaggaagaggccgcgcuguauauucaauccuucuggcgggccugcgugguccgcugugauccugaaauccaggagcuuagacaguggcagaaaaagcugcgggaggcuaaacacauucaccaacaggugaagaucuuuugggccaaacaggaacaaaaggugaaaugcaagauggaggacgaugcuguccccgccgcgaagaugaaaauuccgagcuccuga

SEQ ID NO: 70845 - RNA, 4974 nt, Artificial Sequence
  derived and/or modified sequence opt5 from IQGAP1__Homo_sapiens__NP_003861
augagcgccgcugacgagguggauggccugggggucgccagaccccacuacggauccguucucgacaacgaacggcugaccgcggaggaaauggaugagcgcagacggcagaauguggcuuaugaauaccuuugccaucuggaggaggccaagcgcuggauggaagccugucucggcgaggaccugccuccgacaacggaacuugaggaggggcugagaaacggaguguaucucgcuaaacugggcaauuucuuuucucccaaggucgugagccugaaaaagaucuacgaucgggaacaaacccgcuauaaagccacagggcuccacuucagacauaccgacaacguuauucaguggcugaaugcuauggaugagaucggacuuccuaagaucuuuuaccccgaaacaaccgacaucuaugaucggaagaacaugccucgcugcauuuacuguauccacgcccugucccucuaccuguucaaacuuggccuggcgccccagauccaggaccucuauggcaagguggauuuuacagaggaagagauuaauaacaugaaaaccgagcuggaaaaguacgggauccaaaugccugccuucucuaaaauuggaggcauccuggcuaaugagcucagcgucgacgaagccgcucugcaugccgcggugauugccaucaacgaggcuauugauagacggaucccggccgacacguuugcugcccuuaagaaucccaacgccaugcugguuaaucucgaagaaccucuggcuuccaccuaucaggacauccuuuaccaggcgaagcaggauaaaaugacaaacgccaagaaucgcaccgagaacucugaaagagagcgggacguguaugaggagcugcucacacaagcugaaauucaggggaacaucaauaaagucaacaccuucagcgcccuggccaauauugaucuggcucucgagcagggagacgcccuggcgcuuuuucgcgcucugcagucccccgcccucggccugagagggcuucaacagcagaacagcgauugguaccugaagcaacuccugucugacaaacagcagaagcggcaguccggacaaacggauccucugcagaaagaggaacuccagagcggcguggacgccgcuaauucugccgcucagcaauaucagagacgccuggccgcgguggcccuuaucaacgcugccauucagaagggcgucgcugagaagacaguucuggaacucaugaaucccgaggcccagcugccgcaaguguacccuuucgcggccgaucuguaccagaaagagcuugcuacccuccagcggcagucccccgaacacaaccugacacacccugagcugagcguggccgucgaaaugcucucuuccguggcucugaucaauagagcccuugagagcggggacguuaacaccguguggaagcaacuguccucuagcgucaccggacucacaaauaucgaagaggagaacugccagcgcuaucuggaugaacugaugaaacuuaaggcccaggcucaugcggagaauaacgaauuuauuacguggaaugacauccaagccuguguggaccacguuaaccucgugguccaggaggaacaugagcggauucuggcuaucggccugauuaacgaggcccucgaugaaggggacgcccagaaaacccugcaggcccuucaaauccccgcugcgaagcuggagggagugcucgcugaagucgcccagcacuaccaggauacacugaucagagccaagcgcgagaaagcucaggaaauucaagacgaguccgccgugcuguggcuugaugagauccagggcgggauuuggcagagcaauaaggacacccaggaagcgcaaaaauucgcucucggaaucuuugccauuaacgaggccguugaaucuggcgaugugggcaagacacuguccgcucugcggagccccgacgucgggcucuauggagugaucccugagugcggcgagaccuaccacucugaucuggccgaagcuaaaaagaagaaacuugccguuggggacaauaacagcaagugggugaaacauugggucaagggaggcuauuacuauuaccacaaucuggagacgcaggaagggggcugggaugagccgcccaacuucgugcaaaauuccaugcaacucucuagagaagagauucagagcuccaucagcggagugacagcggccuacaaccgcgagcagcuguggcuggcuaaugaaggccuuaucacccggcuccaggccagaugucgcggguaucugguucggcaagaguucagaucucggaugaacuuucugaaaaagcagauuccugcuauuaccugcauucagucccaguggcgcggauacaagcagaaaaaggccuaucaggacagacucgccuaccugcggagccauaaagaugaagucgugaagauccagucucuugcuagaaugcaccaggcgcgcaaacgguauagagaccgccugcaauacuucagagaccauauuaaugauaucaucaagauucaggccuuuauccgggcuaacaaagcccgcgacgauuauaagacacucauuaaugccgaggaucccccuaugguggucgugagaaaguucguucaucugcuggaccaguccgaccaggauuuucaagaggaacuugaccugaugaaaaugcgggaggaagugaucacccucauucgcagcaaccagcagcuggagaaugaucucaaccugauggacaucaagaucggccuucuggucaaaaacaagauuacacuccaagaugugguuucccacucuaaaaagcugacgaagaaaaauaaggaacagcugagcgacaugaugaugaucaacaaacagaaagggggacuuaaggcucuguccaaggagaagagagaaaaacucgaggccuaccagcaccuguucuaccuccugcaaaccaaucccacauaucuugcgaagcugauuuuucagaugccgcagaacaaaucuaccaaguucauggauagcgugaucuuuacacucuacaauuaugcuuccaaccagcgggaggaauaccugcugcuucgccuguucaaaaccgcccuccaagaggaaauuaagagcaaggucgaccagauccaggagaucgugacgggcaauccuaccguuauuaaaaugguggucucuuuuaacagaggggcccggggccagaaugcucugcgccaaauccucgcccccguggugaaggagauuauggacgauaaaucccugaacaucaagacagacccugucgauauuuauaaaagcuggguuaaucagauggaaucucagaccggagaggcguccaaacuucccuacgacgugacaccugaacaagcucuggcccacgaggaagugaagaccagacuggauagcucuauccggaacaugagagccgucacggacaaguuccucagcgcuauuguguccagcguugauaagauccccuauggcaugcgcuuuaucgccaaagugcugaaggacucucuucaugagaaauucccggaugcuggggaggacgaacugcucaagauuaucggaaaucugcucuacuaccgguauaugaacccugccauugucgcgcccgaugccuucgacaucauugaccuguccgcuggcgggcagcuuacaaccgaucagagacgcaaucugggaagcaucgccaaaaugcugcagcacgcugccuccaacaagauguuucucggcgacaacgcccaccugucuaucauuaaugaguaccuuagccaauccuaucagaaguuccggagauuuuuccagacagcuugugaugugcccgaacugcaggacaaauuuaacguugaugaguacucugaccucgugacccugaccaagccugucaucuauauuagcaucggggaaauuaucaauacacauacgcuccugcuugaucaccaagacgcgaucgccccggagcauaacgaucccauucacgagcugcuggacgaucucggcgaagugccuaccaucgagucccugauuggagaaucuagcggcaaucuuaacgaccccaauaaagaggcucuggccaagacagaaguuucccucacccugacaaacaaauucgaugugccuggggacgagaaugccgagauggacgcucgcaccauccuccugaacacgaagcggcuuauugucgaugugaucagauuucagcccggagaaacacugaccgagauucuggaaaccccugccacaagcgagcaggaggcggaacaucagcgcgcuaugcaacggagagccauccgggacgccaagacccccgauaaaaugaagaaaucuaaguccgugaaagaggacagcaaucucacacugcaggaaaagaaggagaaaauccagacgggccuuaagaaacugaccgaacucgggacagucgauccgaagaacaaauaccaggagcugauuaaugacaucgcucgcgauauuagaaaccaacggcgcuauagacagcggagaaaggccgagcugguuaagcuccagcaaaccuacgcggcccuuaauucuaaagcuacauucuacggagaacagguggacuauuacaaguccuauaucaaaaccugccuggauaaccuggccagcaagggcaaagugucuaagaaaccucgcgagaugaaggggaagaaauccaagaaaauuagccucaaguacacggcugcccggcugcacgaaaaaggcguccuucuggagaucgaagaccuccaggugaaucaguuuaagaacguuaucuucgagauuucccccaccgaggaagugggagauuuugaggucaaggcuaaauucaugggcgugcaaauggaaacauuuaugcugcacuaucaggaccugcuccagcuucaguacgaggggguugccgugaugaagcuguucgauagagcgaaagucaacgugaaucugcucaucuuccugcuuaacaagaaauuuuauggaaaguga

SEQ ID NO: 70846 - RNA, 3216 nt, Artificial Sequence
  derived and/or modified sequence opt5 from IQGAP2__Homo_sapiens__NP_001272390
augcacagccugcccggcguggucgccguuggguacaucaacgaggcuauugacgaaggaaauccucucagaacccuggagacacuucugcucccgacggccaacaucuccgauguggaccccgcgcaugcucagcacuaucaagaugugcuguaccaugccaagucucagaaacuuggcgacagcgaauccgucucuaaggugcuguggcucgaugagauucagcaggccguugacgaugcuaauguggacgaagaucgggccaaacaaugggucacccuggugguugacgugaaccagugccuggaggggaagaaaagcuccgauauccucucuguccuuaagagcuccacaagcaaugcuaacgacauuaucccugagugugccgauaaguauuacgacgcgcuugugaaagccaaggaacugaaaucugagcgcguguccagcgacggaucuuggcucaagcugaaucuucacaaaaaguaugauuacuauuacaacaccgacuccaaggaaagcucuugggucacacccgaguccugccuguacaaagagagcuggcucaccggcaaggaaaucgaggcuuucuggaaaggguauaagcagagaaaagaauacaugcaucggcgccagacauuuauugauaauaccgacuccaucguuaagauucaaucuugguucagaauggccacggcucggaaaagcuaucugucccgccugcaguacuuuagagaucacaacaaugagaucgugaagauucagagccuccugcgggccaacaaggcgcgcgacgauuauaaaacccuugugggaucugaaaauccuccccugacagucaucagaaaguucguguaccuccuggaccaguccgaucuugacuuucaagaggagcuggaaguugcccggcuccgcgaggaaguggucaccaaaauuagagcuaaccagcagcuggagaaggaucugaaucucauggacaucaaaaucggccugcuugugaagaaccggauuacacuggaagacguuaucagccacucuaagaaacucaacaagaaaaagggcggggagauggagauucugaauaacaccgauaaucaaggaaucaaaagccuuuccaaggaacgcagaaagacgcuggagacauaucagcaacucuucuaccugcugcagaccaacccucucuaccuggccaaacuuauuuuucagaugccgcagaauaagucuacaaaauucauggacaccgugaucuuuacccuguauaacuacgcuagcaaucagcgggaagaguaucuccugcugaagcuguucaaaacagcccucgaagaggagaucaaguccaaggucgaucaggugcaagacauugucacgggcaaccccaccgugaucaaaaugguugugagcuuuaauagaggggcccgcggacagaacacacugcggcagcugcucgcuccugucgugaaggaaauuaucgaugacaaaucucugauuaucaauaccaaccccguugagguguacaaggcgugggucaaucagcuugaaacacaaaccggcgaggccuccaaacugccuuaugaugugacgacagagcaggcucucaccuaccccgaagugaagaacaaacuggaggccagcaucgaaaaucugagacgcguuaccgacaagguccuuaacucuauuaucuccagccucgaucugcugccguaugggcuccgguacauugccaaggugcugaaaaacuccauccaugagaaguucccugacgcuacagaagaugagcuucugaaaauugugggaaaucuccuguacuauagauacaugaaccccgccaucgucgcgccugacggcuuugauauuaucgacaugaccgcuggcgggcagaucaauucugaccagcgccggaaccugggaagcguggccaagguucuucaacacgccgcuuccaauaaacucuucgagggcgaaaacgagcaucugucuagcaugaauaacuaucuguccgaaacauaccaggaguucagaaaguauuuuaaggaagccuguaaugugcccgagcccgaggaaaaauucaacauggauaaguacacggaccucgucaccgugagcaaaccuguuauuuauaucucuauugaggaaaucauuuccacacacagccugcuucuggagcaccaggaugcuaucgccccggaaaagaaugaccuccugucugagcugcuugggucccucggagaggugcccaccgucgagagcuuucugggcgagggggcgguggauccuaacgaccccaauaaagccaacacacugucucaacucagcaagaccgaaaucucccugguucuuacgagcaaguacgauauugaggacggagaggcuaucgauucucgcucccugaugauuaaaaccaagaaacucaucauugacgugauccggaaucagccuggcaacacacugaccgaaauccuggagacacccgccaccgcucagcaggaagucgaucaugccacggacauggugagcagagcgaugauugauucccgcacaccggaggaaaugaagcacucucaaagcaugaucgaggacgcccagcuuccucuggagcagaaaaagcggaagauucagagaaaccuccggacccuggaacaaacaggccauguguccucugagaauaaauaccaggacauccucaacgaaauugcuaaggauauccgcaaucagagaaucuaucggaaacugagaaaggccgagcuugcuaaacugcagcaaacccucaacgcccugaauaagaaagccgcuuucuacgaagaacagauuaacuauuacgacaccuauaucaagacaugccuggauaaucuuaagcgcaaaaacacgcggagaagcauuaagcuggacgggaaaggagagcccaagggcgcgaaacgcgccaagccugucaaguacaccgcugccaaacuccacgaaaaggggguucugcucgauaucgacgaucugcagacaaaucaauuuaaaaacgugaccuucgacauuaucgccacagaggaugugggaauuuuugacgucagauccaaguuccuuggcguggaaauggagaaaguucagcugaauauccaggaucuccugcagaugcaauaugaagggguggcugucaugaagauguuugacaaggugaaaguuaacgugaaucugcuuaucuaccugcucaacaagaaauucuacggcaaguga

SEQ ID NO: 70847 - RNA, 4896 nt, Artificial Sequence
  derived and/or modified sequence opt5 from IQGAP3__Homo_sapiens__NP_839943
auggagagacgggccgcuggccccgggugggccgcguacgaacgccugaccgcugaggaaauggacgagcagagacggcaaaacguggccuaucaguaccucugccgccuggaagaggccaagagauggauggaggcuugucuuaaagaagaacugccuagcccggucgaacucgaggagucccugcggaauggaguucuucuggccaagcucggccacugcuucgcucccucuguggugccucugaaaaagaucuaugaugucgaacagcugcgcuaccaggccacagggcuccauuuuagacacacggacaacauuaauuucuggcugagcgcgaucgcccauauuggacuucccuccaccuuuuucccugagacaaccgauaucuaugacaaaaagaacaugccccgggugguuuacuguauucacgcucugucucucuuucuguuccgccuuggccuggccccucaaauccaugaucucuaugggaaggugaaauuuacagcugaggagcugagcaauauggccuccgaacuggcgaaguacggacuccagcugccggccuucucuaaaaucggcggcauucuugcuaacgagcugagcgucgacgaggccgcugugcacgccgccguucucgcuaucaaugaagcgguggagagaggggucguggaagauacccuggccgcucugcagaaccccuccgcccugcucgagaaucugcgggaaccucuggccgcuguguaccaggagaugcucgcccaagcgaagauggagaaagcugccaacgcccgcaaucacgacgauagagaaagccaggacauuuaugaucauuaccugacacaggcugagauccagggaaacauuaaucacgucaacguucauggcgcccuugaagugguggacgaugcucuggagcggcaaucucccgaagcccuccugaaggcgcuucaggacccugcccuggcucuccgcggggucagacgggacuuugccgauugguaucuggagcagcuuaauuccgacagagagcaaaaggcucaggaacucggacugguggagcuucuggaaaaagaggagguucaggccggcguggcggccgcuaacaccaagggggaucaggaacaagccaugcuccacgcuguccagcgcaucaacaaagccauucggagaggaguggccgcugacacgguuaaggagcugaugugccccgaagcgcagcugccgccuguguaccccgucgccagcucuauguaucagcuugagcucgcugugcugcaacagcagcagggcgaacugggccaagaggaacucuucgucgccguggaaaugcuguccgccguugugcuuaucaaucgcgcucuggaggcccgggaugcgagcggguuuuggucuucccucgucaacccugcuaccggacuggccgaaguggagggcgaaaaugcccagagauacuucgacgcucugcuuaaacuccgccaggagcgggggaugggagaggauuuucugagcuggaacgaccugcaggccacaguuucccaagugaaugcgcagacccaggaagagacagauagaguccucgcugugucucugaucaacgaagcccuugacaagggcagccccgagaaaacccuguccgcccuccugcugcccgcugccgggcuugaugacgugagccucccuguugcuccgcgcuaucaucugcugcucgucgccgcgaagcggcaaaaggcccaggugacgggagaccccggcgcugugcuguggcuugaagagauuagacagggcgucgugcgcgccaaucaggauacaaacaccgcucaacggauggcccuggggguugccgcuaucaaucaggcgauuaaagagggaaaggccgcucagacagaaagagugcuccggaacccugccgucgcccugcgcggcgugguucccgacugugcuaauggguaccagagagcccuggagucugcgauggcuaaaaagcaacggccugccgauaccgccuucugggugcagcacgacaugaaagauggaaccgcuuacuauuuccaccuucagacauuucagggcaucugggaacaacccccggggugcccucucaacacgucccaucugaccagagaggagauucagagcgccgucacaaaggugaccgcggcuuacgaccgccagcaacuguggaaggccaauguuggcuucgugauccagcuccaggcccggcugagaggauuucuuguccgccagaaauucgcugaacacucucauuuucugagaacauggcuccccgccgugaucaagauucaagcucacuggcggggcuaucgccagagaaaaaucuaccuggaguggcugcaguauuucaaggccaaccuugaugcgauuaucaaaauucaggccugggcucggaugugggccgcucgcagacaauaccugcggcgccuccacuauuuucagaagaaugugaacagcaucgucaagauccaggccuucuuuagagcccggaaagcucaggacgauuaccgcauucugguucaugcgccucacccuccccucuccguggugagacgguucgcccaucugcuuaaccaaucucagcaggacuuucuggcugaagccgagcuccugaagcugcaggaagaggucgugagaaaaauccgcagcaaucaacagcuugagcaggaucugaacauuauggacaucaagauugggcuccugguuaaaaaucggaucacccuccaagaaguggucucccacuguaagaagcugacgaaaagaaacaaggagcagcuuagcgauaugauggugcuggacaaacagaagggacucaaaucucuguccaaggaaaaacgccagaagcuggaggccuaccaacaccuuuucuaucugcuccagacacagcccauuuaccuggcuaagcucaucuuucagaugccgcaaaauaaaaccaccaaguucauggaagccguuaucuucagccuguauaacuacgcgucuucccggagagaggcuuaucuucugcugcagcucuuuaaaacagcccugcaggaggaaauuaagagcaaaguggagcagccucaagacgucgugaccggcaaucccacaguugugcgccuugucgugcgguucuacagaaacgggcgcggacaguccgcccugcaggaaauccucggcaaggugauucaagauguccuggaggacaagguucucucugugcauacggaucccgugcaccuguauaaaaauuggaucaaccagaccgaagcucagacagggcagcggagccaucuuccuuacgacgucaccccggagcaagcccugucccaccccgaggugcagagacggcuggauauugcgcuccgcaaucugcuugccaugacagacaaguuucugcucgcuaucaccucuagcguugaucagaucccuuacggcaugagauauguggccaaaguccugaaggcuacgcucgccgaaaaauuccccgacgcuaccgauuccgagguguacaagguugugggaaaccugcuuuauuaccgguuucugaauccugccgucguggcgcccgacgccuucgauauugucgcuauggccgcuggcggggcccuggccgcuccucagcgccaugcgcucggagccguggcucaacugcuucagcacgccgccgcuggcaaggccuuuagcgggcagucucagcaccugagaguucucaacgacuaucuggaagagacacaucucaaauuccggaaguuuauccacagagcgugccaagugcccgagccggaggagcgcuucgccgucgaugaauacuccgacaugguggcuguugccaaaccuaugguguauauuaccgucggagagcuggugaauacacaucggcuucugcuggaacaccaggacuguaucgcucccgaucaucaggacccucuccacgagcugcuugaggaucugggcgaacuccccaccauuccggaccugaucggggagagcaucgccgcggauggccacacggaccugucuaagcucgaagugucccuuacacugaccaacaaauuugagggacuggaagccgaugcugacgauagcaacacaagaucucuccugcuuagcaccaagcagcugcucgccgacauuauccaauuccauccuggcgauacccugaaggagauucugucccucagcgcuucucgcgagcaggaagccgcucacaaacagcuuaugucccggagacaagccugcacagcgcagacgcccgagccucugcgccggcauagaagccugaccgcccacucccuccugccccuugcugaaaagcagcgcagaguucugcggaaucuccgcagacuggaggcccuggggcucgucucugcucggaacggauaccagggccuuguggacgaacuggccaaagacauccgcaaucaacacagacaucggcacagacgcaaggccgagcuggugaaacuccaggcgacacugcaggggcuuagcaccaagacaaccuuuuacgaggaacagggagauuauuacucccaauauauucgggcuugucuggaccaucucgcccccgauucuaaaagcuccggcaaggggaagaaacagccuucucugcacuacacggcugcccagcugcucgagaagggcguccuuguggaaaucgaggaccugccggccagccauuucagaaacguuaucuucgauauuacacccggagacgaggcuggcaaauuugaagugaaugccaaguuccugggggucgauauggagcgcuuucagcuccacuaucaagaccugcuucagcugcaguacgaaggaguggcgguuaugaaacucuucaacaaggccaaggugaaugucaaccugcugaucuuucuccuuaauaaaaaguuccugcggaaauga

SEQ ID NO: 70848 - RNA, 3345 nt, Artificial Sequence
  derived and/or modified sequence opt5 from IQSEC1__Homo_sapiens__NP_001127854
auggccugcagacggcgcuacuucguggagggcgaagcucccagcuccgagaccgggacaucucuggacagcccuuccgccuauccgcagggaccccucgucccuggcucuagccugucccccgaucacuacgaacauacgucuguuggggcguauggacuuuacagcggcccucccgggcaacagcagagaacccggcgcccuaagcugcagcacuccacaagcauccucagaaaacaagcugaggaagaggccauuaagcggucucgcucccugagcgagucuuaugaacuuuccagcgaccugcaggauaaacagguggagaugcucgaaagaaaguacggaggccggcuggugacccgccaugccgcuagaacaauccagaccgccuuucggcaauaucagaugaacaaaaacuucgagcgccugagaucuuccaugagcgagaaccggaugucccgcagaauuguccucucuaauaugcggaugcaguuuagcuucgaaggcccggagaaggugcacuccagcuacuuugaagggaagcagguuucugugacaaacgacggaucccaacugggcgcucuugucagccccgaguguggggaucugucugaaccuaccacgcucaaaagccccgccccuuccucugacuucgcggaugccaucaccgagcuggaggacgcuuuuagcagacaggugaagucccuugccgaaagcauugaugacgcucugaauugccgcucucuccauacagaggaagcccccgcgcuggaugccgcucgggccagagacaccgagccgcagacagcucugcacggaauggaucaccgcaaacucgacgaaaugaccgccuccuacagcgacguuacgcuguauaucgaugaggaggaacuuucuccuccccugccucucucccaagccggcgaccggcccagcuccacagagucugaucugagacuucgcgcugggggagcggcccccgacuacugggcucuggcccauaaggaagauaaagccgacaccgauacaagcugucgguccaccccuucucucgagagacaggaacagcgccugcggguggagcaucugccgcuccugaccaucgagcccccuagcgacuccagcgucgaucuuucugacagauccgaacgcggcagccugaagcggcagucugcuuaugagagaucccucggcgggcaacagggaagccccaagcacggcccucacucuggggcccccaaaagccugccgcgggaggaaccugagcuucgccccagaccuccccggccucuggauucccaccucgcgauuaacggaagcgcuaauagacagucuaaguccgaaagcgacuacuccgacggcgauaacgacucuaucaauagcacauccaacucuaaugauacgauuaacugcagcuccgagucuagcucccgcgacagccugcgggaacagacccugucuaaacaaacauaucauaaggaggccagaaauuccugggauagccccgccuucucuaacgacgugauccgcaaaagacacuaccggauugggcucaaucuguuuaacaagaaaccggaaaagggagugcaguaucuuaucgagcgcggcuucgucccugauacccccguuggcguggcucauuuucugcuccagagaaaggggcugucccggcagaugauuggagaguuccugggcaaccgccaaaaacaguuuaauagagacgugcuugauugugucguggacgaaauggauuucagcacaauggagcucgacgaagcccugcggaaguuccaggcucacauccgcguucagggggaggcccaaaaaguggaaagacugaucgaggcguuuucucagcgguacugcauuuguaaccccggagucgugcgccaguucagaaauccugauaccaucuuuauucucgccuucgcuaucauucugcuuaacacggacauguacuccccgaauguuaagcccgagcggaaaaugaagcuggaagacuuuaucaagaaccucagaggcguggaugacggggaggauaucccucgcgaaaugcugaugggcauuuaugagcggaucagaaaacgcgaacugaagacaaaugaggaccaugucagccaagugcagaaagucgagaaacuuauugugggaaagaagcccaucggcucccuccacccugggcugggaugcguucugagccucccccaccggagacugguguguuacugccgccuuuucgaagucccugaucccaacaagccgcagaaacugggccuccaucagcgggagauuuuucuguucaaugaccugcuugugguuaccaagaucuuucagaaaaagaaaaacucugugaccuauagcuucagacaauccuuuucucucuacgggaugcagguccugcuguucgaaaaucaguauuacccuaacggaauccgccucacaagcuccgugcccggcgccgauauuaaggugcugaucaauuuuaacgcuccuaauccccaagaccggaagaaauucaccgaugaccuuagagagucuauugccgagguucaggaaauggagaagcaccggaucgaaagcgagcuggaaaaacagaagggggucgugcgcccguccaugucucaguguagcucccucaaaaaggagagcggcaacggaacacugucuagagcgugccuggaugacuccuaugccagcggcgaggggcuuaaacggucugcucucuccagcucccugcgcgaucugucugaagccggaaagagaggccggagaagcuccgcugggagccucgagucuaacguggaaggauccauuaucagcucuccucauaugcgccggagagccacgagcacccgcgagugccccucccggccucaccaaacaaugcccaauucuagcucccugcuuggcucucuguucgggagcaagagaggcaaacccccuccgcaggcccaccuccccuccgcuccugcgcugcccccuccccauccuccggucgugcugccccaccuucagcauagcguugccggacaccaucugggcccucccgaagggcucccucaagcugccaugcacggacaccauacccaguacugucacaugcagaaucccccgccuuaccaucaccaucaccaccaucacccuccccagcauauucaacacgcccaccaguaucaucacggcccccaugggggacaccccgcuuacggcgcccaugcgcacgggcacccuccgcugcccucugcucaugugggccacacaguccaucaccacggacagccucccgccccucccccgccuaccuccagcaaggccaaacccuccggcaucucuacgaucguguga

SEQ ID NO: 70849 - RNA, 4467 nt, Artificial Sequence
  derived and/or modified sequence opt5 from IQSEC2__Homo_sapiens__NP_001104595
auggaggccggcagcgggcccccuggaggcccgggguccgaaucucccaacagagcuguggaguaccugcucgaacugaauaacaucauugagagccagcaacagcuucuggaaacccagcggcgcagaaucgaggagcucgaaggacagcuggaccaacuuacacaggagaaucgggaucugcgcgaagagucccagcuccacagaggcgagcugcaucgggacccucacggggcccgcgauucucccggaagagaaagccaguaccaaaaccugcgggagacgcaguuccaucaccgcgaacucagagagucccaguuucaucaggcggcucgggacgucggcuacccuaaucgcgaaggcgccuaucaaaacagagaggccguuuaccgggauaaggagcgcgacgcuucuuauccccugcaggauaccacaggguacaccgccagagaacgggacguggcucagugccaccuucaccaugagaauccugcccugggaagagaacgcggcgggcgggaggcgggaccggcccaccccggcagagaaaaagaggcuggguauagcgccgcugugggagucggcccucggcccccucgcgagagaggccaacucucccgcggggccagccggucuuccagccccggagcgggcgggggacauucuacauccaccagcacaucuccggccaccacgcugcagagaaaguccgauggcgaaaacagccgcaccguguccguugagggggacgcuccuggaucugaucuuagcacagccguggacucccccggcagccagccucccuaccggcugucucagcugcccccuuccagcucucacaugggcgggccgcccgcuggagucggccucccuugggcccaaagagcccgccugcagcccgcuagcguggcgcuccggaaacaggaagaggaagagauuaagagauccaaagcccugucugauagcuacgagcuuuccaccgaccugcaggacaagaagguugaaaugcucgagcggaaauaugggggcagcuuccugucucgcagagcugcccggacaauccaaaccgccuuuagacaguaccgcaugaauaagaacuucgaacggcuuagauccagcgcuucugagucccgcaugagcagacggauuauccuguccaauaugcgcaugcaguuuucuuucgaggaauaugagaaagcccagaacccugcguacuuugaaggaaagcccgcuagccucgaugagggggccauggccggcgcuagaucccaccggcuggaacgcggacugccguauggcgggucuuguggaggcgggaucgacggaggcgggagcuccgugacgacaagcggcgaguucucuaaugauauuaccgagcucgaagacuccuuuagcaaacaagucaagucucuggccgaguccaucgaugaagcucuuaacugccauccuagcggacccaugucugaggaaccuggcagcgcccagcuggagaagagagaguccaaagaacagcaggaggacagcucugcgacauccuucagcgaucucccccuguaccuugacgauaccgugccucaacagucccccgaacggcugccgucuaccgagccuccuccccaggggcgccccgaauuuugggccccggcuccccucccucccgugccucccccuguccccagcggaacaagagaggacggcucccgggaggaagggacgcgcagaggaccgggcugucuggagugccgggauuucagacugcgcgccgcucaccucccucugcuuaccauugaacccccuucugacagcuccguugaccugucugaucggagcgacagaggguccgugcaucgccaacucguguaugaggccgauggcuguagcccccacggaacacugaagcauaaaggcccgccugggcgggcgcccaucccucacagacacuaccccgcccccgagggaccugcuccggcucccccuggcccccugccucccgccccuaauucugggaccggaccguccggcgucgccgggggccgccggcuuggaaagugcgaagccgcuggcgagaacagcgacgggggagauaacgaaucucucgaguccagcucuaauuccaacgaaacaauuaauuguagcuccggcagcucuagcagagacucccugcgcgagcccccugcgaccgggcugugcaaacagacguaccagcgggagacaagacauucuugggauagccccgccuuuaacaaugacgugguucagcggcgccacuauagaaucggacucaaccuguucaauaagaaaccugaaaagggcauucaauaccuuaucgagcggggcuuccuguccgauacccccgugggggucgcucauuuuauccucgaacgcaagggacugucuagacagaugauuggcgaguuccuggggaaccggcagaaacaguuuaauagagacgugcuugauuguguuguggacgaaauggauuucagcuccauggaccucgacgaugcccugcgcaaguuucaaucucacauccggguccagggagaggcccagaaaguggagagacugauugaggcuuucagccagcgcuauugcgucuguaacccggcccucgugcggcaauuuagaaauccugacaccaucuucauucuggcguuugcuaucauccuucugaacacagauauguacucccccagcguuaaggccgaacgcaaaaugaagcucgacgauuucauuaagaaucugcggggcguggacaacggggaagauauccccagagaccugcuugucggaauuuaucagcgcauccagggcagagagcuccggaccaaugaugaccacgugucucaaguucaggccguggaacgcaugauugucggcaaaaagccugugcugucccugccccauagacggcucgugugcugcugucagcuguacgagguuccugauccgaaccgcccccagagacuugggcugcaccaacgggaggucuuucucuucaacgaccugcugguggugacaaaaaucuuucagaagaaaaagauccuugucacguauagcuucagacagucuuucccucucguggaaaugcauaugcagcuguuucaaaauuccuacuaccaguucggaauuaagcugcucagcgcuguucccggcggggagcgcaaagugcugaucauuuuuaacgccccuucccuucaggaucggcugagauucaccucugaccuccgcgaaagcaucgcggagguccaggagauggaaaaguaucggguggaguccgaacuggagaaacaaaagggaaugaugagacccaaugcuagccagccgggcggggccaaagacucuguuaacggaacaauggcccgguccagccuggaagauaccuacggcgcuggcgacgggcuuaagcgcggagcccugucuagcucccucagagaucugucugacgcuggcaagcgggggcgcagaaauagcgugggaucccucgauucuacaauugagggcagcgucaucuccagcccucggccccaccagcgcaugccucccccucccccgccuccuccgcccgaggaauauaaaucucagagacccguguccaacagcuccucuuuucuggggagccuuuucggauccaagcggggcaaaggccccuuucaaaugccucccccucccaccgggcaggccucugcgagcuccagcucugccuccagcacgcaucaccaccaucaccaucaccaucacggacacucucauggcgggcugggaguucucccugacggccaguccaagcugcaagcucugcacgcccaguacugccaggggccgggacccgcuccucccccuuaucuucccccgcagcaaccuagccugccuccuccgccccagcagcccccuccccucccccagcugggcucuauucccccucccccggccagcgccccucccgugggcccucaucgccacuuccacgcucaugggcccgucccuggaccccaacacuacacccucggcagaccggggcgggcgccuagacgcggagccggcgggcauccccaguuugcuccccacggacggcauccucugcaccagccgacaucuccccuuccucuguauucccccgccccucagcaucccccugcccacaaacaaggccccaagcacuucaucuuuagccaucacccgcagaugaugccugcugccggcgcggcugggggacccggcuccagaccucccgggggaagcuacucccacccgcaucacccucagucuccccucagcccccauuccccuauucccccucacccgucuuaucccccucugcccccucccagcccucauaccccgcacucuccccugccucccacauccccucacggcccccuucaugccagcgggccgccuggaaccgccaauccucccuccgcuaaccccaaagccaagcccagccgcaucucuacggugguguga

SEQ ID NO: 70850 - RNA, 3549 nt, Artificial Sequence
  derived and/or modified sequence opt5 from IQSEC3__Homo_sapiens__NP_001164209
auggagagccugcucgaaaaccccgugagagccguccuguaccuuaaggagcugaccgcuaucguucagaaucaacagucccucauucacacacagcgggaacgcaucgacgagcuggaaagacggcuugaugagcugucugccgagaaccgcagccucugggaacaucagcaacugcugcaggcgcagccuccgcccggccucgugccucccuccucugcuccucugcccgccgccccugcuacggccccggcugccgcggccagagcucaggagccccuucaagaccaggggcagcggagcgccgcugccccucaccccgcgccugauagacccccgagacagcaucacggacaacugcucgaacagccucagcggggccccgggucccgcgcccauaccccucaaucuccccacaaacaccugggaacacagggcgcugugaccgacaaggagaaagagagacccccuagcugcugcgccgcugccggggcccuucugcagcauaaguccccgagcgcucucggaaaaggcguccugucucggcgccccgaaaaugagacagugcugcaccaguucugcuguccugcggccgaugcuugcuccgaccucgccagccaaucugauggcuccuguacccaggccgggggaggcauggaagacagcguuguggcugccgcggcugucgccgccgggagacccucugcucaugccccuaaggcucaggcccaggagcugcaagaagaggaggaacggcccggagcgggcgccgcuuccccgcgcgccgggccucagcacaaggcuagccccggaagacagcagccugcccuugcgacagcccugugcccccacgcuccugccgcuuccgauuaugagcucucucuggaccuuaaaaacaagcaaauugaaaugcuggagcauaaauacggcggccaccucgugagccggagagccgccuguaccauccagacggcuuuucgccaguaucagcuguccaagaauuucgaaaagauucggaacagccugcucgagucuagacugccccgccggaucucccuuagaaagguucgcagcccgaccgcggagucucuggccgcugaaaaggcccucauggagggguacggacuggugggccuuccucugguccggagccccucccugcccccuacauuugccgggacccucacagaacuggaggauucuuucaccgaacaagugcagagccucgcuaaauccaucgacgaugcccugagcacguggucucuuaagacaaugugcucccugagagagagcggagcguaucagcuccaucaagcucugcaggccgccgcuggcccgcccgggcuggaggccgaaggacgcgcgccugagucugcuggccccggcccuggggacgacgccgccgaaacccccggacuuccucccgcucacuccggcacacucaugauggccuuucgggaugugaccguccagauugcuaaucagaacaucagcguuuccucuagcaccgcccuguccguggcgaauugucugggggcccaaacagugcaggcuccggccgagccugcugccggaaaagccgagcagggcgaaacgucugggagagaggcucccgaagcgccugccgucggccgcgaggacgcuagcgccgaagauuccugcgccgaggcugccgcgagcggagcugccgacggcgccaccgcucccaagacagaggaagaggaagaggaagaggagaccgccgaaguggggcggggagcggaggcugaagccggcgaucucgagcagcugucuuccagcucuacauccaccaaaagcgccaagucugggagcgaggcuuccgccagcgcuucuaaagacgcccuucaagcgaugauucugucccucccgagauaccauugugaaaacccugccagcugcaagucccccacgcugucuacagauacccugcggaagcgccuuuauagaaucggacucaaucuguucaacauuaauccugacaaaggcauccaguuucugauuagccggggguucauccccgauacccccaucggcguugcucacuuucuccugcagagaaagggacuuucccgccagaugauuggcgaguuccuggggaacucuaaaaagcaauuuaaucgggacgugcucgauugcgucguggacgaaauggacuucagcuccauggagcuggaugaagcccugagaaaauuucaggcucacauccgcguucagggagaggcccaaaagguggagagacuuauugaagccuucucucagcgguacuguaugugcaacccugaggucgugcagcaguuccauaacccggacacaaucuuuauucucgcuuucgcgaucauccugcugaauaccgauauguacagccccaacauuaagccugaccgcaaaaugaugcucgaagauuuuaucagaaaucugcggggcgucgacgauggggccgacauuccccgcgagcuugugguuggaaucuaugaacgcauucaacagaaggagcugaaauccaacgaggaucacgugacauacgucacgaagguggagaaaagcaucguuggcaugaagaccgugcucucugucccucaucggcgccugguguguugcuccagacuguucgaagugacagacguuaauaaacuucagaaacaggcugcccaccaacgggaagucuuucucuucaacgaucugcuggugauccucaagcugugucccaaaaagaaaucuagcuccaccuauacauuuugcaagagcguggggcuucugggcaugcaguuccagcucuuugagaaugaauacuauucucacggaauuacccuggucacgccucuguccggcagcgagaagaaacaggugcuucauuucugugcccugggguccgacgagaugcaaaaguuuguugaagaucucaaagagagcaucgcugaagugaccgagcuggaacagauucgcaucgagugggagcucgaaaagcagcagggaacaaaaacccugucuuucaagccgugcggcgcccaaggggacccccagagcaaacagggauccccuacagcgaagagagaggcugcccuucgggaaagacccgccgagucuaccgucgaggugagcauucacaaccgccugcaaacgucccagcauaauucuggccucggggcugaacggggcgccccuguucccccgccugaccugcagcccagcccucccagacagcaaacacccccucugccgcccccucccccuacacccccgggaacccuugugcagugucagcagaucgucaaggugauuguucuggauaaaccuugccucgcgcgcauggagccccugcucucccaagcccugucuuguuacaccagcuccagcucugacuccugcggcagcaccccucuugggggacccggcucuccugugaaggucacacaccagcccccgcugccucccccucccccgcccuauaaccauccucaccaguuuugucccccugggucccuccugcacggacaucgguacagcuccggcucuagaagccugguguga

SEQ ID NO: 70851 - RNA, 783 nt, Artificial Sequence
  derived and/or modified sequence opt5 from IRAK1BP1__Homo_sapiens__NP_001010844
augagccugcagaagacacccccuaccagaguguucgucgagcucguuccgugggccgaccggucccgcgaaaacaaucuggcuucuggcagagagacgcuucccgggcugcggcacccucucagcuccacccaagcccagacagcgacccgcgaaguccaggugucuggaacaagcgagguguccgcuggccccgauagagcccaggugguugugcgggucucuagcaccaaagaagccgcugccgaggcuaagaaauccgugugccgcagacuggacuacaucacacaaagccuucagcagcaggggguucaagccgagaacauuaccgugacgaaggauuuucggcgcgucgaaaaugcguaucauauggaggccgaaguguguaucaccuucacagaguuuggaaaaaugcagaacauuugcaauuuccugguggagaagcucgacucuuccgucguuaucagcccuccccaguuuuaccacaccccuggcucuguggaaaaccugagacggcaggcuugucugguggccgucgagaaugcuuggcgcaaggcccaagaagugugcaaccucguugggcagacacugggaaaaccgcuucugauuaaggaggaagagaccaaagagugggaaggccagaucgaugaccaucaauccagcagacucucuuccagccugacggugcagcagaagaucaaauccgcgacaauucacgccgcuucuaaggucuucaucaccuuugaggugaagggcaaagaaaagcggaaaaagcaucuuuga

SEQ ID NO: 70852 - RNA, 2049 nt, Artificial Sequence
  derived and/or modified sequence opt5 from IRAK1__Homo_sapiens__NP_001020413
auggccggcgggcccggaccuggcgagccggcugcccccggggcgcagcacuuccuguacgaagugccucccugggucaugugcagauuuuauaagguuauggacgcucucgagccugccgauuggugucaauucgccgcucugaucgugcgggaccagaccgaacuucgccugugcgagagaagcggacagcggacagccuccgugcucuggcccuggauuaaccgcaaugcuagagucgccgaucuggugcauauccuuacgcaucugcagcuccugcgggcgcgcgacauuaucaccgccuggcacccuccggcuccccugccuucucccggcacaaccgccccuagacccagcuccauuccggcuccugccgaagcggaggccuggucuccccggaaacucccuagcuccgcuucuacauuucugagccccgccuuccccgggucccaaacccacagcggaccugagcuuggccugguuccgucucccgcuucccucuggccucccccucccagcccggccccuucuuccacaaagcccggcccugaaagcucugugucccugcuucagggggcccgccccuuuccuuucuguuggccccugugcgagaucagcagaggaacccauaacuuuuccgaggagcucaaaaucggcgaagggggauucggcugugucuaccgggcugugaugcgcaauacgguuuaugcggugaagagacugaaagaaaacgccgaucuggaguggaccgcugucaagcagucuuuucucacagaaguggagcagcugagccgguuccgccacccgaauauuguggacuuugccggguacugcgcccaaaacggauucuauugucuugucuacggcuuucugccuaauggcucccucgaagauagacugcacugccagacccaggcuuguccuccccuuagcuggccccagcggcuggacauccuccuggggacagccagagcgauucaauuccugcaucaggauucuccgucccucauccacggagacauuaagagcucuaacguucugcuugaugagcgccugacccccaaacucggcgacuucgggcuggcucgguuuagcagauucgccggauccucuccuagccaguccagcaugguggcccgcacgcaaacagugcggggcacccuugcuuaucugcccgaggaauacaucaagacagggagacucgccgucgauaccgacaccuuuucuuucggagugguugugcuggagacacuggcuggccagcgcgccgucaaaacgcauggcgcgcggaccaaguaccucaaagaccugguggaagaggaagccgaggaggcugggguugcccuuagauccacacagagcacccugcaggcuggacucgccgcggaugccugggcugccccuauugcuaugcaaaucuauaagaagcaccuggacccccgcccuggccccugcccgccugaacuggggcuuggacucggccagcuggccuguugcugccugcaccggagagccaaacgccggcccccuaugacacaggaaaauucuuacguguccagcaccgggagagcucauuccggcgcggcccccuggcagccgcucgcugccccuucuggagccagcgcucaagccgcggagcagcugcagcggggccccaaccagccugucgaguccgaugaaucucuugggggacugagcgcugcccuccgcuccuggcaccugacgcccagcuguccccuggacccugccccgcuuagagaggcuggcugcccccaaggggauacagccggagagucuuccuggggcagcgggccuggcucucggcccaccgcgguggaaggacucgcucugggcuccagcgccucuagcuccagcgagccuccccagaucauuaucaauccugccagacagaagaugguccagaaacuggcucucuaugaagacggggcccuggauucucuucaacugcucuccagcuccucucugccgggacugggccuugagcaggaccgccaggggcccgaggaaagcgaugaguuucaauccuga

SEQ ID NO: 70853 - RNA, 1878 nt, Artificial Sequence
  derived and/or modified sequence opt5 from IRAK2__Homo_sapiens__NP_001561
auggccugcuacaucuaucagcugcccagcugggugcucgacgaucuguguagaaacauggacgcucuuuccgagugggauuggauggaguucgccucuuacgucauuaccgaccugacacaacuccggaagaucaaaagcauggaacgcguucagggcguguccauuacgagagaacugcuuugguggugggggaugcggcaggcgaccgugcagcaacuggucgaucuccugugccgccuggagcucuauagagcugcccagaucauucugaauuggaagccugccccggaaauccggugucccaucccugcuuuucccgacucugugaaaccugagaagccccuugccgcuagcguucgcaaagccgaggaugaacaggaggaaggacagccugugagaauggcgacauucccgggccccggguccucuccugcccgggcucaccaacccgccuuucugcagccucccgaggaggacgcuccgcauagccuccgcuccgaucugccuaccagcucugacuccaaggauuucagcacaucuauucccaagcaggaaaaacuucugucccucgccggagacagccuguuuuggucugaggcggaugucgugcaggccaccgacgacuucaaccaaaauagaaagaucucccagggcacauuugcugauguuuaccgggggcaccgccauggaaaaccuuucguguuuaagaaacugagagaaaccgccugcagcucccccggcucuauugagcgguucuuucaggcugaacuccaaaucugucugcgcugcugucaccccaacguccuuccugugcugggcuucugcgccgccagacaguuucauagcuucauuuauccguacauggcuaaugggucccuccaggaccggcugcagggacaaggcgggagcgauccccuuccuuggccccagagagugucuaucuguuccggacugcucugcgcggucgaguaucugcacggccuggagauuauccacagcaacguuaagucuagcaaugugcuccuggaccagaaccuuacgccuaagcuggcccaucccauggcucaccucuguccggugaauaaacgcuccaaguacaccaugaugaaaacacaucugcuucggaccucugccgccuaccugccugaagauuucaucagagucgggcagcucacaaagcgcguggacauuuuuagcugcggaaucguucuggcugaggugcugaccggcauucccgccauggauaacaaucgguccccugucuaucucaaagaccugcuucugagcgauauccccucuuccacggcgagccucugcucuagaaagacaggcguggaaaacguuauggcuaaagagauuugucaaaaguaccuggaaaagggggccggacgccugccugaggacugcgccgaggcucuugccaccgcugccugucucugccugcggagacgcaauacaucccugcaggaaguguguggcagcgucgcggccguggaggaacggcucagagggcgcgagacccugcuucccugguccggacugucugaaggcaccgggagcuccucuaacacaccggaggagacggaugacgucgacaauagcucccucgaugcuucuagcuccaugagcguggccccuugggcuggagccgcgacaccccugcugcccaccgaaaacggcgagggccggcuuagaguuaucguggggcgggaagccgacucuuccagcgaggcuugcgucggacucgagccuccgcaggaugugaccgaaacaucuuggcagaucgagauuaacgaagccaaacgcaagcugauggagaauauccugcucuauaaagaagagaagguugacagcauugagcuguucggccccuga

SEQ ID NO: 70854 - RNA, 1608 nt, Artificial Sequence
  derived and/or modified sequence opt5 from IRAK3__Homo_sapiens__NP_001135995
auggccggcaacugcggggcuagaggagcccugagcgcgcacacccuccuguucgaccuucccccugcucugcucggcgagcugugugccgugcuugauuccugcgacggggcccugggauggcggggccucggggcuguccugucuccgagcgaaaaguccuaccaggagggaggcuuucccaauauccuguucaaagaaacagccaacguuacgguggauaaugugcucauuccugagcauaacgaaaagggcauccugcuuaaaucuagcauuuccuuucaaaauaucauugaggggacccgcaacuuccacaaggacuuucugaucggagagggcgaaaucuucgaggucuauagaguggaaauucagaaucucacauacgcuguuaaacuguuuaagcaggagaagaaaaugcaguguaagaaacauuggaagcgguuccuuucugagcuggaagugcuccugcuguuucaccaucccaacauccucgagcuggccgcguauuucaccgaaacagagaaauuuugccuuauuuacccuuauaugcgcaaugggacccuguucgauagacuccaaugugucggagacacagcuccccugccuuggcacauccggauuggcauccuuauugggaucagcaaggcuauccacuaccugcauaacgugcagccgugcuccguuauuuguggaagcaucucuuccgccaauauucuccuggaugaccaguuucagcccaagcugaccgauuucgcuauggcccacuuccgcagccaucucgaacaccaaucuugcacgaucaacaugaccuccagcagcuccaaacaccugugguauaugccugaggaguacauuagacagggcaaacuuagcaucaagacagacguguacuccuuuggcaucgucauuauggaagugcugaccgggugucgggugguccucgaugaccccaagcauauccagcugcgcgaucuucugagagagcucauggaaaaacggggacuggacucuugccugagcuuccucgacaagaaaguuccucccuguccgcgcaauuuuuccgcgaagcuguucugccuugccggcagaugcgcugccacacgggcuaagcugcgcccuagcauggaugaggugcucaacacccuggaaucuacgcaggccucccuguauuuugccgaggaucccccuacaagccuuaaaucuuucagaugucccagcccccucuuucuggagaaugugccuuccauuccggucgaagacgacgagucucaaaacaacaaucugcuccccagcgaugaagggcugcggaucgacagaaugacccagaagacaccuuucgagugcucccagagcgaagugauguuucuuucucuggauaaaaagcccgaguccaaacgcaacgaggaagccuguaauaugccuucuucuuccugcgaggaaagcugguuccccaaguacauuguuccgucccaagaccuccggccuuauaaggugaacaucgaucccucuagcgaggcgccuggacacuccuguagaucucgccccgucgagagcuccugcagcucuaaauuuuccugggacgaauacgagcaguauaagaaagaauga

SEQ ID NO: 70855 - RNA, 1011 nt, Artificial Sequence
  derived and/or modified sequence opt5 from IRAK4__Homo_sapiens__NP_001138728
augcccuucugcgacaaggauagaacccugaugacaccugugcagaaccucgagcaaagcuacaugccgcccgacuccucuagcccugaaaauaaaucccuggaggucucugauacgcgguuucacagcuucuccuuuuaugaacuuaagaacguuaccaauaacuucgacgagcgccccaucucugugggcgggaauaaaaugggagaaggcggguuuggaguggucuacaagggcuaugugaacaauacaaccguugccgugaaaaagcuggcugccauggucgauauuacaaccgaggagcucaagcagcaguucgaccaggaaaucaaagugauggcgaagugucaacaugagaaccugguugaacuucugggguuuagcuccgauggagacgaucucugccugguguacgucuauaugccuaauggcagccugcucgacagacugucuugucuugauggcacacccccucuguccuggcacaugcggugcaaaauugcucagggggccgccaacggaaucaauuuccuccaugagaaccaccauauucaccgcgacaucaagagcgcuaauauccugcuugaugaggccuuuaccgcuaaaauuucugacuucggccuggccagagcguccgaaaaguuugcccagacggugaugaccagccggaucguggggacaaccgcuuacauggccccggaggcucuccgcggagaaauuacacccaagucugacaucuauuccuucggcgucguucugcuggagauuaucaccgggcucccugccguggaugaacacagagagccccagcugcuucuggacauuaaagaggaaaucgaggaugaagagaagacgaucgaagacuacauugauaaaaagaugaacgacgcggauagcacauccguggaggccauguacucugucgcuagccaaugucuccaugagaaaaagaauaaacggccugacaucaagaaggugcagcagcugcuucaggaaaugaccgccuccuga

SEQ ID NO: 70856 - RNA, 2892 nt, Artificial Sequence
  derived and/or modified sequence opt5 from IREB2__Homo_sapiens__NP_004127
auggacgcccccaaggcuggcuacgccuucgaguaucugaucgaaacccucaacgauagcucccacaaaaaguuuuucgacgugucuaaacuggggacaaaguacgauguccuuccuuauagcauuagaguucugcucgaggcggcugugcggaauugcgacggauuucugaugaaaaaggaagaugugaugaacauccuugacuggaagacgaaacaguccaaugucgaggugccguucuuucccgcccgcguucugcuccaagauuucaccggcauuccugccaugguggacuuugcugccaugagagaagcugucaagacacuugggggagaucccgagaaagugcauccugccugucccaccgaccugacaguugaucacucucuccagaucgacuucagcaagugcgcgauucagaacgccccuaauccgggcgggggagaucugcagaaagcuggcaagcugucuccccugaaggugcaaccuaaaaagcuccccugucggggccagaccacaugccgcggguccugugacagcggagagcugggcagaaacuccgggaccuuuagcucucagaucgaaaauacgccuauccuuugccccuuccaucugcagccggucccugagcccgaaaccgugcucaaaaaccaagagguggaguuuggacggaaucgcgaaagacugcaguucuuuaagugguccagccgggucuucaaaaacguugccgugauuccucccggcacagggauggcucaccagaucaaucuggaguaccucucucgcguggucuucgaagagaaggaccugcuuuuucccgauuccgugguuggaaccgacagccauauuacaauggugaacggccugggcauccucggguggggagucggcgggauugaaaccgaggccgugaugcugggacuuccuguuucucugacgcucccggagguggucggcugugaacugacaggguccagcaaucccuucgugaccuccaucgaugucgugcugggaauuacaaaacaccucagacagguuggcguggcgggcaaguuugucgaguucuuugggucuggagugagccaacuguccaucguugaccggaccaccaucgccaacaugugcccugaauauggcgcuauucuuagcuucuuucccguggauaaugucacacugaagcaccucgagcauacgggguucucuaaagccaagcuggaauccauggagaccuaccuuaaagcugugaagcuguuucgcaacgaccagaacagcucuggagagccugaauauagccaggugauccaaauuaaucucaacuccaucguucccucugucagcggcccgaaaagaccucaggaucggguggccgugacagacaugaaguccgauuuccaggccugucugaaugagaaggucggguuuaaaggcuuccagauugcugcggaaaagcaaaaagacaucgugagcauccacuacgagggaucugaauacaagcugucccauggcagcguugugauugccgcugucaucucuugcaccaacaauuguaaccccuccgugaugcucgccgccgggcugcuugcuaaaaaggccguugaggcgggacugcgcgugaagccuuauauuagaacaagccucucccccggcucugggauggucacccacuaccugagcuccucuggagugcugccuuaucuuagcaaacucggcuuugagaucguuggguacggcugcuccacgugcgugggaaauacagcuccccugagcgaugccguccugaacgccgugaagcagggcgaccucgugaccugugggauucugucuggaaauaaaaacuucgaaggccggcuuugcgacugugucagagcuaauuaucuggccuccccgccucucguuguggcuuacgccaucgcggggaccgugaacaucgauuuccagacagagccccugggaaccgaccccacaggcaagaauauuuaucugcacgauaucuggccuagccgcgaagagguccaucggguggaggaagaacacguuauucuuucuauguuuaaagcccucaaggacaagaucgaaauggggaacaaaagauggaacucccuggaggcuccggauagcgugcuguuccccugggaccucaagucuacguacauucgcugcccuagcuuuuucgauaaacugaccaaggaacccaucgcccuucaggcuauugagaaugcccauguccugcucuaccugggcgacuccgugacaaccgaucacaucagcccugcgggaucuaucgcccggaacuccgcugccgcuaaauaucugacaaauagaggccuuacgccccgcgaguuuaacagcuacggggcccggagaggaaaugacgccguuaugacccgcggcaccuucgcuaacauuaagcucuuuaauaaauucaucgggaagccugcgcccaagacaauucauuuuccguccggacaaacccuggauguguucgaagccgcugagcuguaucagaaagaaggcaucccucucauuauccuggccgggaagaaauacggcucuggaaacagccgggacugggccgcuaagggccccuaucuucugggggucaaagccgugcucgcggaguccuacgaaaagauccacaaggaucaccugauuggaaucggcauugcuccucugcaguuucuucccggggagaaugccgacucucucggacugagcggcagagagacauucucccugaccuuuccggaggagcucucuccuggcaucacgcugaacauucagacaagcaccgggaaaguuuucuccgugaucgccagcuucgaagacgaugucgagaucacacuuuauaagcauggaggccugcucaauuuuguggcucgcaaauucucuuga

SEQ ID NO: 70857 - RNA, 978 nt, Artificial Sequence
  derived and/or modified sequence opt5 from IRF1__Homo_sapiens__NP_002189
augcccaucaccagaaugcggaugcgcccuuggcuggagaugcagauuaacagcaaucaaaucccgggccucauuuggaucaacaaggaagagaugauuuuccagauccccuggaaacacgccgcuaagcaugggugggacaucaauaaagaugccugccuguuuagauccugggcgauucacacaggacgguacaaggcuggcgaaaaagagccugaccccaagacguggaaggccaacuuccgcugugccaugaauagccuuccugauaucgaagaggugaaagaccagagcagaaacaagggguccucugcuguccggguuuaucgcaugcugcccccucucaccaaaaaucagagaaaggagcggaaaagcaaguccucucgcgaugccaagagcaaagcuaagagaaaauccugcggagacagcucuccggauacauuuuccgacggccugucuucuuccacccuucccgaugaccauagcucuuacacagugccuggguauaugcaagaucuggaaguggagcaggcccucacccccgcgcuguccccuugugccgucagcuccacacugcccgacuggcacauuccgguggaaguugugccugauucuaccagcgaccucuacaacuuccaggucucccccaugccuagcacgucugaggcuaccacagacgaggaugaagagggaaagcugcccgaagacaucaugaaacuucuggagcaguccgaauggcaacccaccaauguggauggcaagggcuaucuccugaacgagccugggguucagccgacaagcguguacggagacuuuucuugcaaagaggaacccgagauugauagcccuggcggggacaucggacuuucccugcagcgggucuucaccgaucucaagaauauggacgccacguggcuggauucucugcucacacccgugcgccugccuagcauucaggcuauccccugugccccguga

SEQ ID NO: 70858 - RNA, 1716 nt, Artificial Sequence
  derived and/or modified sequence opt5 from IRF2BP2__Homo_sapiens__NP_001070865
auggccgcugccguggcggucgcugccgccagcagacggcaguccugcuaccugugugaccucccccgcaugccuugggcuaugaucugggauuucaccgagccgguuugcagaggcugugugaacuaugaaggggccgaccggguggaguuugucauugaaacagcucgccaacugaagagagcccacggaugcuuccccgagggccggucuccucccggggcggccgcuagcgccgcugccaaaccucccccucuuuccgcgaaggauauccugcuccagcagcagcaacagcugggacauggcgggccggaagccgcuccccgcgccccucaggcucuugagagauacccccuggccgccgcugcggagcggccuccccgccucggaucugacuuuggcagcuccagaccggccgcuucucuggcccagccucccacgccucaacccccucccgugaauggcauucugguuccgaacggguucagcaaacucgaggaacccccugaacugaaucggcagucccccaacccucgcagaggacacgccgugcccccgacccuugucccucugaugaauggcagcgcuacaccccucccuaccgcccuggggcuuggaggccgggcggcugccucucuggccgcuguguccgggacagccgcugccagccucggaucugcgcagcccaccgaucugggcgcccauaagcgcccugcuuccguuagcuccuccgccgcuguggagcacgagcagagagaagccgcggccaaagagaagcaacccccgccucccgcucaucggggccccgccgacagccuguccacagcugccggggccgcugaacucucugcggagggagccggcaagagcagaggguccggagaacaggauugggucaaccgcccuaaaaccgugcgggacacgcugcuugcucugcaccagcacggccauagcgggccguuugagucuaaguucaaaaaggagcccgcccucaccgccguggcuagaacagcccgcaaacggaagccuucccccgaaccugagggagaagucgggcccccuaagaucaauggcgaggcgcaacccuggcugagcaccucuacagaaggccuuaaaauuccgaugaccccuacgagcuccuuuguuucucccccucccccgacagcuagcccucacuccaacagaaccacacccccugaggccgcccagaauggacagagccccauggcugcccugauccucguggcggauaacgcuggcgggucucaugccuccaaggacgccaaucaggugcacagcaccacccgccggaacucuaauucucccccuagcccguccucuaugaaccaaagacgccugggaccccgggaggucggcgggcagggcgcuggaaauacaggcgggcuggaaccugugcaccccgccagccucccugauuccucucuggcuacgagcgcgccccuuuguugcacccugugucaugagagacucgaagacacacacuucguucagugcccuuccgugccgagccauaaauuuuguuuccccugcucucgccaguccaucaagcaacagggagccagcggcgaggucuauuguccuucuggggaaaaaugcccccuggugggauccaacguuccuugggccuuuaugcagggcgagauugcuaccauccuugccggggaugugaaggucaaaaaggagcgggacagcuga

SEQ ID NO: 70859 - RNA, 2391 nt, Artificial Sequence
  derived and/or modified sequence opt5 from IRF2BPL__Homo_sapiens__NP_078772
augagcgccgcucagguguccucuagcagacggcaauccugcuaccugugugaccucccccgcaugccuugggccaugaucugggauuucucugagccggucugcagaggcuguguuaacuaugaaggggcggaccggauugaguuugugaucgaaaccgcucgccagcugaagagagcccacggaugcuuccaggauggccggagccccgggccucccccucccgugggagucaaaacaguggcccuuuccgcuaaggaggccgcugccgcggccgcugccgcugccgcggccgcugccgcugcccagcaacagcagcagcaacagcagcagcaacagcagcaacagcagcagcaacagcagcagcaacagcagcagcaacugaaucauguugacggcucuagcaaaccugccgugcucgcugcgccguccgggcuggaacgcuacggacuuagcgccgcugccgccgcugccgcggcugccgccgcugccgucgagcagagaucucgguuugaguaucccccucccccugugucccugggcucuagcucccacacggcucgccuccccaacggccucgggggaccgaauggcuucccuaagcccaccccugaagaggggccucccgaacugaacagacagagccccaauucuuccagcgccgcggccuccguugcuucucggcgcggaacacauggcgggcuggugaccggacugccgaaccccggcggcgggggaggcccucagcuuacagugcccccuaaucugcucccccaaacccugcuuaacgggccggccagcgcugccguccugccucccccucccccucacgcgcucggauccagagggcccccgaccccugccccucccggcgcucccggaggcccggccugucugggcgggacacccggagugagcgcuacgucuuccagcgccucuagcuccaccucuagcuccgucgccgagguuggcgugggggcuggaggcaaacggccugggagcgugucuuccacagaucaggagcgcgaacugaaggagaagcagagaaaugcggaagcccucgcugagcugagcgaaucucuucggaacagagccgaggagugggccuccaaacccaagaugguccgcgacacccugcucacacuggcuggcugcaccccuuacgaagugcgguuuaaaaaggaucauagccuucugggaagaguuuucgccuuugacgcgguguccaaacccggcauggauuaugagcucaagcuguucauugaauacccuacggggucuggaaaugucuauagcuccgcuucuggcguggccaagcaaauguaccaggacuguaugaaagauuuugggcgcggacugagcuccggcuucaaguaccucgaguaugaaaagaagcacgggagcggcgacuggcggcugcuuggagaucugcuccccgaggccguuagauuuuucaaagagggcgugccgggggcugacaugcugccucagcccuaccuugacgccucuugcccuaugcugcccacagcgcucgucucccugagccgcgcuccgucugccccucccggaaccggcgcccugccucccgcugcccccuccgggcggggagcugccgcgagccucagaaagcgcaaagccucuccugaaccgcccgauagcgcugagggcgcccugaaacuuggggaggaacagcaacggcagcaguggauggcuaaccaguccgaagcccugaagcucacaaugagcgccggcggauuugcugcgccuggccacgccgcugggggacccccucccccuccgcccccucugggcccccauucuaauagaaccaccccucccgaguccgccccgcaaaacgggccuagccccauggccgcucugauguccguggccgacacacuuggaacggcgcacucucccaaagauggcagcuccguccauucuaccacagcuagcgcccgcagaaauuccucuagcccugugucccccgccagcguuccugggcagcggcggcucgcuucucgcaacggcgaccugaaccuccagguggccccgcccccucccuccgcgcacccuggaauggaucagguccacccccaaaauaucccggacagcccuauggcuaacucuggcccccuguguugcaccauuugucaugagagacuggaagauacacacuucgugcagugcccuuccguucccagccauaaguucugcuuuccuuguucucgggaguccaucaaagcccagggggccaccggagaaguguauugccccagcggcgagaaguguccgcuugucggguccaaugugccuugggcuuucaugcaaggagagaucgccacgauucuggcuggcgacgugaaaguuaagaaggaaagagaucccuga

SEQ ID NO: 70860 - RNA, 1050 nt, Artificial Sequence
  derived and/or modified sequence opt5 from IRF2__Homo_sapiens__NP_002190
augcccguggagagaaugcggaugcgcccuuggcuggaggaacagaucaacagcaauaccauuccgggccucaaguggcugaacaaagaaaagaaaaucuuccaaauucccuggaugcacgccgcuagacaugggugggacgucgagaaggaugccccucuuuuucggaauugggcgauccacacaggaaaacaucagcccggcguugacaagccugaucccaagacguggaaagcuaacuuccgcugcgccaugaauagccugccugacauugaagaggugaaggauaaaucuaucaagaaagggaacaaugccuuuagaguguaccggaugcucccgcugagcgagcgccccuccaagaagggcaaaaagccuaaaaccgaaaaggaggacaaagucaagcacaucaaacaggaacccguggagucuagccuuggacuguccaacgggguuucugaucucagcccugaguaugcugugcugacauccaccauuaagaaugaagucgacagcacagugaacaucauuguugugggacagucucaucuggauuccaauaucgagaaccaagaaauugucaccaaucccccggacaucugucaggugguggaggucacaaccgaaagcgaugagcagccuguuucuauguccgagcucuacccccugcagauuagcccugugucuuccuaugccgaaagcgagacgaccgacuccgugcccucugaugaagagagcgcugaaggcagaccccacuggcggaagcgcaacaucgagggcaaacaauaccuuuccaauauggggacaagaggaagcuaucugcucccuggcauggccucuuucgucaccuccaacaagccggaccuucaggugacaaucaaagaggaaagcaaccccguuccuuacaauucuagcuggcccccuuuucaggaccugccccuguccucuagcaugaccccggcguccuccucuucccggccugaucgcgagacgagagccagcgugauuaagaaaacaucugacaucacccaggcucgggucaaguccugcuga

SEQ ID NO: 70861 - RNA, 1179 nt, Artificial Sequence
  derived and/or modified sequence opt5 from IRF3__Homo_sapiens__NP_001184052
auggugggcagaaagcagggguggagcugccgggucaccggaaucaaacccggcaagccugccugggcugaggccacaggggcguacguuccgggacgcgacaaacccgaucugccuacguggaagagaaacuuccgguccgcucucaaucgcaaagaaggccugagacuugccgaggaccggucuaaggauccccacgacccucauaagauuuaugaauuugugaacagcggggugggagauuucucccaacccgacaccucuccugauacaaauggcggcgggagcaccuccgacacacaggaggauauccuggacgaacuccugggaaacaugguccuugccccgcugcccgauccugggcccccuucucucgcuguggcccccgagccguguccucagccccugcgcagcccuucccuggacaaucccacccccuuuccuaaccucggcccgagcgagaauccccugaaaagacuucugguuccuggagaagagugggaguucgaagugacagcuuuuuaccggggccgccaggucuuccaacagaccauuucuugccccgaggggcucagacuggugggauccgaaguuggcgaucggacgcuuccuggcuggcccgugacccugccggacccugggaugagccucacagaccgcggagucaugucuuaugugagacacgugcuguccugucugggcgggggacucgcccuguggcgggcgggccaguggcuuugggcccagcgccuggggcauugccacaccuacugggcugucagcgaggaacuccugcccaacucuggacauggcccugauggcgagguucccaaggacaaagaagggggaguguuugaucuuggcccuuucaucguggaccugauuacauuuaccgagggguccggaagaagcccccgguaugcccucugguucugugucggcgaguccuggccgcaagaucagccuuggacgaagagacuggugaugguuaaagugguccccacaugccugcgcgcucucguggaaauggcccggguugggggcgcgucuagccuggagaauaccguggaccuucacaucuccaacagccacccccugucucucacauccgaucaguacaaggccuaucugcaggaccuugucgaaggaauggauuuucaaggcccuggggagagcuga

SEQ ID NO: 70862 - RNA, 1353 nt, Artificial Sequence
  derived and/or modified sequence opt5 from IRF4__Homo_sapiens__NP_001182215
augaaccuggagggcgggggaagaggcggggaguucggaaugagcgccguguccugcggcaaugggaagcuccggcaguggcugaucgaccaaauugauucuggaaaauaccccggccuugucugggagaacgaagaaaagagcaucuuucgcauuccuuggaaacacgcuggcaagcaggacuauaauagagaagaggaugccgcgcuguucaaggcuugggcccucuuuaaagggaaguuccgggagggaaucgacaaaccggaucccccuaccuggaagacacgccugagaugugcccuuaacaaauccaaugacuuugaagaacugguugaacggucucagcucgauauuagcgaccccuacaagguguaucgcaucgugccugagggcgcuaaaaagggggccaagcagcugacgcuggaggauccccaaauguccaugucucauccuuacaccaugacaaccccguaucccagccucccugcucagguccacaacuacaugaugcccccucuggacagauccuggcgggauuaugugcccgaccagccgcauccugaaauccccuaccagugcccuaugacauucggaccccgcggccaccauuggcaagggcccgccugugagaauggaugccagguuaccggcacauuuuacgcgugugccccuccggaaagccaggcucccggcgugccuaccgagcccucuauuagauccgccgaagcucuugccuucagcgauugccggcugcacaucugucucuauuaccgcgagauucuggucaaagagcuuacgaccucuuccccugaagggugcagaaucagccacggacauacauaugacgcgucuaaccuggaccaggugcucuuucccuacccggaggauaauggccaacggaagaacauugaaaaacugcugucccaccucgagcgcgggguugugcuguggauggccccugacggacuuuaugcuaagagacugugucagagccggaucuacugggauggcccccucgcccugugcaaugacagaccuaacaaacuugaacgcgaucagaccuguaagcuguucgacacacaacaguuucucuccgagcugcaggcuuucgcccaucacgggcggucucugcccagauuucaggucacccucugcuucggagaggaguucccugauccccaacgccagcggaaacugauuacggcccacguggagccgcuucuggcuagacagcucuauuacuuugcgcagcaaaauagcggccauuuccugcgcggcuacgaccuuccugaacacaucuccaaccccgaggauuaucaucggagcaucagacacucuuccauucaggaauga

SEQ ID NO: 70863 - RNA, 1497 nt, Artificial Sequence
  derived and/or modified sequence opt5 from IRF5__Homo_sapiens__NP_001092097
augaaccagagcauccccguggccccuaccccgcccagacggguccgccugaagccuuggcucguugcucaagucaauuccugccaguaccccggccugcagugggugaacggggagaaaaagcuguucuguauuccuuggagacacgccacacggcauggacccucucaggacggcgauaauacgaucuuuaaagcgugggcuaaggaaaccgggaaauauacagagggaguggacgaagccgauccugccaaguggaaggcuaaccuucgcugcgcccucaauaaaagcagagacuuccggcugauuuacgauggcccgcgcgacaugcccccucaacccuauaagaucuacgagguguguuccaacgggccugcucccaccgauucucagccgccugaagacuauagcuuuggagccggcgaggaggaagaggaagaggaggaacuucagagaaugcugcccucccucucucugacagaggauguuaaauggccucccacccugcagcccccuacacuccggccgcccacccugcaaccucccacgcuucagccucccgugguccugggcccgccugcgcccgacccuagcccccucgccccucccccggggaauccugcuggauuccgcgaacugcuuuccgaggugcuggaacccggcccccucccugccagccugccgcccgcuggggagcagcugcucccugaucugcuuauuucuccccacaugcugccucucaccgaccuggagaucaaguuucaguacagaggacggcccccucgcgcccuuacaaucuccaacccccauggcugcagacuguucuauagccaacucgaagcgacccaggagcagguugaacuguuugggccgauuucucuggagcaagugcgguucccuucccccgaagauaucccuagcgacaaacagcgcuuuuacacaaaucagcuccuggacguccuugauagaggacugauucuccagcugcaaggccaggaccuuuacgccauccggcugugucagugcaagguguucuggucuggccccugugcuuccgcccacgauagcugcccgaacccuauucagagagaggugaagaccaaacucuuuucccuggagcauuuccugaaugaacucauccuguuucaaaaggggcagacgaacacacccccucccuucgagauuuucuuuuguuucggagaagaguggcccgaccgcaaaccucgggaaaagaaacuuaucaccguccagguugugccgguggcugccagacugcuccuggagauguuuucuggcgagcugagcugguccgccgauagcauccgccuucagauuucuaaucccgaccucaaggaucggauggucgaacaauucaaagagcugcaccacaucuggcagucccagcagagacugcaaccuguggcucaggcgcccccuggggccggacucggcguugggcagggacccuggccuaugcauccggcuggcaugcaauga

SEQ ID NO: 70864 - RNA, 1119 nt, Artificial Sequence
  derived and/or modified sequence opt5 from IRF6__Homo_sapiens__NP_001193625
auguacgacggcaccaaggaggugcccaugaacccugucaaaaucuaucagguuugcgauauuccgcaaccccaggggagcaucauuaauccuggauccacaggcucugcccccugggacgaaaaggauaacgacguggaugaggaagacgaggaagaugagcucgaccagagccagcaccaugugccuauccaagauacguuccccuuucucaauauuaacggguccccuauggcuccggccucugucggaaauuguagcgugggcaacugcucccccgaggcgguuuggccuaaaaccgaaccccuggagauggaagugccucaggcucccauccagccguucuacucuagcccugagcuuuggaucuccagccugcccaugacagaccucgauauuaaguuucaguauagagggaaagaguacggacaaaccaugacagucucuaauccucagggcugucggcuguucuauggcgaccuugggcccaugcccgaucaggaggaacuguuuggaccugugucccucgaacagguuaaguucccgggccccgagcacaucaccaacgaaaagcaaaaacuguuuacaagcaagcugcucgacgugauggaccgcgggcugauucuugaggucucuggacaugccaucuacgccauuagacugugccaguguaaaguguauugguccggcccuugcgcucccagccucguggccccuaaucugaucgagcggcagaagaaagucaaacuuuucugucuggaaaccuuucucucugaucugauugcucaccaaaaggggcagaucgagaagcagcccccguucgaaaucuaccugugcuuuggagaggaauggccugacggcaagccccucgagcgcaaacugauucuuguucaggugaucccuguggucgccagaaugauuuacgagauguucuccggcgauuuuacgcggagcuucgacuccgggucugugcgccugcaaaucagcacccccgauauuaaggacaacaucguugcgcagcucaaacagcuguauagaauccuucagacacaagaauccuggcagccuaugcagcccaccccgagcaugcagcugccucccgcccugcccccucaauga

SEQ ID NO: 70865 - RNA, 1512 nt, Artificial Sequence
  derived and/or modified sequence opt5 from IRF7__Homo_sapiens__NP_001563
auggcccuggcucccgagagagccgcgccucggguccucuucggcgaauggcugcuuggggagaucagcuccggaugcuacgaaggccugcaguggcucgacgaggcucgcaccuguuuuagagucccguggaagcacuucgcccggaaagaucugucugaagccgacgcucgcauuuuuaaggccugggcuguugccagagggcgguggcccccuagcucccgcggaggcgggcccccucccgaggcggagacagccgaaagagcuggauggaaaacgaacuuccggugcgcccuucgcucuaccagacgguuugugaugcugcgcgauaauagcggcgacccugcugauccgcauaagguguaugcccucuccagagagcuguguuggcgggaaggccccgggacagaccaaaccgaggcggaggccccugcugccgugcccccuccccagggaggcccgccugggcccuuccuggcucacacacaugccggacuccaggccccuggcccccugcccgcuccugcgggggauaaaggagaccuucugcuccaggccgugcaacagucuugccuggcugaucaccuucugaccgccagcuggggcgccgacccgguucccacaaaggcuccuggcgaagggcaggagggacucccccugaccggcgccugugcugggggaccuggccugcccgcgggggaacucuacggaugggccguggagacgaccccguccccuggcccccagccugccgcucugacaaccggcgaagccgcugcccccgagagcccucaucaagcggagcccuaucuuucuccguccccuagcgccugcacagcuguccaggaacccucucccggggcccuggaugugaccaucauguacaagggacgcacgguucuccagaaaguggucggccacccuuccuguacauuucuguaugggccgcccgacccugcugugagagccaccgauccccagcaaguggcguucccuagccccgccgagcuuccugaccagaagcagcugcgguacacagaggagcuccugagacacgucgcucccggacugcaucucgaacugcgcggcccgcaacuuugggcccggagaauggggaaaugcaagguuuauugggaggugggcggaccucccggcucugcuuccccuagcacccccgccugucugcucccgcgcaacugcgacaccccuauuuuugauuuccggguguuuuuccaggagcuggucgaauuuagagcccgccagcggagagggucuccccgcuacacaaucuaccuuggauucggccaggaccuguccgcugggcggccuaaagaaaagagccucgugcugguuaagcuggaacccuggcucuguagagugcaccuggagggaacgcaacgcgaaggcgucuccagccuugauucuuccagccugucucucugccugagcuccgccaauucucuguaugacgauauugagugcuuccuuauggagcucgaacagcccgcguga

SEQ ID NO: 70866 - RNA, 1281 nt, Artificial Sequence
  derived and/or modified sequence opt5 from IRF8__Homo_sapiens__NP_002154
augugcgacagaaacggcgggcggcgccugagacaguggcucaucgagcaaauugauagcuccauguaccccggacugaucugggaaaaugaggaaaagucuauguuccggauuccuuggaaacacgccggcaagcaggacuauaaccaggagguggaugcuagcaucuuuaaagccugggcggucuucaaggggaaauuuaaggaaggagacaaggcugagccggccaccuggaaaacacgccuuagaugugcccugaauaagucccccgauuucgaggaaguuacggaccggucucagcucgauauuagcgagccuuacaaaguguaucgcaucgugcccgaagaggagcaaaagugcaaacugggcgucgcuaccgccgggugugugaacgaaguuacagagauggaaugcggaagauccgagaucgacgaacuuauuaaggagccuucuguggaugacuacaugggcaugaucaagcggagccccuccccuccggaggcuugucgcagccagcugcuccccgauuggugggcccagcagccuucuaccggcgucccccuggugacaggguauaccacauacgacgcgcaucacuccgccuuuagccaaaugguuauuucuuucuauuacggaggcaaacugguggggcaggcuaccacgaccugcccugaaggauguagacucucccugagccagcccggccuuccggggacaaagcuguacggaccugagggccucgaacugguccgguuucccccugccgaugcuauccccucugagcgccagagacaagugacccggaaacuuuucggccaucuggaacgcggggugcuccugcacuccagcagacagggagucuuuguuaagcggcugugccagggcagaguguucuguuccgggaaugccguggucugcaaaggacgccccaacaagcucgagcgggacgaggugguucaaguguuugacacaucucaguucuuuagagaacugcagcaguucuauaauagccaaggccgccuuccugaugggcgggucgugcuguguuucggagaggaauuuccggacauggcgccccucagauccaaacugauucuuguucagaucgagcagcuguacgugcgccagcucgccgaagaggcuggcaagagcugcggcgccgggucugucaugcaagcuccugaggaacccccucccgaucagguguuccggauguuuccggacauuugcgccucccaucagcgcagcuucuuuagagagaaccagcaaaucaccgucuga

SEQ ID NO: 70867 - RNA, 1182 nt, Artificial Sequence
  derived and/or modified sequence opt5 from IRF9__Homo_sapiens__NP_006075
auggccagcggcagagcucggugcacccgcaagcugagaaacuggguggucgagcagguugaauccgggcaauuccccggaguguguugggacgauacagccaaaacgauguuucggaucccuuggaagcacgcgggcaaacaggacuuccgcgaggaucaggacgcugccuuuuucaaggccugggcuauuuuuaaagggaaguacaaggaaggagauaccggcgggccggccguguggaaaacaagacuccggugcgcucugaauaagucuagcgaguucaaagaaguccccgagcgcggaagaauggacguggccgagccuuauaagguuuaccagcuucugcccccuggcaucguguccggccaacccgggacccagaaagucccuucuaagcggcagcauagcuccgugucuagcgaacgcaaggaggaagaggaugcgaugcagaacuguacacucuccccgagcguucugcaagacucucuuaauaacgaggaagagggagccuccggcggggcugugcacagcgauauuggaucuuccucuagcuccagcucccccgaaccucaggaggucaccgacacaaccgaagcccccuuucagggcgaucagagaucucuggaguuccuccugccucccgagccggacuauagccugcuccugacguuuaucuacaaugggcggguggugggagaagcucaaguccagucccuugauugccgccugguugccgagccuagcggcucugaauccagcauggagcagguccucuuccccaaaccuggcccccuggaacccacccaaagacuucugucucagcucgagcgggggauucugguggcgagcaacccucgcggacuguuugugcagagacucuguccgauccccaucuccuggaaugccccucaggcucccccuggccccgggccgcaucugcuuccuucuaacgagugcguggaacuguuccggacagccuauuuuuguagagaccucguucgcuacuuccaaggacuggggcccccucccaaguuccaggugacccuuaauuuuugggaggaaagccacggcuccagccauacaccucagaaccugauuaccgucaaaauggagcaggcuuucgcccgguaucuccuggaacaaacgcccgagcagcaggccgcuauccugucucucguguga

SEQ ID NO: 70868 - RNA, 1446 nt, Artificial Sequence
  derived and/or modified sequence opt5 from IRG1__Homo_sapiens__NP_001245335
augaugcucaagagcaucaccgaguccuucgccacagcuauucacggccugaaaguggggcaucugacggacagagucauccagcggucuaagcgcaugauucuugauacccugggagccggcuuucucgggacaaccacagaaguuuuccacaucgcgagccaauacuccaaaauuuauucuagcaacaucuccucuaccguguggggacagcccgacaucagacugccuccgacauacgcugccuuugugaauggcgucgccauucauagcauggauuucgacgauaccuggcaccccgcuacgcauccuuccggggccgugcuucccguucugaccgcucucgccgaggcgcugccucggagccccaaguuuucuggacuggaccuccugcuugccuucaacgugggcaucgaaguccagggccgccugcuccacuuugcuaaagaggccaaugauaugccuaagagauuccacccgcccuccgugguugggacacugggaagcgcugccgcggccucuaaguuucuuggccuguccagcaccaaaugccgggaagcucucgccauugcugugucucaugccggggccccuauggcuaacgcggccacacagaccaagccccugcacaucggaaaugcugccaaacauggcauugaggccgcuuuccuggccaugcucgggcugcaaggaaacaagcagguccuugaccuggaggcgggcuuuggcgcuuucuaugccaauuacuccccuaaagugcuccccagcaucgccuccuauucuuggcugcuugaucagcaggacguggcuuuuaagcgcuucccggcccaccugagcacgcacugggucgcugaugccgcggccuccguuagaaagcaucucguggcugaacgggcccugcugccuacagacuacauuaaacgcaucgugcucagaauccccaacguccaauaugugaaucggccuuuccccguuagcgagcacgaagcucgccauucuuuucaguacguggccugugcgaugcugcuugaugggggaauuaccguccccuccuuccacgagugccagaucaacagaccucaggugcgggagcugcucagcaagguugaacuggaguacccgcccgacaaucuuccuucuuuuaacauucuguauugugaaaucagcgugacacucaaagacggcgccaccuucaccgaucgcuccgacacauuuuacgggcauuggagaaagccccugucucaagaggaucuggaagagaaauuccgggcuaaugccagcaagaugcucuccugggacacggucgagagccugauuaaaaucgugaagaaccuugaagaucuggaggacugcucuguccucaccacacugcugaagggaccuuccccgcccgaaguggcuagcaauucuccugccuguaacaacuccaucaccaaucuuagcuga

SEQ ID NO: 70869 - RNA, 546 nt, Artificial Sequence
  derived and/or modified sequence opt5 from IRGM__Homo_sapiens__NP_001139277
auggaggccaugaacguggaaaaggcuagcgccgacggcaaucugcccgaggucaucuccaacauuaaagaaacccucaagaucguuucuagaacaccugugaauauuacgauggcgggggauagcggaaacggcauguccaccuucaucucugcucugcggaauacagggcacgagggaaaagccagcccgcccaccgaacuugugaaggccacacagcgcugcgcuuccuacuuuucuagccauuucuccaacgucgugcugugggaccucccuggcaccgggagcgccacaaccacgcuggagaauuaucuuauggagaugcaauuuaacagauacgauuucauuaugguugcuucugcccaguuuuccaugaaucacgugaugcuggcgaaaaccgccgaagacaugggaaagaaguucuauaucgucuggacaaaacucgauauggaccugagcaccggcgcucugcccgaggugcagcuccugcagauccgggaaaacguucuugagaaucugcaaaaggagcgcgugugugaauacuga

SEQ ID NO: 70870 - RNA, 3729 nt, Artificial Sequence
  derived and/or modified sequence opt5 from IRS1__Homo_sapiens__NP_005535
auggccagcccucccgaguccgacggcuucucugaugugagaaaggucggguaccugcggaaaccuaagagcaugcacaaacgcuuuuucguucucagagcugccuccgaagcgggaggccccgcucggcuggaguauuacgaaaacgagaagaaauggcgccauaagucuagcgccccuaagagauccaucccccuugaaucuugcuuuaauauuaacaaacgggccgacagcaagaauaaacaccugguggcucucuauacccgcgaugagcauuucgccaucgcugccgacuccgaggcggaacaggauagcugguaccaagcccugcuucagcugcacaacagagcuaaggggcaucacgacggagccgcugcccucggcgccgggggaggcggcgggucuuguuccggaagcucuggccugggggaggcgggagaagaucuguccuauggcgacgugccucccgggccugcuuuuaaagaggucuggcagguuauucucaagccgaagggacugggccagacgaaaaaucuuaucggcauuuaccggcugugccucacaagcaagaccaucucuuucguuaaacugaacuccgaggccgcugccgugguccuucaacugaugaauauccgcagaugugggcacagcgaaaacuuuuucuuuauugaggugggacgguccgccguuacaggccccggggaguucuggaugcaaguggaugacucugucguggcucagaauaugcaugagaccauccucgaagcgaugcgcgccaugagcgaugaguuuagaccucgguccaagagccagucuuccagcaacugcucuaaucccauuagcgugccucugcgcagacaccaucugaacaaucccccgccuucccaagucggacucacacggagaucucgcaccgagagcaucacagcuaccucccccgccagcaugguuggcgggaaaccuggaucuuuccgggugagagccuccagcgacggcgaaggcacgaugucucgccccgcuuccguggaugggagccccgucuccccuucuaccaaccggacacacgcccacagacaucgcggaagcgcgcggcugcacccgccccuuaaucauuccagaucuauuccuaugcccgcuagccgcuguuccccuagcgccaccucucccgugucccuguccucuuccagcacaucuggccacgggagcaccuccgacugccucuuuccgcggagaagcucugccuccgugagcggaagcccgucugacggcggguucaucagcuccgaugaauauggcucuagccccugugacuuccgcuccucuuuucggagcgugacgccugauucccugggacauacacccccugcuagaggcgaagaggaacuuagcaacuacauuugcaugggagggaagggccccucuacccugacagccccgaacgggcacuacauccucucccggggaggcaaugggcaccgcuguaccccuggcaccggacugggcacaagccccgcucuggccggggacgaggcggccucugcugccgaucucgacaacagauuccggaaaagaacgcauuccgcuggaaccagccccacaaucacccaccagaagacaccuucucaguccagcgucgccuccauugaggaauauaccgagaugaugccggcguaucccccuggcgggggaagcggcgggcgccugcccggccaucggcacucugccuuugugccuacgagaagcuaccccgaagagggacuugaaaugcacccucuggagcgcagaggcgggcaucaccggcccgauuccucuacacuccauaccgacgauggauacaugccgaugagcccuggcguugcucccgugccuuccgggcgcaagggaucuggcgacuauaugcccaugagcccgaaauccgucucugccccucagcagaucauuaaucccaucagacggcacccucagcgcguggaucccaacggguacaugaugaugagccccuccggcggaugcagcccugacauuggcgggggaccgucuuccucuagcuccagcuccaaugcuguccccucuggcaccagcuaugggaagcuguggacaaacggagugggcggccaucacucccacguucuuccucaucccaaaccucccguggagagcucugggggaaagcugcucccuuguaccggcgacuacaugaauauguccccggucggggauagcaacacaucuagccccuccgacugcuacuauggaccugaagauccccagcacaaaccugugcugucuuacuauagccugcccagauccuucaagcauacgcaacggccgggcgagccugaagagggggcccgccaccagcaucucagacugucuaccagcuccggacggcuucuguacgccgcuacagcggacgauucuagcuccagcaccuccucugacagccucggcggcggguauugcggagcccgccuggagcccucccugccccacccucaccaucagguucuucagccccaccucccuagaaagguggauacagcugcccaaaccaauucucggcuggccagaccgacgcgccugagccucggcgaccccaaggcuuccacccugccucgggccagagaacagcagcagcaacagcagccccuucugcauccucccgagccuaaaagcccgggggaauacgucaacaucgaguuuggaucugaucaguccggcuaucucagcgggcccguggcguuccacucuuccccuagcgugcgcugucccucucaacugcagccugcuccccgggaagaggagacaggaaccgaagaguacaugaaaauggaccugggcccgggcagacgcgccgccuggcaggaaagcacagggguugagaugggacggcuuggcccugcuccucccggggccgcguccaucugcagacccacccgcgcugucccgucuagccggggagauuacaugacgaugcagauguccugucccagacaaagcuauguggacacauccccugccgcccccgugucuuacgcugauaugcggaccggcauugccgcugaagaggucagccucccucgcgccacaauggcggccgcuuccucuagcuccgccgcuucugccagccccaccgggccucagggagccgcugagcuggcggcccacuccagccugcucggcggcccgcaggggcccggaggcaugucugcuuuuaccagagugaaucuguccccuaaccggaaucaaagcgccaagguuauccgcgccgacccccaggggugcagacggagacauucuuccgaaacauucagcucuacgccuuccgcuacccgcgugggaaacacaguccccuuuggcgccggggcggcugugggaggcggcgggggaagcuccagcucuagcgaggacguuaaacggcacuccucugccagcuucgaaaauguguggcuuagaccgggcgagcucgggggagccccuaaggaacccgcuaagcuguguggcgccgcugggggacuggagaacggccugaacuauauugaucuugaccucgucaaagauuuuaagcagugcccccaggaguguaccccugaaccccaaccuccgcccccucccccuccccaucagccgcugggcuccggggagucuagcuccacacgccggucuagcgaagaccuguccgcguacgccagcaucucuuuccagaaacagccugaggauagacaauga

SEQ ID NO: 70871 - RNA, 4017 nt, Artificial Sequence
  derived and/or modified sequence opt5 from IRS2__Homo_sapiens__NP_003740
auggccagcccucccagacacggcccgcccgggccugcuuccggagacggccccaaccugaauaacaauaacaauaacaauaaccauucugugcggaagugcggguaccuccgcaaacagaagcacggacauaaaagauucuuuguccugcggggcccuggggccggaggcgaugaggcgaccgcuggcgggggaagcgcuccccaaccuccgcgccuugaauauuacgaguccgaaaagaaauggagaucuaaggccggcgcccccaagcggguuaucgcccuggacuguugccucaauauuaacaaacgcgcugaugccaagcacaaauaucugaucgcgcuuuacacaaaggacgaguauuucgccguggcugccgaaaaugagcaggagcaggaagggugguacagagcucugacggaucucgugagcgagggacgggccgcggccggcgacgcuccucccgccgcugccccugccgcuuccuguucugcgagccugcccggggcccugggaggcuccgcuggcgccgccggggcugaagauagcuauggacucgucgccccggcgaccgcugccuaccgcgagguguggcagguuaaccugaaaccuaagggccuugggcaaucuaagaaucugacaggaguguacagacucugccuguccgcccggaccauuggcuuugucaaacuuaacugugagcagcccagcgugacacugcagcucaugaauauccgcagaugcgggcauucugacuccuucuuuuucauugaaguuggacggagcgcugugaccggcccuggcgagcuguggaugcaggccgaugacucugucguggcucaaaacauccacgaaacaauccuggaggccaugaaggcgcucaaagaacuguuugaguuccgccccagauccaagagccaguccucugggagcuccgccacccaccccauuagcgugccuggagcucggagacaucaccaucuugucaaccugccgcccucucagacgggccucguucgccgguccagaaccgauagccuggccgcuacaccucccgccgcgaaauguucuagcugccgcgugcggaccgccuccgagggggacggaggcgcugccgcuggggccgccgcugcgggcgccagaccugugucugucgcuggaagcccccuuuccccgggcccugugcgcgcuccccugagccggucucacacacucuccgggggauguggcgggagaggaagcaagguugcccugcugccugccggcggggcccuccagcacucucgcuccaugagcaugcccguggcgcauuccccucccgcugccaccucuccgggcagccuguccucuagcuccggacacggcagcgggucuuauccuccuccgcccggaccccaucccccucuuccccacccucugcaucacggccccgggcaacggccuuccagcggaucugccuccgcuagcggcucucccagcgauccgggguuuaugucccucgacgaauacggcagcucuccuggagaccugagagccuucugcucccaccgcagcaauacgcccgaguccaucgcggaaacaccucccgcucgggauggcgggggaggcggggaguuuuauggauacaugaccauggacagaccgcuuucucauuguggccggagcuaucgcagagucuccggggaugccgcccaggaccuggaucggggccucagaaaacgcacauacucucugaccaccccugcucggcagagacccgugccucaacccagcuccgccucucuggacgaauauacacucaugcgcgcuacguucagcggauccgccggcagacugugccccagcugcccugcgucuuccccgaagguugccuaccaccccuacccugaggauuauggggacauugagaucggaagccaucggucuuccagcucuaaccuuggcgcugaugacggguacaugcccaugaccccuggagccgcucuggccggcuccggcagcggguccugucgcagcgaugacuauaugcccaugucuccugccagcguguccgcuccgaagcagauucuccagcccagagcggccgcugccgccgcugccgcggucccuucugcuggacccgccggcccugcccccacaagcgcugccgggcggaccuuuccggcguccggaggcggguacaaggcuucuagcccugccgaauccucucccgaggacagcggauauaugcgcauguggugcggcuccaaacugagcauggaacacgccgauggcaaacugcuucccaauggggacuaccucaacgugucuccuuccgaugcugucacaaccggaacgcccccugacuucuucagcgccgcucugcacccgggcggggagccccugagaggagugccuggcuguugcuauucuucccucccccggagcuacaaggccccuuacacaugugggggagauuccgaccaguauguucugaugucuagccccgugggccgcauccuugaagaggagagacuggaaccgcaagcgaccccuggccccucccaggccgcuagcgccuuuggggcuggaccuacccagcccccucaucccgucgugccgucuccuguucggcccuccggcgggcgccccgagggauuccucggccagagagggcgggccgugagaccuacacgccugagccuggaaggacuuccgucucuccccagcaugcacgaguacccucugcccccugagcccaaauccccuggcgaauauauuaauaucgauuuuggcgagccgggggcccggcugucucccccugcucccccucuccuggcgagcgccgcuuccucuagcucccuucugagcgccucuucccccgccagcucccucggaucuggcaccccggggacaagcuccgacucuagacaacgcagcccucuguccgauuacaugaaccuggacuucagcucucccaagucccccaagccuggagcucccagcggccauccugucgggucucuugauggacuccuguccccggaagccagcucucccuauccuccccugccuccccggccgagcgcguccccuucuagcucccuccagcccccucccccucccccggcuccuggcgagcuguacagacuuccucccgccagcgccguggcuacggcccagggccccggggcggccuccucucugagcuccgacaccggagauaauggcgacuauacagaaauggcuuuugggguggccgcuaccccgccccagccuaucgccgcucccccuaaacccgaggccgcgcgcguugccucuccuacaagcggagucaagcggcucucccugauggagcaagugucuggcguggaggcuuuccugcaggccagccagcccccggacccucacagaggggcuaaagucauucgcgccgauccccagggaggccggagacggcauuccagcgaaaccuuuucuuccacgaccacagugaccccuguuagccccucuuucgcccacaacccgaagcgccacaauuccgcuagcguggaaaacgucucucuuagaaaauccagcgagggcggggugggaguuggcccugggggaggcgacgaaccucccacaagcccccggcaacuccagcccgcgccuccgcuggcuccccaggggcgcccuuggacccccggacaaccuggcggccugguggggugccccggauccggcgggucuccuaugagacgggagacgagcgccggauuucagaauggccucaacuacaucgccauugaugucagagaggaaccggggcugcccccucagccccagccucccccgccuccccuuccccaaccuggcgacaaguccucuuggggacgcacacggagccugggcgggcucaucuccgccgugggaguuggcucuaccgggggaggcugugggggccccggaccuggcgcucugccgcccgccaauacauacgcgagcauugauuuccugucccaucaccuuaaggaggccaccaucgugaaagaauga

SEQ ID NO: 70872 - RNA, 3774 nt, Artificial Sequence
  derived and/or modified sequence opt5 from IRS4__Homo_sapiens__NP_003595
auggccagcugcuccuucaccagagaccaggcuacacggcgccugagaggcgccgcggcugccgccgcugccgcucucgccgcgguggucacgacaccccugcuuucuagcgggaccccuaccgcccugaucggaacaggcuccucuuguccgggggcuauguggcucagcaccgccacaggaucccggucugauagcgaguccgaagaggaagaccugcccguuggcgaggaagugugcaagcgcggguaccuuagaaaacaaaagcacggacaucggcgcuauuuugugcugaaacucgagaccgcugaugccccugcgagacuggaguacuaugaaaacgcccggaaguuccgccacagcgucagagcugccgcugccgccgcugcggccgcugccucuggcgccgcuauucccccucugauucccccucggcgcgugaucacgcucuaccaguguuuuuccguuagccagagagccgacgcgcgguaucgccaucugaucgcucuuuucacccaggaugaguacuuugccaugguggccgaaaaugagucugagcaagaauccugguaucugcuccugagcagacuuauucuggagucuaaacggagacgcugcggcacacucggggcucagccggacggagaacccgccgcucuggccgcggccgcugccgcugagccucccuucuacaaggaugucuggcaagugaucguuaagccucggggccuggggcacagaaaagaacucuccggaguguuucgccugugucuuaccgacgaggaggucguguucgugcggcugaacacagaagucgccagcguuguggugcagcuccuguccaucagacgcugcggccauucugagcaauacuuuuuccuugaagucgggcggagcaccgugauuggacccggcgagcuguggaugcagguugaugacuguguggucgcgcagaauaugcacgaacucuuucuggagaagaugagagcccugugcgcugaugaguaucgcgcccgguguagauccuacagcaucucuauuggcgcucaccuccugacgcuucuguccgcccgccggcaucucgggcuggugccgcuugaaccuggaggcuggcugagacggagccgcuucgagcaguuuugccaccucagagccaucggggacggagaagaugagaugcuguucacacggagauucguuacccccucugaaccuguggcucauagccgccggggcagacugcaccucccccgcgggagacggucccgcagagcggucucugugcccgccagcuuuuuccggcgccuggcuccuuccccggccagaccccggcacccugccgaggcucccaacaauggagcccgccuuagcucugaggucuccggcagcggcucugggaacuuuggagaagagggcaauccucaagggaaagaagaccaggagggauccggcggggacuauaugcccaugaacaauuggggcagcggaaacggcagaggguccggaggcgggcagggaucuaauggccaagggagcuccucucauagcuccggcggaaaccaguguagcggcgaggggcagggaucucggggcgggcagggauccaauggccaagggagcggcggaaaccagugcucucgcgauggccaggggacagcgggaggccacggguccggaggcgggcagagaccgggcggaggccaugggagcggaggcgggcaaggaccuggcgacggccacgggucuggaggcgggaagaauagcggaggcgggaaaggauccggcagcggcaaggggucugauggagacggcgaacgggggaagucccugaaaaagagaagcuacuucggaaaacucacccaguccaagcagcagcaaaugcccccucccccucccccgccucccccucccccgcccgcuggcgggaccggaggcaaaggcaagucugggggacgcuuucggcuguauuucugcguggauagaggcgccacaaaagaguguaaggaagccaaggagguuaaagacgcugaaauuccugagggggccgcgcgcggaccccaucgggcuagagccuuugaugaggacgaagaugacccuuacgugcccaugcgcccuggcgucgccacgccccuggugagcuccucugauuauaugccgauggcuccucagaacguuagcgccuccaagaaacggcacucuagaagccccuucgaggacucccgcggguacaugaugauguuuccucgggugucucccccgccugcucccucuccucccaaggcccccgacaccaacaaagaagaugacuccaaggauaaugacagcgagucugauuacauguucauggcgccuggagccggcgcuaucccgaagaaccccagaaauccucagggcggguccagcucuaaauccuggagcuccuauuuuagccuucccaacccuuuccggucuagcccccucggacagaaugacaacuccgaauacgucccuaugcugccgggcaaguuucuggggcgcggacucgauaaagaggugucuuauaauugggaccccaaggaugccgcuagcaaaccuuccggcgaggggucuuucagcaagcccggagacggcggcuccccuucuaagcccagcgaucacgaaccgccuaaaaacaaggccaaaagacccaaucggcuguccuucauuacaaagggguacaaaaucaagcccaagccucaaaaacccacccaugagcagcgcgaagccgacagcagcuccgauuaugugaacauggacuuuacaaagagagagagcaauaccccugcuccgucuacgcagggacuucccgacuccuggggcaucauugcggaaccucggcaaagcgccuucuccaacuacguuaaugucgaguuuggggugcccuucccuaaccccgcuaaugaucugucugaccuccugagagccaucccgcgcgccaacccucugagccuugauuccgcucgguggccccucccuccccugccucugagcgccacaggaucuaacgcgauugaggaagagggcgacuauaucgaagugauuuuuaauuccgcuaugacccccgccauggcccucgcugauagcgccaucagauacgacgcggagaccgggcgcaucuacgucguggauccguucucugagugcuguauggacauuagccuguccccuucucggugcagcgaacccccucccguugcuagacuucugcaggaggaggaacaggaacgccggagaccgcagucccgcucucagagcuuuuucgccgccgcuagagccgcuguguccgccuuucccacagauagccucgagcgggaccugucuccuuccagcgcgcccgccgucgcuuccgccgcugagccuacccuggcccuuucucaggugguugccgcugcgagcgcccucgcugccgcccccggaaucggcgcugccgcggcugccgccggcuucgauuccgcuucugcccgcugguuucagccuguggcgaacgccgcugacgccgaagcugucagaggggcccaggauguggcuggaggcagcaauccgggggcccacaaccccuccgcgaaucuggcccggggagacaaccaagcuggcggggccgcugccgccgcugcggccccugagcccccuccccgcagcagacggguuccgagaccucccgaacgcgaggacucugauaaugacgaugacacacaugugcggauggauuucgcuagacgcgacaaccaguuugauucccccaaacggggaagauga

SEQ ID NO: 70873 - RNA, 1443 nt, Artificial Sequence
  derived and/or modified sequence opt5 from IRX1__Homo_sapiens__NP_077313
augagcuucccccagcugggcuacccucaauaucucuccgccgcugggccgggagccuacggcggggagagacccggagugcuggcggcugccgccgcugccgcugccgcggccucuagcggccggccuggggcugccgaacuuggaggcggcgcuggggccgcggccgucaccuccguucugggaauguaugcugccgcuggccccuacgccggggccccuaacuauucugcuuuucuccccuacgcggccgaccugagccuuuucucccagaugggaucucaguaugagcugaaggauaauccuggcgugcacccggcuacauuugccgcccauacggcucccgccuacuacccuuaugggcaguuccaauacggagaccccggccgcccuaaaaacgcgaccagagaaagcacauccacccucaaggcuuggcugaaugagcaccggaaaaaccccuauccgacaaagggcgaaaaaaucaugcuggccauuaucaccaagaugacacucacccaggugagcacgugguuugccaaugcucgcagacggcugaagaaagagaacaaggucaccuggggggcccgcucuaaagaucaggaggacggagcucuuuucggcuccgauacagaaggggacccugagaaggccgaagaugacgaggagauugaucuggaaagcaucgacauugauaaaaucgacgagcaugauggagaccagucuaaugaagacgaugaggacaaggcggaagccccccacgcuccugccgcucccuccgcccucgcgagagaucaaggcagcccccuggccgcugccgacgugcuuaagccucaggauucuccgcuggggcucgcuaaagaggcccccgagccuggauccacccggcugcugagccccggcgccgcugcgggcgggcuccagggagccccucauggcaagcccaaaaucuggucccuggcugaaacagccaccucuccggacggggccccuaaggcuagccccccucccccugccggacaccccggcgcgcacgggccguccgcuggcgccccucuucagcaucccgccuuucugcccagccacggacucuacacgugccauauuggcaaauucucuaacuggacaaauuccgcuuuucuggcccaagggagccuucugaacaugcgcucuuuccucggaguuggcgcgccucacgcugccccgcacgggccccaucugccugcccccccucccccucagcccccgguggcuaucgccccuggagcucugaauggcgauaaggccagcgucagauccucucccacccucccugagcgggaccuggugccccgcccggauagcccugcgcagcaacuuaaaucccccuuucagccuguuagagacaacagccuggccccccaggaagggacaccccggauucucgcugcccugccuucugcuuga

SEQ ID NO: 70874 - RNA, 1416 nt, Artificial Sequence
  derived and/or modified sequence opt5 from IRX2__Homo_sapiens__NP_150366
augagcuacccccagggcuaucuguaccaagccccugggucccucgcucuguauucuugcccggccuacggagcgagcgcucuugccgcccccagauccgaggaacuggcucggucugccagcggcuccgcuuucucuccuuaucccgggagcgccgcguuuaccgcccaggcugccacaggauucggcuccccucuccaguacagcgcugacgccgcggccgcugccgcuggguuucccucuuauaugggagccccuuacgaugcccacacgaccggcaugacaggcgcuaucuccuaccauccguaugggagcgcggccuaccccuaucagcugaacgacccugcuuaccgcaagaaugccaccagagaugccacagcuacccuuaaagccuggcugaacgagcaccggaagaaucccuauccuacaaaaggagaaaagauuaugcucgcgaucauuaccaaaaugacgcugacccaagugucuacaugguucgcuaacgcccgcagacggcugaagaaggagaauaaaaugaccugggccccgcgcaacaaguccgaagacgaggaugaggacgaaggcgaugcuacaagaagcaaagacgagucuccggauaaggcccaggaagggaccgagacguccgcugaggacgaaggaaucagccuccaugucgauucccugacagaccacucuuguagcgccgaguccgauggcgaaaaacuuccuugccgggcgggggacccccugugugagagcggaucugaaugcaaggacaaguacgaugaccucgaggaugacgaggaugacgaugaagagggcgaacgcggccuggccccucccaaacccguuaccuccagcccucuuacagggcuggaggcuccgcuccugucucccccucccgaagccgcuccuagaggaggccggaagacaccccaggggagccgcaccuccccgggagccccucccccugcgucuaaacccaagcuguggagccucgccgagauugcuaccuccgaccugaaacagccuagccuuggccccggguguggaccgccuggccugcccgccgcugccgcccccgcuucuacgggcgcgccucccgggggaucccccuauccugccagcccccuccugggcagaccucuuuacuacaccucucccuuuuaugggaauuacacaaacuauggaaaucugaacgcugcccuccaaggccaggggcugcugcgguacaauuccgccgcugccgcgccuggcgaggcucuccauaccgcccccaaggccgcuagcgaugccggaaaagcgggcgcucacccgcuggaaucccacuaucgcucuccugggggaggcuacgagcccaagaaggacgccagcgaagggugcacaguggugggaggcgggguccagccuuaucuuuga

SEQ ID NO: 70875 - RNA, 1506 nt, Artificial Sequence
  derived and/or modified sequence opt5 from IRX3__Homo_sapiens__NP_077312
augagcuucccccagcugggcuaccaauauaucagaccucucuacccguccgagcggcccggggccgcuggaggcucugggggaagcgccggcgcgcgcgggggacugggcgcuggcgccuccgaacuuaacgccucugggagccuguccaaugugcucucuagcgucuauggagcuccuuacgccgcugccgcggccgcugccgcugcccagggcuauggggcguuucugcccuacgccgcugagcuuccuauuuucccccagcugggagcccaguaugaacucaaggacuccccuggcguucaacacccggcugccgccgcugcguuuccccauccucaccccgccuucuacccuuacgggcaguaucaguuuggagaucccagcagaccgaaaaacgcuacccgggagucuacauccacgcugaaggccuggcugaaugaacaucgcaaaaacccuuaccccaccaagggcgagaaaaucaugcucgccauuaucacaaagaugacccugacacaggugagcaccugguucgcuaaugccagacggcgccuuaagaaagagaacaagaugacaugggcgccuagaucucggaccgacgaagagggcaaugcuuauggguccgaacgcgaggaggaagaugaggaagaggacgaagaggauggaaaaagagagcuggaacucgaggaagaggaacugggcggggaggaggaagacacgggaggcgaggggcuugccgaugacgaugaagacgaggaaauugaucuggagaaccucgacggagccgcuaccgagcccgaacugagccuggccggcgcugcccggcgcgauggcgaccucgggcugggacccaucucugacuccaagaauagcgauuccgaggacucuagcgaaggccuugaggauagaccucugccggugcucucccuggcgcccgccccucccccugucgcuguggccagccccucucuuccguccccucccguuagccuggacccuugcgcucccgccccugcgcccgccucugcucuccaaaaaccgaagaucuggagccuggccgagacagcuaccuccccugauaacccccggcgcucucccccuggggccggaggcagcccgcccggggccgcuguggcgccuuccgcccugcagcucagccccgcugccgccgcugccgcggcucacagacuggucucugccccucuuggcaaguuucccgccuggacaaaucggccuuuccccggaccgccucccggcccuagacugcauccccucucccugcuugggagcgcuccgccucaucugcucggacugcccggcgccgcggggcacccugcugccgccgcugccuuugcucgccccgccgaacccgagggaggcaccgaccgguguucugcgcuggaaguggagaaaaagcuccugaaaacggccuuccagccuguuccgagacgcccccagaaccaccuugaugcugcccuggugcucuccgcucugagcuccucuuga

SEQ ID NO: 70876 - RNA, 1560 nt, Artificial Sequence
  derived and/or modified sequence opt5 from IRX4__Homo_sapiens__NP_057442
augagcuacccccaguucggcuauccuuacuccucugccccgcaauuucugauggcuaccaacagccucuccacaugcugugagucugggggaagaacgcuggccgacagcggccccgcggcuuccgcccaggccccuguguauugccccgucuacgaaucucggcuucuggcuaccgcccgccacgagcucaauagcgcugccgcgcuggggguuuauggaggcccuuacgggggaucccagggcuauggcaacuacgugacauacgggagcgaagccucugcuuucuauucccuuaauagcuuugauucuaaggacggauccggcagcgcccaugggggacuggcucccgccgcggccgcuuacuauccuuacgagccggcccucggccaguaucccuacgauagauaugggaccauggacucuggaacacggcgcaaaaacgcuaccagagaaacaaccuccacgcugaaggccuggcugcaagagcaccggaaaaauccuuaccccaccaagggcgagaaaaucaugcucgccauuaucacaaagaugacccugacacaggugagcaccugguucgcuaacgcgcgcagacggcuuaagaaagaaaauaagaugacguggccuccccgcaacaaaugugccgaugagaagagaccguacgcugaaggcgaggaggaagaagggggagaagaggaagcccgggaggagccucugaaauccucuaagaaugccgaacccgucggcaaggaggaaaaagagcucgaacugagcgaccuugaugacuuugauccucuggaggcugagccucccgccugcgaacucaagcccccguuccauucccuggacgggggacuggagcgcgugcccgcggcuccugauggccccguuaaagaagccagcggggcccucagaaugucucuggcugccggaggcggcgcugcccuugacgaggaucuggaacgggcgcgcuccugucucagaagcgccgcugccgggccugagccccugccgggagcugagggcgggccucaggugugcgaagccaaacuuggauuuguccccgcgggcgccucugcugggcuggaggccaagccucggauuuggagccucgcucacacagccaccgccgcugcggccgcugccacaucccugucucagaccgaguuccccagcuguaugcugaagagacaaggcccugccgcucccgccgcgguguccagcgcuccggccaccucuccuuccguugcccucccccauagcggagcucuggaccgccaccaggacucucccgugacaucccuucggaacugggucgauggcguguuucacgacccuauccugagacauagcacgcucaaucaggccugggcgaccgcuaaaggggcccugcuugauccgggaccccugggccgcucccucggggccggagcuaacgugcugacagccccucuggcucgggccuuucccccugcggucccccaggacgccccugcugccggcgcugccagagagcuccuggcccuucccaaggcugggggcaagccguucugcgcguga

SEQ ID NO: 70877 - RNA, 1449 nt, Artificial Sequence
  derived and/or modified sequence opt5 from IRX5__Homo_sapiens__NP_001239126
augagcuacccccagggcuaucuguaccaaccuuccgccucucucgcucuguauagcugcccggccuacuccaccucugugaucagcgggcccagaacagacgagcuuggacgguccucuagcggcuccgcguucagcccuuaugcugggucuacggccuuuaccgcccccuccccuggauacaacagccaucugcaguauggcgcugaucccgccgcugccgcggccgcugccuucucuuccuacgucgggagcccuuacgaccacacaccgggaauggcuggcucucucggcuaucaccccuacgccgcgccucugggguccuaucccuacggagauccugccuaucgcaagaaugcuaccagagacgccacagcuacccuuaaagccuggcugaacgaacaucggaagaaucccuacccgacaaaaggcgagaagauuaugcucgccaucauuaccaaaaugacgcugacccagguuagcacaugguuugcuaacgcgcgcagacggcugaagaaggaaaauaaaaugaccuggacaccucgcaacagauccgaggaugaagaggaggaagagaauaucgaccucgaaaagaacgaugaggacgagccccagaaaccugaagauaagggggaccccgagggacccgaagccggcgcugagcaaaaagccgccucugggugugaacggcugcagggaccuccgacccccgcuggcaaggagacggagggcagccuuuccgauagcgacuucaaggaaccucccucugaggggcgccuggaugcccuccagggaccucccagaacaggcgggccguccccugcgggacccgcugccgcccggcuggcugaagacccugccccgcacuauccugcuggcgcccccgcgccggggccucaucccgccgcuggagaggugcccccuggcccgggcgggcccagcgugauucacucuccucccccucccccucccccggccguccuugcuaaaccuaagcuguggagccucgccgaaaucgcgaccuccucugacaaagugaaggauggaggcgggggaaaugagggcagccccugcccucccuguccggggccuaucgccggccaggcucugggaggcucccgcgccagccccgcuccugcccccucuagaucccccagcgcccaaugcccuuuucccgggggaacaguucugucucggccccucuacuacaccgcuccuuucuaucccggcuacaccaacuauggguccuuuggacaucugcacggccacccugggcccggcccuggaccgacaacgggccccgggagccauuucaauggacuuaaccagaccgugcugaaucgcgcggacgcccucgcuaaagauccuaagaugcugagaucccagucucagcuugaccuguguaaagauagccccuacgagcucaagaagggcauguccgacauuuga

SEQ ID NO: 70878 - RNA, 429 nt, Artificial Sequence
  derived and/or modified sequence opt5 from ISCU__Homo_sapiens__NP_055116
auggugcugaucgacaugagcgucgaucucuccacccagguuguggaccacuacgagaaccccagaaaugugggcucucuggauaagacaagcaaaaacgucgggacgggacuugugggcgccccugcuugcggggacguuaugaagcugcaaauucagguggaugaaaaaggaaagaucgucgacgcccgguucaaaaccuuuggcuguggguccgcgauugcuucuagcucccucgccacagagugggugaagggaaagaccguugaagaggcccugacaaucaaaaauaccgauauugcuaaggaacuuugccugccgcccgugaaacuccauuguucuaugcuggccgaggacgcuaucaaggccgcgcuggccgauuauaaacucaagcaggagccuaagaaaggcgaagcugagaagaaauga

SEQ ID NO: 70879 - RNA, 546 nt, Artificial Sequence
  derived and/or modified sequence opt5 from ISG20__Homo_sapiens__NP_001290163
auggccggcagcagagagguggucgcuauggacugcgaaaugguugggcugggaccccaccgggaguccggccucgcccgcuguucucuggugaacgugcauggggcgguccuuuacgauaaguucaucagaccugaaggagagauuaccgacuaucggacacgcgugagcggcguuacgccgcagcacauggugggggcuacccccuuugccgucgccagacuggaaauccuccaacugcuuaaaggaaagcuggugguuggccaugaucucaaacacgacuuccaggcucugaaggaggauauguccggcuacacaauuuaugacaccucuacagaucggcugcucuggcgcgaggccaaacuggaccauugcagacgggugagccuucgcguccuguccgaaagacuccugcacaagucuauccagaauagccuucuggggcacuccagcguggaggaugcucgggccaccauggaacucuaccagauuucucaacgcaucagagcgcggcgcggacugccuagacuggccguguccgacuga

SEQ ID NO: 70880 - RNA, 1050 nt, Artificial Sequence
  derived and/or modified sequence opt5 from ISL1__Homo_sapiens__NP_002193
augggcgacaugggggaucccccuaagaaaaagagacugaucagccucugcgugggauguggcaaccagauucacgaccaauacauccugcgggucuccccggaucuugaguggcaugccgcuugccugaaaugugccgaaugcaaucaguaucucgacgagucuuguaccugcuucguucgcgaugggaagacauacuguaaaagagacuauauucggcuguacggaaucaagugcgcgaaguguagcauuggcuuuuccaaaaacgauuucgugaugcgcgcuagaucuaagguguaucacaucgaaugcuuucggugugucgccugcagccgccagcuuauccccggggacgaguucgcccugagagaagauggacucuuuugccgggcugaccaugaugugguugagcgcgccucccugggcgcuggcgacccucugucuccccuccacccugccagaccccugcagauggcggccgagccuauuagcgcucggcaaccggcccuucgcccccaugugcacaaacagccugaaaagacgaccagaguccggacagugcugaaugagaaacagcuccacacccugcgcacauguuacgcugccaaccccagaccugaugcgcuuaugaaggaacagcugguugagaugaccgggcucagcccccgggugaucagagucugguuccaaaauaagcgcugcaaagacaagaaacgguccauuaugaugaagcagcugcagcagcaacagccgaacgacaaaacaaauauccagggaaugaccggcacgccuaugguggccgcuucucccgagagacaugaugggggacugcaagccaacccuguggaaguccaguccuaucagccucccuggaagguucucagcgacuuugcucugcagucugauauugaccaacccgccuuccagcagcuugugaauuuuuccgagggcgggccgggaagcaacucuaccggcuccgaaguggccagcauguccucucagcugcccgauacaccuaauagcauggucgcuucccccaucgaggcguga

SEQ ID NO: 70881 - RNA, 1395 nt, Artificial Sequence
  derived and/or modified sequence opt5 from ISM1__Homo_sapiens__NP_543016
auggugagacuggccgcugagcuccugcuucugcucggccugcuucugcucacccugcacaucacaguccugcgggggagcggagccgcggacggccccgaugcugccgccgggaacgcuucccaggcccaacuccagaauaaccugaauguuggaucugacacgaccagcgaaacauccuucucucuuagcaaggaggcuccucgcgaacaucuggaucaccaggccgcgcaucagccguuucccagaccucgguuccgccaagagaccggccaccccucccuccagagagacuuuccucggucuuuccugcuugaucugcccaacuuuccugaccucagcaaagccgauauuaaugggcagaacccgaauauccaggugacaauugaaguggucgacggacccgauuccgaggcugacaaggaucaacauccugagaacaaacccagcuggucugugccuucccccgacuggcgcgccugguggcagagaagccugucucuggcucgggccaauuccggcgaucaggacuacaaguaugacagcaccucugaugacuccaacuuccucaauccgccucgcggcugggaucacacagcgcccgggcacagaaccuuugaaacgaaagaccagccugaguacgauagcaccgacggagaaggcgauuggucccuguggucuguuugcagcgugacaugugggaacggaaaucaaaagcggacccgcuccugcggcuaugccuguacagcuaccgagagcagaacgugcgaccggcccaacugucccgggaucgaggauacauuccgcaccgccgcuacagaagucucucuucuggccggauccgaggaauuuaaugccaccaaacucuucgagguggacaccgauagcugcgaaagauggaugucuuguaagagcgaguuucugaagaaauacaugcauaagguuaugaacgaccuuccuuccugcccguguucuuaucccacagagguggcuuacagcacggcggacauuuucgaucggaucaaaagaaaggacuuucgcuggaaggaugccuccggcccuaaagaaaagcuggagaucuauaaacccaccgcucgguacugcauuagaagcaugcucucucuggaauccacaacccuggccgcccagcacuguugcuacggcgacaacaugcagcucaucacacgcgggaagggagcuggcaccccuaaucugauuagcacggaguucucugccgaacuucauuauaaagucgaugugcugcccuggaucauuugcaagggggacuggucccgguacaacgaggcgagaccgccuaauaacggacaaaaauguacagagagccccuccgaugaagacuauaucaagcaguuccaggaggcucgcgaauacuga

SEQ ID NO: 70882 - RNA, 879 nt, Artificial Sequence
  derived and/or modified sequence opt5 from ISM2__Homo_sapiens__NP_872315
augagagcccugcgggaccgcgcuggccuccugcuuugcgugcugcuccuggccgcgcuucuggaggcugcccucgggcugcccgucaagaaaccuagacugcggggaccgcgccccggcagccucaccagacuggccgaaguuuccgcuucuccugauccccggccucuuaaggaggaagaggaagcuccccugcucccucgcacacaucugcaggccgagccgcaccaacacggguguuggacggugaccgagcccgccgcgaugacaccuggaaacgccacacccccuagaacccccgaagugaccccgcuucggcuggagcuccagaaacugccuggccuggcuaauacaacccucagcacgcccaacccugacacccaggccuccgcuucucccgauccccgcccucugagagaagaggaggaagcccggcuucugccgcgcacacaucuccaggcggagcugcaccaacaugggugcuggaccgucacagaacccgccgcucuuaccccuggaaaugccacgcccccuagaacacaggaggugacaccccugcuccuggaacugcagaagcucccggagcugguucacgcuacccuuagcaccccuaaccccgacaaucagaccaugucccugcggcgcucuggcgugccuggccuccccgccgucgggacagccgcucuggcgagcuccagaggacuuggcccuguggccauggcugcccugcccccgcggccuguucccgugacgugucccccuguccucgcccugagaacccgcacaccgugggcuagccccgugcggucuggguccagcuggccugccaugcugagaaccugcaugaucaaaauguggacagcggugcgcucuggauga

SEQ ID NO: 70883 - RNA, 1356 nt, Artificial Sequence
  derived and/or modified sequence opt5 from ISPD__Homo_sapiens__NP_001094896
auggaggccgggcccccugggagcgcuagaccggccgaacccggaccuugccuguccggccagcggggcgcggaccacaccgcuucugccagccuccaauccguggccggaacagagcccggccgccauccucaggcugucgccgcuguucugcccgccgggggauguggcgaaagaaugggcgugccuacgccgaagcaguucugccccauccuugagcggccucugauuucuuacacccuccaggcgcuggaacgcguguguuggaucaaagauauugucguggccguuacaggggagaacauggaggugaugaaaagcaucauucaaaaguaucagcacaagagaaucucccuugucgaagcuggagugacccggcaucgcucuaucuuuaauggccugaaagcccucgcugaggaccagauuaacagcaagcuguccaagcccgaaguugugaucauucacgaugccgucagaccuuucguggaggagggggugcugcucaaagucguuacagcggccaaggaacauggagcugccggcgcuauccggccccuggugagcaccguggucucuccguccgccgacgggugccuugauuacagccuggagcgcgccagacaccgggcuucugaaaugccucaggcguuucucuucgacgugauuuaugaggccuaccaacaguguuccgauuaugaccuggaauuuggaacagagugccuucagcuggcucucaaauacuguugcaccaaggccaaacugguugagggcagccccgaucuguggaaggugacguauaagcgcgaccucuacgccgcugaaucuaucauuaaagagagaaucucccaggaaaucugugucgugauggauaccgaggaagacaauaagcacguuggccaucugcuugaggaggugcugaaaagcgaacucaaccacgucaaggugacauccgaggcccuggggcaugcgggacggcaccuucaacagauuauccuggaucagugcuacaauuucgucugugugaacguuaccacaucugacuuucaagaaacccagaaacuccugagcaugcuggaggaauccagccucugcauucuguauccuguggucgugguuucugugcacuuccuugacuuuaagcuggucccucccucccagaaaauggagaaucucaugcagauccgcgaguucgcuaaggaagugaaggagagaaacauucugcuuuacggccugcucaucagcuauccccaagaugaccagaaacugcaggaaucucugcggcagggggccaucauuaucgccagccucauuaaggagagaaauuccggacugaucggccaacuucugauugcuuga

SEQ ID NO: 70884 - RNA, 1101 nt, Artificial Sequence
  derived and/or modified sequence opt5 from IST1__Homo_sapiens__NP_001257904
augcugggcagcggguucaaggccgagagacuccgggugaaccugcgccuugucaucaauagacugaaacuccuggaaaagaaaaagaccgagcuugcucagaaagcccggaaggaaauugcggacuaccuggcugccggaaaggaugagcgcgccagaauccggguugaacacauuauccgcgaggacuaucucguggaggcuauggaaauucuggagcuguacugcgaucuccugcuugccagauuuggccugauccaauccaugaaagaacucgacucugggcuggcugagagcguguccacacuuaucugggccgcgccccggcugcagucugaggucgccgaacucaagauuguggcugaucagcugugugccaaauauagcaaggaguacggaaaacugugccgcacgaaccagaucggcaccguuaaugacagacucaugcauaagcuguccguggaagcuccuccgaagauucuugucgagcgguaucugaucgaaauugccaaaaacuacaaugugcccuaugagccugauucuguugugauggcggaggcucccccuggggucgaaacagaccucaucgaugugggauucaccgacgaugugaagaaaggcggccccgggcgcggaggcagcgggggauuuacagcuccugucggcgggccggacggaaccguucccaugccuaugcccaugccuaugcccaugccguccgccaacacaccuuucagcuacccccugccuaagggccccucugauuuuaauggccuucccauggggaccuaccaagccuucccuaacauucacccgccccagaucccugccacgcccccuuccuaugagagcguggacgacaucaaugccgauaaaaacauuucuuccgcucagaucgugggacccggcccgaagccugaagcgagcgccaaacugcccucuagaccugcugacaauuacgauaacuuuguccuccccgagcugccuuccgugcccgacacccugccgacagccagcgccggggcuuccaccucugccagcgaagauauugacuucgaugaccucucccggcgcuuugaggagcugaagaagaaaacauga

SEQ ID NO: 70885 - RNA, 738 nt, Artificial Sequence
  derived and/or modified sequence opt5 from ISX__Homo_sapiens__NP_001290437
augugcgccgaggugggccccgcucuguguagagggauggaacggaacagccucggaugcugugaggccccuaagaaacugucccuuucuuucagcaucgaagcgauucugaagcgcccggcuagacgguccgacauggaucgccccgagggcccuggggaagagggacccggcgaggccgccgcuucugggagcggacucgaaaaaccucccaaggaccagccucaagagggcagaaaauccaagcggcgcgucagaaccacauuuacgaccgaacagcugcacgagcuugagaagaucuuccauuuuacacacuacccggauguucauauucggucucagcuggccgcucgcaucaaucuccccgaagccagagugcagauuugguuccaaaaccagcgggcgaaauggcgcaagcaggagaaaaucggcaaucugggggccccucagcaacugagcgaggcuuccguggcccuccccaccaaccuggacgucgcuggaccuacauggaccagcacagcccuuagacggcuggcgcccccgaccucuugcuguccuuccgcccaggaucagcucgcuagcgccugguuucccgcuuggaucacgcugcuuccugcccaccccugggaaacccagcccgugccuggccugccgauucaucaaacaugcauccccguucucuguauucugccucccccucaccccaagugggggucuaucugcgccaccuccacauga

SEQ ID NO: 70886 - RNA, 1515 nt, Artificial Sequence
  derived and/or modified sequence opt5 from ISYNA1__Homo_sapiens__NP_001164409
auggaggccgcugcccaguucuuuguggaaagccccgacgucguuuacggcccugaggcgaucgaagcucaauaugaguacagaaccacacgggugucccgcgaagggggagugcugaaggaggccaacuauuacggcucucucacgcaggccgggaccgucagccugggacuugaugcugagggccaggaaguguucguuccguuuuccgccgugcugcccauggucgcuccuaaugaccucguguucgaugggugggacauuucuagccugaaccuugccgaggcgaugagacgggccaaaguucuggauuggggacuccaggaacaacuguggccccacauggaggcucugcgcccuagacccuccguguauaucccugaguuuauugccgcuaaucagucugcccgggcggacaaccucaucccgggcagccgcgcccagcagcuggaacaaauuagacgggauauccgcgacuucagauccagcgcuggccuugauaaggucaucgugcuguggacagccaauaccgagcgguuuugcgaagugauucccgggcucaacgacacagcugagaaucugcuucgcaccaucgaacugggacucgaggucucuccuuccacacuguucgccguugccagcauucuggagggcugugcuuuucucaacgggucuccccagaauacccuggugccuggagcgcuugaacuggccuggcagcauagaguguucgucggcggggaugacuuuaaauccggacagacgaaggugaaaagcguucucguggauuuccugaucggcucuggccuuaagaccauguccauugucagcuacaaccaccuggggaauaacgacggagagaaucucuccgcuccccugcaauuucggucuaaggaagugagcaaauccaacguuguggacgauaugguccagagcaauccggugcuguauacaccuggcgaggaacccgaccauugcgucgugaucaaguacguuccuuacgugggggauucuaaacgcgcccucgacgaguauaccuccgagcugaugcuuggaggcacaaacacccugguccuccacaacacgugugaagauagccugcuugccgcucccauuaugcuggaccucgcccugcugacagagcucugccagagagugucuuucuguaccgauauggaccccgaaccucaaacauuccauccgguucugagccuucuguccuuucucuucaaggcgccccuggugccucccgggucuccugucgugaaugcucuguuucggcagagaagcugcaucgagaacauccuucgcgccugugugggacugcccccgcagaaucacaugcuccuggaacacaaaauggagcggccuggccccucccucaagagaguuggcccugucgccgcuaccuaccccaugcugaacaagaaagggccugugcccgccgcuaccaauggaugcacaggcgaugccaacgggcaucuucaggaggaaccgccuaugcccacgaccuga

SEQ ID NO: 70887 - RNA, 2712 nt, Artificial Sequence
  derived and/or modified sequence opt5 from ITCH__Homo_sapiens__NP_001244066
augagcgacuccggcucucagcuggggagcaugggaucccucaccaugaagucucaacugcagaucacagugauuagcgccaaacuuaaggagaacaaaaagaauugguucggccccuccccuuacgucgaaguuacgguggaugggcagucuaaaaagaccgagaagugcaacaauacaaacagcccgaaauggaagcagccccugaccgugaucgucacaccuguguccaaacuccacuuuagaguuuggagccaucaaacccugaagucugacgugcuucugggaacagcugcccucgauauuuaugaaacccugaaauccaauaacaugaagcuggaggaagucgugguuacgcuccagcugggcggggacaaggagcccaccgagacaaucggagaucuuagcauuugucuggacggccuccagcuggaaucugagguggucaccaauggcgaaacaaccugcuccgagaacggggugagccuuugucugccucggcucgagugcaauucugcgaucuccgcucacuguaaccugugccugcccggacucagcgauuccccuaucucugccagccgcguggccggcuucacgggggcuucccagaaugacgauggaagcagaucuaaagacgaaacacgggucuccaccaacggcagcgaugacccggaggaugccggggcuggagaaaaucgcagaguuucuggcaacaauagccccucccugucuaacggcggguuuaagccuagccggcccccucgccccuccagaccgccucccccuacaccccggcgccccgccagcgugaacggaucuccuuccgcgaccagcgagucugacggcuccagcaccgggucccuuccgcccacaaauacgaacaccaauacaucugaaggagccaccagcggccugauuaucccucucacaauuuccgggggaucuggccccagaccucugaaccccgugacccaagcuccgcuuccucccggcugggagcagcgggucgaccagcaugggcgcguguacuauguugaucacguggagaaaagaacgacaugggaccggccugaaccccugccucccggaugggagcgcagagucgauaauaugggccggaucuacuauguggaccauuucaccagaaccacaaccuggcagcgcccgacacucgaaagcguucggaacuacgagcaauggcagcugcagagaucccaacugcagggggccaugcagcaguuuaaucaacgcuucauuuauggaaaccaggaucucuuugcuacgagccagucuaaggaguucgacccucugggcccccuucccccugggugggaaaaacggaccgauuccaauggcagaguguacuuugucaaccacaauacacgcaucacccagugggaggacccgcggagccaaggacagcugaacgaaaagccccucccugagggcugggaaaugagauucacaguggaugggauucccuacuuugucgaccacaaucgccggaccacgaccuauaucgauccuagaacaggaaaaucugcccuggacaacggcccccagaucgcguacgugcgcgacuucaaggccaagguucaguauuuucgguucuggugucaacagcuugcuaugccucagcauauuaaaaucaccgugacaagaaagacccuguucgaggauuccuuucagcaaauuaugagcuucucuccccaggaccuccggcgcagacugugggucaucuuuccgggggaagagggacuggauuacggcgggguggcccgggagugguucuuucuccugagccacgaaguucuuaauccuauguauugccuguucgaguacgcuggcaaagacaacuauugucuccagauuaaccccgccuccuacaucaauccugaucaucugaaguacuuuagauucaucggacgcuuuauugccauggcucuguuccacggcaaauuuaucgacacgggguucagccuucccuuuuauaagcggauucucaacaagccggugggacugaaagaucuggaaucuaucgacccugaguucuacaauucccucauuugggucaaggagaacaauaucgaagagugcgaucuggaaauguauuucagcguggacaaagagauccuuggcgaaauuaagucccacgaucugaaacccaacgggggaaauauccucgugacagaggagaacaaggaagaguacauuagaaugguugcggaauggcgccugucuagaggcgucgaggaacaaacccaggccuuuuucgagggguuuaaugagauccugccucagcaguaucuucaauacuucgacgcuaaggaacucgaggugcugcuguguggcaugcaggaaauugaucucaacgacuggcagcggcaugccaucuaucgccacuacgccagaacaagcaaacagauuaugugguuuuggcaauucgugaaggagaucgacaaugaaaaacggaugcgccugcuucaguuugucaccggaaccugcagacugcccgugggcggguucgcugaucucaugggauccaacggcccccagaaguuuugcaucgagaaaguugggaaggagaauuggcugccucggucucauacauguuucaaccgccuggaccuuccgcccuacaagagcuaugaacagcucaaagagaagcugcuguuugccauugaagagacggagggauucggccaagaauga

SEQ ID NO: 70888 - RNA, 1395 nt, Artificial Sequence
  derived and/or modified sequence opt5 from ITFG1__Homo_sapiens__NP_001291931
auggacgugcugcucaccuaccugcccaagaacuaugccaaaagcgagcuuggcgcugucaucuucugggggcagaaucaaacacuggauccuaacaauaugacgauucucaacagaaccuuucaggacgaaccgcugaucauggauuucaauggagaccuuauucccgauaucuuuggcauuacaaacgaguccaaucagccucagauccugcucgggggaaaccugucuuggcaccccgcccugaccacaaccagcaagaugcggaucccucauucccacgcguucauugaccucacagaagauuuuaccgcugaccuguuccuuacgacccugaaugccacaaccucuacauuucaauucgagaucugggaaaaccucgauggcaauuuuagcguuuccaccauucuggagaaaccccagaacaugauggugguggggcagucugccuucgcugacuuugauggagacggccauauggaucaccuucugccuggcugcgaggacaagaauugucagaaaagcacgaucuaccucguccgcuccgggaugaagcaaugggugccgguucugcaggacuucagcaacaagggaacacuguggggcuuugugcccuucgucgaugaacagcagccuaccgagauucccaucccuauuacacuccauaucggggacuauaauauggauggauaccccgacgcccuggugauccuuaaaaacaccucuggcuccaaccaacaggcuuuccugcucgaaaauguuccgugcaacaaugccagcugugaggaggcgagacggauguuuaagguguauugggaacugaccgaucuuaaccagauuaaagacgccauggucgcuacauucuuugauaucuacgaggacgggauucuggauaucguggugcucucuaagggauauacgaaaaaugacuucgccauucacacccugaagaacaauuuugaagcugaugccuacuucgucaagguuaucgugcuguccggccucugcagcaacgacuguccucgcaaaaucacacccuuuggcgugaaucaaccugggcccuacauuauguauaccacagucgacgcgaacggauaccugaagaauggcucugccgggcagcuuucccagagcgcucaccuggcccuccagcugcccuauaacgugcuuggacugggcagauccgcuaauuuccucgaucaucuguacguugggaucccucggccgucuggagagaaaagcauucgcaagcaagaauggaccgccaucauucccaacucccagcugaucgugaucccuuauccccacaaugucccuagaagcucucaucggugccucuguuuucaccugggcaacaacuggcacuucacgcuugccggcaaagagucccgcuga

SEQ ID NO: 70889 - RNA, 1659 nt, Artificial Sequence
  derived and/or modified sequence opt5 from ITFG3__Homo_sapiens__NP_114428
augcuggaccacaaggaucucgaggccgaaauccauccccugaaaaacgaggaaagaaagagccaggagaaucuuggcaacccuuccaaaaaugaagacaacgugaagucugcuccgccccaaagccggcugucccgcugcagagccgcggcuuucuuucucucucuguuccuuugucuguuugucguuuucguggugagcuuugucauuccuugccccgaucggccugccucccagcgcauguggagaaucgacuacucugccgcugugauuuaugauuuccucgccguugacgauaucaauggggaccggauucaggaugugcuguuucuguacaaaaacaccaauagcuccaacaauuucagccgcucuugugucgacgagggauuuuccagccccugcacauucgcugccgcggugucuggcgccaacggguccacgcucugggagagaccuguugcucaggauguggcccuggucgaaugugcugugccgcaaccccggggaagcgaggccccuucugcgugcauccuugugggccgccccuccagcuuuaucgccgucaaucuguucaccggggaaacacucuggaaccacuccucuagcuuuuccggaaaugcuagcauucugucuccucuucugcagguucccgacguggauggcgacggcgccccggaccuccuggugcugacccaggagagagaggaagucuccgggcaucucuauagcggaucuacaggccaccagaucgggcugcggggaagccuuggcguggauggggaguccggauuccugcuccauguuacccgcacaggcgcucacuacauucuguucccuugugccucuagccuuugcggcuguuccgugaaggggcuguaugaaaaggucaccggaagcggcgggcccuuuaaaucugacccucacugggaguccaugcucaacgccacgaccagacggaugcugagccauucuuccggagcugugcgcuaccugaugcacguucccggcaaugcgggggccgaugugcuccuggucggaagcgaggcuuucgugcuucuggacggccaagaacucacacccagauggaccccuaaggccgcccauguccugcggaaaccgaucuuuggcagauauaagcccgauacacuugcuguggccguugagaacgggaccggaacggaccgccagauucuguuccucgaucugggcacaggggcggugcugugcucccucgcucugccuucucuucccggaggcccucugagcgccucccuccccaccgccgaccaccggucugccuuuuucuuuugggggcugcacgaacugggcagcacauccgagaccgaaaccggagaggcuagacauagccuuuacauguuccacccgacacucccucgcguccugcuggaacucgcuaacgugucuacgcauaucguugccuuugaugcggugcuguucgagcccucccggcacgccgcuuacauucuucugaccggcccugccgacagcgaggcucccgggcucgucucugugaucaaacauaaggugagagaucugguuccuuccagccgcgucgugcggcugggagaaggcgggcccgacucugaccaggccaucagagaucgcuuuagccggcuuagauaucaguccgaggcguga

SEQ ID NO: 70890 - RNA, 3111 nt, Artificial Sequence
  derived and/or modified sequence opt5 from ITGA10__Homo_sapiens__NP_001289969
augaacaucacccacgccuacagccagggccaucaaaagcugaaucucgacacaguguccuauaacaugcugggggucgauucugacggaugccccacguacauggauguugugauugugcuugacggcagcaauuccaucuauccuuggucugagguccagaccuuccugagacggcucguggggaaacuguuuauugauccggaacagauccagguuggacuugugcaauacggcgagagccccguccacgaauggucccugggggacuuccgcacaaaggaggaagugguuagagcugccaaaaaccucucucggcgcgagggaagagagaccaagacagcgcaggcuauuaugguggccuguaccgaaggcuuuagccagucccauggcgggcggccugaggccgcucgccugcuggucguggugacagauggagaaagccacgacggcgaggagcuccccgccgcucugaaagccugcgaagcggggagagucacccgguauggaaucgccguucuuggccauuaccugcgcagacagcgggauccuucuuccuuccuccgcgagaucagaacgauugcuagcgaccccgaugaacgguuuuucuuuaaugugaccgacgaggccgcucugacagauaucguggacgcccuuggggaccgcauuuucggacuggaaggcucucacgcggagaacgaguccagcuuuggccucgaaaugucucaaaucggguucuccacccacagacugaaggauggcauucuguuuggaauggucggggccuaugacuggggaggcagcgugcucuggcuggaagggggacaucggcuuuucccuccgagaauggcucuggaagaugaguuucccccugcccuccagaaucacgcugccuaccugggcuacuccguuucuagcaugcuucugcgcggcgggcggagacucuuccuguccggagcuccccgcuuccggcauagaggcaaggugaucgccuuucagcugaaaaaggacggggcgguccgcguggcccagagccuccaaggagaacagauuggcucuuauuucggguccgagcuguguccucuugauacagaccgggauggcaccacggacguucugcucguggcugcccccauguuucugggaccgcagaacaaagagacaggcagagucuacguguaucuugucgggcaacagagccugcucacccugcagggaacacugcagccugaacccccucaagaugcccgcuucggcuuugcuaugggggcccuccccgaccugaaucaggauggauucgcggacguggcuguuggcgcuccccuugaggacgggcaccagggcgcccuguaccucuaucacggaacccagucuggcgugcggccucauccggcccaaagaaucgccgcugccagcaugccccacgcgcuguccuacuuugggcgcucugucgauggacggcuggaccuugauggcgacgaucucguggacguugccgugggggcucagggagccgcuauccugcugagcuccagaccuauuguccaucucacccccagccuggaagugacaccucaggccaucucugugguucagcgggauugccgcagacggggccaagaggcggucugucuuacggccgcucugugcuuccaggugaccuccagaacacccgggcgcugggaccaccaguuuuauaugcgguucaccgccagccucgaugaauggacagcuggcgccagagccgcuuuugacggaucuggccagcgccuguccccgagacggcugcgccuuagcguggggaacgucaccugugagcaacuccauuuccacgugcuggauacguccgacuaccugagaccuguugcgcucacagugaccuuugcccuggauaauaccacaaagcccggaccuguccuuaacgagggcucucccaccagcauucagaaacuggugccuuucuccaaggacugcgggcccgacaaugaauguguuacagaucucgugcugcaggucaacauggacauccggggaucucgcaaggcuccguucgugguuagaggcgggcggcgcaaagugcuggucagcacgacccuugagaauagaaaggaaaacgccuacaacacaucccucagccugauuuucucucggaaucugcaccucgccucccugaccccucaacgcgagagccccaucaaaguggagugcgcugcccccucugcgcaugcuagacuuuguuccgugggccacccugucuuccagacaggagccaagguuaccuuucugcucgaauuugaguuuagcugcucuagccugcugucccagguguucgugaaacuuacggccagcucugauucccucgaacggaacggcacccugcaggacaauacagcucaaaccagcgccuauauccaguacgagccgcaucugcucuuuuccucugaaagcacacugcacagauaugagguccaccccuacgggacccuuccugugggacccggcccugaguucaagacgacacugcgcguucagaaccucgggugcuauguggucuccggacugauuaucucugcgcugcuucccgcuguggcccauggcggcaauuacuuucugagccucucccagguuauuaccaacaaugccucuuguaucgugcaaaaccugacagaaccucccgggccgccuguccaccccgaggaacuccagcauaccaaucggcugaacggaagcaauacccagugccaggugguuagaugucaccuuggccaacuggcuaaagggacagagguguccgucggacuccugcgccuggugcauaacgaguucuuucggagagccaaguucaagagccuuacgguggucucuaccuuugagcugggcacagaggaaggguccguucuccagcugaccgaggcuagccgcuggucugaaucccuccuggagguggugcagacacggccuauucuuaucagccuguggauccucauuggaucuguccugggcggccugcuucugcucgcccugcucguguucugccuguggaaacuuggguucuuugcgcacaagaaaauccccgaagaggagaagagagaagagaaacuggaacaauga

SEQ ID NO: 70891 - RNA, 3567 nt, Artificial Sequence
  derived and/or modified sequence opt5 from ITGA11__Homo_sapiens__NP_001004439
auggaccugcccagaggccucguggucgccugggcucugagccuuuggccuggguucaccgauacauuuaacauggacacgcggaagccgcgcguuauccccggauccagaaccgccuucuuuggcuacacagugcagcaacacgauauuucugggaauaaauggcugguggucggagcgccucucgagaccaacggcuaucagaagacaggggacguguacaaaugccccguuauccauggaaauuguaccaagcugaaccuuggccgggugacacugagcaaugucuccgaacgcaaagauaacaugagacucggccugucucuggcuaccaauccuaaggacaacagcuuccucgccugcucuccccuguggucccacgagugugggagcuccuauuacacgaccggaaugugcagccggguuaauucuaacuuucgcuucuccaagacaguggccccugcccuucagagaugucagaccuauauggauauugugaucguccuggacggcagcaauucuauuuacccguggguggaagugcaacauuuucucaucaacauccugaaaaaguucuauauugggcccggacagauccaggucggcguugugcaguacggggaggaugugguccacgaauuucaucuuaaugacuaccgguccgugaaagauguuguggaggccgcuagccacauugagcaacgcggaggcacagaaaccagaacggccuucggcaucgaguuugcgcggucugaagccuuccagaagggcggacgcaaaggcgcuaagaaggucaugauugugaucacagacggggagucccacgauagcccugaccuggagaaaguuauucagcaguccgaaagagacaacgugacccgguaugccgucgcugugcucggauacuauaaucgcagaggcaucaaccccgagacauuucugaacgaaaucaaguacauugccucugauccugacgauaaacauuucuucaaugucaccgacgaggcggcccugaaggauaucguggacgcucucggggaucggauuuuuagccuggaaggaaccaacaaaaaugagacauccuucggccuugagaugagccaaacgggcuuuucuucccacguuguggaagacgggguccugcucggagccgugggcgcuuaugauuggaacggggccguucugaaggagaccagcgccggaaaagugaucccccuuagagaaucuuaccugaaggaguucccggaggaacucaagaaucauggcgcuuaucugggguacacagucaccagcgugguguccucucgccagggccggguuuacgucgcgggagccccuagauuuaaccacacaggcaaagugauucuguucaccaugcacaauaaccgcagccucacgauccaucaggcuaugcgggggcaacagaucggauccuauuuuggcagcgagauuacaucuguggacaucgauggggacggagucaccgacgugcugcuuguuggcgcccccauguacuucaaugaagggagagagcgcggcaagguguaugucuacgaacugcggcagaaccucuuuguguauaauggaacccugaaagauucccacagcuaccagaacgccagauucgggucuuccauugcuagcguucgcgaccuuaaucaagauuccuauaacgacguggucgugggggccccucuggaggauaaucaugcgggagcuaucuacauuuuucacggcuuccgggggucuauccucaagacacccaaacagagaaucaccgccagcgaacuggccacaggacugcaguacuuuggcugcuccauucaugggcagcucgaccugaacgaggauggccuuaucgaccuggcuguuggagcccucggcaacgcugugauucuguggucucgccccgucgugcaaaucaaugccagccugcacuucgagccuuccaagauuaacaucuuccaccgggauuguaagagaagcgggcgggacgcgacgugccuugccgcuuuucucuguuucaccccgauuuuucuggcuccccauuuccagacaaccacagugggaauccgcuauaaugcuaccauggaugaaagacgguacacgccuagagcccaccuggacgagggcggggaucgcuuuaccaaccgggcgguccuccugucuuccggacaggaacuuugcgagagaaucaauuuccauguucuggacacagccgacuaugugaaacccgugaccuuuagcgucgaguacucucucgaagauccugaccacggccccaugcuggaugacggguggccgacaacccugcgcguguccguuccuuucuggaacggcuguaaugaggaugaacacugcgugcccgaccuuguccucgaugcuagaagcgaccugccuacggccauggaguauugccagcgggugcugcgcaagcccgcucaagauuguucugccuacacacucagcuuugacaccacaguuuucauuaucgaauccaccagacagcggguggccgucgaggcuacccuggagaaccgcggagaaaaugcguauagcacagugcuuaacauuucucaguccgccaaucugcaguuugcuagccucauccaaaaagaggauuccgacggcucuauugaaugcguuaacgaggaaagacggcugcagaaacagguguguaaugucagcuacccuuucuuucgcgccaaggccaagguggcuuucagacuggauuucgaguuuuccaagucuaucuuccuucaucaccucgagaucgaacuggccgcggggagcgacuccaacgagcgggacucuacgaaagaagauaauguggcuccccugcgcuuucaucucaaguacgaggccgacguccuguucaccagaagcuccagccuuucucacuaugaaguuaaaccgaacuccagccuggagcgguacgauggaauuggcccucccuuuucuugcaucuuccgcauucaaaaccucgggcuguuucccauccauggaaugaugaugaagauuacaaucccuaucgccaccagauccggcaaucggcugcuuaaacucagagacuuccugacagaugaggcuaacaccagcuguaauauuuggggcaacucuacggaauaucgcccgacacccguggaggaagaccugcggagagccccucagcucaaucacuccaacagcgauguggucuccaucaauugcaacauucgccuggugcccaaucaggagaucaacuuucaccuucuggggaaucucuggcugcggagccugaaggcgcuuaaguacaaaucuaugaagauuaugguuaacgcugcccugcagagacaauuccauagcccuuuuaucuuccgcgaggaagaccccucccggcagaucguguucgagauuucuaaacaggaagauuggcaggucccuaucuggauuaucgugggaagcacccucggcgggcugcuccugcuugcccugcucguucuggcucuguggaaacuuggauuuuucagauccgcccggcgcagacgggagcccggccuggacccgaccccuaaggugcucgaauga

SEQ ID NO: 70892 - RNA, 3540 nt, Artificial Sequence
  derived and/or modified sequence opt5 from ITGA1__Homo_sapiens__NP_852478
auggcccccagaccucgggcucgcccgggcguggccgucgcgugcuguuggcugcucaccguugugcugagaugcugugugagcuucaacgucgacgugaagaauagcaugacauuuucugggcccguugaggauauguucggauacacggugcagcaauaugaaaacgaggaaggcaaauggguccuuaucgggagcccucuggugggacagcccaagaaucggaccggcgacguuuacaaaugcccuguggggcgcggagagucccuccccugugucaagcuggaucuuccugugaacacaucuauuccgaaugugaccgaagucaaagagaacaugacauuuggcagcacccugguuacaaaucccaacggcggguuccucgcuugcggaccucuguaugccuacagauguggccaucugcauuauaccacggggaucugcuccgacgugucucccaccuuucagguggucaauagcauugccccugugcaggaguguuccacacaacucgauaucguuauugugcuggacggaagcaacucuaucuaccccugggauuccgucaccgcuuuccuuaaugaccugcucgaacggauggauaucggcccgaagcagacacagguggggauuguucaguauggagagaacgugacccacgaauuuaaucugaacaaguacagcucuacggaggagguccuuguggccgcuaaaaagaucguccaacgcggcggcagacagacaaugaccgcccuggggauugacacagcgcggaaagaagccuucaccgaggcucgcggagccagacggggcgugaagaaaguuauggugaucgucaccgauggggaaucccaugacaaucaccgccucaagaaggugauucaggauugcgaggacgaaaacauccagagauuuagcauugcuauccugggaucuuacaaccggggcaaucuguccacagagaaauucguugaggaaaucaagagcauugccuccgagccuacggaaaaacacuuuuucaacgugucugacgagcucgcgcuggucaccaucgugaagacacuuggggaacgcauuuuugcccuggaggcuaccgccgaucaaagcgcugccuccuucgagauggaaaugagccagacaggauucucugcccacuauucccaggacugggugaugcucggcgcuguuggcgcguacgauuggaaugggaccgucgugaugcaaaaagccagccagaucauuauccccagaaacacgacauuuaauguggagucuaccaagaaaaacgaaccucuggcuagcuaucuuggauacaccgucaauuccgccacagccucuagcggcgacgugcuguauaucgcugggcagccccgguacaaccacaccggacagguuauuaucuauagaauggaggauggcaauauuaagauccuccaaacacuguccggggaacagauuggcagcuacuucggaucuauccugacgaccacagacaucgauaaggacuccaacaccgauauucuccuggugggcgcccccauguacauggggacagagaaagaggaacagggaaaggucuauguguacgcgcuuaaucagacccgcuuugaguaucaaaugagccuggaaccuaucaaacagacguguuguucuucccggcagcauaacagcugcaccacagagaauaagaacgagccgugcggcgcuagauucgggaccgccauugccgcuguuaaagaccucaaucuggauggauuuaacgacaucgugauuggcgcuccccuugaagacgaucacgggggcgccgucuacaucuaucauggauccggcaagacaauucgcaaggaguacgcccagcggaucccuucugggggagacggcaaaacccugaaguucuuugggcaaagcauccacggagaaauggaucucaacggcgacgggcugacggaugugacaauuggcggacugggcggggcggcccucuucugguccagagacguugcuguggucaaagugaccaugaauuuugagcccaacaaggugaauauccagaaaaagaacugccacauggaaggaaaggagacagucuguauuaaugccaccguuugcuucgaugugaaacugaagucuaaagaggacaccaucuaugaagcugaucuucaguaccgcgugacacuggacagccuccggcagauuuccagauccuuuuucucuggcacgcaagagcgcaagguccagcggaacaucaccgugagaaaauccgaauguacaaagcauagcuuuuacaugcuggauaagcacgacuuccaggauucuguucgcaucacccuggacuucaaucuuacagacccugagaacgggcccgugcucgaugacucccugccgaauagcguccaugaauauauuccuuuugccaaagauugcggaaacaaggagaaauguaucucugaccugagccuccacguggcgaccacggagaaggaucugcuuauuguucggucccaaaaugacaaauucaacgugagccugacagucaagaauaccaaagauucugccuacaacaccagaacaaucgugcauuauucccccaaucucguuuuuagcggcauugaagcuauccagaaggacuccugcgagucuaaccacaacaucaccuguaaggugggguacccuuuccugcggcgcggcgaaauggucacauuuaaaauucuguuccaguuuaauacgagcuaucuuauggagaacgugaccaucuaccucuccgccacaucugauagcgaggaacccccugagacccuguccgacaauguggucaacauuucuauccccguuaaguaugaagugggacugcaguucuacagcuccgcuagcgaguaccacauuucuaucgccgccaaugaaacagugccggaggucaucaacuccaccgaggauauuggcaaugaaaucaacaucuuuuaucucauuagaaaaagcgggucuuucccuaugcccgagcugaaacuuuccauuagcuuucccaauaugacgucuaacggauacccugugcuguauccgaccggccucuccagcuccgaaaaugcuaacugccggccccauaucuucgaggacccuuuuagcauuaauucugggaagaagaugacaaccagcacagaucaccugaagagaggaaccauccuggacuguaacacaugcaaauucgcgaccaucacgugcaaucuuacauccucugacauuagccaaguuaacgugucccucauccuguggaagcccaccuucauuaaaucuuacuuuagcucccugaaccucaccauccgcggcgaacugcggucugagaaugccagccuuguccuguccagcucuaaccagaagagagagcucgcuauucagaucuccaaagauggccugccugggcgcgugccccuguggguuauccuucucagcgccuucgccggacugcugcuccugaugcuucugauucucgcucuguggaagaucggcuuuuucaagagaccucugaaaaagaaaauggaaaaguga

SEQ ID NO: 70893 - RNA, 3120 nt, Artificial Sequence
  derived and/or modified sequence opt5 from ITGA2B__Homo_sapiens__NP_000410
auggccagagcucugugcccccuccaggcccuguggcuucuggagugggugcuccugcuucugggcccuugugcggcuccgcccgccugggcccucaaccuggacccuguccaacugaccuucuacgcugggcccaauggaagccaguuuggcuucucccucgauuuucacaaggacucucaugggcggguugccaucguggugggagcuccucgcacacugggccccagccaggaagagaccgggggagucuuccuuugcccuuggagagccgaaggcggccaguguccgucccugcucuuugaucugcgggacgagacgcgcaacguggggucucaaacacuucagaccuucaaagcgagacagggacugggcgccagcguuguguccuggucugaugucauuguggcuugcgcccccuggcagcacuggaauguucucgaaaagacagaggaggcugagaaaaccccuguggggagcuguuuucuggcccaacccgaauccggacggcgcgcggaauauagcccuugcagaggcaacacacugucucggaucuacgucgagaaugacuucuccugggauaagcgcuauugugaggccggguuuagcucuguggugacccaggcuggagaacucguccugggcgcccccggcggguacuauuuccuuggacugcucgcucaggccccgguugccgacaucuuuuccagcuacagaccuggcauucugcuuuggcaugugucuucccagagccuguccuucgauucuagcaaccccgaguauuuugacggguacuggggauacuccguggcugucggcgaguucgauggggaccucaauacgaccgaauaugugguuggagcgccuacauggagcuggacccugggcgccguggaaauucuggauucuuacuaucaacggcuccaccgccugagaggcgagcagauggcuuccuacuucgggcauagcgucgccgugacagacguuaacggagacggccggcacgaucuucuggugggggcuccccucuauauggagucucgcgccgacagaaaacuggccgaagucggacggguguaccuuuuucugcagcccagaggcccucacgcgcucggggcuccgagccugcugcucaccggcacgcaacuguauggacgcuucggcuccgccaucgcuccccuuggggaucuggaccgggauggauacaaugacaucgccgucgccgcuccuuacggcgggcccucuggaagaggccaggugcucguuuuucuggggcagagcgagggccugcgcucccggccuagccaggugcuugauucucccuucccgacaggauccgccuuuggcuucagccucagaggggcggucgacauugaugacaacggauauccugaucugaucgugggcgccuacggggcuaaucaaguugccguguaucgcgcucagcccgucgugaaggccucugugcagcugcucguucaggacucccugaacccugcggucaagagcugcgugcuuccccaaaccaaaacaccuguguccuguuuuaauauucagaugugcgucggagccaccggccauaacaucccccagaagcugucucucaaugcugaacugcagcuggaccggcaaaaaccgagacaggggcgccgggugcuucuccugggcagccagcaggccggaaccacacugaaccucgaucugggcgggaagcacuccccuauuugucauacgaccauggcuuuccuuagagacgaggccgauuuucgcgacaaacugucucccaucguucucagccugaacgugucccugcccccuacagaagccggaauggcuccggcggucgugcuucacggcgauacccacguucaagagcagacacggauugugcucgacugcggggaggaugacgucugcgugccccagcugcaacugaccgccagcguuacgggaucuccucuccuggugggcgcugauaauguccuugaacugcagauggacgccgccaacgagggggaaggcgcuuacgaggccgaacucgcggugcaucugccccagggagcucacuauaugagagcccuguccaauguggagggcuucgagcggcuuaucuguaaccagaagaaggaaaaugagacacgcgucguucucugcgaacuggggaacccuaugaaaaagaaugcccaaaucggaauugcuaugcuggugagcgugggcaaccucgaggaggccggggaaucugucuccuuucagcugcagaucagaagcaaaaauucucagaaccccaauagcaagauugugcuucuggauguuccugugcgggcggaggcucaagucgaacucagaggaaacuccuuccccgccagccuggugguugccgcugaggaaggcgagcgcgagcaaaauucucuggacuccuggggcccgaaaguggaacauaccuacgagcuucacaacaaugggccuggaaccgucaacggccugcaucucagcauccaucugcccgggcagucccagccuucugaucuccuguauauucuugacauccagccccagggaggccugcaguguuuuccgcaaccucccgugaacccucucaagguugacugggggcugcccauccccagcccuuccccgauucaccccgcccaccacaaacgggauagacgccagaucuuccugccugaacccgagcagccuucuagacuucaggaccccgugcuggucagcugcgauuccgcuccuuguacaguggugcaaugcgaccuccaggaaauggcccggggacagcgcgcgauggucaccguucuggccuuccucuggcugccgucucuuuaccagagaccccuggaucaauuugugcuccagagccaugcuugguucaauguguccagccugccuuacgccgugcccccucugucucuuccccggggcgaggcucaggucuggacacagcugcuccgcgcccuggaggaaagagccauuccgaucugguggguucucgugggcguccuugggggacugcugcugcucacgauucuggugcuugcuauguggaagguuggcuuuuucaagcggaaccgcccuccccuggaggaagacgaugaggaaggggaguga

SEQ ID NO: 70894 - RNA, 3546 nt, Artificial Sequence
  derived and/or modified sequence opt5 from ITGA2__Homo_sapiens__NP_002194
augggccccgagagaaccggggccgcuccucugccgcuccugcuugugcuggcccucagccagggaauccugaacugcugucuugcguacaaugucggccugcccgaagcuaagauuuucuccgggccuucuagcgagcaauuuggauaugccguucagcaguucaucaaccccaaaggcaauuggcuccuggugggguccccuuggucuggauuucccgaaaaccggaugggcgacguguacaagugcccugucgaucugagcacagccacgugugagaaacucaaucugcagaccuccacaucuauuccgaacgugaccgaaaugaagacaaauaugagccuuggccugauccucacccgcaacauggggacaggaggcuuccugaccugcgggccccuuugggcucaacaguguggaaaucaguauuacacgaccggcguuugcuccgacauuagcccugauuuucagcugucugccuccuucagccccgcuacacaaccuugucccucucucaucgacguggucgugguuugcgaugaguccaacagcaucuauccgugggacgccgugaaaaauuuucuggagaaguucguccaggggcuggauauuggaccuaccaagacacaggugggccucauccaguacgcgaacaaucccagaguggucuuuaaccugaauaccuauaaaacgaaggaagagaugauuguugccacaucucaaaccucccaguacggcggggaccuuacaaacaccuucggagcuauccaguacgcccggaaauaugcuuacagcgccgcguccggcgggcgcagaucugccaccaaggugaugguggucgugacagauggagaaagccacgacggcuccaugcugaaagcuguuauugaucaauguaaccaugacaauauccuccgguuugggauugccgugcugggauaucuuaaccgcaaugcucuggauacgaagaaccucaucaaggagaucaaagccauugccagcaucccuaccgagagauacuucuuuaaugucucugacgaagcugcgcugcuggagaaggccggcacacucggcgaacagauuuucuccaucgaggggaccgugcagggaggcgacaacuuccagauggaaaugagccaaguuggguuuucugcugauuauagcucccagaaugacauucugaugcuuggagccgugggcgccuucggguggucuggcacaaucguccagaaaaccagccacggacaucugaucuuucccaagcaggcuuucgaucaaauucuccaggaccggaaccacuccagcuaccugggcuauucuguggccgcgaucuccacgggggagagcacacauuuugucgcuggagcuccccgcgccaauuacaccggccagauugugcuuuacucuguuaacgagaaugggaacaucaccgugauucaggcucacagaggagaucaaaucggcuccuauuucgggagcguccugugcuccguggacguugauaaagacacaaucaccgaugugcuccuggucggcgccccuauguacaugucugaccugaagaaagaagagggacggguguaucucuuuacaauuaaggaaggcauccuggggcagcaccaguuccuugagggaccggaaggcauugagaauacgcgcuuugggagcgcuaucgccgcgcuguccgauauuaacauggacggauucaaugacgugaucguuggcucuccccucgagaaccagaacagcggggccgucuacauuuauaauggccaucaaggaaccaucagaacaaaguacucccagaaaauccugggcagcgauggggcuuuucggucucaucugcaguauuucggacgcucccuugacggcuacggggaucucaacggagacagcauuaccgaugugucuaucggcgccuuugggcaagugguccagcuguggucccagagcauugcugacguggccaucgaagcgucuuucacaccugagaagauuacccugguuaauaaaaacgcccagaucauccucaagcuguguuucagcgcuaaauuuagacccacgaagcaaaauaaccagguggccauugucuacaauaucacccuugaugcugacggcuucuccagccgggugacaucuagaggacuguuuaaggaaaacaaugagcgcugccuccagaaaaacaugguugugaaucaggcccaauccugcccugaacacauuaucuauauucaggagcccagcgaugucgugaacucccuggaccugcggguugauaucucucuugagaauccgggcaccagcccugcccucgaagccuacuccgagacagcgaagguguucucuauccccuuucacaaagacuguggggaagauggacugugcauuagcgaccugguccucgacgugagacagaucccugccgcucaggagcaacccuucauuguguccaaccagaauaagcgccugaccuuuucugucacgcuuaaaaacaagcgggagagcgccuauaacacaggcaucguuguggauuucuccgaaaaucuguuuuucgccagcuuuucucucccuguggacgggaccgaggucacaugucagguggcugccucccaaaagagcguugcgugcgaugugggauaccccgcucugaaaagagaacagcaggucaccuucaccauuaacuuugacuucaaucugcagaaccuucaaaaucaggccucucucuccuuccaggcccugagcgagucucaggaagagaacaaggcugauaaucuggugaaccucaaaaucccgcugcuuuaugacgccgagauccaccugacacgcuccacgaauauuaacuuuuacgaaaucagcuccgauggcaauguuccuagcauugugcauucuuucgaggacgucggccccaaguuuaucuucagccucaaagugaccacaggguccguucccgugucuauggcgaccgucauuauccacauuccucaauauacaaaggaaaagaacccgcugauguaccugaccggagugcagacggauaaagcuggcgacaucagcuguaaugccgauaucaacccccuuaagauugggcagacauccucuagcguguccuuuaaaucugagaauuuccggcauaccaaggaacucaacugcagaaccgccagcuguuccaacgucacaugcuggcugaaagacguucacaugaagggagaguacuuugugaaugugaccacacgcaucuggaacggcacguucgcuagcucuaccuuucagacaguccaacugaccgccgcugccgagauuaauacauauaacccugaaaucuacgugauugaggauaauaccguuacgaucccccucaugaucaugaaaccugacgaaaaggcggaggugcccaccggggucauuaucggauccauuaucgccggcauucugcuucugcucgcucugguggccauccuguggaaacuuggcuucuuuaaacggaaguaugaaaagaugacaaagaacccugacgagaucgaugagaccacagaacugagcucuuga

SEQ ID NO: 70895 - RNA, 3156 nt, Artificial Sequence
  derived and/or modified sequence opt5 from ITGA3__Homo_sapiens__NP_002195
augggccccgggccuagcagagccccgcgggcuccccgccugaugcucugcgcccuggcgcuuaugguggcugccggaggcugugucguuuccgccuucaaccuggacaccagauuucucguggugaaggaggcugggaauccuggaucucuguucggcuacagcgucgcccuucaccggcagacagaacgccaacagagauaucugcuccuggcuggggcgccccgggagcuggccgugccugauggauacacgaaccgcaccggcgccguuuaucucugcccccugacagcucauaaagacgauugugaaagaaugaauaucaccgugaagaacgacccuggccaccauauuaucgaggauauguggcuuggggucacaguggccucccagggaccggcuggccggguucuggugugcgcccaccgcuacacccagguccucuggucugggagcgaagaccaaagacggauggugggaaaauguuaugugcgcggcaaugaucuggagcuugacuccucugaugacuggcagacauaccauaacgagaugugcaauagcaacaccgauuaucuggaaacggggaugugucagcucggaaccuccggcggcuuuacacagaauaccgucuacuucggggcgcccggagccuacaacuggaagggcaauagcuauaugauucaaagaaaagagugggaccugucugaauacuccuauaaggauccugaggaccaggggaaccuguacaucggauauacaaugcagguuggcagcuuuauucuccaccccaagaauaucaccaucgugacgggggcuccucggcaccgccauaugggagccguguuccugcuuucucaggaggcuggcggcgaccugagacggagacaaguccucgaagggucccaggugggagccuacuuuggcagcgccauugcucuggcggaucuuaacaaugacggguggcaggaucugcucguuggagcccccuauuacuucgagcgcaaagaagaggugggcggggcuaucuacgucuuuaugaaccaagccggcacaucuuucccggcccacccuucccugcugcuccauggacccagcggcuccgcuuuugggcugucuguggccagcauuggagacaucaaccaggauggcuuccaggacauugcgguuggggcuccuuuugaaggacuuggcaagguguauaucuaccacuccagcucuaaagggcugcuccggcagccccaacaggucauucacggcgagaagcugggacuucccggccuggccaccuucggguauucccucagcggacagauggauguggacgagaauuucuacccugaucugcuggucggcucucucagcgaccauaucgugcugcuuagagcccgcccgguuaucaacauugugcacaaaacacuggucccccggccugcugugcucgaucccgcccugugcaccgcuaccuccuguguucagguggaacugugcuuugccuauaaucaaucugcggggaacccuaauuacagacgcaacaucacacuugccuauacgcucgaggcugaccgggacagacggcccccgcgccugagauucgccggaagcgaauccgcugucuuucauggcuucuuuagcaugccugagaugcgcugucagaagcuggaacuccugcuuauggauaaucugcgggacaagcucagacccauuaucauuucuaugaacuacucccugccucugcggaugcccgaucgcccuagacuugggcuccggagccuggacgccuaccccauccugaaucaggcgcaggcccucgagaaccacaccgaggugcaauuccagaaagaaugcggcccggauaauaagugcgagucuaaccugcagaugagagcugccuuuguguccgaacagcaacagaaacuuagccgccugcaguauucccgggacguuagaaagcuccugcugucuaucaaugucacaaacacccgcacaagcgagagauccggagaagaugcucaugaggcccuucucacccugguggugccucccgcccugcuccugucuagcguccggcccccuggcgcuugucaagcgaaugagacgauuuucugcgaacuugggaacccguuuaaacgcaaccagagaauggagcugcucaucgccuucgaagugauuggaguuacacugcacacccgggaccuucaggugcagcugcaacucuccaccagcucucaccaggauaaucuguggcccaugauccugacacuccuggucgacuacacccuucagacaucccugagcauggugaaccaucgccuccaguccuuuuucggcgggacgguuaugggagagucuggcaugaagaccguggaggaugucgggagcccucugaaauaugaauuucaagugggccccaugggagagggccugguugggcuuggaacacuggugcucggccuggaauggccuuacgaggucucuaaugggaaguggcuccuguaucccaccgaaauuacagugcacggaaacggcagcuggccuuguagacccccgggcgaccuuaucaauccucugaaccucacccuguccgaucccggggaccggccuagcucuccccagcgcagacggcgccagcuggacccgggaggcgggcagggaccucccccugugacgcuugcugccgccaagaaagcuaaguccgagaccguccugacaugcgccaccggcagagcgcauuguguuuggcucgagugccccauccccgaugcuccuguggugacaaaugucaccgugaaagcccggguuuggaacagcacguucauugaagacuacagagauuucgaccgcgugcgggucaaugggugggccacacuguuucucagaaccuccaucccgacaauuaacauggagaauaagaccaccugguucucuguggauaucgacagcgaacugguugaggaacuucccgcugagauugagcuguggcucgugcuggucgccgugggagcgggccugcuucugcucggccugaucauucuccugcuuuggaaauguggguuuuucaagcgcgcucggacaagagcccuguaugaagccaagcgccaaaaagcugagaugaagucccagccuucugaaacggagcggcugaccgaugacuacuga

SEQ ID NO: 70896 - RNA, 3099 nt, Artificial Sequence
  derived and/or modified sequence opt5 from ITGA4__Homo_sapiens__NP_000876
auggccugggaggcuagacgggaacccggcccucgcagagccgcggugcgggagaccgucaugcugcuccugugccuugggguuccgacaggacgccccuacaacguggacacggaaagcgcucugcucuaucagggcccucacaauacccuguucggguacuccgugguccuucauucucacggagccaacagauggcugcucgugggcgcccccacagcuaauuggcuggccaacgcuagcguuaucaauccuggggccauuuaucggugucgcaucggaaagaaccccggccaaaccugcgagcagcugcagcucggcuccccuaauggggaaccguguggaaaaacaugccuggaggagagagauaaccaguggcuuggcgugacccugucucggcaacccggggaaaauggaagcauugucacauguggccaucgcuggaagaacaucuuuuacauuaaaaaugagaacaagcucccuaccgggggaugcuauggcgugcccccugaccugagaacggaacuuuccaaacggaucgcgcccuguuaccaggauuauguuaagaaguucggcgagaauuuugccucuugccaggcugggaucagcuccuucuacaccaaagaccugauugugaugggagccccgggcagcucuuacuggacagggucccucuuugucuauaacaucaccacaaauaaguacaaggcuuuccuggauaaacagaaccaagugaaauuuggaagcuaucugggcuacucugugggggccggacacuuccgcucccagcauaccacggaggucguuggcggcgcgccucagcacgaacagauugggaaggccuauaucuuuagcauugacgagaaggaacucaacauccugcacgagaugaaaggaaagaaacuuggcucuuacuucggggcuuccgugugugccguggaucugaaugcugacggauuuagcgaucuccuggucggcgcccccaugcaauccacaauuagagaagaggggcggguguucguuuauaucaacucuggcagcggagccgugaugaaugcuauggagaccaaccuugucggcuccgacaaguacgcggcccgcuuuggggaaagcaucgugaaucugggagauauugacaacgauggcuucgaggacguugcuaucggggccccucaggaagacgaucuccagggagccauuuacaucuauaauggcagagcugacgggauuucuuccacauucagccaacggaucgagggccugcagaucucuaaaagccuguccauguuuggacagucuauuagcggccagaucgaugccgacaacaauggguacguggaugucgcggugggagcuuucagauccgacagcgccguccuccugcgcacccggcccgugguuauuguggaugccucucuuucccaucccgaaagcgucaacagaaccaaguuugacugcguggagaauggcuggccuucuguuuguaucgaucugacacucugcuucuccuauaaagggaaggaggugccgggauacauuguccuguuuuauaacaugagccuugacgugaaucgcaaggcugaauccccuccccgguucuacuuuucuagcaacggcacguccgaugugaucaccgggucuauccaaguuagcuccagagaggccaauugccgcacacaccaggcuuucaugcggaaagacgucagagacauucugacccccauccagauugaagccgcguaucaucucggcccucacgugaucagcaagcgcucuacagaggaauuucccccgcugcagccuauucugcaacagaaaaaggagaaagauaucaugaagaagaccauuaacuucgcccgguuuugugcucacgagaacugcuccgccgaccuccaggugagcgcuaaaaucggauuccugaagccccaugaaaauaaaacguaccuugccgucggcucuaugaagacacugaugcucaacgugucccuguuuaaugcgggggaugacgccuacgagaccacccugcacguuaaacuuccugugggacucuauuucaucaagauucuggaacuggaggagaagcagaucaacugugaagucacagauaauagcggcgugguucaacucgacugcucuauuggguacaucuauguggaucaucugagcagaauugacaucuccuuccuucuggaugucagcucucucucccgcgcugaggaagaccugagcaucaccgugcacgccacaugugagaacgaagaggagauggauaaucugaaacauucccggguuacgguggcuauuccccuuaaguacgaagucaaacucaccgugcacggauuugugaacccuacaucuuucgucuauggcagcaaugacgagaacgaacccgagaccugcaugguugaaaagaugaaucugacauuucacgugaucaacaccggcaauuccauggccccgaacgugucugucgagauuauggugccuaauagcuucagcccccagacggauaaacuguuuaacauccucgacguucagaccacaaccggggagugucauuucgaaaacuaccagagagugugcgcccuggagcaacagaagucugcuaugcagacacuuaagggaauuguccgguuucugagcaaaaccgacaagcgccuccuguauuguaucaaagcggauccccacugccugaauuuccuuuguaacuuuggcaagauggaauccgggaaagaggccagcgugcauauccaacucgaaggaagaccuucuauucuggagauggacgagacguccgcucugaaguucgaaauccgggccacaggcuuuccggagcccaauccuagaguuauugaacucaacaaagaugagaauguggcccacguccugcuugaggggcugcaccaucagcgccccaagcgguacuucaccaucgugauuaucuccucuucccuccugcugggacuuaucguucuccugcugauuagcuacgugauguggaaggcuggcuuuuucaaaagacaguauaagucuauccuccaggaagagaaccgcagagacuccuggagcuacauuaauuccaaaagcaacgaugacuga

SEQ ID NO: 70897 - RNA, 3150 nt, Artificial Sequence
  derived and/or modified sequence opt5 from ITGA5__Homo_sapiens__NP_002196
augggcagcagaacccccgagucuccccugcacgccgugcagcuccggugggggccgcgcagacggcccccucugcuuccccugcuccugcuucugcucccucccccuccgcgcgucggaggcuucaaccuggacgcugaagcccccgcgguucuguccgggccucccggcagcuuuuucggcuuuuccguggaguucuacagaccugggacagauggagugucuguccucgugggcgcucccaaggccaauacgagccaaccgggcguucugcaagggggagccguguaucuuugcccuuggggcgcuucccccacccaguguacaccuaucgaauuugacucuaaagggagccggcugcucgaguccagccugucuuccagcgaaggagaggagcccgucgaauacaagucucuucagugguucggcgccaccgugcgcgcucauggguccagcauucuggccugcgcgccccucuauucuuggagaacagagaaagaaccucuguccgauccgguuggaaccuguuaccugagcacagacaacuuuacccggauccucgaguaugcccccugccgcuccgauuucucuugggcugccggccagggcuacugucaagggggauuuagcgcugaguucacgaagaccggcagagugguccuugggggaccuggcuccuauuuuuggcaggggcagauucugagcgccacacaggaacagaucgcggagucuuacuaccccgaauaucugauuaaucucgugcagggacagcugcaaacccggcaggccuccagcaucuacgacgauucuuaucuuggcuacagcguggcugucggcgaguucuccggggacgauacagaagacuuuguugccggagugccuaaaggcaaccugaccuauggguacgugacgauccucaauggaucugauauucgcagccuguauaacuucuccggcgagcagauggcuagcuacuucggguacgccgucgccgcuacagacgugaauggcgauggacuggacgaccuccugguuggcgcgccccuucugauggauagaaccccggacgggcggccucaagaggugggacgcgucuauguguaccuccagcaccccgccggcaucgaaccuacacccacccugacccuuacagggcaugaugaguuuggaagauucggaucuucccugacgccucucggggaccuggaucaggacggcuauaacgauguugcuauuggagcccccuuuggcggggaaacccagcaaggaguggucuucguguuuccgggcgggccuggaggccuggggagcaagcccucucagguccuccagccccugugggccgcuucccacacaccugacuucuuuggcagcgcccuucggggaggcagagaucuggacgggaauggauacccggaucucaucgugggcuccuucgggguugacaaggcgguggucuaucgcggacggcccauugugucugcuagcgccucccugaccaucuuuccugccauguucaaccccgaggaaagaucuugcagccuggagggcaauccuguugcuuguauuaaccuuuccuuuugccucaaugccagcgggaaacauguggcugacucuaucggcuucacagucgagcugcagcuggauuggcaaaagcagaaaggaggcgugcgccgggcccucuuucuggcguccagacaggccacccuuacgcagacacugcucauccaaaacggggcucgcgaagacugucgggagaugaagauuuaccugagaaaugaaagcgaguuccgcgauaaacugucucccauccacauugcccuuaacuucucccucgacccucaggcucccguggauagccacggacugcggccggcccugcauuaucagucuaagagcagaaucgaagacaaggcgcagauucuccuggauugcggcgaggacaacaucuguguuccugaucuucaacuggaggucuuuggggaacagaaucacguguaccucggagacaaaaacgcccugaaucugaccuuccaugcucagaacgugggcgagggcggggccuacgaagcugagcuucgcgucaccgcucccccugaggccgaauauuccggacucgugcggcaccccggcaauuuuagcucucuguccugcgauuacuucgccguuaaccaaagcagacugcucgugugcgaccuggggaauccgaugaaggcgggagccucccuuuggggcgggcugcgguuuacagucccucaccuccgcgauaccaaaaagacaauccaguucgacuuucagauucugucuaaaaaccugaauaacagccaguccgacgugguuucuuucagacuuagcguggaggcucaagcccaggucacgcucaauggaguguccaagcccgaagccguucuguuuccugugucugauuggcauccccgggaccagccccagaaagaggaagaucugggcccugcuguccaccauguguaugagcucaucaaccaaggcccgagcuccauuagccagggggugcuggagcuuucuuguccccaggcccuggaaggacagcaacuccuguacgucaccagaguuacaggccugaauugcaccacaaaccacccuaucaaucccaaggggcuugagcuggacccugaaggaucccuccaucaccagcagaagcgcgaggcgcccagccggucuuccgcuagcucuggcccucaaauucugaaauguccggaagccgagugcuucagacuccgcugugagcuggggccccuucaccagcaggaaucccagagccugcaacuccauuuuagagugugggccaagaccuuccugcagcgggagcaccagccuuuuucccugcagugcgaagcuguguauaaagcccuuaagaugcccuaccgcauccugccuagacaacucccccagaaagagcggcaggucgcgacggcugugcaguggaccaaggccgaaggaagcuauggcguuccgcuguggaucauuauccucgccauucuguucggccuucugcuccuggggcugcuuaucuacauucuguacaagcucggauucuuuaaacgcucucugccuuauggcacagcuauggagaaggcccaacucaaaccucccgcuaccagcgaugccuga

SEQ ID NO: 70898 - RNA, 3222 nt, Artificial Sequence
  derived and/or modified sequence opt5 from ITGA6__Homo_sapiens__NP_000201
auggccgcugccggccagcugugccuccuguaccuuagcgcggggcugcucuccagacugggagcugccuucaaccuugacacccgggaggauaaugugauccgcaaguauggcgaccccgggucucuguuuggauucagccucgccaugcacuggcaacugcagccugaagauaaaagacugcuccuggucggcgcuccgcgggccgaggcccuuccccugcagcgcgcuaacagaacagggggacucuacuccugugacauuacggcgcggggcccuugcacccgcaucgaauuugauaaugacgccgaucccacaucugagagcaaggaagaccaguggaugggcguuaccgugcaaucccaggggccuggaggcaaaguggucacaugugcucauagauaugagaagcggcagcacgugaacaccaaacaggagucucgcgauauuuucgggagaugcuacguucugagccaaaaucuucggaucgaagacgauauggacggaggcgauugguccuuuugugacgggcgccugagaggacaugagaaguucggcagcugccagcagggcguggccgcuacauuuaccaaggacuuccacuauauugucuuuggggcccccggaacguacaacuggaaaggcaucgugcggguugaacagaagaauaacaccuucuuugauaugaauaucuucgaggacgggccuuaugaggugggaggcgaaacagagcaugaugaaucucucgucccggugcccgcgaacuccuaccugggguuuagccuggacucuggaaaaggcauuguguccaaggaugagaucaccuucgucagcggcgccccucgcgcuaaucacucuggggccguugugcuccugaaaagagacaugaaguccgcucaccuucugcccgaacauauuuucgauggagagggccucgccagcuccuuuggguacgacguggccgucguggaucugaacaaggacggauggcaagauaucguuauuggcgcuccucaguauuucgaccgggacggggaggugggcggagcggucuacguguauaugaaucagcaaggcagauggaacaauguuaaacccauccgccuuaacgggacaaaggauucuauguuuggaauugccgugaaaaacaucggcgacaucaaucaggauggguacccggacauugcugucggagccccuuaugaugaccugggcaagguguucaucuaccacgggagcgccaacggcauuaauaccaaacccacgcagguccucaagggaaucuccccuuauuuuggcuacagcauugcugggaacauggaucuggaccggaauagcuaccccgauguggccguuggaucccugagcgacucugugacaaucuucagaagccgccccgucaucaacauucagaaaaccaucacagugaccccuaaucggauugaucucagacaaaagaccgcguguggcgcuccguccgggaucugccugcagguuaagucuuguuuugaauauacagccaaccccgccggauacaauccuagcauuuccaucgugggcacgcuugaggcugaaaaagagcgccggaagucugggcugucuuccagaguccaguuccgcaaccagggcagcgaacccaaauauacccaagagcucacacugaagcggcagaaacagaaggugugcauggaggaaacccuuuggcugcaggacaauaucagagauaagcuccgcccuauucccaucacagccucuguggagauucaagaaccguccagccggagacggguuaacucccugccugagguccugcccauccucaauucugacgaaccuaaaaccgcucauauugacgugcacuuucugaaggagggauguggcgaugacaacgugugcaauagcaaccuuaaacuggaguacaaguucugcacgcgcgaagggaaccaggauaaauuuuccuaucuccccauccagaagggagucccugagcuggugcugaaggaccagaaagauauugcccuugaaaucacaguuaccaauucucccagcaacccgagaaauccuaccaaggacggcgaugacgcgcacgaggccaaacucaucgcuacauuccccgauacccugacauacuccgccuaucgggagcugagagcuuuucccgaaaagcaacucagcuguguggccaaccagaaugggucucaggcggacugcgagcugggaaacccuuucaaacgcaauuccaacgucacguucuaccuugugcugagcaccacagaaguuaccuuugauacaccggaccucgauauuaaucugaagcuggagaccacgucuaaccaagacaaucuugcccccaucaccgcuaaggccaaaguggucauugaacuccugcuguccgugagcggcguugcuaagccuucucagguguacuucgggggcacagucgugggagagcaggccaugaaaagcgaggacgaagugggcucccucaucgaguaugaauuucgggucauuaaccuggggaagccccuuaccaaucugggaacagccacccucaacauccaguggccuaaagagaucagcaauggcaaguggcugcuguaccuuguuaaaguggaaucuaaggggcucgagaaggugacgugugagccccaaaaagaaauuaacucccugaaccugacagagagccauaauuccagaaagaaacgcgaaaucaccgagaagcagauugaugacaacagaaaauucucucucuuugcugaacggaaguaucagacacugaauugcagcgucaacgugaauuguguuaacauccgcugcccucuuagaggacuggauuccaaggcgucucucauucugcggagccgccuguggaacuccaccuuccuugaggaguacucuaaacucaauuaucuggacauccugaugagagccuuuaucgaugugaccgcugccgccgaaaauauucggcuccccaacgcuggcacacagguccgcgugacgguuuucccgagcaagaccguggcccaauacuccggcgucccuugguggaucauucugguggcgauccuugcugggauucugaugcucgcccugcugguuuuuauccuuuggaaauguggauucuuuaagagaaauaaaaaggaccacuaugaugccacauaccauaaggcugagauccacgcccagcccagcgacaaagaacggcugaccucugaugcguga

SEQ ID NO: 70899 - RNA, 3426 nt, Artificial Sequence
  derived and/or modified sequence opt5 from ITGA7__Homo_sapiens__NP_001138468
auggccggcgcuagaagccgggaccccuggggagccuccgggaucugcuaccuguucggcucucuccugguggagcuucuguuuagccgcgcggucgcuuucaaccucgauguuaugggggcccugagaaaggaaggagagccuggcucccuuuuuggguucucuguggcccugcaccggcagcuccaaccgcgcccccagagcuggcugcuggugggagcuccucaggcccucgcucugcccggccagcaagccaauagaaccggcgggcuuuuugcguguccucugucccucgaagagacagacugcuaucgggucgauauugaccagggagccgauaugcagaaagaaucuaaggagaaccaguggcugggcgugagcguucgcucccaagggcccggaggcaaaaucgugacgugugcucauagauacgaggcccggcagcgcgucgaccagauucuugaaaccagagauaugaucgggcggugcuucgugcugagccaggaccucgcuauucgcgaugagcuggacggaggcgaauggaaguuuugugagggcagaccucaagggcacgagcaguucggauuuugccagcaaggcacagccgcggccuucucuccggauucccauuaucugcucuuuggggcucccggaaccuacaauuggaaaggcacagcccggguugaacugugugcucaggggagcgccgaccuugcccaccuggaugacggaccuuaugaggcuggcggcgaaaaggagcaggacccccgccucaucccugugcccgcgaacucuuacuucggguuuuccaucgauagcggaaagggccuggucagagccgaagaacuuucuuucguggcuggggccccgcgggccaaucauaaaggagcuguggucauucugagaaaggacuccgccagccgccucguuccugaggugaugcuguccggcgaacggcugaccucuggguucggcuauagccucgcgguggcugaucugaacuccgacggauggcccgaucuuaucgucggcgccccuuacuuuuucgagagacaggaggagcucgggggagccguguacguuuaucugaaucaaggcgggcacugggcuggaauuagcccccugcgccuuugcggcucucccgacuccauguuugggaucagccuggccgugcucggcgaucugaaccaggacggauucccugauauugcugucggcgccccguuugacggggauggaaaaguguucaucuaccacggcucuagccuggggguuguggcgaagcccucccagguccucgaaggagaggccgugggcauuaaaucuuuuggguauagccuguccggcagccuugacauggacggaaaucaguacccugaucugcucgucggcucucuggcugacacagccgugcuguuccgggcuagacccauccuucauguuucccacgaggugagcaucgccccucgcucuauugaucucgaacaacccaacugugccgggggacauuccgucugcguggaccugcggguuuguuuuagcuauaucgcggugccguccucuuacagcccuaccgucgcucuggauuaugugcucgacgccgauacggacagacgccugcggggccaggugcccagaguuaccuuccuuucccgcaaucuggaggaaccuaagcaccaggcuucugggacagucuggcucaagcaccagcaugaucgggugugcggagacgccauguuucaacugcaggagaacgugaaagauaagcugagagccauugucgugacccuuagcuacucccuccagacaccccggcugcgcagacaggcuccuggccaagggcugcccccgguugcgccuauccucaaugcccaccagcccagcacccagcgggcugaaauucauuuccugaaacaaggcugcggagaggacaagaucugucagucuaaccuucagcuggugagagcccgcuuuugcacgcgggucuccgauacagaguuccagccccucccuauggacguggacggcaccacagcccuguucgcucugagcgggcaaccgguuaucggacuugaacucauggugaccaaucugcccucugauccugcccagccccaggcggacggcgaugacgcucacgaggcccagcugcucgucaugcugccugauucccuucauuacagcggggugagagcccuggaccccgcugaaaaaccucucugucugucuaacgagaacgccagccacguugagugcgaacugggaaaucccaugaagcgcggcgcgcaagugaccuuuuaucuuauucucuccacaagcggcaucucuauugagacgaccgaacuggaggucgaacugcuccuggcuacaaucuccgagcaggagcuucacccggugagcgccagagcccggguguucauugaacugccucucuccaucgcugggauggccaucccccagcagcuguuuuucucuggagucguucgcggcgagagagcuaugcaaagcgaacgggaugugggguccaaagugaaguacgaggucaccgugucuaaccagggacagagccugcgcacacuuggcuccgccuuucugaauauuauguggccucaugaaaucgcgaacgggaaguggcuccuguaucccaugcaaguugagcucgagggaggccagggcccggggcagaaaggacuguguucuccuagacccaauauucuucaccuggacguggauagccgggaccgcagacggcgcgaacucgagccucccgaacagcaagagcccggcgaaagacaggagccuuccaugagcugguggccggucucuuccgccgagaagaaaaagaacaucacccuggauugcgcucgggggacggccaauugugugguuuucagcugcccccuguacucuuuugacagagcugccgugcuucaugucuggggacgccuguggaacuccacauuccucgaagaguauagcgccgugaaaucucuggaaguuauugugcgggcuaauaucaccgucaaguccagcauuaagaaccucaugcugagagaugcguccaccgugaucccugugauggucuaccuugaccccauggccguuguggcugagggcgugccuuggugggucauccugcucgccgugcuggccgggcugcuuguucuggcucuccuggugcuccugcuuuggaaaaugggauuuuucaagcgcgccaaacaccccgaggcgacagucccucaguaucacgcugugaagauuccgcgggaagacagacagcaauuuaaagaggaaaagaccggcacaauccugcgcaauaacuggggcagcccccggagagaggggccugaugcccaucccauucuggccgcugacggacacccugaacucggccccgaugggcauccgggaccuggcacggccuga

SEQ ID NO: 70900 - RNA, 3147 nt, Artificial Sequence
  derived and/or modified sequence opt5 from ITGA8__Homo_sapiens__NP_001278423
augagccccggcgccuccagagggccucggggaucucaggcuccgcugaucgcgccccucugcugugccgcugccgcccugggcaugcuucuguggagcccugcuugccaagccuucaaccucgacguggagaagcugaccgucuacuccgggcccaaaggaucuuauuuuggcuacgcuguugauuuccacauuccugacgcccgcacagcgagcgugcuugugggggcccccaaggcuaauacgucccagccugauaucgucgaaggaggcgccguguauuacuguccguggcccgcugagggcucugcccagugcagacagauuccuuuugacaccacaaacaaucggaaaauccgcguuaacgggaccaaggaacccauugaguucaaaagcaaucaaugguuuggagcgacagugaaggcccauaagggcaaagucguggcuugugccccucuguaucacuggagaacccucaagcccacaccggaaaaagauccuguugggaccugcuacguggcuauccagaacuucuccgccuaugccgaguuuagccccugucgcaauucuaacgcugacccugagggacagggcuacugccaggcgggguucucccuggauuuuuacaagaauggagaccugaucgucggcggccccgggagcuucuauuggcaaggacaggugauuacggccucuguggcugauaucauugccaacuacuccuuuaaagacauccuccgcaagcuggccggcgaaaagcagaccgaggucgcucccgccagcuaugaugacucuuaccuugaacugguugcggggauuccuagaggagcucagaauuucggcuauguguccaucauuaacagcacagauaugaccuuuauccaaaauuucacaggggagcagauggccuccuacuucggauauaccguggucgugucugacguuaacagcgacggccucgaugacgugcuggucggcgccccgcuuuuuauggagcgggaguucgaguccaauccccgcgaaguggggcagaucuaccuguaccuccaaguuagcucucugcuguuuagagauccucagauucucacgggaacagagaccuucggccgguuuggguccgcuauggcccaucugggagaccuuaaccaggauggcuauaacgacaucgcuauuggggugcccuucgccggcaaagaucagcgcggaaagguccugaucuacaauggcaacaaagacgggcucaauacaaagccuagccaagugcugcagggagucugggcgucucacgccgugcccagcggcuuuggguucacccuuagaggagauuccgacauugauaaaaacgacuauccggaccugaucguuggcgcuuuugggaccggcaagguggccgucuaccgggcucgcccugugguuacaguggaugcccagcuccugcugcaucccaugaucauuaaucucgaaaacaaaacgugucaggucccugacucuaugaccagcgcggccugcuucucccugagagugugugcuagcgugacaggacaaucuaucgccaauaccauuguucuuauggcugagguccagcuggauucccucaagcagaagggcgccaucaaacggacacuguuucuugacaaccaccaggcccacagaguguucccccuggugauuaagcgccagaaaagccaucaaugccaggauuuuaucgucuaucuccgggacgagaccgaguucagagauaagcugucuccuaucaauauuucccugaacuacagccucgacgaauccacguucaaagaagggcuggaggugaagcccauccuuaauuauuaccgcgaaaacauuguuucugagcaggcucacauccugguggauugcggagaggacaaucucugugucccggaucugaagcugagcgcgcggccugacaaacaucaagugauuaucggcgaugaaaaccaccuuaugcucauuaucaaugccagaaacgagggggaaggagcuuacgaggccgaacuguuuguuaugauccccgaggaggccgacuaugugggcauugaacgcaacaauaagggguuccggccccuguccugcgaguacaaaauggaaaacgucacaagaauggugguuugugaccucggcaauccuauggugucuggaaccaacuauagccugggccuucgcuuugcugucccgcggcuggagaagaccaauauguccaucaacuucgaucuccagauuagaagcucuaauaaagacaaccccgauuccaauuuugugagccugcagaucaacauuacagccguggcgcaagucgagauccgcgggguuucucacccuccccagaucgugcugccuauucauaauugggaacccgaggaggaaccucacaaggaagaggaggugggaccccuugucgaacauaucuacgagcuccacaacauuggcccguccaccaucagcgacacaauucuggaagugggguggccuuucucugcucgggaugaguuucugcucuauaucuuccauauccagacgcugggaccccuucagugccaaccuaaucccaacauuaauccgcaggacaucaagccugccgccagccccgaagauaccccugagcuguccgcuuuucucagaaacagcacaauuccccaccugguucggaaacgcgacgugcacgucguggaguuccauagacagucucccgccaagauccugaacuguaccaauauugaaugccuucagaucuccugugcgguuggccggcucgaagggggcgaaagcgcugugcugaaagucagaucccgccugugggcccacacauuucuccaacggaagaacgauccuuacgcccuggcuucucuugugagcuucgagguuaaaaagaugccguauaccgaccagcccgccaagcugccugaaggauccaucgugauuaaaacgucugucaucugggcuacccccaaugugagcuuuuccauuccucucugggugaucauucuggccauccugcuuggccuccugguccuggcgauucucacacuggcccuuuggaagugcggguucuucgauagagcucggcccccucaggaggacaugaccgauagagagcagcugacaaacgacaaaaccccggaagccuga

SEQ ID NO: 70901 - RNA, 3108 nt, Artificial Sequence
  derived and/or modified sequence opt5 from ITGA9__Homo_sapiens__NP_002198
augggcgggcccgccgcuccuagaggagccggccggcugcgcgcgcuccugcuugcucugguggucgccgggaucccggccggagcuuacaaccucgacccccagagaccuguucacuuccaaggccccgccgauagcuuuuucggguaugcugugcuggagcauuuucacgacaauacccggugggugcuugucggagccccuaaggcggauuccaaauacucucccagcgugaaguccccuggcgccguuuucaaaugccgcgugcauacaaacccggacagacgguguacggaacuggauauggcucgcggcaagaauagagggaccucuugcggaaaaacaugucgggaggaccgcgaugacgaauggaugggcgucagccucgccagacagcccaaggcugaugggcgggugcuggccugcgcgcaccgcuggaagaacauuuauuacgaggccgaccauauccugccucacggauuuuguuauauuauccccuccaaucuccaggcuaaaggcagaacccugauuccuugcuacgaagaguauaagaaaaaguacggggaggaacacggaucuugucaggccggcaucgcuggcuucuuuacagaggaacuuguugugaugggggcccccggcagcuucuacugggccggcaccaucaaaguccugaaccucacagauaauaccuaucugaaacuuaacgacgaggugauuaugaaucggcgcuacacguaucugggguacgcugugaccgcgggacauuuuucccacccgagcacaaucgaugucguuggcggggccccucaagacaagggaauuggcaaaguguauaucuucagagcugaccggagaucuggcacccucauuaagaucuuucaggccuccgggaaaaagaugggaagcuacuucggaucuucccugugcgccguggaucugaacggggacggacucagcgaucugcuugucggcgcucccauguuuucugagauucgcgacgaaggccaggugacaguuuauaucaaucgggggaacggagcccuggaggaacagcucgcgcugaccggcgauggggcuuacaaugcccauuucggagaguccaucgccagccuugacgaucuggacaacgauggcuucccugacguggcuauuggggcccccaaagaagaugacuuugcuggagccgucuacaucuaucacggcgacgccgggggcauugugccccaauacuccaugaagcucucuggacagaaaaucaauccuguucugagaauguucggccagagcauuuccgggggaaucgauauggacggcaacggguauccggaugugacggucggagccuuuaugagcgacucugugguccugcuccgcgcucggcccgugaucacaguugauguguccauuuuccugccuggcagcaucaacauuaccgcgccccagugucacgacgggcaacagccugucaauugccuuaacgugacaaccuguuuuucuuuccauggcaagcacguucccggagagaucggccugaauuacgugcucauggcugaugucgccaagaaagagaaggggcagaugccgagaguguauuuugugcugcuuggagaaaccaugggccaaguuacagagaaacugcagcucacguacauggaagagaccugccgccauuaugucgcgcacgugaagcggagagugcaggacgucauuagcccuaucguguucgaagccgcuuacucccugucugagcauguuacaggggaggaggaacgcgaacugcccccucucacccccgugcugcgguggaaaaagggacagaagaucgcccaaaagaaccagacagucuuugagagaaauugccgcagcgaagauugugcugccgaccuucagcugcagggcaagcuccugcuguccagcauggaugagaaaacccuuuaccucgcccugggggcugugaagaacauuucucugaauaucuccauuagcaaccucggcgacgaugcguaugacgccaauguuucuuucaacgugucccgggagcuguuuuucaucaauauguggcaaaaagaagagaugggaauuagcugcgaacuucuggaguccgacuuucucaaguguucugucggcuucccuuucaugagaagcaaguccaaauacgaguuuucugugaucuucgauacgagccaccuguccggggaagaggaaguucugagcuuuauugugacagcucagucuggaaacaccgagcgguccgaaagccuucacgacaauacccucguccugauggugccccugaugcaugagguggauacaucuaucaccggcaucauguccccgacgagcuucgucuauggggagucuguugacgccgccaacuuuauucagcucgaugaccuggaaugccacuuccagccuaucaauauuacacuucaaguguacaacaccggacccagcacacugcccggcuccagcgugucuaucuccuuuccuaaccgccucagcuccggcggggcugagauguuccauguccaggaaauggugguuggacaggagaagggcaauuguucuuuucagaaaaacccgacccccugcauuaucccucaagaacaggagaauaucuuccacacaauuuuugccuucuuuaccaagagcgggagaaaagugcuggauugugagaagcccggaaucuccugccugacggcgcacuguaacuucucugcucuugccaaggaagagagccggaccauugacaucuauaugcuccugaauacagaaauucugaaaaaggauuccucuagcgucauccaguucauguccagagccaaagugaagguugacccugcucuccgcguggucgagaucgcccauggcaaccccgaagaggugaccguuguguuugaggcgcugcacaaucuugaaccucggggguacgucgugggauggauuaucgcuauuagccugcucgugggcauccugauuuuccugcuucucgccguccugcuguggaaaaugggcuuuuucagacgcagauauaaggagaucaucgaagccgagaaaaaccggaaggagaaugaagauucuugggacuggguucaaaagaaccaguga

SEQ ID NO: 70902 - RNA, 3486 nt, Artificial Sequence
  derived and/or modified sequence opt5 from ITGAD__Homo_sapiens__NP_005344
augaccuucggcacagugcugcuccugagcguccuugccuccuaccacggguuuaaccuggacguugaggaacccacgaucuuccaggaggaugcuggaggcuuugggcaaucuguggugcaguucggaggcagcagacucgucgugggggccccucuggaaguuguggcggcuaaucagaccggacggcuuuaugacugcgccgccgcuacaggcaugugucagccgauuccccugcauauccgcccugaggccgucaacaugucccucggccugacccuggcugccucuacaaaugggagcagacuccuggcgugcggacccacccuucaccggguguguggcgaaaacuccuacucuaaggggagcugccugcuccugggaucccgcugggagauuauccaaacaguuccugaugccacccccgaguguccucaucaggaaauggacauuguguuucuuaucgauggcagcgggucuaucgaccagaaugauuucaaccagaugaaaggauuuguccaagcugugaugggccaguucgagggcacggacacccuguuugcccucaugcaguauuccaaucugcugaagauucacuucacauuuacccaguucagaacaagcccgucucaacagucccucguggaucccaucguccagcugaaagggcuuaccuuuacggcuacagggauucugaccguugugacacaacucuuccaucacaagaacggcgcccggaaaagcgcgaagaagauccugauugugaucaccgacgggcagaaauacaaggauccucuugaauauucugacgucauuccccaggccgagaaagcuggaaucauccgcuacgccauuggcguggggcacgcuuuccagggaccuaccgccagacaagagcugaauacaaucuccagcgcucccccgcaggaucauguuuuuaagguggacaacuucgccgcgcucggcuccauucagaaacagcugcaagaaaagaucuaugccgucgagggcacgcagucucgggcuagcuccagcuuucagcacgaaaugucucaggagggguucuccaccgcccugacaauggacggacucuuucugggcgccguggggagcuucucuuggagcggaggcgcuuuucuuuacccucccaauauguccccuaccuucauuaacaugucucaagaaaauguugauaugcgcgacagcuaccugggguauuccacagagcucgcccuguggaagggcgugcagaaccuuguccugggagcgcccagauaccagcauaccggcaaagcugugaucuuuacgcaggucagccggcaauggcgcaagaaagccgaggugacagggacccagaucggaucuuauuucggcgccucccucugcagcguugauguggacucugauggguccaccgaccugauucugaucggagcuccccacuacuaugaacagacaagaggcgggcaagucagcguguguccucucccgcggggccgcguucaguggcagugcgaugccgugcugagaggagagcagggccaccccugggggcgguuuggagcugcccuuaccguccugggcgacgugaaugaagauaagcucauugacguggcgaucggggccccuggagagcaagaaaacagaggcgcuguuuaccuguuccauggggccuccgagucuggcauuagccccucccacucucagcgcaucgcuagcucccagcugagcccucggcuucaguauuuuggacaagcccucucuggcgggcaggaucugacacaggacggacugauggaccucgcggucggcgccagaggacaggugcugcuucugcgcucccuccccgugcugaaagucggaguggcuaugcgguucagcccgguugagguggccaaggcugucuacagauguugggaagagaaaccuucugcccuggaagccggcgaugcuacggugugccuuaccauccaaaaguccagccucgaccagcugggggauauucagucuagcguucgcuucgaccuggcgcucgaucccggccggcugacauccagagccaucuuuaacgagaccaagaauccuacacuuacccgccggaaaacgcugggacucggcauucauugugaaacccugaagcugcuucuccccgacugcguggaggaugucgugagcccuaucauucugcaccugaacuucucucucguuagagagcccaucccguccccucaaaaucugcgccccgugcuugcugucgggagccaggaccuguuuacagccucccuccccuucgagaaaaacugcggacaggauggccugugugaaggggaccugggagugacccuuucuuuuagcggccuccagacacugaccgugggcuccucucuggaacucaaugucauuguuacgguguggaacgccggggaggauagcuacggaacaguggucucccuguauuacccugcuggccuuucucaucggagagugagcggggcccaaaagcagccgcaccaguccgcgcugcggcucgcuugcgagaccguucccacagaagacgagggacugcgcagcucuagauguuccgugaaucacccuaucuuccaugaaggcagcaacgggaccuuuaucgucaccuucgaugugucuuauaaagccacacugggagaccggaugcuuaugagagccuccgcuagcucugagaauaacaaggccuccagcuccaaggcgacguuucagcuggaacuccccguuaaauacgcuguguauaccaugauuagccgccaagaggagucuacaaaguacuucaauuuugccaccagcgacgagaaaaagaugaaagaagccgaacaccgguauagagucaacaaucugucccagcgcgaucucgcuaucucuauuaacuucugggugccuguucugcuuaauggcguggccgucugggacguggugauggaggcucccagccagucccugccuugcgucucugaaagaaagcccccgcagcauagcgauuuucucacacaaaucucccggucuccuaugcuggacuguagcauugccgauugccugcaguuccgcugugacguucccuccuucagcgugcaggaggagcuugauuuuacccugaagggcaaccucucuuucgggugggugagagaaacgcugcagaaaaagguccucgugguuuccguggcggagaucacauuugacaccagcgucuacucucaacugccuggacaggaagccuucaugcgggcucagauggagauggugcuugaagaggaugagguuuacaacgccauccccauuaucaugggcuccagcgugggggcucugcuccugcuggcccuuauuaccgccacacuguauaaacucggauuuuucaagcgccacuacaaagaaaugcuggaggacaagccggaagauaccgcuacauuuuccggcgacgauuucucuugcgucgcgccuaaugugccccucagcuga

SEQ ID NO: 70903 - RNA, 3540 nt, Artificial Sequence
  derived and/or modified sequence opt5 from ITGAE__Homo_sapiens__NP_002199
auguggcuguuccacacccuccugugcaucgccagccuugcucugcucgccgcguuuaacguggacgucgcuagacccuggcugacaccuaagggcggggccccguucguucuuuccucucugcuccaucaggaucccagcacgaaucaaaccuggcugcuggugacauccccucggaccaaacgcacacccggaccucuccacagauguucucuggugcaggacgagauucuuugccaucccgucgaacacgugccuaucccgaagggccggcaucgcgggguuaccguggucagaagccaccacggagugcugauuuguauccagguucucgugcggcgcccccauucccugucuagcgagcuuacagggaccugcucccugcucggcccugaucugagaccccaggcccaagcuaacuuuuucgaccuggaaaaucuccuggauccugacgcccgggucgauacgggagacuguuacagcaacaaagagggcggcggggaagaugacgugaauaccgcucgccagagacgggcccuugagaaggaggaagaggaagauaaagaggaggaagaggacgaagaggaagaggaggcgggaacagaaauugccaucauccuggauggcucuggguccauugaucccccggacuuucagcgcgcuaaggacuucaucagcaacaugaugagaaauuuuuaugagaagugcuucgaauguaacuuugcccucgugcaguacggaggcgucauucaaaccgaguucgaccugcgggauucucaggacguuauggcuucccuugcccgcgugcagaauaucacacagguggggagcgucaccaaaacggcgucugccaugcaacacgugcuggauuccauuuuuacaagcucccauggaucuagacggaaggcuagcaaaguuauggugguccucaccgacggcggcaucuucgaagauccucugaaccugacaaccgugauuaauucccccaagaugcaggggguugagagauuugccaucggagugggcgaggaguucaaaagcgcucgcaccgcccgggaacucaaccugaucgccucugacccugaugaaacacacgcuuucaaggucacgaauuauauggcgcuugacgggcugcucuccaagcugagauacaacauuaucagcauggagggaaccgugggcgaugcccuucacuaucagcuggcucaaauuggguuuucugcccagauccucgacgaacgccagguccugcugggagccgugggcgcuuucgacuggagcggcggggcccuccuguacgauacacgguccagacgcggacgguuucuuaaucagaccgcggcugccgccgcugacgccgaggcugcccaauauucuuaccugggcuacgcgguugccgugcuccauaaaacaugcagccuguccuauauugcuggggcccccagauacaagcaccauggagcugucuucgagcugcagaaagaaggccgcgaggccagcuuucuucccgugcucgaaggggagcagaugggcucuuauuucggauccgagcuguguccuguugauaucgacauggauggcagcaccgacuuucugcucguggcggccccguucuaccacguccauggggaagagggacggguguauguguacagacugucugaacaggauggcuccuuuagccuugcucgcauccuguccgggcaccccggauucacgaacgcccgguuuggcuucgcuauggccgccaugggggaccucucucaagauaagcugacagacguugcuauuggcgcgccucuggagggauuuggcgccgaugacggggcuagcuucggauccgucuauaucuacaacggccacugggaugggcuuucugccagccccucccagcggauuagagccagcaccguggcuccuggacuccaguacuucggcaugucuauggccgggggcuuugacaucuccggagacggccuggcggauauuaccguggggacacugggacaggcugucguguuccgcagcagacccguugugcggcucaaagucucuauggccuuuaccccguccgcccugccuaucggcuucaauggggugguuaacgugagacuuugcuuugaaaucagcucugucacaacggcuagcgaguccggacugcgcgaggcccuccugaauuucacccuggacguggauguuggcaagcaacggagacgccuucaguguagcgacgugagaucuugccucgggugccugcgggaaugguccagcggcucccagcugugugaggaucuccugcuuaugcccacagaaggagagcugugcgaagaggacuguuuuucuaacgcgagcgucaaaguguccuaucagcuccaaaccccugagggccagacagaucauccccagccuauucuggaccgcuacaccgaacccuucgcuaucuuucaacugccguaugagaaggccugcaagaauaaacuuuucuguguggccgaacuccagcuggcuacgaccgucucucagcaggagcugguuguggggcucacaaaggaacugacccuuaacauuaaucugacaaacagcggagaggauuccuacaugaccucuauggcccucaauuauccuagaaaccugcaacugaaacggaugcagaagccucccagccccaauauccagugcgacgauccgcagcccguggcuuccguccuuauuaugaacugucgcaucggccacccugugcugaaaagaagcucugcccauguuuccguggucuggcaacucgaggaaaaugcguuucccaaccggacggccgacauuacagugaccguuacaaauagcaacgagcgcagaucucuggcuaacgaaacccacacccuccaguuccggcacggguuuguggccguccuguccaagccuagcaucauguacgugaauacaggacagggccuuucucaucacaaggaguuccuguuccauguucacggcgagaaccucuuuggggcugaauaucagcugcaaaucugcgugcccacgaaacugcgcggacuucaggucguggccgugaagaaacugaccagaacacaggccuccaccgucuguacauggagccaagagcgggcuugcgcguacuccagcguucagcauguggaagaguggcacucugugagcugugucauugccuccgauaaggaaaaugugaccguugcugccgagaucucuugggaccacagcgaggaacuccugaaagacgugacggagcuccagauucugggcgaaaucuccuucaacaagucucuuuacgaggggcugaaugccgaaaaccauagaacaaagauuaccgucguguuucucaaagaugagaaguaucacagccugccuaucaucauuaaaggauccguuggcgggcugcuugugcugaucgucauucucgugauccuguucaagugcggauuuuucaaacgcaaguaccagcaacucaaucuggagucuauucggaaggcucagcuuaaaagcgaaaaccugcuggaggaagagaauuga

SEQ ID NO: 70904 - RNA, 3261 nt, Artificial Sequence
  derived and/or modified sequence opt5 from ITGAL__Homo_sapiens__NP_001107852
augaaggacagcugcaucaccgugauggccauggcucugcucuccggcuucuuuuucuuugcccccgcgucuagcuacaaccuggaugucagaggggcucgguccuucucuccuccgcgcgccggaagacacuuuggcuaucggguucuucagguggggaauggagugauugucggcgcccccggggagggaaacagcacaggcucccuguaccaaugucagucuggcacggggcauugccucccugugacccugcgcggaagcaauuauacauccaaauaccuuggcaugacccuggcuacagaccccaccgaugggagcauccucuucgccgcuguucaguuuucuacauccuauaagaccgaguucgacuuuagcgauuacgugaaaagaaaggacccugaugcccugcugaaacacgucaagcauaugcuccugcuuacgaacaccuucggagcgauuaauuauguggccacagagguuuuucgggaagaacugggcgcucgccccgacgccaccaaggugcucaucauuaucacagauggggaagcuaccgacucuggaaacaucgaugccgcgaaagacauuaucagauacauuaucggcauuggcaagcacuuccagacgaaagagucccaagagacacugcauaaguuugccagcaaaccugcuucugaguucgucaagauccuugauaccuucgaaaagcugaaagaccucuuuacagaacugcagaagaaaauuuacgugaucgaggggaccuccaagcaggaccugaccagcuucaauauggagcucuccucuagcggaaucuccgccgaucugagccggggccacgcuguggucggggccguuggagccaaagacugggcuggcggguuucuugaucugaaggcggaccuccaggaugacacauucauuggaaacgaaccgcugacgcccgaggugcgcgccggcuaucuuggcuacaccgugacauggcugccuucuagacagaaaaccucccuccuggcuagcggggcuccccgguaucaacacaugggacgcguccugcucuuucaggaaccucagggcgggggacauuggucucaagugcagacaauccacggcacccagauugggagcuacuucggcggagagcuguguggcguugauguggaccaagauggggaaacggagcuucugcucaucggagcgccccuguuuuauggcgagcagagagggggacgggucuucauuuaccagcgcagacagcuuggcuuugaagagguguccgaacugcaaggggacccgggcuauccucucggacgguucggcgaggccaucacagcccugaccgauaucaauggggacggacugguugacguggccgucggcgcuccccucgaggaacagggggccguguacauuuuuaacggaagacauggcgggcugucuccucagcccagccagcgcaucgagggcacccaaguccuuuccggcauucagugguucggacggagcauccacggggugaaggaucuggaaggagacggccucgccgauguugcugugggggccgagucucagaugauuguccuguccagcagacccgugguugacauggugacacugaugucuuuuuccccugcugaaaucccgguccacgagguggaaugcagcuacuccaccucuaauaagaugaaagagggagugaacaucacaauuuguuuccagaucaagagccuuauuccccaauuccagggccgccucguugccaaucugacguauacccugcagcucgaugggcaucggacaagacgccggggccuguuuccuggaggcagacacgagcuucgccggaacaucgcggucaccacauccaugucuugcaccgacuucagcuuucauuuccccgugugugugcaggaucugauuuccccuaucaaugucagccucaacuuuucucugugggaagaggaagggacgcccagagaccaacgcgccggaaaagauauuccgccuauccugcggcccucccuucacagcgagaccugggagaucccuuucgaaaagaacugcggcgaggacaaaaagugugaagcuaaucucagagugucuuuuucccccgcccggagccgcgcucugagacugacagccuucgcgucucucagcguugagcugucccuuagcaaccuggaagaggaugccuacugggugcagcucgaccugcauuuuccucccgggcugucuuuccggaaggucgagaugcuuaaaccgcacucccagauuccugugagcugcgaggaacuccccgaagaguccagacugcugucucgcgcucucagcuguaauguuuccucucccaucuuuaaggccggacacagcguggcucugcaaaugauguucaacacccuugucaauuccucuuggggcgauagcguggaacugcaugccaacguuacaugcaauaacgaggacuccgaccuccuggaggauaauagcgccaccacgauuaucccuauucuguauccgaucaacauccuuauucaggaccaggaagauucuacacucuacguguccuuuacccccaaaggcccuaagauccaccaggucaaacauauguaucaagugcggauucagcccagcauccacgaccacaauauuccuacacuggaggcuguggucgggguuccccagccucccucugaaggaccgaucacccaucagugguccgugcaaauggagccucccgugccuugccacuacgaagaucuggagagacuccccgacgcggccgagccgugucugccuggcgcucuuuuccgcugccccgucguguucagacaggaaauccugguucaggugauugggacccucgagcuggucggagaaaucgaggccagcucuauguuuucccuguguagcucccuuagcauuucuuucaacagcuccaagcauuuucaccuguauggcucuaaugccagccucgcucaggugguuaugaagguggaugucguguacgagaaacaaaugcuguaccucuauguucuguccgggaucggaggccuucugcuccugcugcuuauuuucaucgugcuguacaaggucggcuuuuucaaacggaaccucaaggagaaaauggaagccgggcgcggagugccuaauggcauccccgcggaagacucugagcagcuggcuagcgggcaggaagccggagaucccggcugccucaagccucugcaugagaaggacuccgagucugggggaggcaaagauuga

SEQ ID NO: 70905 - RNA, 3459 nt, Artificial Sequence
  derived and/or modified sequence opt5 from ITGAM__Homo_sapiens__NP_000623
auggcccugagagugcuccugcuuaccgcucugacacucugccacggcuucaaccuggacacggagaaugccaugaccuuucaggaaaacgcgcggggguucggacaaagcgugguucagcuucagggcucccgcgugguggucggggcuccccaggagaucguggccgccaaucaaagaggaucucuguaccagugugauuauagcacaggcuccugcgaaccuauucggcuccagguuccgguggaggcugucaacaugucucuggggcugagccucgccgcuaccacauccccuccucagcugcuugccuguggacccaccgugcaucaaacaugcucugaaaauaccuacguuaagggccuguguuuucucuucggcagcaaccugcgccagcagccucagaaauuucccgaggcgcuuagagggugcccucaagaggacuccgauaucgccuuccugauugacggaagcggcucuaucauuccgcacgauuuucggcgcaugaaggaguucguguccacggucauggaacagcucaaaaagagcaaaacccuguuuucucugaugcaguauuccgaagaguucagaauccauuuuacauucaaggaguuucaaaauaaccccaauccucggagccucgugaagcccaucacccagcugcuugggcgcacacacaccgcuacgggaauuagaaaagugguccgggaacuguucaacaucacaaauggcgcccgcaagaacgcuuucaaaauucucguugugaucaccgacggggagaaguuuggagauccucugggcuacgaagacgugauucccgaggccgauagagaaggcgucauccgguaugugauugggguuggagacgcguuccgcucugagaaauccagacaggagcuuaauacaaucgccagcaagccgccucgggaucauguguuucaggucaacaauuucgaagcucugaagaccauccaaaaccagcucagagagaaaauuuuugccaucgaaggcacccagacaggguccucuagcuccuucgagcacgaaaugagccaggagggauuuucugcugccauuacguccaacggcccccugcugagcaccguggggucuuacgacugggccggaggcguuuuccucuauacaagcaaggagaaauccaccuuuaucaauaugacacgcguggauucugacaugaacgacgcuuaccugggcuacgcggccgcuauuauccuucggaauagaguccaaagccuggugcucggggccccucgcuaucagcacaucggacuggucgccauguuccggcagaacaccggcaugugggaauccaaugcuaacgugaaggggacgcagauuggagccuacuuuggcgcgagccuuuguucuguugauguggacuccaaugggagcacagaucugguccucaucggcgcuccccauuauuacgagcaaaccagaggaggccaggugucuguuugcccccugccucgcgggcgggccagauggcagugugacgccgugcuguauggagaacagggccaaccgugggggcgcuucggagcugcccucaccguccugggcgaugugaacggggacaaacuuacagauguggcuauuggcgcccccggagaggaagacaaucggggcgcgguuuaccuguuucacgggaccuccggaagcggcaucuccccuucucauagccagagaauugccggguccaagcucucuccccgccugcaguauuucggacaaagccuguccggcgggcaggaucuuacaauggacggccucgucgaucugacggugggagcucagggccacgugcugcuccugcggagccagccuguccuuagagugaaagccaucauggaguucaacccccgggagguugcucgcaauguguuugaaugcaacgaccaagucgugaaggggaaggaggccggagaaguuagagugugucugcacguccagaaaucuacccgggacagacuccgcgagggccagauccaguccgugguuacauacgaucuggcgcuggacagcgggcggccgcauucuagagccguguucaaugagaccaagaacuccacacgcagacaaacccagguccuuggacucacgcagaccugcgaaacacugaaacugcagcucccuaauugcauugaggaucccgugagcccuaucgugcugcggcuuaacuuuucucuggucggcacaccccucagcgcuuucgggaaccugcgcccuguucuggccgaagacgcucaaagacuuuuuaccgcccucuuccccuuugagaagaauuguggcaacgauaauauuugccaggacgaucuguccaucaccuucagcuuuaugucucuggacugucucguggugggaggcccgcgggaguucaacgucacggugacaguucgcaaugauggggaagacuccuacagaacccaggugacauuuuucuuuccucuggaucuuagcuaucggaaagucuccacccugcaaaaccagcgcucucagagaagcuggcggcucgccugcgaguccgcuucuagcaccgaaguguccggagcgcugaagucuacaagcuguuccauuaaucaccccaucuuccccgagaacagcgaaguuacguucaauauuaccuuugacguggauucuaaggccucccugggcaacaaacuucuccugaaggcuaaugucacaagcgagaacaauaugccucgcaccaacaaaacagaguuccagcuggaacucccggugaaguacgccguuuauaugguggucaccucucaugggguguccacgaaauaccugaauuuuacagccagcgagaacaccucuagagugaugcaacaccaguaucaggucuccaaccuuggacagcggagccugcccaucucccucguuuuccuggugccugugagacugaaucaaaccgucaucugggaccgcccccaggugacauuuagcgaaaaccuuucuagcacaugccauaccaaggagcggcugccuucccacucugacuuccucgcugaacugagaaaggcccccguugugaauuguagcauugcggucugccagcgcauccagugugauauucccuuuuucggcauccaagaggaauuuaacgcuacgcucaaaggcaaucuguccuucgacugguacauuaagaccucucacaaccaucuucugaucgugagcacagccgagauccucuuuaaugauuccguuuucacccugcugcccgggcagggagccuucgugcggucucagacagagaccaaagucgaaccguuugaggugccuaacccccuuccucugauugucggcagcuccgucgggggacuccugcuccuggcucuuaucacggccgcgcuguauaagcucggcuucuuuaaaagacaguacaaggacaugaugagcgaagggggacccccgggcgcugagccucaauga

SEQ ID NO: 70906 - RNA, 3009 nt, Artificial Sequence
  derived and/or modified sequence opt5 from ITGAV__Homo_sapiens__NP_001138471
augcugcucggcacccugcuucugauccucuacauucugaugcuuugcagaauguuccugcucgugggggcccccaaggcuaacacaacgcagccuggaaucgucgagggcgggcaaguucugaaaugugacuggagcuccacccggcgcugccagccgauugaauuugaugccacaggaaauagagacuaugcgaaggaugacccccuggaguucaaaucucaccagugguuuggcgcuagcgugcgguccaagcaggauaaaauccucgccugugccccucuguaccauuggcgcaccgaaaugaagcaagagagagaacccguggggacaugcuuccuucaggacggaaccaagacagucgaguaugcuccuugucggucucaggauauugacgccgauggccagggcuuuugccaagggggauucagcaucgacuuuaccaaagcugaucgcgugcugcucggcgggcccggauccuucuacuggcagggccagcugaucucugaccagguugccgagauugugagcaaguaugauccuaacgucuacuccaucaaauauaauaaccaacuugcgacgagaaccgcccaggcuauuuuugacgacagcuaccugggguacucuguggccguuggagauuucaauggcgacggcaucgaugacuuuguguccggggucccgcgggcugcccgcacacucggaaugguguauauuuacgauggcaagaacaugagcucucuguauaauuucaccggggaacagauggcggccuacuuuggauucuccguggcugccacagacaucaacggcgaugacuaugcugaugucuucauuggggcuccccuguuuauggacagaggaagcgauggcaaacuccaagagguuggccaggugucugugucccugcagcgggccagcggggacuuccagaccacgaaacuuaauggauuugaagucuucgcccgcuuuggcuccgcgaucgccccucugggggaccucgaucaagacggauucaacgauaucgcuauugccgcccccuacggcggggaggacaagaaaggcaucguguauauuuuuaauggaagaucuacaggccugaacgcuguuccuagccagauccuugaggggcagugggccgcgcgguccaugcccccgagcuucggauacucuaugaagggcgcuaccgauauugacaaaaauggguacccugaucugaucgugggagccuuuggcgucgaccgcgccauccucuauagagcucggcccgugauuacaguuaacgccgggcuggaaguguacccuuccauccugaaucaggauaacaagaccuguagccuccccggcaccgcucugaaagucucuugcuucaacgugagauuuugucuuaaggccgacggaaaaggcguccugccccgcaagcucaauuuccaaguggagcugcuucuggauaagcucaaacagaagggggcgauucggagagcccuguuucuguauagccgcuccccuucucacagcaaaaacaugacaaucucccggggaggccucaugcagugcgaagaacugauugcuuaccuuagagacgaaagcgaguuccgcgauaagcugacgccgaucaccaucuucauggaguaucggcucgacuacagaacagccgcugacaccacagggcugcagcccauucugaaucaauuuaccccugccaacaucucucgccaggcgcauauucuucucgauuguggagaagacaauguuugcaaacccaagcuggagguguccgucgauagcgaccagaagaaaaucuauauuggcgaugacaacccucugacgcucaucgugaaggcccagaaucaaggggaaggcgcuuacgaggccgaacugauuguuucuaucccccuucaggcugauuucaucggagugguccggaacaaugaggcccuggccagacucuccugcgcuuuuaaaacagagaaccagacccgccaaguggugugugaccugggcaauccgaugaaggcggggacccagcugcuugccggacuccgguucagcguucaccagcaguccgaaauggauacaucugucaaauuugaccugcaaauucagagcuccaaccuguucgauaaggugucuccuguggucagccauaagguggaccucgcuguucuggccgccguggagaucagaggcgucuccagccccgaucacauuuuucuuccuauccccaauugggaacacaaagagaacccugaaaccgaggaggacguggggcccguugugcagcauauuuacgaacugcggaauaacggaccgucuuccuucagcaaggcuaugcuccaucugcaguggccuuauaaauacaacaauaacacacugcuuuauauccuccacuacgacaucgauggccccaugaauugcacgucugacauggagauuaacccccugcgcaucaagauuuccagccugcaaaccacagaaaagaaugauaccgucgccgggcagggcgagagagaccaccucaucacaaagcgggaucuggcgcuuucugagggagacauucacacccugggcugugggguggcucagugccucaagaucguuugucaggugggaagacuggaucgcggcaaaagcgccauccuguaugucaagucccuucucuggacggaaaccuuuaugaacaaagagaaucaaaaccauagcuacucucugaaguccagcgccuccuucaaugugauugaauuuccuuauaaaaaccugccgaucgaggacauuacaaauucuacccucgugacaaccaacgucacgugggggauccagcccgcuccuaugcccguuccugugugggugauuauccuggccguccuugcgggacugcuccugcuggcugugcuuguuuucgugauguaccggaugggcuuuuucaagagagucagacccccucaggaggagcaagagcgcgaacagcugcagccccacgagaauggcgaagggaacagcgagacauga

SEQ ID NO: 70907 - RNA, 3492 nt, Artificial Sequence
  derived and/or modified sequence opt5 from ITGAX__Homo_sapiens__NP_000878
augaccagaacacgggccgcucugcuccuguucacggcccuugcgaccagccugggcuuuaaccucgacacagaggaacugaccgcuuuccgcguggauuccgccggguuuggagacucugucguucaguacgccaauagcugggugguggucggcgcuccccaaaagaucacagccgcuaaccagaccgggggacuuuaucagugcggcuacuccacaggggccugugagccuauuggacuccaggugccgcccgaagcgguuaauaugucucugggccugagccuggccuccaccacgucuccuagccaacuccuggcuugcggccccaccgugcaccaugagugugggagaaacauguaucuuacaggacugugcuuccuccugggcccuacccagcuuacacagcggcugcccgucucccgccaggaauguccuagacaagagcaggauaucguguuucucauugacgggagcggaucuaucuccagccggaauuucgccaccaugaugaacuuuguucgcgcugugauuucucaguuccagagaccguccacgcaauuuagccugaugcaguucucuaauaaauuucagacacacuucaccuuugaggaguuccggcgcuccagcaacccccugucccuccuggccucuguccaucaacuucagggcuucacauacaccgcgaccgccauccagaauguggugcacagacuguuucaugcuagcuauggggcccggcgcgaugcugccaagauccucauugucaucacagacggcaaaaaggaaggagauucccuggacuacaaagauguuauuccuauggccgacgcugcgggcaucauuagauaugccaucggggugggacuugcuuuccagaaccggaauagcuggaaggaacugaacgauauugccucuaagcccucccaagagcacaucuuuaaaguggaggacuucgaugcccucaaggacauccagaaucagcugaaagaaaagauuuuugcuaucgagggcacggaaaccacaagcucuagcuccuucgagcuggaaauggcccaggagggguuuucugcggucuucaccccugacggacccgugcucggcgcuguugggagcuuuacaugguccggaggcgccuuccuguacccgccuaacaugagccccaccuuuauuaauaugucucaagagaacguggauaugcgcgacuccuaccuuggcuauagcacggaacuggcccucuggaaagggguccagucucuggugcuuggagcuccuagauaccagcacacaggcaaggccguuaucuucacccaggugucccggcaauggagaaugaaggcugaggucaccgggacacagauuggaagcuauuuuggcgccucccugugcucuguggaugucgacagcgauggguccaccgaccucgugcugaucggcgcgccccauuacuaugaacagacacgcggaggccagguuucuguguguccccugccucggggguggagacgcugguggugcgaugccguccucuacggagagcaaggccacccgugggggcgguucggagcugcccugacggugcuuggcgacguuaacggggauaaacugaccgacguggucaucggcgcucccggagaagaggagaauagaggcgccguguaucucuuccauggggugcugggaccuagcauuucccccagccacucucagcgcaucgcgggcucccagcugagcucucggcuucaauacuuugggcaggcccucuccggaggccaggaucugacacaggacgggcugguugaccucgcugucggcgccagaggacaagugcugcuucugcgcacccggccugugcucugggucggcgugagcaugcaguucauucccgcugaaaucccgagaucugccuuugagugucgcgaacagguugugagcgagcagacacugguccaauccaacauuugccuguacaucgauaagcggagcaaaaaucuucucgggucuagagaccugcaguccagcgugacccuggaucucgcccuggacccuggacggcuuucuccccgcgcuacguuccaggaaaccaagaacagaucccugagccggguuagagugcucggccugaaagcgcacugugagaauuuuaaccugcuucucccuuccugcgucgaggauucugugacacccaucacccugcgccugaauuucacacucguugggaagccucugcuugccuuucggaaccugagacccaugcucgcugccgacgcccagcgcuauuucaccgcuagccugccguuugagaaaaauugcggagccgaucauauuugucaagacaaccugggcaucuccuucucuuuuccugggcuuaagagccuccuggugggcuccaaucuggaacucaacgcggaagucaugguguggaaugauggagaggacagcuacggcacgacaauuaccuucucucaccccgcugggcuguccuauagauacguggccgagggacagaagcagggccaacuucggagccugcaucucacaugcgauucugcccccgucgggucccagggaaccuggagcaccucuugucgcaucaaccaccugauuuuuagaggcggcgcucagaucacauuccuggccacguucgacguuuccccuaaagcggugcuuggggaucggcugcuccugaccgcuaaugugagcuccgaaaacaacacaccgcgcaccagcaagacaaccuuucagcucgagcugcccgucaaauaugccguguacacgguugugucuagccaugaacaauucacaaaguaucuuaauuuuuccgagucugaagagaaagagagccacgucgccaugcacagauaccaggugaacaaucugggacagcgggaccucccuguuuccauuaacuucugggugcccgucgaacugaaucaggaggcuguguggauggacguugaagugucucauccucaaaaccccagccugcgcugcuccucugagaagaucgccccucccgcuagcgauuuucuugcccacauccagaagaauccgguccuggacuguuccauugcgggcugccucagauuccggugugaugugccuagcuuuucugugcaggaggaacuggacuucacccucaaagggaaccuguccuuuggauggguccgccagauccuucaaaagaaaguuagcguggugucugucgccgagauuaccuucgauacauccguguacagccagcugcccggccaggaggcuuuuaugagagcccagaccacaacgguucucgaaaaguauaaagugcauaauccuacaccccugaucgucggguccucuauuggaggccugcuucugcucgcucugaucaccgccgugcucuacaagguuggcuucuucaagcggcaauauaaagaaaugauggaggaagccaacgggcagaucgcuccggagaauggaacccagacaccuagcccucccuccgagaaguga

SEQ ID NO: 70908 - RNA, 603 nt, Artificial Sequence
  derived and/or modified sequence opt5 from ITGB1BP1__Homo_sapiens__NP_004754
auguucagaaagggcaaaaagcggcacagcuccucuagcucccagucuagcgagaucuccaccaaaucuaagagcguggacuccagccuugggggacucucucgcuccagcacagucgccucucuggauacggacuccaccaaaagcucuggccaauccaacaauaacagcgauacaugcgcugaauuuagaauuaaguacguuggggccaucgagaagcugaaacuguccgaaggaaagggccucgaggggccccuggaccuuauuaauuauaucgauguggcgcagcaggacggaaaacugccuuucgugccgcccgaagaggaguuuauuaugggcgucucuaaguacggcaucaaagugagcaccuccgaucaguaugacguucuccaucggcacgcucuguaccugaucauucgcaugguguguuaugaugacgggcucggagccggcaagagccugcuugcccugaagacaaccgaugcuucuaacgaagaguacucccucugggucuaucaaugcaauagccuggaacaggcccaggcuaucuguaaagugcuuucuacagccuucgacagcguucugaccuccgagaagccuuga

SEQ ID NO: 70909 - RNA, 2406 nt, Artificial Sequence
  derived and/or modified sequence opt5 from ITGB1__Homo_sapiens__NP_391988
augaaccugcagcccaucuucuggauuggccucaucagcuccgugugcugugucuuugcccaaaccgacgagaauagaugccugaaggcuaacgccaaaucuuguggggaaugcauucaggcgggaccuaauuguggcuggugcacaaacagcacguuccuucaggaggggaugccgaccuccgcucggugugaugaccuggaagcccucaagaaaaagggaugucccccugaugacaucgagaauccccgcggcucuaaagauauuaagaagaacaaaaauguuacaaacagaagcaaggggaccgccgaaaaacugaagccugaggacaucacacagauccaaccccagcagcuugugcugcggcuccgcuccggagagccucagaccuuuacacugaaauucaagagagcugaagauuacccgauugaccuguauuaccucauggaucugucuuauagcaugaaggacgaucuugagaaugugaaaucccugggcaccgaccucaugaacgaaaugcggcgcaucacgagcgauuuuagaauuggcuucgggucuuuugucgagaagaccgugaugcccuacaucuccacaaccccugccaaacugcggaaucccugcacaagcgagcaaaacugcaccucuccuuucuccuauaagaauguucuuagccugacgaacaaaggagaaguguuuaaugagcucgucggcaagcagcgcauuucugggaaccuggacucccccgaaggaggcuucgacgcuaucaugcaaguggccguuugugggagccugauuggauggagaaacgugacacggcuccuggucuuuuccaccgaugcgggcuuccacuuugccggcgacgggaaacuuggaggcaucgugcugccgaaugaugggcagugccaucucgagaacaauauguacacaaugucucacuauuacgacuacccuagcaucgcucaucuggugcagaaacuuuccgaaaacaauauucagaccaucuucgccgucaccgaggaguuccagcccguuuauaaggaacugaagaaccucauuccuaagagcgcugugggaacacugucugccaauuccagcaacgugauccaacugauuaucgaugcguacaauucucucagcuccgaggucauccuggaaaacggcaaacuuucugagggggugacgauuagcuauaaguccuacugcaaaaauggaguuaacggcaccggcgaaaaugggcgcaaguguagcaacaucucuauuggagacgaggugcaguuugagaucuccauuacaagcaauaagugccccaaaaaggauucugacuccuucaaaaucagaccccugggcuuuaccgaagaggucgaagugauccuccaguauauuugugagugcgaaugucagagcgaggggaucccugaguccccgaagugccacgaaggaaacggcacauucgaguguggggccugccgguguaacgaaggccgcguuggaagacauugcgaguguucuaccgaugaggugaauagcgaagacauggaugcuuacugccggaaagagaacuccucugaaauuugcagcaauaacggcgagugugucugcgggcaaugugugugcagaaagcgcgacaauacgaacgaaaucuauuccggaaaguuuugugagugcgacaauuucaacugugaucggagcaauggccugauuugcgggggaaacggcgucuguaaaugcagagugugugagugcaaucccaacuacacagggucugccugcgacuguucccuugauaccucuaccugcgaagcuagcaauggccagaucuguaacggacgcggcauuugcgagugugggguuugcaaguguacagacccuaaauuucagggacagaccugcgaaaugugucaaacaugccugggcgugugugccgagcacaaggaaugcguccagugccgggccuucaauaaaggggagaagaaggauacguguacccaggagugcuccuacuuuaacaucacaaaaguggaaagcagagacaagcucccccagccuguucaacccgauccggugucucacuguaaagagaaggacgucgaugacugcugguucuauuuuaccuacagcgugaacggaaauaacgaagugaugguucaugucguggagaauccugaaugucccacaggcccugauaucauucccaucguggcuggggucguggcgggcauuguucugaucggacuggcccuccugcuuauuuggaaacugcucaugaucauccacgaccgccgggaguucgcuaaguuugagaaagaaaagaugaacgccaagugggauacccaggagaauccuauuuauaaaucccccaucaacaauuucaagaacccgaauuacggcagaaaagccgggcuguga

SEQ ID NO: 70910 - RNA, 2310 nt, Artificial Sequence
  derived and/or modified sequence opt5 from ITGB2__Homo_sapiens__NP_000202
augcugggacucagacccccucugcuugcccugguggggcuccugagccuuggaugcguccugucccaggaguguaccaaguucaaaguuucuagcugccgggaauguaucgaguccggcccggggugcacauggugucaaaagcucaacuuuacgggacccggcgacccugauucuauucgcugcgacaccagaccccagcugcugaugcgggggugugcugccgaugacaucauggauccuacaagccucgcggaaacccaggaggaccacaauggaggccagaaacaacugucuccccagaaggugacacuuuaccugcgcccuggccaggcugccgccuucaacgugaccuuuagacgggcuaaaggguauccgauugaucucuacuaucugauggaccuuuccuacagcaugcuggaugaccuccgcaaugucaagaagcugggaggcgaucugcucagagcccugaacgaaaucacagaguccgggcggauuggauucggcagcuuuguggacaaaaccguucuucccuucgugaauacgcauccugauaagcugcgcaaccccugcccuaauaaagagaaggaaugucagcccccguuugcuuucagacacguccucaaacugaccaacaauucuaaccaauuucagacagagguggggaagcagcuuaucuccggaaaucuggacgccccugaaggcggccucgacgcgaugaugcagguugccgcuugccccgaggagaucggguggcggaacgugacccgccugcuggucuucgccacagaugacggauuucauuucgcuggcgaugggaagcucggagccauucugaccccuaaugacggcagaugucaccuugaagauaaccuguauaaacggagcaaugaguuugacuaccccucuguggggcaacucgcgcauaagcuggccgaaaacaacauccagcccauuuucgcugugacgucccgcauggucaaaacauaugagaaacuuaccgaaaucauuccuaagagcgccguuggagagcugucugaggauuccagcaauguggugcaccucaucaagaacgcuuacaauaaacuguccucuagagucuuccuggaccacaacgcccucccggauacacugaaggugaccuacgacagcuuuugcuccaauggcguuacccaucggaaccagcccagaggcgauugcgacggggugcaaauuaaugucccuaucacauuccaggugaagguuacggccaccgaauguauccaggagcagagcuuugugauucgcgcucuuggauucacagacaucgucaccgugcaaguccugccccagugcgaaugucggugcagagaucagucucgcgaccggucccucugucacggcaaaggguuucuggagugcggaauuuguagaugcgauacaggcuauaucgggaagaacugugaaugccagacccaaggccgcagcucucaggagcuggagggaagcugucggaaagacaauaacuccauuaucugcucuggccuuggggauugcguguguggacagugccucugucauacgagcgacguuccuggcaagcugaucuacgggcaguauugcgaaugugauacaauuaauugcgagagauacaacggacaaguguguggcgggcccggccgcggacugugcuucuguggcaaaugccggugucacccgggguuugaaggauccgcgugccagugcgagagaaccaccgaaggcugucucaauccucgccgggucgagugcagcgggagaggacggugucgcugcaacgugugugagugccacucuggcuaucagcugccccuuugucaggaaugcccugggugucccuccccuugcggcaaguacaucagcugugccgagugccugaaguucgaaaaaggacccuuuggcaagaauugcucugcugccuguccggggcuccaacuguccaacaacccuguuaaaggaagaacaugcaaggagcgggacagcgagggcuguuggguggccuauacccuggaacagcaggaugggauggacagauaccuuauuuacgucgaugagucccgcgaaugcguggcuggacccaauaucgccgcgauugugggcgggacaguugcuggcaucguccucaucggcauucugcugcucgugaucuggaaagcccugauucaucuuucugaccugcgggaguauagacgcuucgaaaaggagaagcucaaaagccaauggaacaaugauaacccccuguuuaaguccgccacgaccacagugaugaauccuaaauucgcugagucuuga

SEQ ID NO: 70911 - RNA, 2367 nt, Artificial Sequence
  derived and/or modified sequence opt5 from ITGB3__Homo_sapiens__NP_000203
augagagcccggccccgcccuagaccgcugugggcuaccgugcucgcccugggcgcgcuugcuggggucggaguuggcgggcccaacaucugcacaacgcggggagugagcuccugucagcaaugccuggccgugucuccuaugugugccuggugcagcgacgaggcucucccccugggcuccccucgcugugaucuuaaggaaaaucugcucaaagacaacugcgcccccgagucuauugaguucccugucagcgaggcuagagugcuggaagaucggccgcuguccgacaaggggucuggagauagcucccagguuacccaggugagcccccagcgcaucgcccucagacugcggccugacgauucuaaaaauuuuuccauucaaguccgccagguggaggacuaccccguugauaucuauuaccuuauggaccugagcuauucuaugaaggaugaccucugguccauucagaaccugggcacaaaacuugcgacccagaugagaaagcugacaagcaaucuccggaucggcuucggggccuuuguggauaagccugucucucccuacauguauaucuccccgccugaggcucuggaaaaccccuguuacgacaugaaaaccacaugccugccuauguucggauauaagcacgugcucacccugacggaccaagugacccgcuuuaaugaggaagucaaaaagcagagcguuuccagaaaccgggaugcccccgagggcggguucgacgcuauuaugcaggccacagugugugaugagaaaaucggauggcgcaaugacgcgucucaucuucugguguuuaccacagaugccaagacccacauugcucucgacggcagacuggccgggaucguccagcccaacgauggacaaugccaugugggcagcgacaaucacuacuccgcuagcacgacaauggauuacccuucucuuggccugaugaccgaaaagcucucccagaaaaacauuaaucugaucuucgccguuacagagaacguggucaaucuguaucagaacuacagcgaacucauuccggggaccaccgugggaguucugucuauggacagcuccaacgugcuucaacugaucgucgaugccuauggcaagauccggucuaaaguggagcucgaagucagagaccugcccgaggagcuuagccuguccuuuaaugcuacaugucucaacaaugaagugauuccugggcucaagagcugcaugggacugaaaaucggcgacacgguuucuuucuccauugaggcgaaggugcgcgggugcccccaggaaaaagaaaagagcuuuaccaucaagccugucggauucaaagauucucugauugugcagguuacauuugacugugauugcgccugucaggcucaagccgaacccaacucccaucggugcaauaacggcaauggcaccuucgaguguggggugugcagauguggaccgggcuggcuggggagccagugcgaguguuccgaagaggacuaccgcccuucucagcaggaugaaugcagcccccgggagggacaaccugucuguucccagagaggcgaaugccuuugcgggcagugugugugccacucuagcgacuucggcaagaucacaggaaaauauugugagugcgaugacuuuuccugugugcgcuacaagggcgagaugugcagcgggcacggacaguguucuugcggcgauugucugugcgacuccgauuggaccggguauuacuguaacugcacgacacggaccgauaccugcaugagcucuaauggacuccuguguuccggcagagggaaaugcgaauguggcagcugcguuuguauccaacccggaucuuacggcgacacaugcgagaaguguccuaccugccccgacgccuguacauucaagaaagaaugcgucgaguguaagaaauuugaccgcggggcucugcaugaugagaacacgugcaaucgguauugcagagacgaaauugagagcgugaaggaacuuaaagauaccggaaaggacgccgugaacuguacauacaagaaugaggaugacugcgucgugcgcuuccaguauuacgaagauuccagcggcaaaucuauccucuauguuguggaggagccggaauguccuaaggggcccgacauucuggucgugcugcucuccguuaugggagcgauccugcuuauuggccuggcugcccuccugaucuggaaacugcuuaucaccauucacgaucggaaggaguuugccaaauucgaagaggaaagagcucgggccaagugggacacagcuaacaauccccucuacaaggaggccaccagcacguuuaccaacaucacauaucgcgggaccuga

SEQ ID NO: 70912 - RNA, 5469 nt, Artificial Sequence
  derived and/or modified sequence opt5 from ITGB4__Homo_sapiens__NP_000204
auggccggccccagaccuagcccgugggcucggcugcuccuggccgcgcuuaucuccgugucucugagcgggacccucgcuaaccgcugcaagaaagcccccgucaaguccuguacagagugcguuagaguggacaaagauugugccuacugcacggacgaaauguuccgggaucgcagauguaauacccaggcugagcugcuugccgcuggaugccaacgggaaucuauuguggucauggagagcuccuuucagaucacagaagagacccagauugacacaacccugcgcagaucucagaugagcccucaaggccuccgggugcgccugagacccggggaggaacggcacuucgagcuggaaguuuuugagccucucgagucccccguggaucuguauauccuuauggacuucagcaacucuauguccgaugaccuggauaaucucaagaaaaugggacagaaccuggcccgcguccuuagccagcugacaucugacuacaccauuggcuuugggaaguucguggauaagguuuccgugccucagacggacaugagaccggaaaaacucaaggagcccuggccuaauagcgaucccccuuuuucuuucaaaaacgucaucucccugaccgaagacguggacgaguuucggaauaagcugcaaggagaacgcaucagcggcaaccucgaugcgcccgagggcggguucgacgccauucugcagacagcuguguguaccagagauaucggauggcggccggacuccacacaucuucuggucuuuucuaccgagagcgccuuccacuaugaagcugauggcgccaauguucucgcggggauuauguccagaaacgacgagcgcugccaucuggauacgacaggaaccuacacacaguaucggacccaggacuacccuagcgugcccacccuugugagacugcucgccaaacacaauaucauuccuaucuuugcugucacaaacuauucuuacuccuacuaugaaaagcugcauacguacuuccccgugagcucucugggcguucuccaagaggauagcuccaauauuguggaacugcuugaggaggccuucaaccgcauccggucuaaucuggacaucagagcucucgauagcccccgcgggcugcggaccgaagucacauccaagauguuucagaaaaccagaacaggaagcuuccacauucgccggggcgaggugggcaucuaucagguucaacuuagagcccuggaacacguggacgggacccaugucugucagcucccugaggaccagaagggaaacauucaccugaaaccgucuuuuuccgauggccugaagauggacgccgggaucauuugcgauguguguacgugcgaacuccagaaagagguccgcagcgcucggugcucuuucaacggagacuuuguguguggccaaugcguuuguuccgagggguggagcggacagacaugcaauuguuccaccggcucucugagcgauauccagcccugccuuagagaaggcgaggacaagccuuguuccgggcggggagaaugccaguguggccauugcguguguuacggggagggacgcuaugagggccaauucugcgaauacgauaacuuucagugccccagaaccucuggguuccuguguaaugaccggggcagaugcagcaugggacagugugucugcgagccuggcuggacagggcccuccugugauugcccgcucagcaacgcgaccuguaucgacucuaauggaggcauuugcaacgggcgcggacacugugaaugcggccggugucacugccaucagcaaucccuguauacagauacgaucugcgagauuaauuacagcgccauccacccugggcugugugaagaccuuagaucuugcgugcagugucaggcuuggggcaccggagagaaaaagggccgcacaugcgaggaauguaacuuuaagguuaaaaugguggaugagcucaagagagccgaagaggucguggugcggugcuccuuccgcgacgaagacgaugacuguaccuacagcuauacaauggagggggauggagcccccggcccuaauucuaccguucugguccauaaaaagaaagacugccccccugggagcuuuugguggcugauuccccuccugcuucugcuccugccgcugcuugcucuccugcugcuccuguguuggaaguacugcgccuguugcaaggcgugccuugcucugcucccuuguugcaacagaggacacauggugggcuucaaagaggaucauuauaugcugcgggaaaaucugauggccuccgaccaccuugauacgcccaugcuccgcagcgggaaccugaagggcagagacgugguccgguggaaagugaccaauaacaugcagcgccccggauuugccacacacgcugccucuaucaauccuaccgagcugguuccguacggccucucccugagacuugcucggcuguguacagaaaaccuccugaagcccgauacccgcgagugcgcccaacugagacaggaaguggaggagaaccuuaaugaagucuaucggcagaucagcggggugcauaaacuccaacagacgaaguucagacagcagccuaacgcgggaaagaaacaagaccacacaauuguugauaccgugcugauggccccccgcuccgcuaagccugcccugcucaaacugacagagaagcaggucgaacagcgggcuuuccaugaccuuaaaguggcccccggcuacuauacccugaccgcggaucaggacgccagagggaugguugaguuucaagagggaguggaacucgucgacgugcgcgugccucuguucauccggcccgaggaugacgaugaaaagcagcugcuugucgaggcuauugacguuccggccggcacagcuacgcuggggagacgccucgugaauaucaccauuaucaaggaacaggcccgggauguggucucuuuugagcagccugaguucagcguguccagaggcgaccaaguugcccgcauucccgugauccggagaguccuggauggaggcaaaucucaggugagcuaccggacacaggacgggaccgcucaaggaaaccgcgauuacaucccuguugaaggcgagcuccuguuucagcccggggaagcguggaaggagcuucaggugaaacugcucgaacugcaggaggucgacucccugcuuagaggacggcaagugcgcagauuccacguucagcugucuaauccgaaguuuggcgcccaccucggccagccucauagcacaaccauuaucauucgggaucccgacgagcuggacagauccuucacgagccagaugcucucuucccaaccucccccccacggggaucugggagcuccucagaacccgaaugccaaagccgcuggcagccgcaagauccauuuuaacuggcuucccccuucugggaaacccaugggauaucgggugaaguacuggauucagggcgacuccgaaagcgaggcccaccugcucgauucuaaggucccuuccguggaacugacaaaucuguaucccuacugugacuaugagaugaaagugugcgcguacggggcucagggagaaggcccuuauagcucccuugucagcuguagaacccaucaagagguuccgucugagcccggccgccuggccuucaacguggugagcuccaccgucacacagcucucuugggccgaaccugcugagaccaauggggaaaucacagccuacgaggugugcuacggacugguuaacgaugacaaucggcccaucggcccuaugaagaaagugcucgucgauaaccccaagaauagaaugcugcuuauugagaaccugcgcgaaagccagccguaucgguacacggugaaagcgagaaacggggcuggauggggcccugagcgcgaagccaucauuaaucuggccacccagcccaagagacccauguccaucccuauuauccccgacaucccuauuguugaugcucaaucuggggaggacuaugauagcuuucucauguacuccgacgaugugcugcggucuccgagcggaucccagcgccccagcgucucugacgacacaggcuguggcuggaaguucgaaccucuucugggggaggagcucgaucugagacgggugaccuggcgccuccccccugaacugauccccagacuuuccgccagcucuggacgguccagcgacgcugaggccccgcacggcccucccgaugacgggggagcgggcgggaaaggaggcucccugccuagaucugccacacccggcccucccggggaacaccuggucaacggacgcauggauuuugcuuucccgggcagcaccaauucccuccaucggaugacgaccacaagcgccgcugccuaugggacccaccugucuccucaugugccccacagaguucuuuccacaagcucuacccugacacgcgacuacaacagccucacccgguccgagcauucucacagcacgacacugcccagagauuauuccacccucaccucugugagcucccacgacagccggcugacagccggagucccugauaccccgacgcgccuuguguucucugcucugggccccacaucccugagaguuagcuggcaggaaccucggugcgagcgcccccuccaaggguacuccguggaguaccagcugcuuaauggaggcgaacugcauagacucaacauuccuaaucccgcgcagaccucugucgugguggaggaccugcucccuaaccacagcuauguuuuucggguccgcgcccagucccaagaaggcugggggagagagcgggaaggagugaucacaauugagucucaggugcauccgcagagcccccuguguccucuucccggcuccgcuuucacccugagcacaccuucugcccccgggccgcuggucuuuaccgcccucuccccugauagccugcagcuuucuugggagcgccccagacggcccaauggagacaucgugggcuaccugguuacgugcgaaauggcucaagggggaggcccugccaccgcguucagaguggauggcgacucccccgagagccgccucacagucccugggcugucugaaaacgugccguauaaguuuaaaguucaggcucggaccacagagggauucggccccgagagagaagggaucauuaccaucgagagccaggacggaggcccuuuuccccagcuggggucccgcgccggacucuuccaacacccucuucagucugaauacagcuccauuacgacaacccacacaagcgccaccgagcccuuucugguggauggccugacccucggcgcucagcaucuggaagccgggggaucccuuacacggcacgucacgcaagaguucgugucuagaacccugacaaccagcggcacacucuccacccauauggaccagcaguuuuuccagacguga

SEQ ID NO: 70913 - RNA, 2400 nt, Artificial Sequence
  derived and/or modified sequence opt5 from ITGB5__Homo_sapiens__NP_002204
augcccagagccccugcuccgcuguacgccugccuccugggccuuugugcgcugcucccccggcuggcugggcuuaacaucugcaccagcggauccgccacaucuugugaggaaugccugcucauucacccuaagugugccuggugcagcaaagaggacuucggcucuccccgcuccaucacgagcagaugugaucugcgggcuaaucuggugaagaacgggugcggaggcgaaauugaguccccugccucuagcuuucauguccuccgcucccugccccuuagcucuaaaggguccggaagcgcuggcugggacguuauccagaugaccccucaagaaauugccgugaaucugagaccgggcgauaagacaaccuuccagcuccaggugcggcaggucgaggacuaucccguggaucuguacuaucuuauggaccugucucucuccaugaaagaugaccuggauaacauccgcagccuggggacaaagcucgcggaggaaaugagaaagcugaccucuaauuuucggcuuggauucggcuccuuuguugacaaagauaucagcccuuucuccuacacagcuccccgcuaucaaaccaacccuuguauuggguacaagcuguuucccaauugcgugccgucuuucggauuuagacaccuccugccucuuacggaccgggucgauagcuucaacgaggaagugcgcaaacagagaguuucccggaaucgcgacgcccccgagggcggguuugacgccgugcugcaggcugccgucuguaaggagaaaaucggauggagaaaggaugcgcuccaucugcugguguucaccacagacgaugugccucacauugcccucgacggcaagcugggcgggcuuguccagccccaugauggacaaugccaccugaacgaagcuaaugaguauaccgccagcaaccagauggacuaccccucucucgcucugcuuggcgaaaaacuggccgagaauaacaucaaucucauuuuugccguuacaaagaaccacuacaugcuguauaaaaacuucaccgcucugaucccugggacgacaguggaaauucucgauggagacuccaagaauaucauccagcugauuaucaacgcguacaauagcauucggucuaaaguggagcuuagcgucugggaucagccggaggaccugaaccucuucuuuaccgccacaugccaagauggcguguccuaucccgggcagagaaagugugaaggacugaaaaucggcgacaccgcuucuuucgagguuagccuggaagcccgcuccugcccuagccggcauaccgagcacguguuugcccuuagacccgucggcuuccgcgacucucucgaaguggggguuacauacaauuguacgugcggauguuccgugggccuggagccuaacagcgcucggugcaaugggucuggaaccuaugucuguggccugugcgaguguucccccggguaccucggcacaagaugcgaaugucaggauggagagaaccaaagcguguaucagaaucugugccgcgaagccgagggcaagccgcuuugcuccgggcggggagacuguucuugcaaccaguguagcugcuuugaauccgaguucggcaagauuuacgggccuuuuugugagugcgauaauuucucuugugcgagaaacaaaggaguccugugcagcggccauggggaaugucacugcggcgaguguaagugccacgcuggauacaucggcgacaauugcaacuguuccaccgauaucagcacaugccgcgggcgggacggacagauuuguucugaaagaggccauugccucugugggcaaugccaguguaccgagcccggagccuuuggcgagaugugcgaaaaauguccuacgugccccgaugccuguuccacaaagcgcgacugcguggagugccugcugcuucacagcgggaaaccugauaaucagaccugucauucucucugccgggacgaaguuaucaccuggguggauacaauugucaaggacgaucaggaggcugugcuguguuucuauaagaccgccaaagacugcguuaugauguuuacauacguggaacugcccuccggcaagagcaaccucacgguccugagagagccggaguguggaaacaccccuaaugcuaugacaauccuucuggccguggugggcucuauucuccugguugggcuggcgcuucucgccaucuggaaacugcuggucaccauccacgaccggcgcgaguucgcuaaguuucaaagcgaaagaucccgggccagauaugaaauggcuagcaacccccucuaccgcaaacccauuucuacacauaccguggauuucacguucaauaaguuuaacaaguccuauaauggaaccguggacuga

SEQ ID NO: 70914 - RNA, 2367 nt, Artificial Sequence
  derived and/or modified sequence opt5 from ITGB6__Homo_sapiens__NP_000879
augggcaucgagcugcucugccuguucuuucuuuuccuggggagaaacgaccacgugcagggaggcugugcccucgggggagcugaaaccugcgaggauugucugcuuauuggcccccaaugcgccuggugugcgcaggaaaauuuuacacauccuagcggggucggagagcggugcgacacgccggcuaaccugcucgccaagggcugucagcugaauuucaucgaaaaccccguuucccagguggagauucugaaaaauaagccucucucugugggccgccaaaagaacagcuccgauaucguccagauugcuccccagucucugauccuuaagcugagaccugggggagcccagacccuccaagugcacguucggcagacagaggacuaccccguggaucuguauuaccuuauggaccugagcgccuccauggaugacgaucucaauaccaucaaagaacugggcucucgccugagcaaggagauguccaagcucacaagcaacuuuagacugggguucggaucuuuugucgaaaaaccuguguccccguucguuaagaccacacccgaggagauugcuaauccuugcagcucuauccccuauuuuugucuuccuaccuucggcuuuaaacauauucugccccucacgaacgacgccgaacgguucaaugagaucgugaagaaccagaaaauuuccgcgaauaucgauaccccggaagggggauuugacgccauuaugcaggcugccgucugcaaggagaagaucggcuggcgcaacgauagccugcaccuucugguguucgugucugacgcugacucccauuucggcauggauagcaaacucgccgggaucgucauuccuaaugacggacugugucaccuggauuccaagaacgaauacucuaugagcacaguucucgaguaucccaccaucggccaacugauugacaaacuugugcagaacaaugugcugcucaucuuugcggucacacaggagcaagugcaccuguacgaaaacuaugccaaacuuauuccuggggcuaccguuggacugcuccagaaagauuccggcaauauccugcagcugaucauuagcgccuacgaggaacucagaucugagguggaacuggagguccuuggggacacggagggacugaaccucuccuucacagcuaucugcaauaacggcacccuguuucagcaucaaaagaaaugcagccacaugaaggugggcgauacagccucuuucagcguuaccgugaauauuccccauugugaacggcgcuccagacacaucauuaucaagcccgucgggcugggagacgcccuugagcuccuggugucuccugaaugcaacugugauugccagaaagaggucgaagugaauagcuccaagugucaccauggcaacgggagcuuucagugcggaguuugugcuugccacccgggccauauggggccccggugugagugcggcgaggacaugcugucuaccgauuccuguaaagaagcgccugaccaccccagcugcucuggacgcggcgacugcuacugugggcagugcaucugucaucucuccccuuauggaaauauuuacggccccuauugccaaugugauaacuucagcugcgugagacacaaggggcugcuuuguggaggcaauggggacugcgauuguggcgagugcgucugucgguccggauggacaggcgaauacugcaacugcacgaccucuacagacagcuguguguccgaggaugggguucugugcucuggacgcggcgacugugugugcgggaaaugugucugcaccaauccgggagccagcggcccuacaugugagagaugccccaccuguggggauccuugcaacuccaagcggagcuguaucgaaugccaccucucugcugccggccaggccagagaggaaugcguggacaaguguaaacuggcuggagccacgauuuccgaggaagaggauuuuagcaaggacggcucuguguccugcagccugcagggggagaacgaaugucuuaucacauuccucauuaccaccgauaaugagggaaaaacaaucauucauucuaucaacgaaaaggacugccccaaaccucccaauaucccgaugauuaugcugggcguuagccuggcgauccuccugauuggggucgugcuucuguguaucuggaagcuccugguguccuuucacgaucgcaaggaggucgcuaaauucgaagccgagcggagcaaggccaaauggcagaccggaacaaacccucuguauagaggcucuacguccaccuuuaagaaugugacauacaaacaucgcgagaagcaaaagguugaccuuagcaccgacugcuga

SEQ ID NO: 70915 - RNA, 2397 nt, Artificial Sequence
  derived and/or modified sequence opt5 from ITGB7__Homo_sapiens__NP_000880
augguggcccugcccaugguccucguucugcuucuggugcucagcagaggcgaguccgaacuggacgcuaagaucccuucuaccggggaugccacagaguggcggaacccgcaccuuagcaugcugggauccugccagcccgcgccuucuugucaaaaaugcauucucagccaucccuccugugcuuggugcaagcagcugaauuucacggccucuggcgaagccgaggcucgcagaugugcccggcgcgaagaacugcucgcuagagggugcccucuggaggaacuugaggaaccccggggacagcaggaggugcugcaagaccagccucucagccagggcgcccgcggggagggagcgacccagcuggccccgcaaagaguccgggugacacuucgccccggcgaaccucagcagcugcagguuagauuucuccgggcugagggcuaccccguggaucuguauuaccugauggaccucuccuauagcaugaaagaugaccuggaacgcgucagacaacuugggcacgcccugcucgugcggcugcaggagguuacccauucugugcgcaucggauucggcuccuuugucgauaagacagugcuuccuuucgugagcaccguccccucuaaacugagacacccguguccuacacggcucgaaagaugccagucccccuuuagcuuccaucacguucugucucugaccggggacgcucaagccuuugagcgcgaggugggacggcaguccgugagcggcaaccucgauuccccugaagggggauucgacgcgauucugcaggccgcucuuugucaggagcaaaucggcuggagaaaugucucucgccugcucguguuuacgagcgaugacaccuuccacacagccggcgaugggaagcugggaggcauuuuuaugcccuccgacgggcauugccaccuugacagcaacggacuguacucucgguccaccgaguucgauuaucccagcguuggccagguggcucaggcccucucugccgcuaauauccagccuaucuuugcggucacaagcgccgcucugccgguguaccaagagcuguccaagcucauucccaaaucugccguuggggaacugagcgaggacuccagcaacgugguccagcuuaucauggaugccuauaauucucuguccagcaccgugacgcucgagcauucuucccugccucccggaguccacauuagcuacgaaucccagugugagggcccugaaaagagagagggcaaagcugaagaccgcgggcagugcaaccacgugcggaucaaucaaacaguuaccuucugggugucucugcaggccacacauugccuucccgagccgcaccuccugagacugcgcgcgcucggauucagcgaggaacugauugucgagcuucauacccugugugauugcaacuguuccgacacccagccucaggcuccccacugcucugauggccaagggcaucuccaguguggagugugcagcugugccccuggccggcuggggagacugugcgaauguuccguugccgagcuuagcucucccgaccucgaguccggcugccgcgcuccuaauggaacaggcccccuguguagcgggaagggacacugccagugcggccgguguucuugcuccgggcaaagcucuggacaccugugugaaugcgaugacgccagcugugagagacaugaaggcauccucugcgggggcuuuggacggugucagugcggcgugugucacugccaugcuaaccgcacggggagagccugugagugcuccggagauauggacagcugcauuucuccggaaggcgggcuguguuccggacacggccggugcaaauguaauagaugccagugucuugacggguacuauggcgcgcugugcgaucaguguccuggaugcaagacccccugugagcgccaccgggacugcgccgaguguggcgcuuucagaacagggccccucgccaccaacugcagcacagcuugcgcccauaccaaugucacgcuggcgcuggccccuauccuugaugacggaugguguaaggaacgcacacucgauaaccaacuguuuuucuuucugguggaggacgaugcuagaggcaccgugguucuccggguccgcccgcaggaaaaaggggccgaccacacccaggcuaucgugcugggaugcgugggcgggauugucgccgugggccuuggacugguucucgccuacagacuguccguggagaucuaugaucggcgcgaauacucuagauucgagaaggagcagcaacagcugaacuggaaacaggacagcaauccccuuuauaaguccgcuauuacaaccacaaucaacccucgguuucaggaagcggauucucccacgcucuga

SEQ ID NO: 70916 - RNA, 2310 nt, Artificial Sequence
  derived and/or modified sequence opt5 from ITGB8__Homo_sapiens__NP_002205
augugcggcagcgcccuggcuuucuuuaccgccgcguucgugugucuccagaacgacagacgggggcccgcuuccuuucugugggccgccugggucuucucucuuguucugggacucggccaaggggaggauaaucgcugcgcuagcuccaacgccgcuucuugugccagaugccuggcgcuuggaccugaauguggcuggugcgugcaggaggacuuuaucagcgggggaucccggucugaacgcugugauauugugagcaaucugaucuccaagggcugcagcgucgacucuauugaguacccguccgugcacguuaucauucccacagaaaacgagaucaauacccaggugacgccuggcgaggucagcauccagcucagacccggggccgaagcuaacuucaugcugaaagugcauccucugaagaaauaucccguugaucucuacuaucugguggacgucucugccuccaugcacaauaacauugagaaacuuaauagcgugggaaacgaucugucucggaagauggccuuuuucucccgcgacuuuagacucggcuucgggagcuacguggauaagacagucuccccuuauaucucuauucauccggaacggauccacaaucaauguagcgacuacaaccuggauugcaugcccccucauggauauauucacguucuuucccugaccgagaauaucacagaguuugaaaaggcugugcaccgccagaaaauuagcggcaacaucgacacccccgagggcggauucgaugcgaugcuccaggccgcugugugugaaucucauaucggcuggagaaaggaggccaaacggcugcugcucgucaugacagaccagaccucccaccuggcucuugacagcaagcuggccggcauugugguuccuaaugaugggaacugccaucucaaaaacaauguguacgucaagucuacgaccauggaacaccccagccugggacaacuuuccgagaagcugaucgacaacaauauuaacgugaucuuugccguucagggcaaacaguuccacugguacaaggaucuccugccgcugcucccugggacaauugcuggagagaucgaaucuaaagcggccaaucugaacaaucuuguggucgaggcuuaucagaagcugaucagcgaagugaaaguccaaguggagaaccagguucagggcauuuacuucaauaucaccgccauuugccccgacgggucccgcaagccuggaauggaaggcuguagaaacgugacaagcaaugaugagguccucuuuaacgugaccguuacgaugaaaaagugcgacgugacaggcgggaagaauuaugccaucauuaaacccaucggauucaacgagaccgcuaagauccauauucaccggaauuguucuugccaaugugaagauaaccgcggccccaaagggaagugcgucgacgagacauuucuggauuccaaauguuuccagugcgacgaaaacaagugucauuuugaugaggaccaguucagcucugaauccugcaagagccacaaagaccagccuguguguuccggaagaggcgugugcguuugcgggaaguguucuugccauaaaaucaaacuuggcaaggucuacggaaaguauugugagaaggaugacuuuagcugcccguaccaccacggcaaucugugugccgggcauggagagugcgaagcgggccggugucaaugcuucuccgggugggagggagauagaugucagugccccucugcugccgcccagcacugugugaacagcaaaggccaggugugcuccgggcgcgggaccugcgucuguggacggugcgaauguaccgacccuagaagcauuggccgcuuuugcgagcauugucccacaugcuauacggcuuguaaggagaauuggaacugcaugcaaugucuccacccucacaaucugucucaggccauccuggaucagugcaaaaccuccugugcucucauggaacagcaacauuacguggaccagacaagcgagugcuucucuucccccagcuaccugcggaucuuuuucauuauuuuuaucguuaccuuccuuaucgggcugcucaaggugcugauuaucagacaggucauucugcaguggaacucuaauaaaaucaagagcuccagcgauuaucgcgugucugccuccaagaaagacaaacuuauucuccaaagcguuugcacacgggcggugaccuacagacgcgaaaagccggaggaaaucaagauggauaucuccaaacugaacgcccacgagacguuccgguguaauuuuuga

SEQ ID NO: 70917 - RNA, 1062 nt, Artificial Sequence
  derived and/or modified sequence opt5 from ITGBL1__Homo_sapiens__NP_001258683
augugcaagaacagccaggacaucauuuguuccaaugccggaaccugccacugugggagaugcaaaugugauaacucugacggaagcggccugguguacgggaaguucugcgagugugaugaccgggaaugcaucgaugacgagacagaagagauuuguggaggccaugggaaaugcuauuguggaaauugcuacugcaaggcuggcuggcacggcgauaaaugugaauuucaaugcgacaucacgcccugggaguccaagcgcagauguaccucuccugaugggaagauuugcagcaaccggggaacaugugucugcggcgaguguaccugccaugacguugauccgacaggggacuggggagauauccacggcgacaccugugaaugcgacgagcgcgauuguagagccguguaugaccgguacuccgaugacuucugcucugggcauggacagugcaauuguggccgcugcgauuguaaagcgggcugguaugggaagaaaugcgaacacccccagagcuguacacucuccgcugaggagagcaucagaaagugccagggaucuuccgaccugccuuguagcggccgggggaaaugcgaauguggaaagugcaccuguuaucccccuggcgaucgcagaguguacgggaagacgugcgagugcgacgaucggcgcugugaagaccuugauggagucgugugcggcggccacgggaccuguucuugcggaagauguguuugcgagcggggcugguuugggaaacugugucaacauccccgcaagugcaacaugacagaagaacaguccaaaaaucucugugagagcgccgacggcauucugugcucuggcaagggguccugucacugcggcaaaugcaucuguagcgccgaagagugguacauuuccggagaguucugcgacugugaugacagagauugcgacaagcaugauggccuuaucuguaccgggaacggaauuugcucuuguggcaauugcgaguguugggacggguggaacggaaaugcuugcgaaaucuggcugggcagcgaguacccuuga

SEQ ID NO: 70918 - RNA, 2736 nt, Artificial Sequence
  derived and/or modified sequence opt5 from ITIH1__Homo_sapiens__NP_002206
auggacggcgccauggggcccagaggacugcuccugugcauguaccuugugagccugcucauccugcaggcuaugccugcccuuggcuccgcgaccgggcggucuaagagcuccgagaaacgccaagcugucgauacagccguugacggaguguucauuagaucucugaaggugaacuguaaagucacgagccgguuugcccacuaugugguuaccucccagguggucaauacagcuaacgaagcccgcgagguggcuuucgaucucgaaaucccgaagaccgccuuuauuucugacuucgcgguuacagccgauggcaaugcuuuuaucggggacauuaaagauaaggugaccgccuggaagcaguacagaaaagcugccaucagcggagagaacgcgggccugguccgggccuccggccgcacaauggaacaguucaccauccaucugacggugaauccccaaagcaaggugaccuuucagcucacauaugaggagguccugaaaagaaaccacaugcaguacgaaauuguuaucaaggugaaaccuaagcagcuugugcaucacuucgagauugacgucgauaucuuugaaccccaagggauuucuaagcuggacgcucaggccuccuuccucccuaaagagcuggcugcccagaccaucaagaaaucuuuuagcggaaagaaaggccaugugcuuuuccggcccacaguuucccagcaacagagcugcccuaccuguucuacgucccugcucaaugggcacuuuaaggugacauaugaugucagccgcgacaaaauuugcgaucugcugguggccaacaaucacuucgcucauuucuuugcgccgcagaaccucaccaauaugaacaagaauguuguguucgucaucgacaucuccggaucuaugagaggccaaaaggugaaacagacaaaggaggcccugcuuaaaauucugggggacaugcagcccggagauuacuuugaccucguccuguucggcacccgggugcagagcuggaagggcucccuuguucaagcuagcgaagccaaccugcaggccgcucaggauuuugugcgcggguucucucucgacgaggccaccaaucugaacggaggccugcucagagggaucgaaauucugaaccagguccaagagucccuuccugaacugagcaaucacgcgucuauccucauuaugcugacagauggagaccccacggagggcgugaccgaucggagccagauccuuaaaaacguucgcaaugcuaucagagggcgguuuccucuguauaaccucggauucggccauaauguggacuuuaacuuccuggaggucauguccauggaaaauaacggcagagcccagcgcauuuacgaggaucacgacgccacacagcaacugcagggguuuuacucucagguggcuaagccccuccugguggauguugaccuucaguauccgcaagacgccguccuggcucucacccagaaucaccauaagcaguacuaugaaggaagcgagaucgugguggccggccggauugcggauaacaaacaauccagcuucaaggccgacguccaggcucacggggaaggacaggaguuuucuaucacaugucugguggaugaggaagagaugaaaaagcugcuuagagaacgcggccauaugcucgagaaucacguugaacggcugugggccuaccugaccauucaggagcuccuggcuaaaagaaugaagguggaccgcgaggaacgggccaaccuuuccagccaagcgcugcagaugucucucgauuauggguucgucacgccucugacauccaugagcaucagaggcauggccgaccaggauggacugaagcccaccaucgacaaaccuuccgaggauucuccuccccuugaaaugcucggcccccgccggaccuucgugcugagcgcucugcagccgucccccacacauucuagcuccaauacccaaagacucccugaccgcguuacagggguggauacggacccccacuuuauuauccacgucccucagaaggaggauacccugugcuucaacauuaaugaggaacccggagugauccuuagccugguucaggacccgaacacaggcuuuucugugaacgggcagcucauuggaaauaaagcccgguccccuggccaacaugacgggaccuacuucggcagacugggaaucgcuaaccccgccacagauuuucagcuggaggucaccccucagaauauuacgcuuaaccccggcuucgggggaccuguguuuagcuggcgggaccaagccgugcuccgccaggauggcgucguugugaccaucaauaagaaaagaaaccugguggucucuguggacgaugggggaacauucgaaguugugcugcaccgggucuggaagggcuccagcgugcaucaggacuuucucggguucuauguucuggauucucacagaaugagcgcucgcacccacggccuucugggacaguuuuuccaucccaucggcuuugagguguccgacauucacccggggagcgauccuacaaagcccgacgcgaccauggucgugcggaauagacgccucacgguuacaagaggacugcaaaaagauuacucuaaggaccccuggcauggcgccgaaguguccuguugguucauccacaacaauggggcuggacugauugauggcgccuacaccgacuauaucgucccugacauuuucuga

SEQ ID NO: 70919 - RNA, 2841 nt, Artificial Sequence
  derived and/or modified sequence opt5 from ITIH2__Homo_sapiens__NP_002207
augaagagacugaccugcuucuuuaucuguuucuuucucagcgagguguccggcuucgaaauucccaucaacgggcugucugaguuugucgacuacgaagaucuuguugagcuggccccuggaaaauuccagcucguggcugaaaaucggcgcuaucaaagaagccugccgggcgaguccgaggaaaugauggaggaaguggaccaggucacacuuuacucuuauaaggugcagagcacgauuaccucccggauggccacaaccaugauccagucuaaaguugugaacaauagcccccaaccucagaacgucguguuugauguucagauucccaagggggcguucaucuccaauuuuagcaugacaguggacggaaaaaccuucagaucuuccaucaaggagaagacagucggccgcgcucuguacgcccaggcccgggcuaaagggaagaccgccggacucgugcgcagcucugcucuggauauggagaacuuuagaacggaagugaauguccugccuggcgccaaaguucaauucgagcuccacuaucaggaagugaaguggcggaaacugggcuccuacgagcaucgcauuuaucuucagcccgggagacuggcgaagcaccucgaaguggacgucugggugaucgagccucagggacugcgguuucuucauguuccggauaccuucgagggccacuucgacggggugcccgucauuagcaagggacaacagaaagcccaugugucuuuuaagccuacaguugcucagcaacgcaucugccccaacuguagagaaaccgccguggauggcgagcuggucgugcucuacgacgucaaacgggaagagaaggcuggggaacuggagguguucaauggauacuuuguucacuucuuugccccugauaaccuggaccccauuccgaaaaauauccucuucgugauugaugucuccggcagcauguggggcgugaagaugaaacagacaguugaggcgaugaagaccauccuggacgaccuucgcgccgaagaucacuuuuccgugaucgacuucaaccagaauauuagaacguggcggaacgaucugaucucugcuacaaagacccaggucgccgacgcuaaaagauauauugagaagauccaaccuagcgggggaacaaauauuaacgaagcccuccugcgcgccaucuuuauccuuaacgaggcuaauaaccugggccuccuggaucccaauuccgugagccugauuauccucgugucugacggggauccuaccguuggagaacugaaacuuuccaagauucagaaaaacgucaaggagaauauccaggacaacauuagccuguucucucucggcaugggguuugauguggacuacgauuuccugaagcggcuuagcaaugagaaccauggaaucgcgcagagaaucuauggcaaucaagacaccuccucucagcugaaaaaguuuuacaaccaggugagcacaccccuccugcgcaauguccaguucaacuauccccacacguccgugaccgacguuacacaaaauaacuuccauaauuacuuuggcgggagcgaaauuguggucgccggaaaauucgauccugcuaagcuggaccagaucgagucugugauuaccgccacauccgccaacacccagcucguucuggaaacgcuugcucagauggaugaccugcaagauuuucucagcaaagacaagcacgccgauccggacuucacacggaagcugugggcguaucugaccaucaaccagcuucucgcugagagaucucuggcccccaccgccgcugccaaacgccggauuacaagauccauccugcagaugagccucgaucaccauauugugaccccucugacaucccuugucaucgagaaugaagcuggcgacgagcgcaugcuggccgaugcgcccccucaagaccccucuugcuguagcggggcccucuacuacggauccaaggugguuccggauucuacgccuagcugggcuaaccccuccccuacccccgugaucagcaugcuggcccagggcucucagguccuggaauccacaccucccccgcacgugaugcggguggagaaugacccucauuuuauuaucuaucuucccaaaagccagaagaacauuugcuucaauaucgacucugaacccgggaaaauucucaaccuggucuccgauccugagagcggcaucguugugaauggacaacuggugggcgcuaagaagccgaacaaugggaaacucucuaccuacuuuggaaagcugggcuucuauuuucagagcgaggacaucaaaauugaaaucuccacagagaccauuacgcuuagccacgggucuuccaccuucagccuguccuggucugauacagcccaggucaccaaccagagagugcaaaucagcguuaagaaagaaaagguggucacaauuacccucgacaaagagauguccuuuucugugcugcugcaucgcguuuggaagaagcaccccgugaaugucgauuuccuuggaaucuacaucccucccacgaacaaauuuagcccuaaggcgcacggccucauugggcaguucaugcaggaacccaaaauccauauuuucaaugagcggccuggcaaggaccccgagaaaccggaagccuccauggaggugaagggacagaagcugaucauuacaagaggccugcaaaaagauuaucggaccgaccucguuuuugggacagaugugaccuguugguucguccacaacucuggaaagggcuuuaucgacgggcauuacaaagauuauuucgugccucagcuguacagcuuucuuaagcgccccuga

SEQ ID NO: 70920 - RNA, 2673 nt, Artificial Sequence
  derived and/or modified sequence opt5 from ITIH3__Homo_sapiens__NP_002208
auggccuucgcuugguggcccugccugauccucgcccugcuuagcucccuggcggcuucuggcuuuccuagaagcccguuccggcuccuggggaagcgcucccuucccgagggaguggccaacggcauugaagucuacucuaccaaaaucaauagcaagguuacauccagauuugcccacaacguggugacgaugcgggcugucaaucgcgccgacaccgcuaaagaggugucuuucgauguugaacugccuaagacagccuuuauuaccaacuucacacucaccaucgacggggugacauaucccggaaaugucaaagagaaggaaguggcgaagaaacaguacgagaaggccguuagccaaggcaaaaccgcugggcuggugaaggccuccggaagaaaacuggagaaguuuacggucagcgugaacguggcugccggcucuaaggucaccuucgaacucacauaugaggaacugcuuaaacggcauaagggcaaauacgagauguaucugaagguucagccuaaacagcucgugaagcacuuugagauugaaguggauaucuucgagccccaggggaucuccaugcuggacgcggaagccagcuuuauuaccaaugaucuucugggaucugcucucacaaaauccuucagcggcaagaaggggcaugucucuuuuaaaccuucccuggaccaacagcgcagcuguccgaccugcacggauucccugcucaacggagacuucacaaucaccuacgaugugaauagagagucucccggcaacguucagauugugaauggguauuucguccacuuuuucgccccucagggacugcccgugguuccuaagaacguggcuuuugucaucgacauuagcggcuccauggccggccggaaacuugaacaaacaaaggaggcccugcuccgcauccuggaggauaugcaggaagaggacuaccuuaauuucauucuguuuagcggggaugugucuaccuggaaagaacaucucguccaggcuacccccgagaaccugcaggaagcgagaacauucgugaaguccauggaggacaagggaaugacgaauaucaacgacggccugcuccgggggaucagcaugcugaacaaagcccgcgaggaacaccggauuccggagagaucuaccagcaucguuauuaugcuuacagauggagacgcuaaugugggcgaaucccgcccugagaagauccaagaaaacgucagaaaugccauugggggaaaauuuccccuguacaaccucggcuucggcaauaaccugaauuauaacuuucuugagaauauggcccuggagaaccacggguucgcucggagaaucuacgaagauucugacgccgaucuccagcugcagggauuuuaugaggaaguggcgaauccucugcucaccggcguugagauggaguaccccgaaaacgcuauccuggaccuuacacaaaauaccuaucagcauuucuacgaugggagcgagauuguggucgccggacgccugguggacgaagauaugaacuccuuuaaggccgacgugaaaggccacggggcuacgaaugaucucacauucaccgaggaaguugacaugaaggagauggagaaggcccugcaggaacgggacuauaucuucggcaacuacauugagagacugugggcuuaccuuaccaucgaacagcuccuggagaaacgcaagaacgcccauggagaagagaaagagaaucugacagcgcgggcccucgaucugagccuuaaguaucacuuugucacaccccugaccucuaugguggugacgaaaccugaagacaacgaggaugaaagagcuauugccgacaagccgggcgaggaugcugaagccacccccgucuccccugcgaugagcuaccucacaucuuaucaacccccucagaaucccuacuauuacguggacggggauccgcacuucaucauccagauuccugagaaggacgaugcccuguguuuuaacaucgacgaggcucccggaaccguucugcgccuuauucaggaugccgugacaggccucaccgucaaugggcaaaucacgggagacaaacggggcuccccugauagcaagaccagaaaaacauauuucgggaagcugggcauugcuaacgcccagauggacuuucagguggaaguuaccacagagaaaaucacccuguggaaucgcgccgugcccuccacguucucuuggcucgacacagucaccgugacacaggauggacugagcaugaugauuaaccggaagaauaugguuguguccuuuggcgacggggucaccuucguggugguccuucaucaaguuuggaaaaagcacccugugcauagagauuuucugggauucuacguggucgacucucaccgcaugagcgcucagacccauggccuccuggggcaguuuuuccagcccuuugauuucaagguguccgacauccggccgggaagcgauccuacaaaacccgacgcgacgcugguugugaagaaccaccaacuuaucgucaccagaggcucucagaaagauuaccggaaggacgccuccauugggacaaaagugguuugcugguucgugcacaauaacggcgaaggacucaucgauggcguccauaccgacuauauugugcccaaucuguuuuga

SEQ ID NO: 70921 - RNA, 2703 nt, Artificial Sequence
  derived and/or modified sequence opt5 from ITIH4__Homo_sapiens__NP_001159921
augaagcccccuagaccggugcggaccugcagcaaaguccugguucuccugucccuucuggccauccaccagacaacgaccgcugagaagaacggcauugacaucuacucucucacaguggauagccgcguguccucuagauucgcccauaccgucgugacaagccggguugugaaucgcgcgaacaccguccaagaagcuacauuucagauggagcugcccaaaaaggccuucauuaccaauuuuuccaugaucauugacgggaugacguauccuggaaucaucaaagaaaaggccgaggcucaggcccaguacucugcugccguggcgaagggcaaaagcgccgggcuuguuaaggcuaccggaagaaacauggaacaauuccagguguccgucagcguggcccccaaugcuaaaauuacauuugagcugguguaugaggaacuccugaagcggcgccugggcgucuacgagcuccugcuuaaaguuagaccucagcagcuggugaagcaccuccaaauggauauccauauuuucgaaccccaggggaucucuuuucuggagaccgaguccacauucaugaccaaccagcuuguggacgcccugacgacauggcagaauaagaccaaagcgcacauucgguuuaagccuacacucagccaacagcagaaaucuccggaacaacaggagaccguccuggauggaaaccugaucauucgcuaugacguggauagagccaucuccggcggcagcauccagauugaaaauggguacuucguucauuauuuugcucccgagggacucaccacaaugccuaagaacguggucuucgugaucgacaaaucuggcuccaugagcgggcggaagauucagcaaacgcgcgaagcccugaucaaaauucuugaugaccugucccccagagaucaguuuaaucucaucguuuucucuaccgaggcuacacaguggcggccuagccuggugcccgccuccgccgagaacgucaauaaggcucgcagcuucgcggccggaauccaggcucuuggcgggaccaacauuaaugacgccaugcugauggccgugcaacuccuggauucuuccaaccaggaagagagacugccggaaggaagcgucucucucaucauucugcuuacagacggcgacccuaccgugggcgagacgaacccccggagcauccagaauaacguuagagaagcuguguccgggcgcuacucucuguuuugucucggauucggcuuugaugucagcuacgccuuccuggagaaacuugcgcuggacaaugggggacucgcucggcgcauucacgaggauuccgacagcgcccugcagcugcaagauuuuuaucaggaaguggccaacccucuccugacagcuguuaccuucgaguaccccucuaaugccguggaagaggucacccagaacaauuuuagacuucuguucaagggcuccgaaauggugguggcugggaagcuccaggaccggggacccgauguucugacagccaccgucagcggcaaacugccuacacaaaacaucacguuucagaccgagucuuccguggcggagcaggaagccgaguuccaaagcccgaaguauaucuuucacaauuucauggaaagacuuugggcuuaccucacaauucagcagcugcuggagcagaccguguccgccucugacgcugaucaacaggcccuccgcaaccaggcgcugaaucuuagccuggccuauuccuuugucacaccccucaccucuauggugguuacgaaaccugacgaucaggagcaaagccagguggcugaaaagcccauggagggcgaaucccggaacagaaauguccauagcgccggggcugccggaucucgcaugaacuuccggccuggcgugcuguccagcagacagcuggggcuucccggaccgccugacguucccgaccacgccgcuuaccauccuuuccgccggcucgcgauccugcccgccucugcuccucccgccaccuccaauccggauccugccgugagcagagucaugaacaugaagauugaggaaacaaccaugacaacccagacgcccgcucccauccaagccccuucugcgauucugccgcuccccggccagagcguggagcggcugugcguugacccucgccacagacaggggcccgugaaccuucuguccgauccugagcaaggcgucgaagugacaggacaguaugagcgggaaaaagcuggcuuuagcuggaucgaggugaccuucaagaauccccucgucuggguucacgccucuccugaacaugugguggucacaagaaaccgccgguccagcgccuacaaauggaaggagacccuguuuuccgugaugcccgggcugaaaaugaccauggacaagacaggacuucuccugcugucugauccggacaagguuacgauuggccuccuguucugggaugggagaggagagggccuucgccugcuccugagagacaccgaucgguuuagcucccacgugggcggcacacugggacaguucuaccaggaaguccuuuggggcucuccugcugccagcgacgaugggcgcagaacccuccgggugcaaggaaaugaccauuccgcgacacgcgagagacggcuggauuaucaggaagggcccccugggguugagaucucuuguuggagcguggaacuguga

SEQ ID NO: 70922 - RNA, 2109 nt, Artificial Sequence
  derived and/or modified sequence opt5 from ITIH5__Homo_sapiens__NP_001001851
augcugcuccugcuuggccugugccucgggcugagccuuugugugggaucccaggaggaagcccaaucuuggggccacagcuccgagcaggacgggcugagagucccccggcagguucgccuccugcagagacugaagaccaaaccucucaugacagaguucucugucaagagcacgaucauuucccgguacgcuuuuaccacagugucuugccgcaugcugaacagagccagcgaggaucaagacaucgaguuccagaugcagauuccggcggcugccuuuaucaccaauuucacaaugcuuauuggagauaaaguguaucagggcgaaaucaccgagcgggaaaagaaauccggggaccgcgugaaggagaagagaaacaaaacaaccgaagagaauggagagaagggcacggaaaucuuucgggccagcgcuguuauucccucuaaagauaaggccgcuuucuuucuguccuacgaggaacuccugcaacgcagacuuggcaaauaugagcauagcaucucugugcggccucagcagcuguccgggcgccucagcgucgacgugaacauucuggaaucugccggaaucgcgucccuggagguucucccccugcacaauagcagacagcggggcuccgggcgcggagaggaugacucuggcccucccccuagcaccgugauuaaccaaaaugaaacauucgccaacaucauuuuuaagccgaccgucgugcagcaggcuagaaucgcccaaaaugggauccuuggagauuucauuauccgguacgacgugaacagagagcaguccauuggcgauauccagguccugaauggcuauuuuguucauuacuucgcucccaaggaccucccuccccugccuaaaaacgugguguuuguccuugauagcucugccuccaugguggggacaaagcugcgccagaccaaagacgcgcuuuucacgauucugcacgaccugcggccccaagauagauucagcaucaucggauuuucuaaucgcauuaagguuuggaaagaccaucucaucagcgugacaccggauuccauucgggacggcaaggucuauauccaccacaugucuccuaccgggggaacagauauuaacggcgcccugcagagagcuauccgccuucugaauaaauacguggcccauagcgggaucggagaccgguccguuagccucauuguguuccugaccgauggcaagcccaccgucggcgaaacacacacgcuuaagauccugaacaacaccagagaggcugcccgcggacagguguguauuuuuacaaucgggauuggcaaugacgucgauuuccggcuccuggaaaaacugucucucgagaacugcgggcugaccagacgcgugcaugaggaagaggacgccggaucccagcuuaucggcuuuuacgaugaaauucggacaccucugcucagcgacaucagaaucgacuauccucccucuuccguugugcaagcuaccaagacgcuguuccccaauuacuuuaacgggagcgagauuaucauugcgggcaaacuggucgaucggaagcucgaccaccuccacguggaaguuacagccuccaauucuaaaaaguucaucauucugaagaccgaugugccgguccgcccccagaaagcuggaaaggacgugaccggcagcccuagacccgggggagauggcgagggggacacaaaccauaucgagcggcugugguccuaucucaccacaaaagaacugcuuucuagcuggcugcaguccgaugacgagccugaaaaggagagacuccgccagcgggcccaagcccuggcugugagcuacagauuucugacgcccuucaccucuaugaaacuucgcggaccgguuccuagaauggauggccucgaggaagcccacgggauguccgcggcuaugggccccgagccugucgugcagagcgugcggggagccggcacacagcccgggccucugcugaagaagcccuaucagccgcgcaucaaaauuucuaagaccuccgucagaggauuucggcgcgaagaacaaaucuucagcaaugugaugaaauuuccuuucgccucuauucucgaacuguga

SEQ ID NO: 70923 - RNA, 1863 nt, Artificial Sequence
  derived and/or modified sequence opt5 from ITK__Homo_sapiens__NP_005537
augaacaauuucauccugcucgaggaacagcugauuaagaaaagccaacagaagagacggaccucccccucuaacuuuaaagugcgcuucuuuguccuuacaaaggccagccuggcuuacuucgaggacagacacggcaaaaagcggacgcucaagggguccaucgaacugucucgcauuaaaugcguugagaucgucaagagcgauauuuccaucccuugucauuauaaauacccguuucagguggugcacgacaauuaucuucuguacguguucgcccccgauagagaaucucggcagcgcuggguucucgcgcugaaggaggagaccagaaacaauaacagccuggugccuaaauaucaucccaauuuuuggauggacggaaaguggcggugcuguucccaacucgaaaagcuggcuacaggcugcgcccaguacgauccuaccaaaaacgccagcaagaaaccccuuccuccgacacccgaggacaaucgcagaccucugugggaacccgaggagaccgucgugaucgcucucuaugauuaccagacaaacgacccucaggaacuggcccuucggcgcaaugaggaauacugucugcucgauucuuccgagauucacugguggagaguucaagaccggaacgggcaugaaggauaugugcccagcucuuaccuggucgagaaguccccgaauaaccuggagaccuaugaaugguacaauaaaagcaucucucgcgauaaggcugagaaacuccugcuugacacgggcaaggaaggggccuucauggugagagauucccggaccgcgggaacauauaccgugagcgucuuuacaaaggccguuguguccgagaacaacccuugcauuaaacacuaccacaucaaggaaaccaaugacaaccccaaaagauauuacguggcugagaaguacgucuucgacucuauuccucugcucaucaauuaucaucagcacaacggcggcgggcuggugacgcgccuucgguaccccguuuguuuuggaagacagaaagcccccgugacagcuggccugcgcuaugggaagugggucauugauccuagcgagcucaccuucgugcaggaaaucggauccggccaauuugggcugguucaucugggauacuggcucaauaaggacaaaguggccaucaagacaauucgggagggcgcgaugagcgaagaggauuucaucgaagaggccgaggucaugaugaaacugucucacccgaaacuugugcagcuguauggcgucugccucgaacaggcucccauuugucugguguucgaguuuauggaacacgggugccuuuccgacuaccugagaacccaacgcggacucuucgccgcugagacccugcugggcaugugucucgauguuugcgaggggauggccuaucuggaagaggccugcgugauccaucgggaccuugcugcgagaaacugucuggucggagaaaaucaggugauuaagguuagcgauuuuggcaugacacgcuucgugcucgacgaucaguacacgucuagcaccgggacaaaguuuccugucaagugggccucccccgagguguucucuuuuagccgguacuccagcaaaucugacgugugguccuucggaguucugaugugggaagucuuuagcgagggcaagaucccuuaugagaacagaucuaauuccgaagugguggaggauaucagcaccggcuuccgccuguacaaaccccggcuugcuuccacacacgucuaucagauuaugaaccauugcuggaaggaaagaccggaggaccggccugccuuuucucgccuccugagacaacuggccgaaaucgcugagagcgggcucuga

SEQ ID NO: 70924 - RNA, 942 nt, Artificial Sequence
  derived and/or modified sequence opt5 from ITLN1__Homo_sapiens__NP_060095
augaaccagcugagcuuccuccuguuucuuaucgccaccacaagaggcugguccacggacgaggcuaauaccuacuucaaggaauggacaugcucuagcucccccucucugccucggagcuguaaagagauuaaggaugaaugcccguccgccuuugacgggcucuauuuccugcgcaccgagaacggagugaucuaccaaacauuuugugauaugaccucuggcgggggaggcuggacacuugucgcgagcguucacgaaaaugacaugagagggaaaugcaccgugggagaucggugguccagccagcagggcucuaaggcuguguaucccgagggcgacgggaacugggccaauuacaacacguucggauccgccgaggcugccaccagcgaugacuauaaaaauccuggcuacuaugauauucaggcuaaggaccuggggaucuggcauguccccaacaagucuccuaugcaacacuggcgcaauuccagccuccugagauaccggacagauaccggauuucugcagacacucggccauaaccuguucgggauuuaccagaaauaucccgugaaguacggagaaggcaaauguuggaccgacaauggcccuguuaucccgguggucuaugauuuuggggacgcccagaagacggcgucuuacuauucccccuacggacaacgcgaguucacagccggcuuugugcaguucagaguuuuuaacaaugaacgggcugccaacgcucuuugcgccgggaugcgcgugaccggauguaauacagagcaccauugcaucggcgggggaggcuauuucccugaggcgagcccccagcaguguggcgacuucuccggguuugauuggucuggauacggcacccacgucggguacagcuccagcagagaaauuaccgaggccgcugugcuccuguucuaucgguga

SEQ ID NO: 70925 - RNA, 978 nt, Artificial Sequence
  derived and/or modified sequence opt5 from ITLN2__Homo_sapiens__XP_011507512
augcugagcaugcucagaaccaugacacggcugugcuuccuucuguuuuucuccguggccacgucuggcuguagcgcugccgcggcuuccucucucgagaugcugagccgcgaauuugagaccugcgccuucuccuuuucuagccuucccagauccuguaaggaaaucaaagagcggugccacagcgccggggacggacuguacuuccuccgcacaaagaacggcgucguuuaucagaccuuuugugauaugacaucugggggaggcggguggacccugguggcuuccgugcaugaaaaugacaugagaggaaaaugcacagucggcgaucgguggagcucucaacagggcaacaaggccgacuacccugagggggauggaaauugggcuaacuauaauaccuucggcuccgccgaggcggccacgagcgacgauuacaaaaacccgggguauuacgacauucaggcuaaggaucugggaaucuggcacgugcccaauaagucuccuaugcagcauuggcgcaacuccgcccuccugagauaucggaccaauacaggcuuucuucaacgccuggggcacaaccucuucggaauuuaccagaaauaccccguuaaguauagaagcggcaaauguuggaaugacaacggcccugcuauccccguggucuacgauuuuggggacgccaagaaaaccgcguccuauuacucuccuuauggacagcgggaguucguggccggcuuuguucaguuccgcguguucaauaacgaaagagcugccaaugcucugugcgccgggauuaaggucacaggauguaacaccgaacaucacugcaucggcgggggaggcuuuuucccgcaaggcaagccccggcaguguggggauuuuagcgccuucgacugggacggauacggcacgcacgugaaauccagcugcucucgcgagaucacagaggcugcggugcuucuguuuuauagauga

SEQ ID NO: 70926 - RNA, 660 nt, Artificial Sequence
  derived and/or modified sequence opt5 from ITM2A__Homo_sapiens__NP_001165052
auggugaagaucgccuucaacacccccacagcuguccagaaagaggaagccagacaagacguugaggcgcugcucagccggacggugcgcacccagauucugacaggcaaguccaccaucuacagaggggaaaugugcuuuuucgauucugaggacccugcuaauagccuucggggaggcgaaccgaacuuucugcccgugacagaggaggccgauauucgcgaagacgauaauaucgccauuaucgacgucccugugcccuccuucucugauagcgacccugcugccaucauucacgauuuugagaaagggaugaccgcuuaucucgaccugcuucugggaaacuguuaccucaugccccugaauacauccaucguuaugccuccgaagaaccugguggaacucuucggcaaacuggccucugggagauaucuuccccagaccuacgucgugcgggaggaucugguugcgguggaggaaauucgcgacgucagcaaucucggaaucuuuauuuaucagcugugcaacaauagaaaguccuuccggcuucgcagacgggaucugcuccugggcuuuaacaagcgcgccaucgacaaauguuggaagauuagacauuucccuaaugaguuuaucguggaaacgaaaaucugccaagaguga

SEQ ID NO: 70927 - RNA, 801 nt, Artificial Sequence
  derived and/or modified sequence opt5 from ITM2B__Homo_sapiens__NP_068839
auggugaaggucaccuucaacagcgcccuggcucagaaagaggccaagaaagacgaacccaaguccggcgaggaagcgcucaucauuccuccggaugcuguugccguggacugcaaagaucccgacgauguggucccuguggggcaaagacgggccugguguuggugcauguguuuuggacuggcuuucaugcuugccggcguuauccucgggggagcuuaccuguauaaguacuuugcccugcagcccgacgauguguauuacugcggcauuaaguauaucaaagacgaugucauucuuaaugagccuucugcggacgcccccgcugcccuguaccagacaaucgaagagaacaucaagauuuucgaggaagaggaaguggaguuuaucagcguuccugugccggaguucgcugauuccgaccccgccaauauuguccacgauuuuaacaaaaagcucacggcguaucuggaccugaaucucgacaaauguuacgugaucccucugaacaccucuauugugaugcccccucgcaaucuucuggaacuccugaucaacauuaaggccgggacauaccuuccccagagcuaucugauccaugagcacauggucaucaccgauagaauugaaaauaucgaccaucucggauucuuuauuuaccggcugugccacgauaaggagacauauaaacugcaacgcagagaaaccaucaagggcauucagaaacgggaggcuuccaacuguuucgccauccgccauuuugagaauaaguucgcuguugaaacacucaucugcucuuga

SEQ ID NO: 70928 - RNA, 663 nt, Artificial Sequence
  derived and/or modified sequence opt5 from ITM2C__Homo_sapiens__NP_001012532
auggugaagaucagcuuccagcccgccgucgcuggcauuaaaggggacaaggccgauaaagcguccgcuucugccccugccccggcuagcgccaccgagauccugcucacacccgcuagacuggcccgggacaacuuuuuccgcugcggaguucuuuacgaagauucccugucuagccaagugagaacgcagauggagcucgaagaggacgugaagauuuaucuggaugaaaauuacgagcggaucaacgucccugugccccaguuuggcgggggagacccugcggauauuauccacgacuuccagcgcggccuuaccgccuaucaugauaucucccuggacaaauguuacguuauugagcucaauacaaccaucgugcugcccccuagaaacuuuugggaacugcucaugaaugucaagcgggggacauaucugccgcaaaccuacauuauccaggaggaaauggugguuacagagcacgugucugauaaggaggcucuuggcagcuucauuuaucaucugugcaacggaaaagacaccuaccgccucagacggcgcgccacgagacggcgcaucaauaagagaggcgcuaaaaacuguaaugccauucggcacuuugaaaacaccuucgucguggagacacugaucugcgggguggucuga

SEQ ID NO: 70929 - RNA, 462 nt, Artificial Sequence
  derived and/or modified sequence opt5 from ITPA__Homo_sapiens__NP_001254552
auggccgcuagccuggugggcaagaaaaucgucuucguuaccgggaacgccaagaaacucgaggaagugcagggacccgugcuggucgaggacacaugccuuuguuuuaaugcgcugggcgggcucccuggaccguacauuaagugguuccuggaaaaacuuaagcccgagggccugcaccaacuccuggcuggguuugaagauaaguccgccuaugcccugugcacguucgcucucucuaccggagacccuagccagcccgugagacuguuucggggccgcacauccggcagaaucguugccccucgggggugucaggauuucggaugggaccccugcuuucagccugauggcuacgagcaaaccuaugcugagaugccgaaagccgaaaagaacgcggugucucaucgcuucagagcccuucuggagcuccaggaauacuuugggagccuggcugccuga

SEQ ID NO: 70930 - RNA, 1245 nt, Artificial Sequence
  derived and/or modified sequence opt5 from ITPK1__Homo_sapiens__NP_001136065
augcagaccuuccugaagggcaaaagagugggguacuggcucagcgagaagaaaaucaagaaacugaacuuucaagccuucgcugaacuuugccggaagcgcggaauggaggucguucagcugaaucucuccagacccauugaggaacagggcccucuggacgugaucauucacaaacuuacagaugugauccuggaagccgaccagaacgauucucaaagccucgagcugguccaucgguuucaggaguauauugacgcgcacccggaaacgaucgugcuggauccccucccugcuauccgcacccugcuugacagauccaaaucuuacgagcugauucggaagaucgaagccuauauggaggaugaccgcauuuguagcccucccuucauggagcucacaucccugugcggggaugacaccaugagacuucuggaaaagaauggacucacauuucccuucaucuguaagacccggguugcccauggcacaaacucucacgagauggcuauuguguuuaaucaggaagggcugaacgccauccagccuccgugcgucgugcaaaauuucauuaaccauaaugcuguucuguacaaaguguuugucgugggagagagcuauaccgugguccagcgccccucccucaagaacuucagcgccggcacgucugauagagaauccaucuuuuucaauagccacaacguuucuaagccugaguccagcucugugcugaccgagcuugacaaaaucgaaggcguguuugagcggcccuccgaugaagucauucgcgagcugagcagagcgcuccggcaggcccugggggugucccuuuucggaaucgacauuaucauuaauaaccagacaggccaacacgcuguuaucgacaucaaugccuucccuggguacgaaggagugucugaguuuuucaccgaucugcucaaccauauugcuacaguccugcagggccagagcaccgccauggcggccacgggggacguggcucugcuccgccacuccaagcugcuugccgagcccgcuggaggccugguuggcgaaagaacauguagcgccucuccggggugcuguggauccaugaugggccaagaugccccuuggaaagcugaggcggacgccgggggaaccgcuaagcucccccaucagcggcugggcugcaacgccggggugagcccuucuuuucagcagcacugugucgccagccuugcuacaaaagccuccucucaauga

SEQ ID NO: 70931 - RNA, 1386 nt, Artificial Sequence
  derived and/or modified sequence opt5 from ITPKA__Homo_sapiens__NP_002211
augacccugcccggcgggccuaccggaauggccagaccgggcggggcucggcccugcagcccuggacucgagcgcgcccccagacgguccgugggcgaacugcgccuucuguucgaggcgagaugugcugccgucgccgcugccgcugccgcgggggaaccucgggcccgcggagcuaagagacggggcggccagguucccaacgggcucccucgcgccccgcccgcuccugugaucccccaacugacggugaccgccgaggaaccugacgugcccccgacaucuccuggacccccugagagagagcgggauugccuucccgcggccggcagcucccaucugcagcagccccgcagacucucuaccagcuccgucucuagcacaggguccagcucucugcuggaagacuccgaggaugaccuccugagcgauucugaaucccggagccgcggaaauguucagcuugaggcuggcgaggacguggggcaaaagaaccacuggcagaagauuagaaccauggucaaucugccugugaucucuccguuuaaaaagcgguacgccuggguucagcucgcuggacacacaggcuccuucaaagccgccggcaccagcgggcugauucuuaagagauguuccgaacccgagcgcuauugccuggcucggcucauggcggaugcccugagaggaugugugccugcuuuucauggcgucguggaacgcgacggggagucuuaccugcagcuccaagaucugcuugacggauucgauggccccugcgugcuggacuguaagauggggguccggacguaucucgaagaggagcugaccaaagccagagaacgcccuaaacuucggaaagauauguacaagaaaaugcuggccguugaccccgaggcuccgacagaagaggaacacgcccagagagcggugaccaagccucgcuauaugcaguggcgggagggaaucagcuccagcacaacccucggcuuuagaauugagggcaucaagaaagcugacgggucuugcuccacggauuucaagacaacccgcagccgggaacaggugcugagagucuuugaggaguucgugcaaggagacgaagaaguucugcggcgcuaccucaacagacugcagcagauccgggauacacuugaggugucugaguuuuucagacgccaugaagucauuggcagcucccugcucuuugugcacgaccacugucaucgggccgggguuuggcugaucgauuucggaaaaaccacaccccuuccugacggccaaauucuggaucacagacgccccugggaggaagggaauagagaggacggcuaucuccugggacuggauaaccucaucggcauucuggccucucuugcugagcgguga

SEQ ID NO: 70932 - RNA, 2052 nt, Artificial Sequence
  derived and/or modified sequence opt5 from ITPKC__Homo_sapiens__XP_006723467
augagacggugccccugucgcggcagccugaacgaggccgaagcuggggcccucccugcggcugccagaaugggacuggaggccccgcggggcgggcgcagacggcagcccggacaacagcgcccuggccccggggcuggagccccugcuggcagacccgaaggcgggggaccuugggcccggaccgagggcuccucucuucacagcgaaccggagcgcgcggggcugggacccgccccuggcacagagucuccccaggcugaguucuggacggacgggcagaccgagccugccgcugccggacucggcguggaaacagagagacccaagcagaaaaccgagccggaucgguccagccugcgcacacaucuugaaugguccuggucugagcuggaaaccacaugccucuggaccgagacgggcaccgacgggcuguggacagauccucacagaagcgaccugcaauuucagcccgaagaggcguccccuuggacccagcccggaguccauggccccuggacagagcucgaaacccacgggagccaaacgcagccugagcggguuaagucuugggccgauaaucuguggacacaucagaacuccagcucucuucagacccacccggaaggagcuugucccuccaaagagccuagcgccgacggcucuuggaaggaacuguacacagaugggucccgcacccaacaggacaucgagggacccuggaccgagccuuauacagauggcagccagaaaaagcaagacacggaagcugccagaaagcagcccggcaccgggggauuccagauucagcaagauacagacggcuccuggacccagccgucuacagaugggagccagaccgccccuggaacggacugccuccugggcgagcccgaagacgggccucuugaggaacccgagccuggcgagcugcucacacaccuguacucccaucugaaauguagcccccucugcccggugccucggcugaucauuacccccgaaacccccgagccugaagcucagccggugggacccccuucuagagucgagggcggguccggaggcuuuagcucugcgagcuccuucgaugagucugaagacgaugugguugccgggggaggcggggcuagcgaccccgaggaucgcuccggcagcaagccuuggaaaaagcugaaaacagugcugaaguauucucccuuugucguguccuuccggaagcacuacccuuggguucaacucagcggacaugccggcaauuuucaggccggggaagacggaagaauccugaaacgcuucugucagugcgagcagcggucucuugaacaacugaugaaggauccccucagaccguuugugccugcuuauuacggcaugguccugcaggacgggcagaccuucaaccagauggaggaucugcucgccgacuuugagggacccuccauuauggauuguaaaaugggcagccgcacauaucuggaagaggaacuugugaaggcgcgggagagaccucgcccccggaaagacauguacgaaaagaugguggcugucgacccgggggccccuacgcccgaggagcacgcccaaggcgcuguuaccaaaccuagauacaugcaguggcgcgaaacaauguccucuaccagcacacugggauuccggaucgagggcaucaagaaggccgaugggaccugcaauacgaacuuuaaaaagacccaggcucucgaacaagugacaaaagugcuggaggacuucgucgauggagaccacgugauucuucagaaguauguugccugucuggaagaacucagagaggcgcuggaaaucucccccuucuuuaaaacccaugagguggucggcucuagccuucucuucgugcacgaucauacagggcuggccaagguuuggaugauugacuuuggaaagaccguggcccuucccgaucaccagacgcugucccaucggcucccuugggcugaaggcaaucgcgaggacggguaccuguggggccuggauaacaugaucugccuucuccagggacuggcucaaagcuga

SEQ ID NO: 70933 - RNA, 8133 nt, Artificial Sequence
  derived and/or modified sequence opt5 from ITPR1__Homo_sapiens__NP_001093422
augagcgacaagauguccucuuuccugcacaucggcgauauuugcagccucuacgccgagggguccaccaacggauuuaucucuacccugggccuuguggacgauagaugugucguucagcccgaaacgggggaccugaauaacccuccgaaaaaguuccgggauugccucuuuaaacugugucccaugaauagauauagcgcucaaaagcaauucuggaaagccgcgaagccuggagcuaacuccaccacagacgccgugcuucugaauaagcuccaccacgccgcugaucuggagaaaaagcagaacgaaaccgagaauagaaaacugcucggcacagugauucaguacgggaacgucauccaacugcuucaucugaagucuaauaaauaucucaccgugaacaagcggcugcccgcccuucuggaaaagaaugcuaugcgcguuacacucgacgaggccggaaacgagggcagcugguuuuacauucagccuuucuauaaacugagauccaucggcgauagcguggucaucggggacaaggugguucugaaucccgugaacgcgggacagccucuccacgccucuucccaucagcuggucgauaauccgggcugcaacgaagugaacagcgugaauuguaacaccucuuggaaaauuguccuuuuuaugaagugguccgacaauaaagaugacauccugaaagggggagacguugugcgccucuuccacgcugagcaagaaaaauuucugacgugcgaugagcaccggaagaagcagcauguguuccuuagaaccacaggccggcagagcgccaccucugcuacauccagcaaagcccugugggaggucgaagugguucagcacgaccccugucgcgggggagcgggcuacuggaacucccucuuuagauucaagcaucuggccaccggccacuaucuggcugccgagguggauccugacuuugaagaggaaugccucgaguuccaacccucugucgauccugaccaggaugcuagccggucccgccugagaaaugcccaggagaaaaugguguacagccuuguuucugugcccgaagggaacgacauuuccagcaucuucgagcuggauccgacgacacuccggggaggcgacucucuggucccucgcaauagcuacgugagacuucggcaccuguguaccaacacauggguccauuccaccaauauucccaucgauaaggaagaggaaaaaccugugaugcucaagauugggaccucucccguuaaggaggacaaagaggccuuugcuaucgugcccgucagcccugcggaagugagagaccuggauuucgccaacgacgcuuccaagguucugggaagcaucgccggcaaacucgagaaggggacaauuacgcaaaaugaacgccggucugugaccaaacugcuugaggaucuggucuauuuugugacaggaggcaccaacuccggccaggacgugcucgaaguugucuucagcaagccgaauagagagcgccagaagcugaugcgggagcagaacauccugaaacaaauuuuuaaacuucuccaggcccccuucacagauugcggggacggaccuaugcugagacuggaagaacuuggcgaucagcgccacgcucccuuucggcauaucuguagacugugcuaccgcgugcuucggcacucucagcaagacuaucgcaagaaucaggaauacauugccaagcaguucggguuuaugcagaaacaaaucggauaugaugugcuggcggaggacaccaucacggcucuccugcauaacaaccgcaagcugcuugagaagcacauuacagccgccgaaaucgauaccuucgucucccucgugcggaaaaauagagagccucgguuucuggacuaccugagcgaucucugcguuuccaugaacaagucuauucccgugacccaggaacugaucuguaaagcuguccuuaauccgacaaacgccgacauucugaucgagaccaagcucgugcugagccgcuucgaauuugagggcguuuccucuacaggggagaaugcucuggaagccggcgaggacgaagaggaaguguggcuuuucuggagagauagcaacaaagagauccgguccaagagcgucagagagcucgcgcaggacgccaaagaaggacagaaggaggaucgcgacgugcugucuuauuaccgguaccaacugaaucucuucgcuagaaugugccuggaucgccaguaucuugccauuaacgaaaucuccggccagcuggacguugaucucauucugagauguaugagcgacgagaaucugccuuacgaucuucgggcuucuuuuugccgccucaugcugcacaugcauguggacagagauccccaagaacaggucacgccugugaaguaugcccggcugugguccgagauccccagcgagauugcgaucgacgauuacgacucuagcggggccuccaaagacgaaauuaaggagcgcuucgcucagaccauggaauuuguggaggaguaucucagagaugucguuugucagcgguucccuuuuagcgacaaagaaaagaacaaacugacauucgagguggugaaucuugcccgcaaccugaucuacuuuggauucuauaauuuuucugaucuccugagacugaccaagauccuucuggcuauucucgacugcguccacgugacaaccaucuuccccauuuccaagauggccaaaggcgaagagaacaaggggagcaauguuaugcgguccauccauggagugggcgaacugaugacgcaagucgugcuccgcgggggcggauuucugccgaugaccccuauggccgcugcgcccgagggcaacguuaaacaggccgagcccgaaaaggaggauauuauggugauggacacaaaacuuaagaucaucgaaauucugcaguucauccucaacgucagacuggauuaccggauuucuugucugcuuugcaucuuuaagagagaguucgacgaaagcaauucccagaccucugagacaagcuccgggaacucuagccaagagggaccuuccaaugugccgggcgcucuggauuucgaacacauugaggaacaggccgaggggaucuuuggaggcagcgaagagaacacaccccucgaccuggaugaccacgggggccgcacguuccuccggguucugcuucaucugacaaugcacgacuacccuccccucgugucuggagcccugcagcugcuuuuuagacauuucucccagcgccaagagguccugcaggcuuuuaaacaggugcaacuccuggugaccagccaggaugucgacaauuauaagcagaucaaacaggaucucgaccaacugcggucuauuguugaaaaguccgagcuuuggguguacaaaggccaggggccugaugaaacaauggacggagccagcggcgagaacgagcacaagaagaccgaagaggggaauaacaaaccccagaagcaugaaucuaccuccagcuauaauuacagaguggucaaagagauccugauucgccuguccaagcucugugugcaggaaagcgcgucuguucggaaaagcagaaagcaacagcagcgccugcuucggaacaugggagcucacgccgugguccuggagcuccugcagaucccuuaugagaaagccgaagauacaaagaugcaagagauuaugagacucgcucacgaguuccugcagaauuuuugcgccggcaaccagcagaaucaagcgcuucugcauaagcacaucaaccuguuccucaaucccgggauccuggaggcugugacgaugcagcauauuuuuaugaacaacuuccagcuuuguuccgaaaucaaugagcggguugugcaacacuuuguccauugcauugagacccacggccgcaacgugcaguacaucaaauuccugcagacaauugucaaggccgaaggaaaauucaucaagaaaugccaggacauggugauggccgagcucguuaauucuggcgaagaugugcuggucuuuuauaacgacagagcuagcuuccaaacccucauucagaugaugcgguccgagcgcgauagaauggacgaaaauucuccgcugauguaccacauccaucuuguggagcugcuggccguuuguacagaggggaagaacguguacaccgaaaucaagugcaauagccuccugccucuugaugacauuguccggguggugacgcacgaggacuguauccccgaaguuaaaauugcuuauaucaacuuucugaaucauugcuacgucgauacagagguggagaugaaggaaauuuauaccuccaaccacauguggaaacucuucgagaauuuucugguggacaucuguagagccugcaacaauaccucugaucgcaagcacgcggacagcauccucgaaaaauacgucacagagauugugauguccaucguuaccacauucuuuagcucuccuuucuccgaucagagcacgacccugcagacacggcaacccguguuuguccagcuucugcagggaguguucagaguuuaucauuguaacuggcugaugccgucucagaaggccuccguggaaagcugcauucgcguccucuccgacguggcuaagucucgggccaucgcuauuccuguugaucuggacagccaagugaauaaccuuuuucugaaaucccacagcaucguccagaagaccgccaugaauuggagacucucugcccgcaacgcugcgcggagagauuccgugcuggccgcuagccgcgacuacagaaacaucauugagcggcugcaggauaucgugucugcccucgaggaccgccuuagaccccugguccaagccgaacugagcguucucguggaugugcugcaucggccugagcuucuguuccccgaaaauacagacgcucgcagaaaaugugaguccggcggguuuauuugcaagcucaucaaacacaccaagcagcugcuggaagagaacgaggaaaagcucuguauuaaaguccuucagacgcugcgggagaugaugaccaaggacagaggauauggcgaaaaaggcgaggcccugcgccaggugcucguuaaucgguacuacgggaacgugagacccucuggacgccgggaaagccugacauccuucggcaaugggccucuuucugcgggaggcccggggaagcccggaggcggcgggggaggcagcggguccagcucuauguccagaggagagaugagccuggcugagguccaaugccaucucgauaaagaaggcgccuccaaccuggugaucgaccugauuaugaaugccucuagcgaucggguuuuccacgaguccauccuccuugcuaucgcccugcuggaagggggaaacaccacaauucagcacagcuuuuucugccgccucaccgaggacaagaagucugagaaauuuuucaagguguuuuaugauagaaugaaagucgcgcagcaggaaaucaaggcuacagugaccgucaauacguccgaccugggcaacaaaaagaaagaugacgagguggaucgggacgccccuagccgcaagaaggccaaagaacccacaacccaaauuaccgaggaaguuagagaucagcuucuggaggcuucugccgcuacacggaaggccuucaccacguuucgcagagaggcggacccugacgaucauuaccagcccggcgaagggacacaggccaccgcugacaaagccaaggaugaccucgagauguccgcugugaucacaauuaugcaaccuauccugcgguuccugcagcuccuuugugaaaaucacaaccgcgaucugcagaauuuucugagaugccagaacaauaaaaccaacuauaaccucgugugugagacacugcaauuccuugacugcaucuguggaagcaccacgggcgggcugggacuccugggccuguacauuaaugaaaagaacgucgcccucaucaaucagacccuugagucucugacagaguauugccaggggccgugucaugaaaaccaaaauugcauugccacccacgaguccaacggaaucgauauuaucacagcucugauccucaaugacauuaacccccugggcaagaaacggauggaucuuguucuggaacucaagaauaacgcgagcaaacugcugcucgccaucauggagucuagacacgacagcgaaaaugcugagcgcauucuuuacaacaugcggccuaaggagcugguggaagugaucaaaaaggccuauaugcagggcgaggucgaauuugaggauggggagaauggagaagacggcgccgcuucccccagaaacguggggcauaauauuuacauccuggcccaccagcucgcgcgccauaacaaggagcugcagucuaugcuuaaaccuggaggccaaguugauggggacgaagcucuggaguucuacgccaagcacaccgcccagauugaaaucgugcggcucgacagaacgauggagcagaucgucuuucccgugccgagcauuugugaguuccugacaaaagaauccaagcugcgcaucuauuacaccacagagcgggaugaacagggaagcaaaauuaacgacuucuuucucagauccgaggaucuuuucaaugaaaugaacuggcaaaagaagcugcgcgcucagccuguccuguauuggugcgcccggaauaugucuuuuuggagcuccaucucuuucaaccucgcggugcugaugaaucuucugguugccuuuuucuaccccuuuaaaggcgugagaggcgggacccucgagccccauuggagcggacugcuguggaccgcuaugcucauuucccuugccaucgucaucgcucugccuaagccccacggcauucgcgcccugaucgcuucuacaauucuccggcugaucuucagcguggggcuucagccuacgcuguuucuccugggagccuucaacguuuguaauaaaauuaucuuucugauguccuucgugggcaacugcgggaccuuuacaagaggauaucgcgcgaugguccucgacguggaguuccuuuaccaucugcuguaucucgugaucugcgccaugggccuguucguucaugaauuuuucuacagccuucugcucuuugaucuggucuacagagaggaaacccugcucaaugugauuaagucugugacacggaacggccgcuccaucauucugaccgcuguccuugcccugauccucguuuaucuguucagcauugugggguaccucuuuuucaaagacgauuuuauccuggagguggacagacucccgaaugaaacggcuguccccgagacaggagagucucuggccuccgaguuccuguuuagcgaugugugucggguugagucuggcgaaaacugcuccagcccugcccccagagaggagcucgugccugcugaagagaccgaacaggacaaggagcacaccugugaaacacugcuuaugugcauugucaccgugcugucccaugggcuccggagcggaggcgggguuggagaugugcugcgcaaacccucuaaggaggagccgcuuuucgcggccagagucaucuaugaccugcucuuuuucuuuauggugaucauuaucgugcugaaucugauuuucggcgucaucauugacacauucgcugaucuccggagcgaaaagcagaagaaggaggaaauccugaaaacgaccuguuuuaucugcggccuugagcgcgacaaguucgauaacaaaacaguuaccuuugaagaacacauuaaggaggaacacaauauguggcauuaccuguguuucaucgugcucgugaaggucaaagacuccacagaguauaccgggccugaaucuuacguggccgagaugauuaaggaaagaaaccuggauugguuuccccggaugcgcgccaugagccuuguuuccucugacagcgagggagagcagaacgaacugagaaaucuccaggagaaacuggaauccacgaugaagcuggugaccaaccucucuggccaacugagcgagcuuaaagaucagaugacagagcagcggaagcagaagcaacgcaucgggcugcucggacacccuccccauaugaaugucaacccucagcagcccgcuuga

SEQ ID NO: 70934 - RNA, 8106 nt, Artificial Sequence
  derived and/or modified sequence opt5 from ITPR2__Homo_sapiens__NP_002214
augaccgaaaagaugagcuccuuccuguacauuggagacauugugucucuuuaugccgaagggagcgucaacggauuuauuuccacacugggccuuguugaugaccggugcguggugcaccccgaggcuggggaucuggccaauccuccgaaaaaguuccgggacugucucuuuaaagucugccccaugaaccgcuacucugcgcaaaagcaauauuggaaagcuaagcaggccaagcagggaaaucauacggaagccgcucugcuuaaaaagcugcagcacgccgcugagcucgaacaaaaacagaacgagagcgagaauaagaaacugcugggcgaaauugugaaguacuccaacguuauccagcuccugcauauuaagucuaauaaauaucuuaccgugaacaagcgccugccugcccuccuggagaaaaaugcgaugcgggucagccuugaugccgcugggaacgaaggauccugguucuacauccaccccuuuuggaagcugcgcagcgagggcgacaauaucgugguuggcgauaaagugguccucaugccugugaacgccgggcagccccugcaugcuucuaauauugagcugcucgacaacccuggauguaaggaagugaaugccgucaacugcaacacauccuggaaaaucacccuguucaugaaguauagcucuuacagagaggauguucuuaagggcggggacguggugcggcuguuucacgcggaacaagagaaauuccucacaugugaugaauacgagaagaaacagcacauuuuucugcgcaccacacuuagacaguccgccaccagcgcuacgucuuccaaggcccugugggagaucgaagucgugcaucacgaccccugccggggaggcgcugggcaguggaauagccucuuccgcuuuaaacaucuggccaccggaaacuaucuggccgcugagcucaaucccgauuacagagacgcgcaaaacgaaggcaagaauguucgggacggcgugccucccacauccaagaaaaagcgccaggccggggagaaaauuauguauacccuggucucugugccucacggaaacgauaucgcuagccuuuucgaacuggacgccacaacccuccagagagccgauugucugguucccagaaauuccuacgugcgccuuagacaccugugcacgaacacaugggucaccagcacaucuauuccgaucgacaccgaugaggagcggccugugaugcucaagaucggcaccugucaaacaaaagaagacaaggaggcuuuugccauugucuccgugccccugagcgaaguuagagaucuggacuucgcgaaugaugcuaacaaggugcucgccacgaccgucaaaaagcuggagaaugggacaaucacccagaacgaacgccgguucgugacaaaacuucuggaggaccucaucuuuuucguugccgaugugccuaauaacggacaggagguccuggacguggugaucaccaagcccaauagagaacgccagaaacugaugcgggagcaaaacauucuugcucagguuuuuggcauccucaaggcccccuucaaggaaaaagcuggggagggaucuaugcugagacuggaggaccucggcgaucagcgcuaugccccuuacaaguauaugcugcggcuuugcuacagaguccugcgccauagccagcaagacuaccggaaaaaccaggaauauaucgcgaagaauuuuugugugaugcagucccagauuggcuacgauauccucgccgaggacacgauuacagcucugcugcacaacaauagaaaacuucucgaaaagcauaucaccgccaaagagauugaaaccuucgugucucugcugcgccggaacagagagccgcgguuucucgauuaucugagcgaccuuugcgucuccaauacaaccgcuauccccgugacacaagagcugaucugcaaguucaugcucagcccugggaacgccgauauucugauccagacgaagguugugucuaugcaggcggacaaucccauggaauccagcauucugucugaugacaucgaugacgaggaagucuggcuuuacuggauugauuccaacaaagagccucacggaaaggccauccgccaucucgcucaggaagccaaagagggcaccaaggcugaccuggaggugcugacauauuacagauaucaacucaaucuguuugcccggaugugucuugacagacaguaccuggccauuaaccagaucagcacccaacucuccguugaucugauccugcgcugcgugucugacgaaagccuucccuucgaucuccgggcuuccuuuuguagacugaugcugcacaugcacgucgaccgcgauccgcaggagucugugguuccugugagauacgcgcggcucuggacagaaauucccaccaaaaucacgauucaugaguaugacagcaucaccgauuccagccgcaaugacaugaagagaaaguucgcccugacaauggaauuugucgaggaguaccuuaaagaaguggugaaccagccuuuccccuucggggauaaggagaaaaauaagcugaccuuugaagucguucaccucgcucggaaccugauuuauuucggauuuuacucuuucuccgagcugcuucgccugacaagaacccuccuggccauccucgacaucgugcaggccccuaugagcucuuauuuugagcggcuguccaaauuccaagauggcgggaauaacgugaugcgcacgauucauggcgucggagaaaugaugacacagauggugcuuagcagaggcucuaucuuucccaugagcguuccggacgugccucccuccauucaccccagcaagcaggggucuccuaccgagcacgaagaugucacagugauggacaccaagcugaaaaucauugagauccuccaguucauccuguccguucggcuggacuaccgcauuagcuauaugcuuuccaucuacaagaaagaauuuggagaggauaacgacaaugcugagaccucugccagcggcuccccggauacacugcuccccucugcgauugugccugacaucgaugaaauugcugcccaagccgagacgauguucgcugggagaaaggagaagaaccccguccagcuggacgaugagggaggccggaccuuucucagagugcugauccaucuuaucaugcacgacuacccuccccugcucagcggggcccugcagcugcuuuucaagcauuuuucccagcgcgcggaaguucugcaggcuuucaagcaagugcagcuccuggucucuaaucaagauguggacaacuauaaacagauuaaggccgaucucgaccagcugcggcuuacaguggagaaaagcgagcugugggucgaaaaguccagcaauuacgagaacggcgaaaucggagagucucagguuaaaggcggggaggaaccuauugaggaauccaauauccugagccccgugcaagacggaaccaagaaaccgcagauugauucuaacaaguccaauaacuauagaaucgugaaggagauucucauccgccugagcaaacuuugcguccagaauaagaaaugucggaaccagcaccaaagacugcucaagaauaugggcgcccauucugugguucuggaccuccugcagaucccuuacgagaagaacgaugagaagaugaaugaggugaugaaccuugcucacacauuccugcagaacuuuugccgcgggaauccccagaaccaaguccugcuccacaagcaucugaaucuuuuccugaccccuggacuccuggaagccgagacgaugcggcacauuuuuaugaacaauuaucaucucuguaacgaaaucuccgagagagugguucagcacuucgugcauugcauugaaacacacggccgccacgucgaguaccugcgguuucuucagaccaucgugaaagcugacgggaaguaugucaaaaagugucaggauauggugaugaccgagcugauuaauggcggagaagacguucugaucuucuacaacgauagagccagcuuucccauccuccugcauaugaugugcuccgagcgggaccgcggcgaugaaagcgggccgcuugcguaccacauuacacugguggagcuccuggccgcuuguaccgaaggcaaaaaugucuauacagagaucaagugcaacucucuccugccucuugacgauauugugagaguugugacgcaugacgauugcauccccgaggucaagauugccuacgugaauuucgugaaccacuguuauguugacaccgaagucgagaugaaagaaaucuacacaagcaaucacaucuggaagcuguuugagaacuuccugguggacauggcucgggugugcaauaccacaaccgaucgcaaacaugccgacauuuuucucgaaaagugugucacggaguccaucaugaacauugugucuggcuucuucaauagcccuuuuuccgauaacucuaccagccugcaaacacaccagcccguuuucauccagcuucugcaauccgccuuuagaauuuauaacugcaccuggcccaauccugcucagaaagcgucuguggagagcuguauccggacacucgccgaagucgcuaagaacagagggauugccaucccgguggaccuggauucccagguuaauacccuguucaugaaaagccauucuaacauggugcagcgcgccgcuaugggauggcggcucuccgccagaagcggcccccgcuuuaaagaggcgcuugggggcccugcuugggacuaccggaauaucauugaaaagcugcaagaugucguggccucucuggagcaccaguucucccccaugaugcaggccgaguuuagcguucucguggacguccuguauuccccugaacuucuguuccccgagggaucugaugcuagaauccgcugcggcgccuuuaugagcaaacucauuaaccauacaaagaaacugauggaaaaggaggaaaagcuguguaucaaaauucuccagacccuucgggagaugcuggagaagaaagacuccuucguggaagaggggaauacgcugagaaagauccuccugaaccgcuacuuuaaaggagauuacagcaucggcgugaaugggcaccuuucuggagcguauuccaagacagcucaagucggcggcagcuucucugggcaggacagcgauaaaaugggaauuuccaugucugacauccagugccugcucgacaaggaaggcgccagcgagcugguuauugaugugaucgugaacaccaagaaugacagaaucuuuuccgaagggaucuuccugggaaucgcccuccuugagggcgggaacacccagacacaauacucuuucuaucagcagcugcacgagcagaaaaagagcgaaaaauuuuucaagguccuguacgaucggaugaaagcugcccagaaggagauucgcuccaccgugacgguuaauacaaucgaccucggaaacaagaaaagagaugacgauaaugaacugaugaccagcggcccucggaugcgcgugagagacucuacacuucaucugaaggagggcaugaaagggcagcucaccgaggcuuccagcgccacauccaaggcguauugugucuaccggagagagauggauccggagauugacaucaugugcaccggacccgaagccggcaacacggaggaaaaaucugcugaggaggugaccaugagcccugccauugcuaucaugcagcccauucugcgcuuucugcaacuccuuugugaaaaccacaaucgggagcugcagaacuuccugagaaaucagaacaauaagacaaacuauaaucucguuugcgaaacccugcaguuucuugauugcaucuguggguccacaaccggaggccuggggcuccugggacuguacaucaacgagaagaauguggcccucgucaaccaaaaucuugaaucucugacggaguacugccagggcccuugucaugagaaccagacaugcauugccacccacgaaagcaauggcaucgacauuaucauugcucugauccucaacgacaucaauccccuggggaaauaucgcauggaucuugugcugcagcucaagaacaacgcguccaaacugcugcucgccauuauggagagccggcacgacucugaaaaugcugagagaauccuuuucaacaugcggccgcgcgaacuggucgaugugaugaagaaugccuacaaccaaggacuggagugugaccauggcgaugacgaagggggagaugacggcguuuccccuaaagauguggggcacaauauuuauauccucgcccaucagcuggcuagacacaacaaacuucugcagcagaugcucaagcccggaagcgaccccgaugaaggcgacgaggcccugaaauacuaugcgaaucauacagcucaaauugaaaucgugcggcacgaucgcaccauggagcagaucgucuuuccuguucccaacauuugcgaauaccugaccagagagucuaagugucggguguucaauacaacggagcgcgacgaacagggcuccaaagugaacgacuuuuuccaacagaccgaggaucucuauaaugaaaugaaguggcagaaaaagaucagaaacaauccugcccucuuuugguucagccggcacauuucucugugggggagcaucuccuuuaaccuggccgucuucauuaaucucgcuguggcccuguucuacccguuuggagacgauggcgacgaggggacacuuucuccccuguucagcguucuccuguggaucgcgguggccauuugcaccuccaugcuguuuuucuuuagcaaaccugucggaauccgccccuuccucguguccaucaugcuuagaucuauuuacacaaucggccuggggccuacccugauucuccugggagcugccaaccuuuguaacaagaucgucuuucuggugagcuucguuggcaaucggggcacguuuacaagaggguaucgcgcugugauucucgauauggccuuccuguaccaugucgcuuaugugcugguuugcaugcucggacuuuuugugcacgaguucuuuuacuccuuccugcuguucgaccucgucuaucgggaagagacccugcuuaacgugaucaagucugugaccagaaauggccgcagcaucauucugacagccguucucgcgcugauccuggucuaccucuuuuccauuaucggguuccuguuucuuaaagaugacuucaccauggaaguggaucggcugaagaacagaacacccgugacgggaucucaucaggucccgaccaugacacucaccacaaugauggaggccugugcuaaagaaaauugcagcccuaccauucccgccuccaacacggcugacgaggaguaugaagauggcaucgagagaaccugcgacacacugcuuauguguaucguuaccgugcugaaucaagggcuccggaacggaggcggcgugggggacguccugagacgcccuagcaaggaugaaccccuguuugccgcccgggugguuuacgaccuccuguucuacuuuauugugaucauuaucguccuuaaucugauuuucggagugaucauugauacauuugcugaccucagaucugagaaacagaagaaggaagagauccugaaaaccacaugcuucaucuguggccuugagcgcgauaaguuugacaacaaaacgguuuccuucgaagaacacauuaagagcgaacacaauauguggcauuaucuguacuuuaucgugcucgucaaagugaaggauccuaccgaguauacagggcccgaaucuuacguggcgcagaugauugucgagaagaaccuggacugguucccgcggaugagagccaugucccugguuagcaaugagggagauucugaacagaacgagauccgcucccuccaagaaaaacuggagagcaccaugucccuugugaagcagcugagcggccagcucgcugagcugaaagaacagaugaccgagcaaagaaagaauaaacagcggcuuggguuccugggaucuaacacaccucacgugaaccaucacaugccgccccauuga

SEQ ID NO: 70935 - RNA, 8016 nt, Artificial Sequence
  derived and/or modified sequence opt5 from ITPR3__Homo_sapiens__NP_002215
augagcgagauguccucuuuccugcacaucggcgacauugugagccucuacgccgaaggguccgucaacggauuuaucucuacccugggccuuguugaugacagaugcgugguggagcccgcugccggggaucuggacaauccuccgaagaaauuccgggauugucucuuuaaggucugccccaugaaccgcuauagcgcgcagaaacaauacuggaaggcuaaacagacaaagcaggacaaggaaaaaauugccgaugugguucugcuucagaagcugcaacaugccgcucagauggagcagaaacagaaugacacggaaaacaagaaagugcacggagaugucgugaaguauggcuccguuauccaacuccugcauaugaagucuaauaaauaccugaccgugaacaagagacucccugcccugcuugagaaaaaugcuaugcgggucacacuggacgccaccgggaacgagggaagcuggcucuucauucagcccuuuuggaagcugcgcuccaauggcgauaacgugguggucggcgacaaaguuauccuuaauccugugaacgcggggcagccccugcacgccagcaauuaugaacucucugauaacgcuggauguaaggaggugaauuccgucaacugcaacacaagcuggaaaaucaaucuguucaugcaguuuagagaccaucuggaagaggugcucaagggcggggacguugugcggcuguuccacgccgagcaagaaaaguuucuuaccugugaugaguacaaaggaaagcugcaggucuuccuccgcacaacccugagacagucugcuacguccgccaccagcucuaacgcgcuuugggaaguggagguugugcaccaugacccuugccggggcggggccggacacuggaauggccuguaucgcuuuaaacaucucgcuacaggcaacuaccuggccgcugaagagaauccguccuacaagggggaugccagcgaccccaaagccgcuggaaugggcgcgcaagggagaaccggacggcgcaacgccggcgagaagauuaaguauugucuggucgcugugccucacgggaaugauaucgccucccucuucgaacuggaccccacaacccuucagaaaacggauucuuuugucccuagaaacagcuacgugcggcugcgccaccucugcacaaauaccuggauucaguccacaaacguucccaucgacauugaggaagagagaccgauccggcugaugcuuggaaccuguccuaccaaggaagauaaagaggccuucgcuauugugagcguccccgugucugagaucagagaccuggauuucgccaaugacgcguccagcaugcucgcuucugccguugaaaagcugaacgagggcuuuaucagccagaaugaccgccgguucgugauucaacugcucgaagaucuggucuuuuucguguccgacgugccuaacaauggccagaacguucuugauaucauggucacaaaacccaacagagagcgccagaagcugaugcgggaacagaauauucucaagcaaguguuugggauccugaaagcccccuucagagagaagggaggcgaggggccucuggugcgccuugaagagcucucugaccagaaaaacgcuccguaucagcauauguuucggcugugcuacagaguccugcgccacagccaggaagauuaucggaagaaucaagagcauauugccaaacaguucggaaugaugcagucccagaucggcuacgacauccucgcugaggauacgauuaccgcccugcuucacaacaauagaaagcugcucgaaaagcauaucacaaaaaccgagguggaaacauuuguuagccuggugcgcaagaaccgggagcccagauuccuggacuaucuuucugaucucugugucuccaaucacauugcgaucccugugacccaagaacugauuugcaaaugcguucuggaccccaagaacagcgauauccucauccggacggagcugcgcccugugaaagagauggcccagucucacgaauaccuuuccauugaguacagcgaagaggaagucuggcugacauggaccgacaagaauaacgagcaucacgagaaauccgugagacagcucgcucaagaagcccgggcugggaaugcccaugaugagaacguucugucuuauuacagauaucagcugaagcuuuuugcgcgcaugugucucgaccggcaguaccuggccaucgacgaaauuagccagcaacugggcguggaucucaucuuccugugcauggcugacgagaugcuucccuuugaucugagagccuccuucugucaccucaugcugcacguccauguggaccgcgauccgcaggaacuggugaccccugucaaguucgcuagacuuuggacagagauucccaccgccaucacaauuaaagacuaugauucuaaucucaacgccagccgggacgauaagaaaaauaaguuugcuaacacgauggaguucguugaagacuaccugaacaaugugguguccgaggcggucccuuuugccaacgaagagaaaaauaagcugaccuucgaggugguuagccucgcucacaaccugaucuauuuuggauucuacucuuuuuccgaacuucugcgccucacaagaacccugcugggcaucauugauugcgugcaggggcccccugccaugcuucaggccuacgaggaccccggaggcaagaauguccggcgcagcauccaaggggugggacauaugaugucuacaaugguucuguccagaaaacagagcguguucucugcuccgagccucuccgccggcgcgagcgcugccgaaccucuggaucggucuaaguuugaggaaaacgaggacauugucgugauggagaccaaacucaagauccuggaaauucuucaguucauccugaauguucgccucgacuauagaaucuccuaccugcugagcguguuuaaaaaggaguucgucgaaguguuucccaugcaggauuccggggccgacggcacggcucccgccuucgauucuaccacagcgaacaugaaucuugaccggauuggagagcaagcugaagccauguucggcguggggaagaccagcuccaugcuggaggucgaugacgagggaggccgcauguuucucagaguucugauccaccucacaaugcaugauuaugccccucuggugucuggggcucuucagcugcucuucaaacacuuuagccagcggcaagaagccaugcacaccuucaagcaggugcagcugcugauuuccgcucaggacgucgagaacuacaaagugaucaagucugaacuugauagacugcgcacgaugguugagaaaagcgaacucuggguggacaagaagggauccggcaaaggggaggaggucgaagccggcgcggccaaggauaaaaaggagcggccgacagacgaagagggauuucugcaucccccuggcgagaaaagcucugaaaauuaucaaauugugaaggggauccucgagagacugaacaaaauguguggaguuggcgaacagaugcgcaagaagcagcagcggcuucugaaaaauauggacgcucacaaggugaugcuggaucuccugcaaauccccuacgacaaaggggaugccaagaugauggagauucuuagauauacccaucaguuccugcagaaauuuugcgcuggaaacccuggcaaucaggcccuccugcacaagcaucuccaccuguuccuuacacccgggcugcuggaagccgagaccaugcaacacaucuuucucaacaacuaccagcuguguuccgagauuagcgaaccuguccuucagcauuucgugcaccugcucgcuacccauggccgccacguccaguaccuggacuuucuccacacagugaucaaggcggagggaaaauauguuaagaaaugccaagauaugauuaugacggaacugaccaaugccggcgacgauguggucguguucuacaacgacaaggcuucucuugcccaucugcuggauaugaugaaagccgcucgggacgggguugaggaucacuccccccucauguaucauaucagccugguggaccuucuggccgcgugugcugaaggaaagaaugucuacacagagaucaagugcaccucucuccugccgcucgaggaugugguguccguugucacacacgaagacuguauuaccgaggugaaaauggccuaugugaacuucgucaaucauugcuacguggacacggaaguugagaugaaggaaaucuauacaagcaaccacauuuggacccuguuugagaauuucacccuugauauggccagagugugcuccaaacgcgagaagcgggucgcugacccuacacuggaaaaauacgugcugagcguugugcucgauaccaucaacgccuuuuucucuagccccuuuuccgagaauucuacaagccugcagacgcaccagaccauugucgugcaacuucugcaguccacaaccagacuccuggaauguccuuggcugcagcagcaacauaagggcucuguugaggcgugcauccggacacucgcuaugguggccaaggggcgcgccauucuucugcccauggaccuggaugcucacaucagcuccaugcucucuagcggagccuccugugcugccgcggcccagagaaacgcuagcucuuacaaagccaccacgcgggcuuucccgcgcgucaccccuacagccaaucagugggacuauaagaacaucauugagaaacugcaggauaucauuaccgcccuugaagagagacugaagccccucgugcaagcugaacuguccgugcuggucgacguucuccauuggccugagcuucuguuucuggaaggcagcgaggcguaccagcggugcgagucuggcggguuccucuccaaacugauccagcacacaaaggaucuuauggaaagcgaggaaaagcuguguauuaaagugcucagaacccugcagcaaaugcugcucaagaaaacaaaguauggagaccgcggcaaucagcuucggaaaaugcugcugcagaacuaccuccaaaauagaaaguccaccucucgcggggaucugcccgaccccaucggaacgggccuugauccugacuggagcgccaucgcugccacacagugccggcuggacaaagagggggccaccaagcucgugugugaucugauuaccuccacaaagaacgaaaaaaucuuucaggagagcauuggacuggcuauccaccuccuugacggcggcaauaccgagauucagaagucuuuccauaaccugaugauguccgauaaaaagagcgaaagauuuuucaaaguccugcacgaccgcaugaagcgggcccaacaggagacgaagucuacaguggcgguuaacaugaaugaucucgggagccagccgcaugaagacagagagcccguggauccuaccacaaaaggacgcgucgcuuccuuuucuauccccggcagcuccucuagauauagccuggggccuucccuucggcgcggacacgaagugagcgagagaguucagucuuccgagaugggcaccagcgugcugaucaugcaacccauucuccgguuccugcagcugcucugcgaaaaccauaaucgcgaccuucagaacuuccugagaugucagaauaacaagacaaauuacaaccuggucugcgagacccuccaauuucuggauaucauguguggguccacgaccggaggccuuggccugcucgggcuguauauuaaugaagacaacgugggacuggucauccagacacucgagacccuuacagaguacugccagggcccuugccacgaaaaucagaccuguauugugacgcacgagucuaacgggaucgauauuaucacagcccugauccugaaugacauuagcccgcucugcaaauaccggauggaccugguucuucaacugaaggauaacgccuccaaacuccugcuggcucucauggaaucuagacaugacagcgagaaugccgaacgcauccuuauuucccugcggccccaggagcugguggaugugaucaagaaggcguaucuccaggaggaagagagagaaaacagcgaggucucuccucgcgaaguuggacacaacauuuacauccuggcccuucaacugucccggcauaauaaacagcuccagcaccugcugaagcccgugaaaagaauccaggaggaggaagcugagggcauuagcucuaugcucucccuuaacaauaagcaacugagccagaugcugaaaucuagcgccccugcucaggaagaggaagaggacccccucgccuauuacgagaaccacaccucccagaucgaaauugugcggcaagaucgcucuauggagcagaucgucuucccggugccugggauuugucaguuucugacagaagagaccaagcauagacuuuucaccacaacggagcaggacgaacaaggaagcaagguuuccgauuuuuucgaccagagcuccuuucugcacaaugagauggaauggcagcggaaacuccgcucuaugccccugaucuauugguucagcagacggaugacccuguggggcuccaucucuuuuaaccucgcuguguucauuaauaucauuaucgccuuuuucuaccccuauauggagggcgcgagcacagggguccuugauuccccucugauuucucugcucuuuuggauccugauuugcuucagcaucgccgcucuuuucaccaagcgcuacuccaucagaccccugauuguggcccucauccugcggagcauuuacuaucugggaaucggcccuacacucaacauucugggggcucuuaaucugaccaacaaaaucgucuuugugguuucuuucgugggaaaucgcggcacguuuaucagaggguacaaggccauggucauggacauggaauuccucuaucaugugggauacauucugacauccguucuuggccuguuugcccacgagcucuucuauagcauccugcuguuugaucucauuuaccgggaggaaacccuguucaacgugaucaaaucugucaccagaaauggccgcuccauucuucugacagcucuccuggcgcuuauccugguguaucucuuuagcaucgugggguuccuguuucugaaggacgauuucauucucgagguugaccggcugccgaacaaucauucuaccgccuccccccuuggaaugccucacggcgcugccgccuuugucgacacauguagcggggauaaaauggacugcguguccggacugagcgugcccgaaguccucgaggaagauagagagcuggacucuacggagcgcgcuugugauacccuucugaugugcaucguuacagugaugaaccacggccuccggaacgggggaggcgugggcgacauucugagaaagccuagcaaggaugaaucccuguuccccgcccgcgucguguacgaccuccuguucuuuuucaucguuauuaucauugugcuuaaucugaucuuuggggucaucauugauaccuucgcggaccuccggucugagaaacaaaagaaagaagagauccugaagacaaccuguuuuauuugcggacuugaaagagauaaauucgacaacaagacggugagcuuugaggagcauaucaagcuggaacacaauauguggaacuaccucuauuucauuguucuggugcgcgucaaaaauaagaccgacuacacaggcccggaguccuauguggcccagaugaucaaaaacaagaaucuggauugguuuccucggaugagagcuaugucucucgugagcaacgaaggggagggagagcagaaugaaauccgcauucugcaggacaaacuuaacuccaccaugaagcuggucucucaucucacagcccaacugaaugagcuuaaggaacagaugaccgagcagcggaaaagacgccagagacugggcuucguugaugugcaaaacuguaucagccgguga

SEQ ID NO: 70936 - RNA, 3663 nt, Artificial Sequence
  derived and/or modified sequence opt5 from ITSN1__Homo_sapiens__NP_001001132
auggcccaguuccccaccccuuuuggcgggagccuggacaucugggcuauuacaguggaggaaagagccaagcacgaucaacaguuccauucccucaaaccgaucucuggauuuauuacgggcgaccaggcgcggaacuucuuuuuccagagcgggcugccccaaccuguccuugcucagaucugggcccuggccgauaugaauaacgacggacgcauggaucagguugaguuuuccauugcuaugaagcucaucaaacugaagcuccagggcuaccaacugcccucugcccucccucccgugaugaaacagcagccuguggcuaucagcuccgccccggcguucgggaugggaggcauugccucuaugcccccucugaccgcugucgcccccgugccuaugggcagcauccccguuguggggauguccccgacacuggucagcucugugccuaccgcugccguucccccucucgcgaauggagccccucccgugauucagccccugccggcuuuugcccaccccgcugccacacuuccuaaguccagcucuuucuccagaagcggccccgggucucaacugaacaccaagcuccagaaagcccaguccuuugacgucgcuagcgugccucccguggcggaaugggccgucccgcaauccucucggcugaaguaucgccagcuuuucaauagccaugauaaaacaauguccggacaccugaccggcccucaggcuagaacgauccucaugcagagcucucugccccaagcccagcuggccuccauuuggaaccucagcgacaucgaucaggacgggaagcugaccgcugaggaauuuauucuugccaugcaucugaucgauguugcgaugucuggacagccucuucccccugugcugcccccggaguacaucccucccagcuuccggcgcgugagauccggcucuggcauuagcgucaucuccagcacaucuguggaccaacggcuucccgaggaaccuguucuggaggaugaacagcagcagcucgagaaaaagcugccggugaccuucgaggacaagaaacgcgaaaauuuugagagagggaaccuggaacucgagaagcggcgccaagcucugcuugaacagcagagaaaagagcaggagcggcuggcccaacucgaacgcgccgagcaggaaagaaaggagcgggaaagacaggagcaagagcgcaaacggcagcuggaacuugagaagcagcuggaaaaacagagagagcucgaacgccaacgggaggaggaaagacgcaaggagauugaacggagagaggcugccaagcgcgagcuggaacggcagagacagcuggagugggaacgcaaucggagacaggagcuccugaaccaacggaauaaagaacaggaggacaucgucgugcuuaaggcuaaaaagaaaacacuggaguucgaacucgaggcccugaacgauaagaagcaccagcuggaaggaaaacuucaggacauucgcugcagacucaccacgcaacggcaggagaucgaauccacaaauaagagcagagagcugcgcaucgcggagauuacccaucugcagcaacagcuccaggaaucucagcaaaugcugggccggcuuauccccgagaaacagauucugaacgaucagcucaagcagguucaacaaaauucccugcacagagacagccuggugacacuuaaacgcgcccucgaagcuaaggagcuggccagacagcaucugcgggaucagcucgacgaagucgagaaggagacccgcuccaaacugcaggaaaucgauauuuuuaacaaccagcuuaaggagcugagagaaauccacaauaaacagcagcuccaaaagcagaaaucuauggaggcugagcggcugaagcagaaggaacaagagcgcaaaaucauugaacuggagaagcagaaagaagaggcccagagacgggcgcaggagcgcgacaagcaauggcuugaacacgugcagcaggaggaugaacaccagagaccucggaaacuccaugaggaagagaagcugaaacgcgaggaaagcgucaagaagaaagacggggaggaaaagggaaaacaagaggcccaggauaagcugggcagacucuuccaccagcaucaggaacccgcuaaaccugccgugcaagcucccugguccaccgccgagaaggggccucugacaaucucugcccaggagaacguuaagguggucuauuaccgggcucuuuaucccuuugaaagcagaucccacgacgagauuacgauccagccgggagacauugugaugguuaaaggcgaauggguggaugagagccaaaccggcgagccuggguggcugggaggcgaacucaaggggaaaacaggaugguuccccgcgaauuacgccgagaagaucccugaaaacgagguccccgcuccggugaaaccugugaccgacucuacauccgcccccgccccuaagcuggcucugcgcgaaacccccgcgccccuugccguuacgagcucugagccuuccacaaccccgaauaacugggcugauuuuagcucuaccuggcccacaagcaccaaugagaagccugaaacagacaacugggaugccugggccgcucagcccucccucacggucccuagcgccggccagcugcggcagagaucugcguucacccccgcuacagccaccggguccagcccuuccccggugcugggccaaggagagaaaguggaaggccuccaggcccaggcucuguaucccuggcgcgccaagaaagacaaucaucuuaacuuuaauaagaacgaugucauuacagugcuggagcagcaagacauguggugguucggggaaguucagggacagaaaggcugguuuccuaagucuuacgugaagcucaucagcgggcccauccggaaauccaccucuauggauagcggauccucugagagcccugcuucccugaagagagucgccagccccgcggccaaaccggugguuucuggcgaggaguucauugcuauguacacguaugaauccagcgaacagggggaccugaccuuucaacagggcgaugugauccuugucacaaagaaagacggagauugguggaccggcacagugggggacaaggccggaguuuucccuucuaauuacgugcgccugaaagacuccgagggcagcgggaccgcuggaaagacgggcucucucgggaagaaacccgaaauugcccaggucaucgccuccuauacagcuaccggccccgagcagcugacacucgcgccuggacaacugauucuuauccggaagaaaaaccccggcggguggugggagggagaacugcaggccagaggcaagaaacgccagaucgggugguucccugcuaauuacgugaagcuccugagcccgggaaccuccaagauuacccccacagagccucccaaaagcacggcccuggccgcugugugucaagucaucggcauguaugauuacaccgcccagaacgacgaugaacuugcguuuaacaaggggcagauuaucaauguucugaacaaagaggacccugauugguggaagggcgaggugaauggacaggugggccucuuccccucuaacuaugucaaacugacaaccgacauggauccgagccaacaguga

SEQ ID NO: 70937 - RNA, 5094 nt, Artificial Sequence
  derived and/or modified sequence opt5 from ITSN2__Homo_sapiens__NP_006268
augauggcccaguuccccaccgcuaugaacggcgggccuaauaugugggccaucacaagcgaagaaagaacgaagcacgaccggcaauuugauaaccugaaaccguccgggggcuacauuaccggggaccaagcgcgcaauuucuuucuccagucuggacugcccgcuccugugcuugccgaaaucugggcccugagcgaucucaacaaggacggcaaaauggaucagcaagaguucuccauugcuaugaagcugaucaaacuuaagcugcaggggcagcagcuccccgucguucugccucccauuaugaagcaaccuccgauguuuucuccccugaucagcgccagauucggaaugggcuccaugccuaaucucucuaucccccagccucugcccccggcugccccuauuacaagccuuuccagcgcgaccucuggcacaaaccugcccccucucaugaugcccacaccccuggugccuuccgugagcacaucuucccuuccgaaugggaccgccagccugauccagccccucccuauucccuauucuuccagcacgcugccucauggauccucuuacagccugaugaugggcggguuuggaggcgcuuccauccagaaagcccaaagccucauugaccuggggucuuccagcucuaccagcuccacagcuucucuuagcggaaacucccccaagaccggcacaagcgagugggccgucccgcagccuacccggcugaaauaucgccagaaguucaauacgcucgauaaaucuauguccggcuaccugagcggguuucaagcgagaaacgcccuucugcagucuaaucucucccagacacagcuggcuaccaucuggacacuggccgacguggauggagacggccaacucaaggcugaagaguucauucuggccaugcaccuuaccgauauggccaaggcugggcagccccugccucucacccugcccccugagcuuguucccccgagcuuucggggaggcaaacagaucgacuccaucaacgggacacugccuucuuaucagaagaugcaagaagaggaaccccagaaaaagcuccccgugacguucgaggauaaacgcaaggcgaauuacgagagaggaaacauggaacuggagaaacggcgccaggcccugauggaacagcaacagagagaggcugaacggaaggcccagaaggagaaagaggaaugggagcgcaagcagagagaacuccaagagcaggaauggaaaaagcagcuggagcuugagaaacggcuggaaaagcaacgcgagcucgaaagacagcgggaggaagagagacgcaaggacauugagcggagagaagccgcuaaacaggagcuggaacgccagcggagacuggagugggagcgcauccggagacaagaacuucucaaucagaagaaccgcgagcaggaagagauuguccggcugaacagcaaaaagaaaaaucugcaucucgaacuggaggcccuuaacggcaagcaccagcaaaucuccggcagacugcaggacgugcgccucaagaaacagacccagaagacagagcuggaaguucuggauaaacaaugcgaccuugagauuauggaaaucaagcagcuccagcaagagcugcaggaauaucagaauaaacugaucuaccucgugccugagaagcagcugcuuaacgagcggauuaagaauaugcaauuuucuaacaccccggauagcggggucucccugcuccauaaaaagagccuggaaaaagaggaacugugucagagacuuaaggagcagcucgacgcgcuggaaaaagagacagcuucuaagcuguccgagauggauagcuucaauaaccagcucaaaugcggaaauauggacgauucugugcugcaaugucuucugucccuccugagcugccugaacaaucuuuuccuccugcugaaggaacuccgggagaccuacaacacgcagcagcuggcccuugaacagcuguauaagaucaaacgcgacaagcucaaagagauugagagaaagcggcuggaacugaugcagaagaagaaacuugaggaugaagccgcuagaaaagccaaacagggcaaagagaaucuguggaaggaaaaccuccgcaaagaggaggaagagaagcagaagcggcugcaggaagagaaaacacaagaaaagauccaggaggaggaaagaaaagcugaggaaaagcagcgcaaagacaaggauacccucaaggccgaggagaaaaagagagagaccgcgucugugcuggucaauuaccgggcccuuuaucccuuugaggcucgcaaccacgacgaaaugagcuucaacuccggggacauuauccaaguugaugagaaaacagugggagaaccuggcuggcuguacgggagcuuucagggcaauuucggaugguuucccuguaacuauguggagaagaugccuucuuccgagaaugaaaaagccgucagccccaagaaagcucuccugccucccaccgugucccugucugccacaagcacguccucugagccgcuuagcuccaaccagccugcgucuguuaccgacuaccagaaugugagcuucuccaaccugacagucaauaccagcuggcaaaagaagucugccuuuacaagaaccgugucccccggcagcguuucuccuauccacgggcagggacagguggucgaaaaccucaaagcucaggcccugugcuccuggacggcuaagaaagauaaucaucucaacuucagcaagcacgacauuaucaccgugcuggagcaacaggaaaauuggugguuuggcgagguccaugggggacggggcugguuccccaaaucuuaugugaagauuaucccgggguccgagguuaagcgcgaagaaccugaagcccuuuacgccgcugugaacaaaaagcccacaagcgcggccuacuccgucggcgaggaauauauugcucuguacccuuauagcucuguggagcccggagaucucaccuuuacagagggcgaagagauccugguuacccagaaagacggggaaugguggacgggaagcauuggcgauagauccgggaucuuccccucuaauuacgugaagccuaaagaccaggagagcuuuggauccgccucuaagagcggcgccuccaacaagaaaccggaaaucgcucaagucacaucugccuauguggcgagcggguccgagcagcugagccuugcucccggccagcugauucucauccugaagaaaaauaccucuggaugguggcaaggcgagcuccaggcccgggggaagaaacgccagaagggaugguucccugccucccacgugaagcugcuuggccccagcucugaaagagcuaccccugccuuccaccccguuugucaggucauugcgauguacgauuaugcugccaacaacgaggacgaacuguccuuuagcaaagggcaacugaucaaugugaugaacaaggaugacccugauugguggcagggagagauuaauggcgugaccggacucuucccguccaacuacgucaaaaugaccacagacucugaccccagccagcaguggugcgccgaucugcaaacgcuugacaccaugcagccuaucgagcggaagcgccagggcuacauccaugaacugauucagacagaggaaagauauauggcugaucuccaacuggugguugagguguuucagaaacggauggccgaauccggauuccucaccgagggcgagauggcucugaucuuugucaauuggaaggaacuuauuaugagcaacacaaagcugcugaaagcccucagagugcgcaagaaaaccgggggagagaagaugcccguucagaugaucggcgacauucuggcggccgaacuuucucacaugcaggcuuacauccgguucuguuccugccaacugaauggggccgcucuccugcagcagaaaacggaugaggacacagauuuuaaggaguuccucaaaaagcuggccagcgacccuagauguaagggaaugccccuuucuagcuuucugcugaaaccgaugcaacgcaucacccgguauccucuccugauuagauccauccuugagaacacccccgagucucaugccgaucacagcucccugaagcucgcucuggaacgcgcggaggaacucugcucucaggugaaugagggcguccgggaaaaagagaacagcgacagacuggaguggauucaggcccaugugcagugcgaaggccuugcugagcaacugaucuucaauucccugacaaacugucucgggccccgcaagcugcuucacagcggaaaacuguacaagaccaagucuaauaaagaacuccacggcuuucuguucaacgauuuucugcuccuuacauauaugguuaagcaguucgccguguccagcggguccgagaaacuguucucuagcaaguccaaugcccaguuuaaaauguacaagacgccuauuuuccugaacgagguccucgugaagcugcccaccgacccuucuagcgaugaaccgguguuucauaucucccacaucgaccgggucuauacacuuagaaccgacaacauuaaugagcggacagcuuggguucagaaaaucaaggccgcgagcgaacaauacauugauaccgagaaaaagaaacgcgaaaaggcuuaccaggccagaucucagaagacguccggaaucggccggcugauggugcaugugauugaggccaccgagcucaaggcuugcaagcccaacgggaaaagcaauccuuauugugaaaucucuaugggaucccagagcuacacaacccgcacaauucaagacacccugaaccccaaguggaauuucaacugccaguuuuucaucaaagaucuguaucaggacguccucugucuuacacuguuugauagagaccaauucucuccugaugacuuucugggccggaccgagauccccguggccaagauuagaacggaacaggagagcaaaggcccgaugacacgccggcuccugcuucacgaaguuccuaccggggaggugugggucagauucgaucugcagcucuuugagcagaagacccugcuguga

SEQ ID NO: 70938 - RNA, 1191 nt, Artificial Sequence
  derived and/or modified sequence opt5 from IVD__Homo_sapiens__NP_001152980
auggccgagauggcuaccgccacaagacugcucggcuggcggguggcgagcuggcgccugagacccccucuugcuggguucgucucccagcgggcccacucucugcucccgguugacgaugccaucaacggacugagcgaggaacaacgccaggaauuuuggaagcagcuuggcaaucugggggugcucggaauuacggcucccgugcaguacggcggguccggacugggcuaucuggagcauguccucgugauggaagagaucucuagagccagcggcgcuguugggcuguccuacggagcccacucuaaccuuugcauuaaucaacuggugcggaacggcaaugaggcgcagaaagaaaaguaucucccuaaacugaucagcggggaguacauuggagcccuugcuauguccgaacccaacgccggcagcgacgucgugucuaugaagcugaaagcugagaagaaggggaaucauuauauccucaacggaaauaaauucuggaucaccaacggcccugaugccgacguucugauuguguacgcgaagacagaucuggccgcuguccccgccucccgcggcaucaccgcuuuuauuguggagaaagggaugccuggauucagcacaucuaagaaacucgacaagcugggcaugagaggguccaauaccugugaacuuaucuuugaggauugcaagauuccggccgccaacauccugggacacgaaaauaaaggcguguauguccucaugagcgggcuggaccuugagcggcugguucucgcuggaggcccccugggccugaugcaggcggugcucgaucauacaauuccuuaccugcacgugcgcgaagccuucgggcagaagaucggacacuuucaacuuaugcagggcaaaauggcugacauguacaccagacugauggccugucggcaguaugucuacaacguggccaaggcuugcgaugaggggcauuguacggccaaagacugcgcgggaguuauccucuauucugcugagugugccacccagguggcccuggauggcauucaaugcuucgggggcaauggauacaucaacgacuuucccaugggccgcuuccuuagagacgcuaagcuguaugaaauuggggccggaacauccgagguccggcgccucgugaucggcagagcuuuuaacgccgauuuccacuga

SEQ ID NO: 70939 - RNA, 1758 nt, Artificial Sequence
  derived and/or modified sequence opt5 from IVL__Homo_sapiens__XP_006711363
augagccagcaacacacccugcccgugacacucuccccugcccugucucaggagcuucugaagacggucccgcccccuguuaacacccaucaggaacagaugaaacaacccacaccucugcccccuccgugccagaaggugcccguggagcucccugucgaagugcccagcaaacaggaggaaaagcacaugaccgcuguuaaaggccuuccugagcaggagugugaacaacagcagaaggagccccaggaacaagagcugcagcagcaacauugggagcagcacgaagaguaccagaaggccgaaaauccggagcagcaacucaaacaggaaaagacacagagagaccagcaacugaacaaacagcuggaggaggaaaagaaacuccuggaucagcagcuugaccaagagcuggugaagcgggaugaacagcucgggaugaagaaagagcagcugcuugaacugccugagcagcaagagggacaucucaagcaccuggaacagcaggagggccaacugaaacaccccgaacagcaggaggggcagcucgaacugccugagcaacaggagggacagcuugaacugcccgagcagcaagaaggccagcucgagcugcccgagcagcaggaagggcaacuugagcugccugaacagcaggagggacaacucgaacugccggagcagcaggagggccagcuggaacucccccaacagcaggagggccagcuggaacuuuccgagcaacaggaagggcagcuggagcucucugagcagcaagaaggacagcugaagcaucuugagcaccaggaaggccagcuggaggucccugaagaacaaauggggcagcucaaauaucuggagcagcaagaaggacagcugaagcaucucgaccagcaggagaaacaacccgaacugccugagcagcagaugggccagcuuaagcaccuggagcaacaggaagggcagcccaagcaccucgagcagcaagaaggacagcuggagcagcuggaggagcaagagggccagcuuaaacaucucgaacagcaggagggccaacuggaacaccuggagcaucaggaagggcagcucggacugccggagcagcaagugcuucagcugaagcagcucgagaaacagcaaggccagccuaagcaccuggaagaggaagaggggcagcugaaacaucuuguucagcaagaaggacagcucaagcaccuggugcagcaagagggccagcuggagcagcaggaacgccaagucgagcaccucgaacaacagguggggcagcugaagcaucuugaggagcaggaaggacagcugaaacaccucgagcagcagcaaggccagcuggaagugcccgagcagcaagucggccagccuaagaaucuggaacaggaggagaaacagcuugaacuccccgagcaacaggaagggcagguuaagcaucuggagaaacaggaagcgcaacuggagcucccugagcaacaggugggacagcccaagcaccuggaacagcaggagaagcaccuugaacauccggagcagcaagauggccagcugaaacaccucgaacagcaggaggggcaacugaaggaccuggagcagcagaaaggacagcuugaacaaccuguguucgcucccgcccccggccagguccaggauauccagccugcccucccgaccaagggggaggugcugcugcccguugaacaucaacagcagaaacaggaggugcaauggccucccaagcacaaguga

SEQ ID NO: 70940 - RNA, 1929 nt, Artificial Sequence
  derived and/or modified sequence opt5 from IVNS1ABP__Homo_sapiens__NP_006460
augauccccaacggcuaccugauguucgaggacgaaaauuuuauugagagcuccguggccaagcucaacgcucugagaaaaucugggcaguucugcgauguccggcuucaaguuuguggacacgaaaugcuggcccaucgcgcggugcucgcuugcuguagcccuuaucuguuugagaucuucaauuccgacucugauccgcacggcauuagccaugugaaguuugacgaucuuaaccccgaagccgucgaggugcugcucaauuacgccuauaccgcucagcugaaagccgacaaggagcugguuaaagauguguacuccgcugccaagaagcucaaaauggacagagucaaacaggugugcggggauuaucugcuuucucggauggacguuacaagcuguaucuccuaccgcaacuucgcgagcugcaugggagauucuagacugcucaauaagguggacgccuauauucaggaacaccuucuucaaaucuccgaggaagaggaguuucugaagcucccucggcugaaacuggaagucaugcucgaggauaacgugugucugcccagcaauggcaagcuguacacgaaggugaucaacuggguccagcgcucuauuugggaaaauggggacucccuggaggaacucauggaggagguucagacccuguacuauagcgcugaccauaaacuucuggauggaaaccuccuggacggccaggccgaaguguucggcucugaugacgaucacauccaauuugugcagaagaaaccucccagagagaaugggcacaagcagauuuccagcuccucuacaggaugccugagcuccccuaacgcuaccguccagagcccgaaacaugaauggaagaucguggccucugagaaaacauccaauaacaccuaccucugucuggcgguucuugacggcauuuucugcgugaucuuucugcacgggcggaacagcccccaaucuagcccuacauccacccccaagcucucuaagagccuguccuucgaaaugcagcaggaugagcuuauugagaaaccuaugagccccaugcaauaugcccgcucuggacugggcacggcugaaaugaaugggaagcucaucgccgcuggaggcuacaacagagaggaaugucugcggaccgucgagugcuauaauccgcauacagaccacugguccuuucuggccccuaugcgcacccccagagcccgguuccagauggcugugcucaugggccagcuguacguugucgggggaagcaacggccacucugaugaccuuuccugcggggaaauguaugauagcaauaucgacgacuggauuccugugcccgagcugcgcacaaacagauguaaugcgggagugugcgcccucaacggcaaacuguacaucgucgggggauccgaucccuacggccagaagggccugaaaaauugugacguguucgauccuguuaccaagcuguggacgucuugcgcuccgcucaacauucggagacaucaaagcgccgugugugagcuugggggauaucuguacaucauuggcggggccgaauccuggaauugccucaacacagucgagcgcuauaaucccgaaaacaauaccuggacacugaucgcuccuaugaacguggcccggagaggagcgggcguugcugugcuuaacgggaagcuguuugucuguggcggauucgacggcucucacgccaucagcugcguggagauguacgaucccacccgcaaugaguggaaaaugauggggaacaugaccuccccucggagcaaugccggaauugcuacagugggcaacacgaucuaugccguugggggauuugacggcaaugaguuccucaacaccgucgaaguguacaaucuggaaucuaacgaguggucccccuauacaaagauuuuucaguucuga

SEQ ID NO: 70941 - RNA, 882 nt, Artificial Sequence
  derived and/or modified sequence opt5 from IYD__Homo_sapiens__NP_001158166
auguacuuccugacccccauccucguggccauucugugcauccuugucguuuggauuuuuaagaacgcugacagaagcauggagaaaaagaaaggcgaaccucggacacgcgccgaggcgagaccguggguggaugaagaccugaaggauuccucugaccuccaccaggcugaggaagaugccgacgaguggcaagagagcgaagagaauguggaacauauccccuucucccacaaccauuauccugagaaagagauggucaagcggucucaggaauuuuacgagcugcuuaauaagcgcagaagcgugcgguucauuuccaacgaacagguucccauggaggugaucgauaaugucauccgcacggccgggaccgcuccuucuggagcccacacagaacccuggaccuuugugguugugaaagacccugaugucaagcauaaaauuagaaagaucauugaggaggaagaggaaaucaacuauaugaaacggaugggccaccgcugggugacagaccugaagaagcucagaaccaauuggauuaaagaguaccuggauacagcuccgauccugauucucaucuucaaacaggugcacggguuugccgcgaacggcaagaagaaaguccauuauuacaaugaaaucagcguuuccauugccuguggcauccugcuugcugcccugcaagugaacaaugggauuaccaugcggcaccagacggcucgccauagacaccucaucgagggacccggccggagcucugaggccugcuccaagcugagcucucagggcuguccugaaugccgcuccggggacugucacuaucauagcucucagcuuuggcccuccaccgagggagcgccuggacccccgagaacauga

SEQ ID NO: 70942 - RNA, 1131 nt, Artificial Sequence
  derived and/or modified sequence opt5 from IZUMO1__Homo_sapiens__XP_005258850
augagcgugcugcuccuguccgucuggggcgagucuacccuucccaacgggcugagagaacucugcgccccugcugccaugggaccgcacuucacacugcuuugugcggcucuggccggcugccuccugcccgccgagggguguguuaucugcgacccuagcguggugcuggcucucaagucccuggaaaaagauuaccuucccggacaucuggacgccaagcaccauaaagcuaugauggagcgggucgaaaaugccgugaaggauuuucaggagcucucucugaacgaggacgcguauaugggcguuguggaugaagccacgcuucaaaaagggagcuggucccugcucaaggaccugaagcgcauuaccgauucugacgucaaaggagaucuguucgugaaggagcucuuuuggaugcugcaccuucagaaagaaacauucgcuaccuacguugccagauuucagaaggaggcuuauuguccuaauaaaugcggcgugaugcugcagacacucaucugguguaagaacugcaagaaagagguccaugccugucggaagucuuacgacugcggcgaacgcaauguggaggugccccaaauggaagauaugauucuggacugugagcuuaacuggcaccaggcguccgaagggcugaccgauuauagcuucuacagagucuggggaaauaacacagagacccucguuucuaaaggcaaggaggccacgcugaccaaaccuaugguggggccggaagacgcuggauccuaucggugcgagcugggcagcgugaauagcucccccgccacaaucauuaacuuucacgucaccgugcucccuaagaugaucaaagaagagaagcccagcccuaauaucguuacacccggggaagcuaccacggagucuuccauuagccugcagccgcuucagccugagaagaugcuggccucccgccuccugggacuucugaucugcggcucucucgcccugauuacaggccugaccuucgcuaucuuuagacggcgcaaagugauugacuucaucaagagcucccucuuugggcugggaagcggcgcggccgaacaaacacagguccccaaagagaaggcuaccgauucuagacagcaguga

SEQ ID NO: 70943 - RNA, 2493 nt, Artificial Sequence
  derived and/or modified sequence opt5 from JADE1__Homo_sapiens__NP_001274366
augaagagaggccggcugcccagcuccucugaggacagcgaugacaacgggucccucucuaccacauggagccaaaauucccgcucucagcacagacggagcuccugcagccgccaugaagauagaaaaccuucugagguguuccggacggaccugaucaccgccaugaaacuucacgauuccuaccagcugaacccggacgaauauuacguccucgcugaucccuggcgccaggagugggaaaagggaguucaggugccugugagccccggcacaauuccucaacccgucgccagaccuaagaaauauaucgugucuuccgggagcgagccgcccgagcugggauacguugacauucggacccuugcggauucugugugucgcuaugaccugaaugauauggacgcugccuggcucgaacugacaaacgaggaauuuaaggagaugggcaugccugagcuggaugaauacaccauggagagaguccucgaagaguucgaacagcggugcuaugacaauaugaaccaugccaucgagacagaggaagggcugggaauugaguacgacgaagaugugguuugugacgugugccagucccccgauggcgaggacggcaaugaaauggucuuuugugauaagugcaacaucugugugcaccaggcuugcuacgggauccuuaaagugccugagggaagcuggcuguguagaaccugcgcccucggcguccaacccaagugucugcuuugcccgaaaaagggaggggcuaugaaaccuacgcgcuccggcaccaaguggguucaugugucuugcgcccuguggauucccgaggugagcaucggguccccugaaaagauggagcccauuacaaaagucagccacauccccucuucccggugggcgcucguguguagccugugcaaugaaaaguucggagccucuauucaguguagcguuaaaaacugccgcaccgcuuuucacgugacaugugccuucgacagaggccuggagaugaagaccauccucgcugaaaaugaugaggucaaauuuaaguccuauugcccuaaacauucuagccaccggaagccggaggaaucccugggcaagggggccgcgcaggagaacggagcccccgaauguagcccuagaaauccccuugagccuuucgcuucucuggagcagaaccgcgaagaggcccaucggguguccguuagaaaacaaaagcuccagcagcuggaagacgaguuuuacacguucgugaaucuucuggaugucgcucgcgcccuccggcugcccgaagagguggucgacuuucuguaucaauacuggaaacucaagagaaaagugaacuucaacaagccgcugauuacaccuaagaaagaugaggaagacaaucuugccaagcgcgagcaggacguucuguuucggagacuccagcuguucacccaccuucgccaggaucuggaacgggugagaaaccucacauauauggucacccgccgggagaaaaucaagagaagcgugugcaaaguucaagaacagaucuucaaucuguacaccaagcugcucgagcaggagcgggugucuggcguccccuccagcuguuccucuagcucccuggaaaacaugcuucuguuuaauucuccuagcguggggcccgacgcuccuaagauugaggaucucaaauggcacuccgcguucuuucgcaagcagaugggaacaagccuggugcauucucugaaaaagccccacaaaagagacccgcuucaaaacuccccuggcagcgaagggaagacgcuccugaagcagcccgaucugugcggacggagagagggcaugguuguccccgaaucuuuccucggccuggagaaaaccuuugccgaggcucgccuuaucuccgcccagcagaagaaugggguggugaugccugaccauggaaaacggagagauaaccgcuuccacugugaccugauuaagggcgaucucaaagacaagagcuuuaaacaaucucauaagccgcugagaagcacagaugucucccagcggcaccuggacaauacccgcgccgcuacaagccccggggugggacagucugccccuggcaccagaaaggaaaucguucccaaaugcaacgggucccuuauuaaggugaauuauaaccagacggcggucaaagugccuacaacccccgcuagcccuguuaagaauuggggcggauuccggauccccaaaaagggcgagcgccaacagcagggggaagcccacgauggagccugccaucaacacuccgacuacccguaccucggccuggggagagugccugcuaaggagcgggccaaaucuaagcugaaaagcgacaacgagaaugauggauauguccccgacguggaaauguccgauucugagagcgaggcuuccgaaaagaaauguauccauaccucuagcacaauuucccgcagaaccgacaucauucggcgcagcauccucgccucuuga

SEQ ID NO: 70944 - RNA, 2553 nt, Artificial Sequence
  derived and/or modified sequence opt5 from JADE2__Homo_sapiens__NP_001276914
auggugcccaccgccgcuaucgccgucggcggguacuuccugggaggcauggaggaaaagagacggaaauauagcauuuccucugacaacagcgauacaacggacucccacgcgaccucuacaagcgcuucccgcugcucuaagcucccuagcuccaccaaaagcggguggccgagacagaaugagaagaaacccucugaaguuuuucggacagaucugaucaccgccaugaagauuccugacuccuaccaacuuagccccgaugacuauuacauccuggccgauccuuggcgccaggagugggaaaagggaguccaggugcccgcuggcgccgaggcuauuccugagccgguggugagaauccugcccccucuggaagggcccccugcccaggcgucucccuccagcacaaugcuuggagagggcucucaaccggacuggccuggcgggucccgguaugaucuggacgaaaucgaugccuacuggcucgagcugauuaacagcgagcugaaagaaauggagcgccccgaacucgacgagcugacccuugaaagaguucuggaggagcucgaaacgcugugucaucagaauauggcucgggccaucgagacccaggaaggacuuggcauugaguaugaugaagacguggucugcgacgugugucgcuccccugagggggaggauggaaacgaaaugguuuucugcgacaaguguaaugugugcguccaccaggcuuguuacggcauccugaaagugcccacagggucuuggcucugcagaaccugugcccugggagugcaacccaagugccugcucuguccuaaacggggcggcgcgcugaagccgacacgcagcgggaccaaguggguccauguuuccugcgcccuuuggauucccgaggugagcaucggaugcccugagaaaauggagcccauuacgaagaucucucacaucccugcuuccagaugggcccugagcuguucucucugcaaagaauguacagggaccugcauucaguguagcaugcccuccugcgugacagcuuuucaugucaccugugccuucgaucacggccuggagaugcggaccauccuugccgacaacgaugaggugaaguuuaaaucuuucugccaggaacacagcgacggaggcccgcgcaaugagccuacauccgaacccacggagccuagccaggcuggggaggaucuggaaaagguuacccucagaaaacaacggcugcagcagcuggaggaagacuuuuacgagcucguggaacccgcggaggucgccgagagacuggaucuugcugaagcccugguggacuucauuuaucaauacuggaagcucaagcgcaaagccaacgcuaaucagccucugcuuacacccaagaccgaugagguugacaaccuggcccagcaggaacaagacgugcucuaucggagacugaaacuguuuacacaucuccgccaggaucuggagcgggucagaaaucuuuguuacauggugacccgccgggaaagaacgaagcacgcgaucugcaaacugcaggagcagauuuuccaucuccaaaugaagcugaucgagcaggaccugugucgcgaacggucuggaagacgcgcuaagggcaaaaaguccgauagcaaacggaagggcugcgaggggucuaaaggauccacagaaaagaaggagaaagucaaggccggcccggacagcgugcuugggcagcucgccggacuguccaccucuuuuccuaucgauggcaccuucuuuaacagcuggcuggcucaguccguucaaauuacagccgaaaauauggcuaugucugaguggccccucaacaaugggcacagagaggaccccgccccuggccugcuuagcgaagaacugcuccaggaugaagagacccugcuguccuucaugcgggacccgagccuucgccccggagauccugcgagaaaagcccggggcagaacacgccuccccgcuaagaaaaagccucccccucccccgccucaggacgggcccggaucucggacgaccccugauaaggcccccaaaaagacauggggccaggacgcuggguccggaaaaggcgggcaaggcccgccuaccagaaagcccccucgcagaacaagcucucaccuccccuccagccccgccgcgggagauugcccuauccuggccaccccggagucucccccuccccucgcuccugaaacgcccgacgaggccgcuagcguggccgccgacuccgauguccaggugccuggcccggcugcgagccccaaaccucuggggcggcuuagacccccucgcgaaucuaagguuacccggcgccugcccggagccagaccggacgcuggcauggggccucccuccgccguggccgagcggcccaaagucagccuccauuucgauacagaaaccgacggauauuuuuccgauggcgagaugucugacagcgauguggaggcugaagacgggggcgugcagcgcggaccuagagaggccggcgcggaagagguuguccggaugggggugcuggcuuccuga

SEQ ID NO: 70945 - RNA, 3657 nt, Artificial Sequence
  derived and/or modified sequence opt5 from JAG1__Homo_sapiens__NP_000205
augagaagcccccggacccgcggcagauccgggcggccucugucucuccugcuugcccugcucugcgcucugcgcgccaagguguguggagcgagcggccaguucgagcuugaaauccuguccaugcaaaacgucaauggggagcuccagaacggaaauugcuguggcggggcuagaaacccgggagaccggaaaugcacacgcgaugaaugugacacguacuuuaagguuugccugaaagaguaucagucuagagugaccgccggcggccccuguagcuucggguccggaucuacaccugugauuggcgggaauaccuuuaaccugaaggccagccggggaaaugaucgcaacagaaucguccuccccuucuccuuugcuuggccucggagcuacacacugcuuguggaagccugggacucuuccaaugauaccguucagcccgacagcauuaucgagaaggcuucucacuccggcaugauuaacccuagccgccaauggcagacacugaagcagaauaccgggguggcccauuucgaguaucagaucagagucacgugcgaugacuacuauuacggauuuggcuguaacaaguucugccggccgcgcgaugacuuuuucggccacuaugcgugugaucaaaaugggaacaaaaccugcauggaaggauggaugggccccgagugcaauagagccaucugucggcaggggugcucuccuaagcauggauccuguaaacuccccggcgacugcagaugucaguacggguggcagggacuguacugcgauaaguguauuccucaccccggcugcgugcauggcaucuguaacgaaccguggcaaugccuuugugagacaaacuggggagggcagcugugcgacaaagaccucaauuauugcggcacccaccagccuugucugaacgggggaacaugcagcaauaccggccccgauaaguaccaauguuccugcccugagggguauucuggccccaacugugaaauugcugagcacgccugccugagcgaccccugucauaaucgcggauccugcaaggaaacgagccucggcuuugagugugaaugcucuccuggguggacaggaccgaccuguuccacaaacaucgaugacugcagccccaauaacugcucucacggcgggaccugucaggaucugguuaauggauucaaaugcguguguccuccccaguggaccggcaagacaugccagcuugacgcuaacgagugugaggccaaaccuugcgucaaugccaagagcuguaaaaaccugauugccuccuacuauugcgauugucuccccggguggaugggccaaaauugcgacaucaacauuaaugauugucugggacagugccagaacgacgcuucuugccgggaucuugugaacggcuacagauguaucugcccgccuggguaugccggagaccauugugaacgcgacaucgaugagugcgcuagcaaucccugucugaacggcgggcacugccagaaugaaauuaaccgguuucaaugucucugcccuacgggauucuccggcaaucugugucagcuggacaucgauuacugcgagcccaacccuugucagaauggggcccagugcuacaacagagccagcgacuauuucugcaagugucccgaagauuacgagggcaaaaauugcucucaccucaaggaccauugucgcaccacaccgugcgaggugauugauuccuguaccgucgcuauggcgagcaacgacacaccugaaggaguucgguauaucucuuccaaugugugcggcccccacgggaaguguaaaagccaauccggaggcaaguuuaccugcgauuguaacaaaggguucacgggaacauacugccaugagaauauuaacgacugugaaucuaaucccugcagaaacggcgggaccugcaucgauggcgugaacagcuauaaguguaucugcuccgacggaugggagggcgccuacugugaaaccaauauuaacgauugcucucagaauccuugucacaacgggggaacaugccgcgaccuggucaaugacuuuuauugugauugcaaaaacggcuggaaggggaagaccugucauagccgggacucccagugcgaugaggcuacauguaauaacggaggcacgugcuacgacgagggcgaugccuucaaauguaugugccccgggggaugggaaggcaccacaugcaauaucgccagaaacagcucuugucuuccgaauccuugccacaacgggggaaccugugugguuaauggcgaguccuuuacaugcguguguaaggaagggugggagggacccauuugcgcucagaacaccaaugacuguagcccucaccccugcuacaacucuggcacgugugucgauggcgacaacugguaucgcugcgagugugccccuggguucgcgggacccgauugccggaucaauauuaacgaaugccaauccagcccgugugcuuuuggcgcgaccugcguggacgagaucaauggguacagauguguuugcccucccggacauucuggcgccaaaugucaggaagugagcgggcggccuugcaucacaaugggauccgucauucccgauggcgcuaagugggacgaugacuguaauaccugccagugucugaacggccgcaucgccugcagcaaaguguggugugggccgagaccuugccuccugcacaagggacauucugagugccccuccggccaaagcuguauuccuauccuugacgaucagugcuucguccaccccuguacaggggugggagaaugccgguccucuagccugcagcccguuaagaccaaauguacguccgacucuuauuaccaggauaacugcgcuaauauuacauuuaccuucaacaaggagaugaugagcccuggccucacaaccgagcacaucuguuccgaacugagaaaucugaacauucucaaaaaugugucugccgaguauagcaucuacaucgcgugcgaaccgucccccagcgccaacaaugagauucaugucgcuaucucugccgaagacauucgcgaugacgggaacccuaucaaggagauuaccgauaaaaucaucgaccugguguccaagcgggauggaaauagcucucuuauugcugccguugcggaggugagaguccaacgcagaccccugaagaaccggacagacuuucucgugccucugcuguccagcgugcuuacgguugccuggaucuguugccucgucaccgcuuucuauuggugucugcgcaaaagacggaagcccggcucucacacacauuccgccagcgaagauaauaccacaaacaacgugcgcgagcagcugaaucagauuaaaaacccuaucgaaaagcacggcgcuaauaccgugccgauuaaagacuacgagaacaaaaauuccaaaaugagcaagaucagaacgcauaacucugaagucgaggaggacgauauggacaagcaccagcaaaaagcccgguuugccaagcagcccgcuuacacacucguggaucgcgaagagaaaccucccaaugggaccccuaccaagcaccccaacuggacaaauaaacaggacaacagagaucuggaaagcgcgcagucccuuaaucggauggaguauaucguuuga

SEQ ID NO: 70946 - RNA, 3717 nt, Artificial Sequence
  derived and/or modified sequence opt5 from JAG2__Homo_sapiens__NP_002217
augagagcccagggccgggggcgccugcccagacggcuccugcuucugcucgcucugugggugcaagccgcgcgcccuaugggauacuucgagcuucagcugagcgcucucagaaacgucaauggcgaacugcuguccggggccugcugugacggagauggccggaccacacgcgccgggggaugcggccacgacgagugugauacguauguuagagugugccucaaggaauaccaggcuaaagugaccccgacaggccccuguucuuaugggcauggagccaccccuguccugggcgggaacagcuuuuaccuucccccugcuggagccgcgggcgaccgggcccgcgcuagagcccgggcugggggagaucaggaccccggccuggugguuaucccuuuccaauuugccuggccgcgcuccuucacacucauuguggaggcgugggauugggacaaugauaccacacccaacgaagaacugcuuaucgagagagucucucacgccggcaugauuaauccugaagaccgguggaagucccugcauuuuuccgggcacguggcucaucucgagcugcagauccgcguuagaugcgaugaaaacuauuacucugccaccuguaauaaauucugccggcccagaaacgacuuuuucggacacuauacgugugaucaguacggcaauaaggcuugcauggacggguggaugggaaaagaguguaaggaggccgugugcaagcagggcugcaaccugcuccacgggggauguaccgucccuggcgaaugccgcuguagcuacggcuggcaagggcgguuuugcgacgagugugugcccuauccgggaugcgugcauggcuccugugucgaaccuuggcagugcaauugugagacaaacuggggagggcugcuuugcgauaaagaccugaauuacuguggcagccaccaucccugcaccaacgggggcacaugcauuaaugccgaaccugaucaguauagauguaccugccccgacggauacucuggccgcaacugugagaaggcugagcacgcgugcacguccaaccccugugccaaugggggaagcugccacgaaguuccuucuggcuucgagugucauugcccguccggguggagcggacccacaugugcucucgauaucgacgaaugcgccucuaacccuugugccgcuggcgggaccugcguggaucagguggacggcuuugagugcaucugucccgaacaaugggucggagccacaugccagcuggaugcgaaugagugugagggcaaaccuugccuuaacgcuuucuccuguaagaaucugauugggggauauuacugcgacuguauccccggcuggaaagggauuaacugccacaucaaugugaacgauugucggggacagugccaacauggcgggaccuguaaggaccucguuaauggcuaucagugcgugugcccgagaggauuuggcgggcgccacugugaacuggagcgggacgaaugcgccagcuccccuugucauucuggaggccugugcgaggaucucgccgacggguuccacugucacugcccccagggauucagcggcccucugugugaagucgauguggaccuuugcgagcccuccccuuguagaaacggggcucgcugcuacaaucuggagggcgauuacuauugugccugccccgacgauuuuggaggcaagaacugcagcguuccgcgggaaccuugucccgggggagcuugcagagugauugacggcugugggucugaugccggacccggcaugccuggcaccgcggccuccggggucugcggaccgcauggccgcugugugagccagcccgggggaaauuucucuugcaucugugacagcggcuuuacagggacguacugccacgagaacauugaugacugucucggacaaccuugccggaauggcggcaccuguaucgaugaagucgacgcuuucagaugcuuuugccccuccgggugggagggagagcugugugacacaaacccuaacgauugccuucccgacccuugucauucucggggccgcugcuaugaucuggugaaugacuucuacugugccugcgaugacggguggaaaggaaagaccugucacagcagagaauuucagugcgaugcuuauacauguuccaacggcgggaccugcuacgacagcggagauacguuccggugugccugucccccgggcuggaaaggcucuacaugcgcgguugccaagaauagcagcugccucccuaaccccugcgugaaugggggaaccugugucggcucuggggcuuccuuuagcugcaucuguagagacggaugggagggccggaccugcacacacaacaccaaugauuguaacccucugcccugcuauaaugggggaauuuguguggacggcguuaacugguuccgcugcgaaugugccccgggcuuugcugggccugauugcagaaucaauauugacgagugucaguccucucccugcgccuacggagccacaugcguggacgaaaucaacggcuaccgcuguagcugcccucccgggagagcuggaccccggugucaggaggucauuggcuucgggcgcuccugcuggucuagaggaacgccuuuuccgcauggcagcuccuggguggaggauuguaauagcugccggugucuggacggccgcagagauugcucuaaagugugguguggguggaagcccugccuccuggcgggacaaccugaagcccuuuccgcucaguguccccugggccagcggugccucgagaaagccccugggcagugccugagacccccuugugaagccuggggagagugcggcgcugaggagccgcccagcaccccuugucugccccgcucugggcaccuugacaacaauugcgcccggcucacacugcauuucaaccgcgaucacguuccucaaggaaccacagucggcgcgaucuguuccggcaucagaagccugcccgcuacccgggccguggccagagaccgccuccuggugcuucugugcgaucgggcuucuagcggggccuccgcggucgagguggcuguuagcuucucuccggccagagaccucccugauuccagccugauucagggagccgcucaugccaucguggcugccauuacgcagcgcggcaacuccucucugcuucucgcggucaccgaagugaagguugagacaguggucaccgggggaagcuccacaggccugcuggugcccguucucuguggggccuuuucugugcuguggcuugcuugcgucgugcugugugugugguggacccggaagagacgcaaagaacgggagagaagccgccucccccgggaagaguccgccaauaaccagugggcuccucugaaucccaucagaaacccuauugagcggccgggaggccacaaggacguccuguaucaaugcaaaaauuucacgcccccuccccgcagagccgaugaagcccuuccuggccccgcugggcacgcggccguucgggaggacgaagaggacgaggaucucggacgcggcgaagaggacucucuggaagcugagaaguuucugagccauaaauucacaaaggauccggggagauccccuggacggcccgcccacugggccagcggcccuaagguggacaacagagcugugcgcucuaucaaugaagcccgguacgcggggaaagaguga

SEQ ID NO: 70947 - RNA, 552 nt, Artificial Sequence
  derived and/or modified sequence opt5 from JAGN1__Homo_sapiens__NP_115881
auggccagcagagcuggcccccgggccgcggggaccgacggauccgauuuccagcaccgcgagagaguggcuaugcauuaccaaaugucugucacacugaaguaugaaaucaaaaagcucauuuacguucaccuggugaucuggcuucugcucguggccaaaaugagcgucggccaucugcggcuucugucccacgaccagguggccaugccuuaucagugggaguacccguaucuccugucuauucugcccagccuccuggggcuucuguccuuuccucgcaacaauaucucuuaccucguucugagcaugauuuccaugggacuuuucagcaucgcuccccugaucuauggcucuauggaaauguuuccugccgcucagcaacucuacagacaugggaaggccuaccgguuccuguuuggauucuccgcggugagcauuauguaucugguccucgugcuggccguucaggugcacgcuuggcagcuuuacuauucuaaaaagcugcucgauuccugguuuacgagcacccaggagaagaaacacaaguga

SEQ ID NO: 70948 - RNA, 3399 nt, Artificial Sequence
  derived and/or modified sequence opt5 from JAK2__Homo_sapiens__NP_004963
augggcauggccugccugaccaugacagagauggaagggacgagcaccuccucuaucuaccagaacggagacauuagcggcaaugcuaacuccaugaagcaaaucgaucccgugcuccaggucuaucuguaccacucucuugggaaaagcgaggccgacuaucugacauucccuuccggagaauacguugcggaggaaauuuguaucgcugccucuaaggccugcggcauuaccccgguguaucauaauauguuugcucucaugagcgagacagagagaaucugguaucccccuaaccacguguuccauaucgaugaauccacccggcacaauguccuguaccgcauuagauuuuacuucccccggugguacuguagcgggucuaaccgcgccuauagacauggaaucucccggggcgcugaggccccucuucuggacgauuuugugaugagcuaccucuucgcgcaguggcgccacgacuuuguucacggcuggauuaaagugcccgucacacaugaaacccaggaggagugccuggggauggccgugcuggauaugaugagaaucgcuaaggaaaaugaccaaacgccucucgccauuuauaacucuaucuccuacaaaaccuuccugccgaaguguauucgggcuaagauccaggauuaucacauccuuacacgcaaacggauuagauaccgcuuuagacgguucauccagcaguuuagccaaugcaaggccaccgcgcgcaaucugaaacucaaguaucugauuaaccuugagacacugcagucugccuucuacaccgaaaaauuugagguuaaggaacccggauccggcccuagcggggaggagaucuucgcuacgauuaucaucacaggaaauggcgggauucagugguccagaggaaagcauaaagaaucugagacccucacagaacaggaccugcaacuguacugugauuuccccaacaucauugacgugagcaucaagcaggccaaucaggagggcuccaacgaaagccgggucgugaccauucacaaacaagauggcaagaaucucgagaucgagcugucuucccuuagagaagcucugagcuuugugucucucaucgacggguauuaccgccugaccgccgacgcccaccauuaucuuugcaaagaggucgcuccucccgcgguucuggaaaacauucagagcaacugucacggaccgaucuccauggauuucgccauuucuaagcucaaaaaggcuggcaaucagacagggcuguacgugcugcggugcagcccuaaggacuuuaacaaauauuuccucacguuugccguggagagagaaaaugucaucgaguacaagcauugucugauuaccaaaaacgagaaugaagaguauaaccuuuccggaacaaagaaaaauuucagcucucugaaggaucuccugaacugcuaccagauggaaaccgugcgcuccgacaauaucauuuuucaauucacaaagugcugucccccuaaacccaaggauaaaagcaaccuucugguuuuucggaccaauggcgugucugacguccccacguccccuacacuccagagaccgacccacaugaaccagaugguguuccauaagauccgcaaugaggaucugaucuuuaacgagagccuggggcagggaaccuucacaaaaauuuuuaagggcguucggagagaagugggcgacuacgggcaacuccacgagaccgaaguccugcuuaaggugcuggauaaagcccaccgcaauuauuccgagucuuucuucgaagcugccagcaugauguccaagcucucucauaaacaccugguccugaacuacggagugugcguuuguggcgacgagaacauccuugugcaggaguuugucaaguucgggagccucgauacauaucugaaaaagaauaagaacugcauuaauauccuguggaaacucgaaguggcgaagcagcuggcuugggccaugcauuuucuugaggaaaacacgcugauucacggaaauguuugugccaaaaacauccuccugauccgggaggaagacagaaagaccggcaaucccccuuucauuaaacuguccgaccccgggaucagcauuacagugcuuccuaaggauauccuccaggagcgcauucccugggucccgccugagugcaucgaaaaccccaaaaaucugaaccuggcuaccgacaaguggucuuuuggcacaacccucugggagaucuguuccggaggcgauaagccucugagcgcccuugacucucaacggaaacugcaguucuacgaagauagacaccagcuccccgcuccuaagugggccgagcuggcgaaucugauuaacaauugcauggacuaugaacccgauuuucggccguccuuccgcgccaucauuagagaccuuaacagccucuuuacgccugauuacgagcugcugaccgagaaugacaugcuccccaacaugcggaucggggcucugggauucucuggcgccuuugaagauagagaccccacacaguucgaggaacgccaucuuaaauuucugcaacagcucgggaagggaaacuucggcagcguggagaugugucgguaugauccucugcaggacaauaccggggaggugguugcugucaaaaagcugcaacacuccacagaggaacaucuuagagacuucgaacgcgagauugaaauccucaagagccugcagcacgauaacaucgugaaauacaagggcgugugcuacucugccggaagacggaaucugaaacucauuauggaguaucugccguacggcucccuucgcgacuaucugcagaagcauaaagagagaaucgaucacauuaagcuccugcaguacaccagccaaaucuguaaggggauggaauaucugggaacgaaacgguacauucaccgcgaccuugcgacaagaaacauccuggucgagaaugaaaaccgggugaagauuggcgauuuugggcucaccaaaguucugccccaggacaaggaguauuacaaagugaaggaaccuggagagucccccaucuucugguacgccccugagucucucacagaaagcaaguuuuccgucgcuucugauguguggagcuucggcguugugcuguaugagcuuuuuaccuacaucgaaaaauccaagucucccccugccgaguucaugcgcaugauugggaaugacaaacagggccagaugaucgucuuucaucugauugaacuccugaagaacaauggaagacugccccggccggauggcugcccugacgagaucuauaugauuaugaccgagugcuggaacaauaacgugaaucaacgccccagcuucagagaucuugcucugcggguugaccagaucagagauaacauggccggguga

SEQ ID NO: 70949 - RNA, 3504 nt, Artificial Sequence
  derived and/or modified sequence opt5 from JAK3__Homo_sapiens__XP_005259953
augaccguggcccaggagacaaagggccccacgcaagaaggggcugagugggacuucccucuggccgcgagcagacucugcccgcccuuugaauccccuggaucucugcccgcucggcaggucgcccuuauggccccucccagcgaggaaaccccucugaucccgcagcgcuccuguucucuccugagcacagaggcuggcgcccuucacguucugcuccccgcuagagggccuggacccccucagcggcuguccuucucuuuuggcgaucaucuggccgaggaccucugcgugcaagcggccaaagcuagcgggauucugcccguguaccacucccuuuucgcccuggcuaccgaagaucucagcuguugguuuccgccuucucauaucuucuccgucgaggacgccagcacacaggugcugcuuuaucgcauuagauuuuacuuccccaacugguuuggacuggaaaagugccaccgguucggccuccgcaaagaucuggcgucugccauccuggaccucccuguucuggagcaucuuuuugcucagcacagauccgaucuggugagcggccggcuccccgucgggcugucucuuaaggagcagggagaaugucugucccucgccgugcuggaccuggcucgcauggccagagagcaagcccagcggcccggcgaacuccugaaaaccguuagcuauaaggcuugccuuccuccgucccugcgcgaucucauucaggggcugucuuucgugacaagacggcgcaucagacggaccgucagacgcgcgcuucggagaguggccgcuugucaggccgaccgccacagccugauggccaaguacaucauggaucucgagcggcuggaccccgcuggagccgcggaaacguuucaugugggccugccuggggcucucggaggccacgauggccuggggcuucugagagucgccggagacggcgggauugccuggacccaaggagagcaggagguucuccagcccuucugcgacuucccugaaaucguggauauuuccaucaaacaagcuccccgcgugggcccggccggggagcaucggcuggucacagugaccagaacagacaaucagauucuggaagcugaguuuccuggacuucccgaagcccucagcuucguugcgcugguggauggcuauuuucgccugaccacggacucucagcacuucuuuuguaaggaggucgccccuccccggcuccuggaggaaguggcugagcagugccacggcccuaucacacuugauuucgccauuaacaaacugaagaccgggggauccagacccggcagcuacguucuccgccggucuccgcaagacuuugauagcuuccugcugacaguguguguccagaauccucuugggcccgacuauaaaggaugccucaucagacggucccccaccggcaccuuucugcugguggggcucucucgcccucauagcucccugagagaacuucuggcuacaugcugggauggcggacuccacgucgacggcguggccguuacgcugaccagcuguugcaucccgcggcccaaggagaagucuaaccugauugugguccagagagggcauuccccucccacaagcucucuugugcagccucaaucccaguaccagcucagccagaugaccuuccacaaaauccccgcggauucccuggaauggcaugagaaucugggacacggcucuuuuacaaagauuuaccgcgggugucggcacgagguuguggacggagaagccagaaaaaccgagguccuccugaaggugauggacgcuaaacauaagaacugcauggagagcuuccuugaggccgcuucccugaugucucaagugagcuaucgccaccucguucugcugcauggcgucuguauggccggggauuccacgauggugcaggaguuugugcaccuuggcgccaucgacauguaccucagaaaacggggacaccuggucccugcuagcuggaagcuccaggugguuaagcagcuggcguaugcccugaauuaccuugaagauaaaggccugccccaugggaacgugucugcucgcaagguccuccuggccagagagggagccgacggcuccccgccuuucauuaaacugagcgaucccggggugucuccugcuguucuuucccuggaaaugcucacagaccggauccccuggguggccccggagugccugcgcgaagcgcaaacccucagccuggaggcugauaaguggggauucggcgccaccgucugggagguguuuucugggguuacaaugccuaucagcgcccuugaccccgcuaaaaagcugcaguucuaugaagauagacagcaacucccugcccccaaguggaccgagcuggcgcugcuuauucagcaguguauggcuuacgaacccgugcagcggccuuccuuucgcgccgucaucagagaccugaauagccucauuucuuccgauuaugagcugcucagcgacccgacacccggcgcccuggcuccucgggauggacuuuggaacggcgcccaacuguacgcuugccaggaccccacgaucuucgaagaacgccaccucaaauacauuucccagcuggggaagggaaauuuuggcucuguggagcuguguagauaugacccucuuggggauaacaccggagcccugguggcggucaaacagcuccaacauagcggccccgaccagcagcgggauuuccagagagaaauccaaauccugaaggcccuccacuccgacuuuauuguuaaauaccgcggggugucuuauggcccuggacggcagagccugagacuugugauggaguaccugccguccggcugccugcgcgauuuccuccagcggcauagagcucgccuggacgccucucggcuucugcucuauagcucccaaaucuguaaggggauggaauaccugggaagcagacgcugcguccaccgggaucucgcugccagaaauauucugguggagucugaagcccacguuaagaucgcugacuuuggccuugcgaaacugcugccccucgauaaggacuauuacgugguccgggagccugggcagucccccauuuucugguacgccccugagagccugucugauaacaucuuuucccgccagagcgacguguggucuuucggaguugugcuuuaugaacuguuuacauacugcgauaaauccuguagccccuccgcugaguuccucagaaugaugggcugcgaacgggacgucccggcccugugucgccuccuggagcuucuggaggaaggccagagacugccugccccucccgcuugccccgccgaggugcaugaacucaugaagcuguguugggcgcccagcccucaagaccggccgucuuucagcgcucuugggccccagcuggauaugcucugguccggaucuagaggcugcgagacccacgccuuuacagcccauccugaagggaaacaccauagccuguccuucucuuga

SEQ ID NO: 70950 - RNA, 2496 nt, Artificial Sequence
  derived and/or modified sequence opt5 from JAKMIP1__Homo_sapiens__NP_001092903
augagcaagaaaggcagauccaagggggagaaacccgaaauggagaccgacgccgugcagauggcuaacgaagaacugcgggccaagcucacaucuauccaaauugaguuccagcaggagaaaagcaaggucggaaagcugcgcgagagacuucaggaagcgaaacuggagcgggaacaagagcagcgcagacacacggcuuacaucuccgagcucaaggccaaacugcaugaagagaagaccaaagaacuucaggcccugcgggagggccucauucgccagcacgaacaagaggcugccagaacagcuaagaucaaggagggggaacugcagcggcugcaggccacccucaauguucugcgcgauggagcggccgacaaagugaagacagcccuucugaccgaggcuagagaagaggcucggcgcgccuuugauggcgaaagacuccggcugcagcaagagauucuugagcugaaagcggcccgcaagcaggcugaagaggcccucucuaacugcaugcaggcugacaaaacaaaggccgccgaucugagagcugcguaucaagcccaucaggacgaagugcaccggaucaaaagagagugugaacgcgauauccggagacugauggacgagauuaaggggaaggaucgcgucauccucgcucuggagaaagaacuuggagugcaggccggccagacccaaaagcugcuccugcagaaagaggcccuugacgaacagcugguucaggugaaggaggcugagcggcaucacagcuccccuaaaagagaacucccgcccggcauuggggauauggucgagcugaugggagugcaagaccagcacauggaugaacgcgacguucggagauuccagcugaagaucgccgagcucaauucugugauucgcaagcuggaagaccggaacacgcuucuggcggaugagagaaaugagcuccugaaacgcagccgggaaaccgagguccagcuuaagccucugguggagaaaaacaagagaaugaauaaaaagaacgaggaccuccugcaauccauccagcggauggaagagaagauuaaaaaucugacacgcgagaacguggaaaugaaggagaaacucagcgcucaggccucucugaagagacauaccucccuuaaugaucugagccucacacgggacgaacaggagaucgaauuucugagacugcaaguccuugagcagcagcacguuaucgaugaccucucucuggagcgcgaacggcugcucagauccaaacgccauagaggcaagagccugaagcccccuaaaaagcacgugguggagaccuucuuuggguucgaugaagagucugucgacuccgagacgcuuagcgaaacauccuacaacaccgaucggacagaccgcacccccgccaccccugaggaagaucuggacgacgcuacagccagagaggaagcugaucuccgguuuugccaacugacgcgcgaguaucaggcccugcagagagcguacgcccuucuccaggagcaagugggaggcacccuggacgcugaacgggaggcccgcacaagagaacagcugcaggcugaucuccugcggugucaggccaaaauugaggaccuugaaaagcugcucguugagaaagggcaagauucuaaguggguggaggaaaaacagcugcugauccgcaccaaucaggaccuucucgagaagauuuauagacuggaaauggaggaaaaccagcugaagaaugagaugcaagaugcgaaagaccagaacgagcuccuggaguuccggguccuugaacuggaagagagagagcgccggagcccggccuuuaaccuccagaucacaaccuuccccgaaaaucacuccagcgcucugcaacuguuuugccaucaggagggagugaaggauguuaacgugucugaacuuaugaaaaagcucgacauucugggcgauaauggcaaccugagaaaugaggaacaggucgccaucauccaggcugggacggugcucgcccugugugagaaauggcuuaagcaaauugagggaacagaagccgcucugacccagaagaugcucgaccuggagaaagaaaaggaucuguucucccgccagaaaggcuaccuugaggaagaacuggacuaucggaagcaggcgcucgaccaagccuaccugaaaauccaggaucucgaggcuacccuguacacagcccuucagcaggaaccugggagacgcgccggagaggcucugagcgaaggccaacgggaggaccuccaggccgcggucgaaaaggugagacgccagauucugcggcagucuagagaguuugauagccaaauccugcgggagcgcauggaacuucugcagcaggcucaacagcggauuagagagcucgaagacaagcuggaguuccagaaacgccaccucaaggagcuggaagagaaauuccuuuuucuguuccucuuuuucucccuggccuuuauccuguggcccuga

SEQ ID NO: 70951 - RNA, 2400 nt, Artificial Sequence
  derived and/or modified sequence opt5 from JAKMIP2__Homo_sapiens__NP_001257863
augagcaagaaaggcagaaacaagggggagaaacccgaagcccugaucguggcucuccaggccgcgaaugaggaccugcggaccaaacuuacagauauucaaaucgaacugcaccaggagaaauccaaggucucuaagcucgaacgcgagaaaacgcaggaggcuaagcggauucgggaacuggagcagcgcaaacauaccguucuugugacagaacugaaggccaaacuccacgaggagaagaugaaggaacugcaagccgugagagagaaccugaucaaacagcaugaacaggagaugagccggaccgucaaggugcgcgacggagaaauucagagacucaaauccgcucugugcgcccuucgggauggcucuagcgacaagguucgcacagcucugaccaucgaggccagagaggaagcgcggaaacucuucgauacagagcgccugaaacuucugcaagaaaucgccgaccucaagaccgcuaagaaacagguggaugaggcccuguccaauaugauucaggcugacaagaucaaggccggggaucugagaucugaacaccagagccaucaagaggcgauuuccaaaaucaagugggagagcgaacgggacauucgcagacucauggaugagaucaaagccaaggaccggauuaucuuuucucuggaaaaggagcuugaaacgcagaccggauacguccagaaacugcaacuccagaaggaggcucuggaugagcagcuuuuccuggugaaagaagccgaguguaacauguccagcccuaagagagaaaucccgggccgcgcuggggacggaucugagcacugcuccagccccgaccuccggagaaaucagaaacgcauugccgagcugaacgccacaauccggaagcuggaagauagaaauacccuccugggcgacgagcgcaacgaacuucugaagcggguuagagagacagaaaaacaauguaagccucuccuggagcgcaauaaaugccuugcuaagcggaacgaugagcugauggugucucuccagagaauggaagagaaacugaaggcggucaccaaggaaaauuccgagaugcgcgaaaagauuacgagccaucccccucugaagaaacucaagucccugaacgaccuugaucaggccaaugaggagcaggaaacagaguuucugaaacuccaagugaucgaacagcagaacauuaucgacgagcugacccgggauagagaaaagcugauccggcgcagaaaacaccggagaucuagcaagcccauuaagcgcccugugcuugacccguucaucggcuaugaugaggacuccauggauagcgagacaucuuccauggcuagcuuucggaccgacagaacccccgccacaccugacgaugaccucgaugaaucucuggccgcugaggaaagcgagcugcgcuucagacagcucacgaaagaguaccaagcccugcagcgggcguaugcccuucugcaggaacagaccgggggaauuaucgacgcugagcgcgaagccaaggcucaagagcagcuccaggccgaaguccugagauacaaagcuaagauugaggaucuggaggccacacuugcgcaaaaaggccagaucgaaaagcaggaggccgaaaaucaccggcuccagcaagagcugcaggacgcucgcgaucagaacgaacugcucgaguuuagaaaccuggagcuugaggaacgggaacgcagaucucccccuuucaaucugcagauccaucccuuuuccgacgggguuagcgcccuccaaauuuauuguaugaaggagggagugaaagaugugaacaucccggaccugauuaagcagcuggauauccuuggcgacaaugggaaccuccggaaugaggaacaggucgcuauuauccaggccuccaccgugcugagccuggcggagaaauggauucaacagaucgaaggagccgaggcugcccuccaccagaagaugauggaacuggagucugauauggagcaauucugcaaaaucaagggcuaccuugaagaggaacuggacuaucgcaagcaggcucucgaccaggccuacaugcggauucaggagcuggaagccacacuguacaacgcgcuucaacaggagaccguuaucaaauuuggcgagcuccuguccgaaaagcagcaggaggaacugagaacggcuguggagaaacucagacgccaaaugcugagaaagagcagagaauaugauugucagauucuucaggagcgcauggagcugcuccagcaagcccaccagcggaucagagaccuggaagauaaaacagacauucagaagcgccagaucaaggaucuggaggaaaaauuccuuuuucuguuccucuucuuuucucuggcuuucauccucuggccuuga

SEQ ID NO: 70952 - RNA, 2535 nt, Artificial Sequence
  derived and/or modified sequence opt5 from JAKMIP3__Homo_sapiens__XP_011537986
augagcaagagaggcauguccucucgggccaaaggggacaaggcugaggcccuggcggcucuccaggccgccaacgaagaucugcgcgcuaaacuuaccgacauccaaauugagcugcagcaggaaaagagcaaaguguccaaggucgagagagaaaagaaucaggagcuccggcaaguucgcgagcacgaacagcauaaaacagccgugcugcuuacggagcugaagaccaaacuccacgaagagaagaugaaagagcugcaggcugugagagaaacacugcuccggcagcaugaggccgaacugcuucgcgucaucaagauuaaggauaacgagaaucaaagacugcaggcgcuccugucugcccuucgggacggaggccccgaaaaagugaagaccguucugcucagcgaggcuaaagaggaagccaagaaaggguucgagguggaaaaggucaaaaugcagcaggagaucuccgaacugaagggagcuaagcgccaaguggaggaggcccugacacucguuauucaggcggauaaaaucaaggccgcugaaaucagaucuguguaccaucugcaccaggaggaaauuacccggaucaaaaaggagugcgaacgcgagauuagacggcuuauggaggaaaucaaauuuaaggaccgcgccgucuucgugcuggagagagaacucggcgugcaagcugggcacgcccagcggcugcagcuucagaaggaggcccuggaugagcaacucagccaggucagagaagcugaccgccacccuggauccccgcggagagagcugccccaugcggccggcgcuggcgaugccagcgaccacucuggguccccugaacagcagcuggaugagaaagacgcccgccgguuucaacucaagauugcugaacugagcgccaucauuagaaaacuugaggaucgcaacgcgcugcucucugaggaacggaaugagcugcuuaagagaguucgcgaagcugagucccaguauaaaccccugcucgacaagaacaagcggcugagcagaaagaaugaagaccugucucaugcccuccgccggauggagaacaagcugaaauucgugacacaggagaauaucgaaaugagacagcgggccggaaucauucgcagaccuuccagccuuaacgaucuggaccaaucccaggaugagcgggaaguggacuuucucaagcugcagaucgucgagcagcaaaaucugauugaugaacuuucuaaaacccucgagacggcuggcuacguuaagagcgugcuggagagagacaagcugcuccgcuuccggaaacagagaaagaaaauggccaagcugcccaaaccuguggucguggaaaccuuuuucggguaugaugaggaggcuucccuugagagcgacggaucuuccguuagcuaccagacagaucgcaccgaccaaacaccguguacccccgaugacgaccuggaggaaggcauggccaaggaggaaacggagcucagauuucggcagcugacaauggaauaucaggcgcugcagcgcgccuacgcucugcuccaagagcaggucgggggaacccuggaugccgagagagaagugaaaacacgggagcagcugcaggcugaagugcaacgcgcccaggcgagaaucgaggaccucgaaaaggcccuggcugagcagggccaggauaugaaguggauugaggaaaaacaagcccuuuaucggcgcaaccaggagcuggucgaaaagaucaaacagauggagaccgaagaggcuagacuccggcacgaggugcaagacgcccgcgaucagaaugaacugcuggaguucagaauccuugaacucgaggagcgggaaagaaagucuccugccauuagcuuucaccauacccccuucguugacggcaaauccccucuucagguguacugcgaggcugaaggggucacagauaucgugguugcggagcugaugaagaagcucgacauucugggagauaacgccaaucuuacgaacgaagaacagguggucgugauccaagcucgcaccgugcugacacucgccgagaaauggcugcagcagauugaagagaccgaagccgcucugcagcggaagaugguugaccuugagucugaaaaagagcucuuuagcaagcaaaaaggcuaccuggaugaggaacuggacuauagaaagcaggcccucgaucaggcgaacaagcacauccuggagcuugaagcuaugcuguacgacgcccuccagcaagaggccggggcuaaagucgccgaacugcuguccgaggaggaacgcgagaaacuuaaaguggcgguggaacaguggaagcggcaggucaugagcgagcugagagagcgcgacgcucagauccuccgggaaagaauggagcugcuccaacuggcccagcagcgcauuaaagaacuugaggaacggaucgaggcccaaaagagacagauuaaggagcuggaagagaaauuccucuuccuguuucuguucuuuucucuugcuuucauccugugguccuga

SEQ ID NO: 70953 - RNA, 789 nt, Artificial Sequence
  derived and/or modified sequence opt5 from JAM2__Homo_sapiens__NP_001257336
auggccagacggagccgccacagacugcuccugcuucugcuccgguaccugguggucgcucuuggcuaucauaaggccuacggguucagcgcgcccaaagaccagcaaguugugaccgcuguggaguaucagggagauuuuaagaaccgcgccgaaaugaucgacuucaauauuagaaucaaaaacgucacacggucugaugccggcaaguaccgcugcgaggugagcgcuccuuccgaacaggggcagaaucuggaggaagacacgguuacccucgaggugcuggucgccccggcugugcccucuugugagguuccuagcuccgcccugucuggaacaguggucgaacucagaugccaagauaaagagggcaaccccgcgccugaauauaccugguuuaaggacgggauucggcugcuugagaauccccgccugggaagccaguccacaaacagcucuuacaccaugaauacaaagaccggcacgcuccaguucaacaccguguccaaacuggauacaggcgaguauagcugugaagccagaaauucugugggguaccggcgcugcccuggaaagagaaugcaggucgacgaucuuaacaucuccggcauuaucgcugccguugugguggucgcucuggugaucagcguuugugggcucggagugugcuacgcccaacggaaaggcuauuuuucuaaggagaccuccuuccagaaaagcaauuccucuagcaaggcgacaaccauguccgaaaacgacuuuaagcacacgaaauccuucauuaucuga

SEQ ID NO: 70954 - RNA, 780 nt, Artificial Sequence
  derived and/or modified sequence opt5 from JAM3__Homo_sapiens__NP_001192258
auggcccugagacggcccccucgccucagacugugcgcucggcuuccggacuucuuucugcuccugcuuuuccgcggcugucugaucggggccgugaaccucaagagcuccaauagaacccccgucguucaggaguuugaaucuguggagcugagcugcauuaucacagauucccaaacgucugacccucggauugaauggaaaaagauccaggaugagcagaccacauacguguucuuugacaacaaaauucaggucaagcccgugaccccuguuugucgcgugcccaaagcggucccugugggaaagauggcuacacugcacugccaagaaagcgagggccauccgagaccccacuauuccugguaccggaaugauguuccucuccccaccgacucucgcgccaacccuagauuccggaauagcuccuuucaucugaacagcgagacagggacccuuguguucacggccguccacaaggaugacucuggacaguauuacuguaucgcuuccaaugaugccggcagcgcucgcugcgaggaacaggaaauggagguguaugaccugaacaucgggggaauuaucggcggcgugcucgucguucuggccgugcuugcgcugauuacccucgggaucuguugcgccuacagacggggauauuuuauuaauaacaaacaggauggcgagucuuacaagaaucccgggaaaccggacggagugaacuacauccgcacagaugaagagggcgacuucagacauaaguccagcuuugucauuuga

SEQ ID NO: 70955 - RNA, 3225 nt, Artificial Sequence
  derived and/or modified sequence opt5 from JARID2__Homo_sapiens__NP_001253969
augguguacuucggcagcucccaggacgaggaagaggucgaagaggaagaugacgagaccgaggauguuaagacagccacgaacaaugcuucuagcuccugccaaucuacccccagaaaagggaagacacacaaacaugugcacaacggacauguguuuaauggcagcucccggucuacccgcgaaaaggagccuguccagaaacacaagagcaaggaagccacaccggcgaaagagaagcauuccgaccacagagcugauagccggcgcgagcaggccucugccaaccaccccgcugccgcuccuuccaccgggagcucugccaaaggacuggcggccacacaucaccaucccccucuccacagauccgcucaggaccugcggaagcaagugagcaaaguuaauggcgugacccgcaugucuucccuuggggccggagucacgagcgcuaagaagaugagagaagugcggcccuccccuucuaaaaccguuaaguauacagccaccgugacaaaaggcgcggucaccuacacgaaggccaaacgcgagcuggugaaggauacaaaaccgaaccaccauaagcccagcuccgcugugaaucacaccaucagcggcaagacagaaucuuccaacgccaaaaccagaaagcagguccucagccuugggggagcuucuaaaagcaccggcccugccguuaaugggcuuaagguguccggacggcugaaccccaaaucuuguacaaaggaggugggcgggcgccagcucagagaaggacugcagcugcgggagggccuccgcaauagcaagagacggcuggaggaagcccaucaagcugagaaaccucaguccccgcccaagaaaaugaagggcgcggccgggccugcugaaggacccggcaaaaaggccccugccgagagagggcuucugaacggacacgucaagaaagaagugcccgagcgcagccucgagcggaauagacccaagcgcgcuacggccggcaaaucuaccccugggcggcaggcgcauggaaaggcugacuccgccagcugcgaaaacagaucuacaucccagccggagagcguucacaaaccccaagauuccggcaaggccgaaaagggcgggggaaaagcuggcugggccgcuauggacgagauuccugugcugcgccccucugccaaggaauuucacgauccucuuaucuauauugagagcguccgggcccagguggagaaauuugggauguguagaguuauucccccgccugacuggcgccccgaaugcaagcugaaugaugagaugcgguucgugacccagauccaacauauccacaaacucggaagacgcuggggcccuaacguccagcggcuggcguguaucaagaaacaucugaagucccaggggauuacaauggacgaacucccccugaucggcggaugcgagcuugaccuggcuuguuucuucagacucauuaacgagaugggcgggaugcagcaagugaccgaucugaagaaauggaauaagcuggccgacaugcugcggaucccucgcacggcucaggauagacucgccaaacugcaggaagcguacugccaguaucugcucucuuacgacagccugucccccgaggaacaccggagacuugagaaggaaguccugauggagaaagagauucucgaaaagcgcaagggaccgcuggagggccacacagaaaacgaucaucacaaauuucauccucuuccccgguucgagcccaagaaugggcugauccacggaguggccccuagaaacggcuuucgcagcaaacucaaggaaguugggcaagcucagcugaaaaccggcagacggcgccuguucgcccaggagaaggagguggucaaggaagaggaagaggacaaaggagugcucaaugauuuucauaaguguauuuauaaaggcagaucuguuucccugaccacauucuaccggaccgcucgcaacaucaugagcaugugcuuuucuaaggaaccggcccccgccgagaucgagcaggaauacuggagacuuguggaggaaaaagacugucacgucgcugugcacugcgggaagguggauacaaauacgcauggauccggcuucccuguuggaaagagcgagcccuucucucggcacggauggaaccugaccguccucccuaauaacacaggcagcauucugcgccaucugggggcggugcccggcgugaccaucccuuggcuuaauauuggaauggucuuuuccacaagcugcuggucuagagaccaaaaccaccuccccuauaucgauuaccugcauaccggcgccgacuguauuugguauugcaucccggcugaggaagagaauaaacuggaagacgugguucacacgcuccugcaggccaacgggaccccuggacuucagaugcuggaguccaaugugaugaucagccccgaaguccucuguaaggagggcauuaaagugcaccggacaguucagcaauccgggcaguucguggucugcuuuccuggaucuuucgugagcaagguuuguugcggcuacuccgugucugagaccguccauuuugccacaacccaguggacgagcaugggguucgaaacagcuaaagagaugaagcgcagacacaucgccaaacccuuuuccauggaaaagcugcuguaucaaauugcgcaggcugaggccaagaaagaaaacggcccgacccuuucuacaaucagcgcccuccuggaugagcugcgggacaccgagcucagacagcgccggcagcuguucgaagcuggacuucauuccagcgccagauacggcucucacgauggguccagcaccguggcggacggaaagaaaaagccucgcaaauggcugcaacucgagacaucugaacggagaugucagauuugccagcaccuguguuaucuguccauggugguccaggagaacgaaaauguuguguuuugccuugagugugcucuccgccauguggagaagcaaaagagcugccggggccugaaacugauguacagauacgaugaggaacagaucaucucucucgucaaccagauuugcgggaagguguccgggaaaaauggcagcaucgaaaacugucuguccaagcccacgccuaaacgcggcccccggaagagagccaccguugacgugcccccuagccggcuuucugccagcuccucuagcaaguccgcuucuagcuccucuuga

SEQ ID NO: 70956 - RNA, 732 nt, Artificial Sequence
  derived and/or modified sequence opt5 from JAZF1__Homo_sapiens__NP_778231
augaccggcaucgccgcugccagcuucuuuuccaacacaugcagauucgggggauguggccugcacuuucccacgcucgcggaccugauugagcauaucgaagauaaucacauugacaccgauccucgggugcuugagaagcaggaacugcaacagccgacauacgucgcucucucuuauaucaaccgcuucaugaccgacgccgccagacgggagcaggaaagccugaaaaagaaaauucagcccaaacuuucccugacacucucuagcuccguuucucgcgggaaugugagcaccccucccagacauuccagcggaucucugacaccucccgugaccccuccgaucacgcccuccagcucuuuucgguccagcaccccuacaggcucugaguacgaugaggaagaggucgacuaugaagaguccgauagcgacgaguccuggaccacagaaucugcuaucagcuccgaggccauucugagcucuaugugcaugaacgggggagaagagaagcccuucgcuuguccugugcccggcugcaagaagcgcuacaaaaauguuaacggcaucaaguaucacgccaaaaaugggcauagaacccaaauucgggugcgcaagccguuuaaauguagaugcggaaaguccuacaagacggcgcagggccuccggcaccacacaaucaacuuccauccucccgucagcgccgaaauuauccgcaaaaugcagcaguga

SEQ ID NO: 70957 - RNA, 492 nt, Artificial Sequence
  derived and/or modified sequence opt5 from JDP2__Homo_sapiens__XP_005267389
augaugcccggccagaucccugacccgagcgugaccacagggucccugcccggacucggcccucugacggggcuucccucuagcgcccugaccgucgaggaacucaaguacgcugauauuagaaaccugggagccaugaucgcgccucuucacuuccuggagguuaaacucggcaagcggccccaaccugugaaauccgaacuggacgaggaagaggagcgcagaaagcggcgcagagagaaaaauaagguggcugccgcccggugccgcaacaagaaaaaggagagaacagaauuucugcagcgggagucugagcgccucgaacugaugaaugcugagcuuaaaacccagauugaagaacugaagcaggaaagacaacagcucauccugaugcuuaaccggcaucgcccgacauguauugucagaaccgauagcgugaaaacacccgaguccgaggggaauccucugcucgaacagcuggagaagaaguga

SEQ ID NO: 70958 - RNA, 7077 nt, Artificial Sequence
  derived and/or modified sequence opt5 from JMJD1C__Homo_sapiens__NP_001269877
augcagggccccuacagccugaacggguauagagugcgggucuacagacaagacuccgccacccagugguucacagggaucauuacgcaccaugaucucuuuaccagaaccaugaucguuaugaaugaccaggugcuggagccucagaacguggauccgucuaugguccaaaugaccuuccuugacgaugugguucacagccugcucaagggcgaaaauauugggaucacaucccggcgcagaucucgggcuaaccagaaugugaacgccguccauagccacuauacccgcgcccaggcuaauucccccagaccugccaugaacucucaggccgcugugcccaagcaaaauacacaucagcagcagcaacagcggagcauucgcccuaacaagagaaaaggauccgacagcucuauccccgaugaggaaaagaugaaagaggaaaaguacgacuauaucucccggggcgagaauccuaaggggaaaaacaagcaccugaugaauaaacgcagaaagccggaggaagaugagaagaaacuuaacaugaaacggcugcgcaccgacaauguuagcgauuuuucugaauccagcgacucugagaacuccaacaaaagaauuaucgauaauagcuccgagcagaagcccgaaaacgagcucaaaaauaagaacacgucuaaaauuaauggagaagagggcaagccucacaacaaugaaaaagccggcgaggagacccugaagaacagccaacccccuugggaccagauccaggaagacaagaaacaugaggaagcugagaagcggaaauccguggauacacagcugcaagaagacaugauuauccacagcucugagcaguccaccgucagcgaucauaauucuaacgaccuccugccccaggagugcaauauggauaagacacacaccauggaacuucugccgaaagagaaguucgugagcagaccucccacgccuaagugugugauugacaucacaaacgauaccaaucucgaaaaagucgcccaggagaacuccucuacauuugggcugcaaacccuucagaagauggaccccaauguuagcgauuccaaacacagcaucgcgaacgccaaguuccuggaaaccgcuaaaaaggacucugaucaguccugggugagcgacguggucaagguggaccucacacagucuuccguuacgaacgccagcuccggaaaugaucaucugaacauggagaaagagaaguacgugucuuauauuagcccccuguccgcugucucugugauggaagacaaacuccacaagcgcagcccuccgcccgagaccaucaaauccaagcugaauacaagcguugauacccauaagauuaaaucuuccccuagccccgaaguggucaagccuaaaaucacacacucucccgacuccgugaaguccaaagccaccuacgucaacucucaagcgacgggcgagcggagacuugccaauaagauugagcaugaacugagccgcugcuccuuucacccgaucccuacacggagcucuacccucgagaccacaaaaagcccccugaucauugauaagaacgaacacuucaccguguacagagacccugcucuuaucgggagcgagacaggagccaaucauauuucccccuuucugucucagcacccuuucccccuccauagcuccucucaccgcacgugucugaacccgggcacccaccauccugcucugacacccgcgccccaccuccuggccgggagcuccucucagaccccucuuccgacaaucaauacccauccccugacgagcggaccucaccaugcuguucaccacccccaucuccugccuaccgugcuucccggcgucccuacagcgucccugcucggcgggcacccccggcuggaaagcgcccaugcuucuucccugagccaccucgcccuggcccaucagcaacagcagcaacuucugcagcaccagucuccgcaccuccugggacaggcucauccuuccgccagcuauaaccaacugggccuuuaccccauuaucuggcaguauccuaaugggacccacgcguacucuggacucggccugcccuccagcaagugggugcauccggagaacgcuguuaaugccgaggccucccugagacgcaacagcccuucucccuggcuccaccagccuacacccgugaccagcgcugaugggaucggacugcuuucccacauucccguccggccuucuagcgccgaaccgcauagaccccugaaaaucacggcucacuccucuccuccccucacaaagacccugguggaccaucacaaagaggaacuggagcgcaaggccuuuauggaaccucuucggagcguggcguccacaucugccaaaaaugaucucgaccugaacagaagccagaccggcaaggauugccaucugcaccggcacuucguugaccccguccucaaccaacugcagcgcccuccgcaggagaccggcgagagacuuaauaaguauaaagaggaacaucggcgcauucugcaggaauccaucgauguggcucccuuuacaacgaagauuaaagggcucgagggagaacgcgagaacuacagccggguggccucuuccuccucuagcccuaagagccacaucauuaaacaagacauggacgucgagagauccgugucugaucuguauaagaugaagcauagcguuccccagucccugccucagagcaauuacuucaccacacuuucuaacuccguggucaaugaacccccgcgcagcuacccuucuaaagaggugagcaacaucuauggcgacaagcaauccaaugcucucgccgcggccgcugccaacccccagacccugacaucuuucaucaccagccuguccaaacccccuccccucauuaagcaccagccugaaucugaggggcugguuggaaaaaucccggagcaccuuccccaucagauugcuagccacuccgugacgacauuuagaaaugauugucggagcccuacccaucugaccgucucuuccacaaacacccuccgcagcaugcccgcccugcacagagccccuguguuccaucccccgauccaccacucccuggaacggaaggagggcucuuacagcucccuuucuccucccacacucacgccuguuaugcccgugaaugcugggggcaagguccaagaaagccagaaaccucccacccugauuccggagccuaaggacucccaggcgaacuuuaaauccucuagcgaacagagccugacagagauguggcgccccaauaacaaucucucuaaggagaaaaccgaauggcauguggagaaguccagcggaaaacugcaagccgcuauggccucugugaucgucagacccagcuccucuacaaagaccgauagcaugccugccaugcagcuugcuuccaaggaccggguuagcgaacgcuccucugccggcgcgcacaaaacggauugccugaagcucgcugaggccggggaaaccggaagaaucauucugccgaacgugaacagcgacuccgugcauacaaaaucugagaagaauuuccaggccgucagccagggcuccgugcccucuagcguuauguccgcugugaacaccauguguaauacaaaaaccgaugucaucacaagcgccgcggacaccacgucuguguccagcuggggagggucugagguuauuuccagccugucuaacacaauccuugcuuccaccagcuccgaaugcgugagcucuaagagcgucucccaaccuguggcccagaagcaggaguguaaaguuucuaccacagcccccgugacccuggcuagcuccaagacgggcucugucgugcagccuagcuccggguuuucuggcacaaccgauuucauucaccucaaaaagcacaaagccgcucuggccgcggcccaauauaagagcuccaaugcuagcgaaacagagcccaacgccaucaagaaucagacccucucugcuucccugccucuugacagcacagugaucugcucuaccauuaacaaagccaauuccgucggaaacggccaggccagccaaacgucccagccgaauuaccauaccaagcugaaaaaggcuuggcucacacggcacucugaagaggauaaaaacaccaauaagauggagaacagcggaaauuccguuagcgaaaucauuaagcccuguucugugaaccugaucgcguccacaagcucugacauucagaauagcguggacuccaaaaucaucgucgauaaguaugugaaagacgauaagguuaaccgcagaaaagccaagcggaccuacgagucuggaagcgaauccggcgacucugaugagagcgaguccaagagcgaacagagaacgaaacgccaaccuaagcccacauauaaaaagaaacagaacgaccugcagaagcggaaaggggagauugaagaggaucuuaagccuaauggagugcugucuagauccgcuaaggaacgcagcaaacucaagcugcaguccaacucuaauaccggcaucccccggagcguccucaaagacuggagaaaggugaaaaagcugaagcaaacaggggaguccuuucuucaggaugacucuugcugcgagauuggcccgaaccugcagaaaugucgcgaaugccggcucaucagaagcaagaaaggagaggaaccugcccauucccccguuuucugucgcuuuuacuacuuccggagacugagcuuuucuaagaauggcgugguccggauugauggguucuccagccccgaccaguaugacgaugaggccaugucucuguggacccacgaaaacuuugaggacgaugagcuugacaucgaaaccuccaaauacauucuggauaucaucggagacaaguucugccaacucgugacaagcgagaagacggcucugucuugggucaaaaaggaugccaaaauugcguggaagcgcgcugugagaggcguucgggaaaugugugacgccugcgaggccacccucuucaauauccauugggugugucagaaaugcggguuugucgugugucuggauugcuauaaggcuaaggaacgcaaauccagcagagacaaggagcuuuacgccuggaugaaauguguuaagggacagccucacgaucacaaacaucugaugcccacacaaauuaucccuggcucugugcugaccgaccuccuggaugcgaugcacacacuucgggagaaguaugggauuaaaagccauugccacugcaccaacaagcagaaucugcaggucggcaacuucccgacgaugaauggagugucccaggugcuccaaaacguucugaaucauagcaacaagaucucccucuguaugcccgaaucucagcagcagaauacaccucccaaaagcgagaagaacggcggguccucuccugaaagcgacgucggaaccgacaacaaacugacacccccggagucccaaucuccucuucacuggcuggcugaucuggccgagcagaaggccagagaagagaaaaaggaaaauaaggagcucacacuggaaaaccagaucaaagaggagcgcgaacaggacaauagcgagucccccaacggccggaccagcccucuugugucucaaaauaacgaacagggguccacacugagagaucuccugacgaccacagcuggaaagcuccgcgugggcagcaccgacgccggcauugcuuuugcccccgucuacucuaugggggcgccuuccagcaaaucuggacggacaaugcccaauauccuggaugacauuaucgccuccgugguugagaacaagauuccgccuagcaaaaccucuaagaucaaugugaagcccgaacuuaaagaggagcccgaagaguccaucauuagcgcugucgaugaaaacaauaagcuguauagcgacaucccucacuccuggauuugcgagaaacauauccuguggcucaaggauuacaaaaacucuagcaauuggaagcuguucaaggaauguuggaaacagggccagccggccgugguuuccggggugcacaagaaaaugaacauuucucuuuggaaggcugagagcaucucccuggacuuuggagaucaucaagccgaccuccugaauugcaaagauucuauuaucagcaacgccaacgucaaggaguucugggacggcuuugaagagguguccaaaagacagaagaauaagagcggggaaacgguugugcucaaacugaaggacuggcccucuggagaggauuucaaaaccaugaugccugcucgcuacgaggaccuucugaagucccugccccucccugaauauuguaaccccgagggcaaauuuaaucuggcgagccaccuuccuggcuucuuuguccggcccgaucuggggccgagacucugcucugccuacggagugguggcugccaaggaccacgauaucggcacaaccaaccugcauauugaagucuccgacguugugaauauccugguguaugucgggauugccaagggaaacggcauccucagcaaagcugggauucuuaagaaauucgaggaagaggaucuggacgauauccugcgcaagagacucaaagacuccucugagaucccuggagcccuguggcacauuuacgcgggcaaggauguggacaagauccgggaauuucuucagaaaauuagcaaggagcaaggccuggaaguucuccccgagcaugacccuauccgcgaucaguccugguaugugaauaaaaagcugagacagcggcugcucgaagaguacgggguccgcacauguacccuuauucaguuccugggagacgcuaucgugcugcccgccggcgcccuccaccaaguucagaacuuccauucuugcauccaggugacagaggauuuugucagcccggaacaccugguggaguccuuccaccuuacgcaggaacugagacuccugaaagaggaaauuaauuaugacgauaagcugcaagucaagaacauccucuaccaugcugugaaagagaugguucgggcccuuaagauucacgaggacgaaguggaggauauggaagagaauuga

SEQ ID NO: 70959 - RNA, 1245 nt, Artificial Sequence
  derived and/or modified sequence opt5 from JMJD6__Homo_sapiens__NP_001074930
augaaccacaagagcaaaaagagaauccgggaggccaaacgcuccgcuagacccgaacugaaggacucucucgauuggacccggcauaauuacuaugagagcuucucccugucuccugccgcgguggcugacaacgucgaacgcgccgaugcccuucagcugagcguugaggaauuuguggagagauacgagcggccguauaaacccgugguccuccugaaugcucaagaaggcugguccgcccaggagaaguggacacuugaacgccugaagagaaaauaccggaaccagaaguucaaaugcggggaggacaaugauggauauucugugaagaugaaaaugaaguacuauauugaguacauggaaagcacgcgcgacgauuccccucucuacaucuuugacagcucuuauggcgagcaccccaagagacggaaacugcuggaagauuacaagguuccuaaauucuuuaccgacgaucucuuccaguaugcuggggagaagcgcagacccccuuaccggugguuugugaugggaccgccccgcuccggcacagggauucauaucgacccucugggaaccagcgccuggaacgcgcuuguccaaggccacaaaagauggugucuguuccccacaucuaccccucgggaacucauuaaggugacaagagaugagggcgggaaucagcaggacgaggccaucaccugguuuaacguuaucuauccccgcacgcagcugccgaccuggccucccgaguucaaaccucuugaaauucugcaaaagcccggagaaacaguguuuguccccggcgggugguggcauguggugcucaaucuggacaccacaaucgcuauuacccagaacuucgccuccagcacgaauuuuccugucguuuggcacaagacagugcggggaagaccgaaacugucucgcaagugguaccggauccucaaacaggagcaccccgaacuggcugugcuugccgauuccgucgaccugcaggagagcaccggcauugcguccgauucuagcuccgacucuagcuccagcucuagcuccucuagcuccgauagcgacucugagugcgaauccgggagcgagggagauggcacagugcauagacgcaagaaacggagaaccuguucuaugguuggcaacggggacaccacaucccaagaugacugcgugagcaaggaacgcuccucuagccggaucagagauacguguggaggccgcgcccacccuuga

SEQ ID NO: 70960 - RNA, 2967 nt, Artificial Sequence
  derived and/or modified sequence opt5 from JMY__Homo_sapiens__NP_689618
augagcuucgcccuggaggaaacccucgaguccgacuggguggcugucagaccccacguuuuugaugaacgggagaagcauaaauucguguuuaucguggccuggaacgaaauugagggcaaguucgcgaucacaugccacaaucgcacggcucagagacaacggucugggagccgcgagcaggccggagccagaggcggggcugaagccggaggcgcugccuccgacgggucucggggaccuggcagcccggcgggccgcgggagacccgaggccaccgcuuccgccacacugguccggucuccuggaccccgcagaagcuccgcuugggccgaaggcgggagcccucggucuacccgcucccuucugggagaucccagacuccggagcccuggcucuaaaggggcggagucccgccugagaagcccggugcgggccaagcccauuccuggacagaaaacaucugaggcugacgaugccgcuggcgccgccgcugcggccgcuagacccgccccucgcgaagcccagguuuccagcgugcggaucgucuccgcuucuggcaccgugagcgaggaaauugagguucuugaaauggugaaggaggacgaggccccgcuggcgcucuccgaugcugaacaaccgccucccgccacagagcuggaaagcccugccgaggaauguucuugggcugggcuguuuuccuuccaggaccucagagccguccaucagcagcugugcagcgugaacucucaacuugagcccugucugcccguguuuccugaggaaccgagcggaauguggaccguccucuucggcggggcucccgagaugacggaacaggagaucgauacccugugcuaccagcuucagguuuaucugggacacggccucgacacauguggguggaagauccugucccaagugcuguuuaccgaaacagaugacccugaggaguacuaugaaucucucagcgagcugcgccagaaaggauacgaagaggugcuucagcgggccagaaagcgcauucaagagcugcucgauaaacauaagaauaccgaauccauggucgagcugcuugaccuguaucagauggaagacgaggcguacagcucucucgccgaagcuacgacagagcuguaucaguaccugcuccagcccuuccgggauaugagagagcuggccaugcuucgccggcaacagaucaaaauuuccauggaaaacgacuaccugggcccuagacgcaucgagagccuccagaaggaagaugcugacuggcagcggaaggcccacauggcggugcugucuauucaagaucuuaccguuaaauauuuugagaucacagccaaggcucagaaagccguguacgacagaaugcgggcugaucagaagaaauucggcaaggccuccugggccgcugcggccgaacgcauggagaaacugcaguaugcugucagcaaggagacccuccaaaugaugagagccaaggaaauuugccuggagcagcggaaacacgcccugaaggaagagaugcagucccucagagggggaaccgaagcuaucgcccgccuggaccagcuugaggcggauuacuaugaccugcaacuccagcuguacgaggugcaguuugaaauccugaaaugugaggaacuucuccugacagcucaacuggagucuauuaagcggcucaucagcgagaaaagagaugaaguuguguauuacgacacguacgaguccauggaagccaugcuggagaaggaagagauggccgcuucugccuaucuucagcgcgaggaacugcagaagcuccagcaaaaagcgagacagcuggaggcucggcgcggcagagucagcgccaagaaauccuaccugcggaauaagaaagaaauuugcaucgccaagcauaacgagaagauucagcagcgcaccagaaucgaagacgaguaucggacacaccauaccgugcaacuuaaacgcgagaagcuccacgaugaagaggaaagaaaaagcgcuugggucucucaggagcggcagcgcacacuggacagacugcggaccuucaagcagagauaccccgggcaagugauccucaaauccacgcgccugcggcuugcccacgcuagacgcaagggagccgcgagcccgguucugcaggaagaucauugugacucucucccuuccgugcugcaggucgaggagaagacagaagaggugggcgaagggcggguuaaaagaggccccagccaaaccaccgagccucagucucuggugcagcuugaggauacaagccucacccagcuggaagccacaucccugccccucagcggagucacgucugagcugccucccaccauuucccuuccgcugcucaauaacaaucuggaaccuugcagcgugacaaucaacccccugcccuccccucuuccgcccaccccucccccucccccucccccgccucccccucccccgccucccccucuccccguggcuaaggacucuggccccgagacacuggaaaaagaucugccucgcaaggaggggaaugagaaacggauucccaagagcgccuccgcucccucugcccaccucuucgacagcucccaacugguuucugccagaaagaaacuucgcaagaccgcugaaggacugcagcggagacgggucagcuccccuauggaugaggugcucgcgagccugaaacgcggcucuuuucaucugaagaaaguggaacagagaacgcuucccccuuuccccgacgaggaugacuccaacaauauccuggcccagauucggaagggggucaaacucaagaaggugcaaaaagauguucugcgcgagagcuuuacccuccugccugacacagacccgcuuaccagaucuauccacgaagcucugcggagaaucaaggaggccucccccgaaagcgaggaugaagaggaagcccucccuuguacagacugggagaacuga

SEQ ID NO: 70961 - RNA, 390 nt, Artificial Sequence
  derived and/or modified sequence opt5 from JPH2__Homo_sapiens__NP_787109
augagcggcgggagauucgacuuugaugacggaggcgccuacugcgggggaugggagggcgggaaggcucacggacauggccuguguaccggccccaaagggcagggagaauauuccggcucuuggaacuucggguuugagguggccggagucuacacauggccuagcggcaauacguucgaaggguauuggucccaaggaaagcggcacggccucggcaucgagaccaaagggcgcuggcuguacaagggagaauggacacauggcuuuaaagggagauauggcauucggcagucuagcuccucuggagcgaaguacgaggggaccuggaacaauggacuucaggauggcuauggcacagagaccuacgcugacgggggaaugugcuga

SEQ ID NO: 70962 - RNA, 561 nt, Artificial Sequence
  derived and/or modified sequence opt5 from JPH3__Homo_sapiens__NP_001258533
augagcuccggcgggagauucaacuuugacgauggaggcucuuacugcgggggaugggaggacggcaaggcccacgggcauggaguguguaccggccccaaaggccagggggaauauacaggaagcuggucccacggcuucgagguccuggggguuuacacguggccuucuggaaauaccuaucaaggcacaugggcucaggggaagcggcauggaaucggccucgaaagcaaaggcaaguggguguacaaaggggaguggacccacggauuuaagggccgcuauggggugagagaaugcgccggaaacggcgcgaaguacgaggggacaugguccaauggacugcaggauggcuauggcaccgagacauacucugacggggaugcuaccgccuucggagccgaaccgggccccgaggcucgggaacuuccugccgcugccgcggccgcugccgcugccgcggccgcugccguccgcugguuucuguguagagagcccuggccugcucuccagcugcccgccugccuugacagcccuauuuccacgccgcaauguaccuga

SEQ ID NO: 70963 - RNA, 1887 nt, Artificial Sequence
  derived and/or modified sequence opt5 from JPH4__Homo_sapiens__NP_115828
augagccccggcgggaaguucgacuuugaugacggaggcugcuacgucgggggaugggaggccggcagagcucacggguauggaguguguaccggcccuggcgcccagggggaauacuccggaugcugggcgcauggcuucgagucucuggggguuuuuacaggaccgggcgggcacagcuaucaaggacauuggcagcagggcaaacgggaaggccucgggguggagcgcaaguccagauggacguaccggggagaauggcugggcgggcuuaaaggacgcucuggcgugugggagagcgucuccgggcugagauaugcuggacucuggaaggauggcuuccaggacggcuacgggaccgagacauauucugauggaggcaccuaccaagggcaguggcaggccggaaaacggcacggcuacggggugcgccagagcguucccuaucaucaagccgcucugcuuagauccccucggcgcacaagccuggacucuggccacuccgaucccccuacacccccuccgccccucccucugcccggagacgaaggcgggagcccugccucuggauccagaggcggguuugugcuggcuggacccggcgaugccgacggggcgagcucucggaagcgcaccccggccgcuggcggauucuuuagacggucccuccugcuuagcggccugcgcgccgggggaagacgguccucucucggcagcaagagagggucccugcgcagcgaggucucuuccgaagugggaagcaccggcccucccgggucugaggcuagcggcccucccgccgcggcucccccugcccuuaucgagggauccgccacggaaguuuacgcuggcgaguggcgggccgauagacgcucuggguucggagugagccagcgguccaacggccugagauaugaaggggaguggcucggaaaucgccggcacggcuacgggagaaccacacgcccggacggcagccgggaagagggaaaauauaagagaaaccgccugguccauggcgggcgggugagaucucugcucccccuggcccuucggcgcggaaaagugaaggagaaagucgauagagcuguugaaggcgcgcggagagccguguccgcugcccgccagcggcaggagauugccgcugccagagcggcugacgcccugcucaaggccguggcugccagcucugucgcugaaaaggccguggaggcggcccgcauggcuaaacugaucgcccaagaccuucagccuaugcuggaagcucccgggagacggccucgccaggauuccgagggaagcgacaccgagccccucgaugaagacuccccgggcguuuacgagaauggccugacaccuucugaagggagccccgagcugccuuccucucccgccagcuccagacaaccuuggcggcccccggcgugucgcagcccucucccucccggaggcgaucaggggcccuuuucuuccccgaaggccuggcccgaagaguggggaggcgcuggggcccaggcugaggaacuggccggauaugaggccgaagacgaggcuggcaugcagggcccugggcccagagauggaagcccucuucugggcgggugcucugacuccagcggaucucuccgggaggaagagggcgaagaugaggaaccccugccuccccuucgcgcgccggccgggaccgagccugagcccauugcuaugcuggugcucagaggaagcuccagccggggcccugacgccggcugucugacggaggaacugggggaacccgccgcuacagagcgcccggcccaaccuggagcggcuaacccccucgucgugggcgccguugcccugcuugaucugucucucgcuuuccuguuuucccagcugcuuaccuga

SEQ ID NO: 70964 - RNA, 1671 nt, Artificial Sequence
  derived and/or modified sequence opt5 from JRK__Homo_sapiens__NP_001070995
auggccagcaagcccgcugccggcaaauccagaggggagaagcggaaacgcgugguccugacccucaaggagaaaaucgacauuugcacaagacuggaaaagggagaaucucggaaggcgcuuaugcaggaguacaacguuggcaugagcacgcuguaugauauccgcgcucacaaagcccaacuccugagauucuuugccuccucugacagcaauaaggcucuugaacagcggcgcacccugcauacaccuaaacucgagcaccuggauagagugcuguacgagugguuccucgggaagcgguccgaaggagugccggucucuggccccaugcugauugagaaagccaaggacuuuuaugaacagaugcagcuuaccgagccuuguguguucagcgggggauggcuguggcgcuuuaaggcuagacauggcaucaaaaagcucgaugccuccagcgagaaacaaucugcggaccaccaggccgcugaacaguucugcgccuuuuuccggucccuggcugccgagcauggccuuagcgcggaacagguuuacaacgccgaugagacagggcuguuuuggcgcugucuccccaauccuacccccgaaggaggcgcugugccugggccgaagcaaggaaaagacagacugacaguccugaugugcgccaacgcuaccggcucucaccggcucaagccccuggccauugggaaauguuccggaccucgcgccuucaagggcauccagcaccuucccguggcuuauaaggcgcagggcaaugccuggguugauaaagagaucuuuagcgacugguuccaucacauuuuugugccuucugucagagagcauuuccggacgaucgggcugcccgaagauuccaaggcugugcuccugcuugacagcuccagagcccacccgcaggaggccgaacuggugucuagcaacgucuucaccauuuuucucccugcuuccguugccagccuggugcaacccauggagcagggaauccgccgggauuucaugagaaauuuuauuaacccucccgugccccugcagggcccucacgcgcgcuacaauaugaacgacgcuaucuucucugucgccugcgccuggaaugcugugccgucccauguuuuucggagagccuggcgcaaacucuggcccagcguggcuuucgccgaagggucuagcuccgaggaggaacuggaggcggaauguuuuccugucaagccccacaacaaaucuuucgcccauauucuugagcuggugaaggaaggaagcuccugcccuggccaacuccggcagagacaggcugccagcuggggaguugcugggcgcgaggccgagggcggccggcccccggcggccacaucuccugcugaaguggucugguccagcgagaagacccccaaagccgaccaggaugggagaggagacccuggcgaaggggaggagguggcuugggaacaagccgccgucgcuuuugaugcggugcugcgcuucgccgagcggcagcccuguuuuucugcucaggaaguuggacagcuuagagcccugcgggccguguuccgcucccaacagcaggagacagucggccucgaagacgugguugugaccagcccugaggagcuggcuauccccaagugcugucuggaagccuccacggagacauga

SEQ ID NO: 70965 - RNA, 996 nt, Artificial Sequence
  derived and/or modified sequence opt5 from JSRP1__Homo_sapiens__NP_653217
augagcaugaccacaagagccugggaggaacuggacggcgggcucggauccugccaggcucuggaggaucacucugcccuugcggaaacgcaagaggaccgggcuagcgccacaccccgccuggccgauuccggcucugugccucaugacagccaggucgcugaagggccguccguugauaccagacccaagaaaauggagaaggagccugccgcucggggaacccccggcacagggaaagaacgccucaaggccggagcgucuccuagaagcgugcccgcccggaaaaaggcucagaccgccccuccgcugcagcccccucccccucccccggcucuuuccgaggaacugccuuggggcgaccucagccugaacaagugucuggugcucgccucucuggucgcgcuucugggcuccgccuuccaacucugccgcgaugcugugcccggggaggccgcucugcaggccagaguuccugagcccugggugcccccuagcucugccccgcgggaacccuccagcccucuucccaaauuugaggcucaggcgccucccucugccccgccugcuccccgcgccgaagccgaggucagaccuaagauccccggaucccgggaagcugccgagaaugacgaggaagaaccuggcgaagcgacaggggaggcugugcgcgaagauagaguuacccuggccgaccggggacccaaagagcgcccgagacgggagggcaagccuagaaaagaaaagccccgcaaggaggaacggcccaaaaaggagagaccucgcaaagaggagcggccgagagccgcucgcgagccccgggaagcccucccucagagaugggagagccgcgaagggggacaccggcccugggcuagagauucccgcgacgccgagccucggaagaaacaagcgugggugucucccagacggccugaugaggaacagcgccccggcagcagacagaagcugcgggccggcaaagggagagacuga

SEQ ID NO: 70966 - RNA, 441 nt, Artificial Sequence
  derived and/or modified sequence opt5 from JTB__Homo_sapiens__NP_006685
augcuggccggcgcugggagacccggacucccucagggccggcaccugugcuggcuucugugugccuucacccucaagcugugccaagcggaggcuccggugcaggaagagaaacuuagcgccuccacaucuaaccugcccuguuggcucgucgaagaguuuguuguggccgaagagugcagcccuuguuccaauuuccgcgcuaagacgacccccgagugcgggccuacaggauacguggagaaaaucaccuguucuagcuccaagagaaacgaauuuaaaucuugccggagcgcccugauggaacagcgccuguucuggaaguuugagggcgcugucguguguguugcccucauuuucgcgugccuggugaucauuagacagcggcaacuugaccgcaaggcccuggagaaagucagaaagcagaucgaauccauuuga

SEQ ID NO: 70967 - RNA, 1044 nt, Artificial Sequence
  derived and/or modified sequence opt5 from JUNB__Homo_sapiens__NP_002220
augugcaccaagauggagcagcccuucuaccacgacgauagcuauacagccacgggcuacgggagagcuccuggaggccugucccuccaugacuauaaacugcuuaagccgucucuggccgugaaccucgcggaucccuaccggagccugaaagcuccuggggcccgcggacccggcccugaagggggaggcggcggguccuauuuuucuggacaaggcagcgacaccggggccucccuuaagcuggcuucuagcgagcucgaaagacugaucguccccaauuccaacggaguuauuacaaccacaccuaccccgcccggccaguacuucuauccucgcgggggaggcagcggcgggggagccggcggggcuggaggcggggugacagaggaacaggagggauuugccgauggcuucgugaaagcgcuggacgaucuccacaagaugaaucaugucacgcccccuaacgugucucugggcgccaccgggggacccccggcuggcccugggggaguuuacgccggccccgagccuccucccguguacaccaaucuuuccagcuauucucccgcuuccgccagcucugggggcgcgggagccgcugucggcacaggguccagcuacccgaccacaaccaucuccuaucugccccacgccccucccuuugcuggaggccauccugcccagcucgggcugggacggggcgccucuacguucaaggaggaaccccaaacagugccggaagcuagaagccgggacgcgaccccucccguuuccccuauuaacauggaggaucaggagcgcaucaaaguggaaagaaagcggcuucgcaauagacuggccgcuacaaaaugucggaagcgcaaacucgagagaauugcccggcuggaagacaaggucaagacccugaaagccgagaacgcugggcucagcucuaccgccggccugcuucgcgaacagguggcgcagcugaagcaaaaagugaugacacacgucuccaauggaugccagcuccugcuuggcguuaaggggcacgcuuuuuga

SEQ ID NO: 70968 - RNA, 1044 nt, Artificial Sequence
  derived and/or modified sequence opt5 from JUND__Homo_sapiens__NP_005345
auggagacccccuucuacggcgacgaagcccugagcgggcucggaggcggggcuuccggaucuggcgggagcuuugccuccccuggaagacuguucccgggcgcgcccccuacagcugccgccggcucuaugaugaagaaagaugcucuuacgcugagccucuccgaacagguggccgcugcccugaagcccgcggccgcuccucccccuaccccgcuucgggccgacggggcucccucugccgcgccucccgauggacugcucgccagcccugaccugggccugcucaaacuggcuucccccgaacuugagcgccugaucauucaaagcaacgggcucgucacaaccacaccgaccucuucccaguuucuguauccuaagguugccgcuagcgaggagcaggaguucgccgaaggauuugugaaagcccuugaggaucugcacaagcagaaucaacucggcgcuggggcggccgcugccgccgcugccgcggcugccggaggccccucuggcacagccaccggguccgcuccucccggagaacuggcccccgcugccgcggccccugaggcuccgguguacgccaaccugagcucuuaugcuggcggggccggaggcgccgggggagcggcuacggucgccuucgcugccgagcccgugccuuuucccccucccccgccucccggcgcccucggcccucccagacuggcugcgcuuaaggacgaaccucagaccguucccgaugugccguccuucggggagagcccuccccugucccccaucgacauggauacacaggaacggauuaaagccgagcgcaagagacuccggaaucgcaucgcugccucuaaaugcagaaagcggaaacuggaacgcauuagcagacuugaggagaaggucaagacccugaaaucccagaacacagaacucgccagcaccgcuucucugcugcgggagcaaguggcccagcucaagcagaaaguucugucccaugugaauagcggaugucagcuucugccucaacaccaggucccggcguacuga

SEQ ID NO: 70969 - RNA, 2238 nt, Artificial Sequence
  derived and/or modified sequence opt5 from JUP__Homo_sapiens__XP_006721941
auggaggugaugaaccugauggaacagcccaucaaggucaccgaguggcaacagacauacacguaugacagcggcauucacuccggggccaauaccugcguuccuucugugagcuccaaaggaaucauggaagaggaugaagccuguggcagacaguacacacucaagaaaaccacaaccuauacacagggggugccgcccucucaaggagaccuggaguaccagaugagcaccacggcccgggcgaagcgcgucagagaggcuaugugcccuggcguguccggggaagauucuagccuucugcucgccacccagguugagggacaggccacaaaccugcaacggcuugcugaacccucccagcugcucaaaagcgccauugugcaucugaucaauuaucaggacgaugcugagcuggccacccgcgcgcucccugagcugacaaaacuucugaacgacgaagaucccgucgugguuaccaaggccgcuaugauugugaaucagcucucuaagaaggaggccuccagacgggcucugaugggcagcccucaacuugucgccgcgguggugcgcacgaugcagaacacaucugaccuggauaccgccagauguacaaccuccauccuccacaaucugagccaucaccgggaaggccugcucgcuaucuucaaaucugggggcauuccggcccugguccgcaugcuuuccagccccguugaguccgugcuguuuuacgcuaucaccacacuccauaaccugcuucuguaucaggaaggagccaagauggccgugagacucgcugacgggcugcagaaaauggucccucugcucaauaagaacaaucccaaguuccuggcgauuacgaccgauugccuucagcugcucgccuacggaaaccaggagucuaaacugaucauucuugcuaauggcgggccucaggcccuggugcaaaucaugcggaacuacagcuaugagaagcuccuguggacaaccucccgcguucugaaagugcucagcgucugucccucuaauaagccggccauuguggaagcuggaggcaugcaggcccugggcaaacaccuuacauccaacagcccuagacugguucagaacugccucuggacccugcggaaucugucugacguggcgacgaagcaggaggggcuugaaagcguccucaaaauccuggugaaccaacuguccgucgaugacgugaauguucucacaugugcuaccggaacccugucuaaccuuacaugcaauaacagcaagaauaagacccuggugacacagaacuccggcgucgaggcccucauccacgccauucugcgcgcuggggacaaagaugacaucacggaacccgccgugugugcucugagacaucuuaccagccggcacccugaggccgagauggcgcaaaauucuguuagacucaacuacggcauucccgccaucgugaagcugcugaaucagcccaaccaauggccucucgucaaagcuacaauuggacugauccgcaaucuugcccugugcccggcuaaccaugcuccccuccaggaagcggccgugaucccucggcuggugcagcugcuuguuaaggcucaccaggaugcccaaagacacgucgcugccgggacccagcagcccuauacagacggagugcgcauggaggaaauuguggagggcuguaccggcgcccuccauauccuggcucgggauccuaugaauagaauggaaauuuuucgccugaacacgaucccccucuucguccaacugcuuuacuccagcguggagaacauucagcggguugcggccggggugcugugcgagcucgcucaggacaaagaagccgccgaugcuaucgacgccgagggagcgucugcuccgcugauggaacugcuucacuccagaaaugagggcaccgccacauaugccgcugccguccucuuucgcaucagcgaggauaagaacccugacuaccggaagagaguguccguugaacugaccaauucucuguucaaacaugaucccgcggcuugggaggccgcccagagcaugauuccuaucaacgaacccuauggggacgacauggaugcuacauaccgcccuauguacuccucugacgugccccucgauccgcuggagaugcacauggacauggauggagacuauccuauugauaccuacagcgacggccuucggccucccuaucccacggccgaucauaugcuggcuuga

SEQ ID NO: 70970 - RNA, 2043 nt, Artificial Sequence
  derived and/or modified sequence opt5 from KAL1__Homo_sapiens__NP_000207
auggugcccggcgucccuggggccguucugacccucugccuguggcuugcugccagcuccggaugucuggcggcuggcccgggggccgccgcugccagacggcucgacgagucucugagcgcuggauccgugcagcgcgccagaugcgcgucucggugucuuagccugcaaaucacacgcauuuccgccuucuuucagcacuuccagaacaauggcucucucguguggugccagaaccauaagcaauguagcaaaugccuggaacccuguaaggaguccggggaucugagaaaacaccagugccagagcuuuugugaaccucucuuccccaagaaaucuuacgagugccugacguccugugaauuucuuaaguauauccugcucgucaagcagggagacugcccugcucccgagaaagccagcggcuucgcugccgcgugcguggagucuugugaaguugauaaugagugcuccggcgugaagaaauguugcagcaacggguguggacauaccugccaagucccuaagacacuguacaaaggcgugccgcuuaagccccggaaggaacugcgcuuuaccgagcuccagucugggcagcuggagguuaaaugguccagcaaguucaauauuuccaucgaaccugugauuuaugucgugcagagacgguggaacuacggaauccaccccucugaggacgaugccacacauuggcaaaccguggcucagacaaccgacgaacgcguccagcugacggauaucagaccuagccggugguaucaauuucgcguugccgcugugaaugugcacggcaccagaggguucacagcccccuccaaacacuuucggagcucuaaggacccguccgccccucccgcuccugcgaaccuccgccuggccaauagcaccgucaacucugauggaagcgugacaguuaccauugugugggaccuucccgaggaacccgauaucccuguccaucacuacaaaguguucugguccuggaugguuucuagcaagucccuggugccgacgaaaaagaagagacggaaaacaaccgacggcuuucagaauagcgucauucucgagaagcugcagcccgauugugacuauguggucgagcuucaggcuaucacauacuggggccaaaccagacugaaaucugccaaggugucccuccauuucaccagcacacacgccacgaacaauaaagaacagcugguuaagacccgcaagggagggauucagacacagcugccuuuccaacggagacgccccacccggccucucgaggugggcgcucccuuuuaccaggacgggcagcugcaggucaaaguguauuggaagaaaacagaagauccgaccguuaacagauaccacgugcgcugguucccugaggccugcgcgcauaaucggacgacaggaucugaggcuuccagcggcaugacccacgaaaacuauaucauucuucaagaccuguccuuuucuuguaaguacaaagucaccgugcagcccaucagaccuaagagccauuccaaggccgaggccguguucuuuacaacacccccuugcucugcucucaaaggaaagagccacaaacccguugggugucugggcgaagccggccauguccuuuccaaggugcuggcuaaaccggagaaccucagcgccucuuucaucgugcaggaugucaauauuaccgggcacuuuuccuggaagauggcgaaggccaaccuguaucagccuaugacgggauuccaagugaccugggcugaaguuacaaccgagagccgccaaaauucucugcccaacuccaucauuagccagucucagauccuccccagcgaccacuacgugcugacagucccuaaucuucggccguccacccuguauagacucgaagugcagguucugacgcccggcggggagggaccugccaccauuaaaacauuucgcacccccgagcugccucccagcucugcucaucggucccaccuuaagcauagacacccucaccauuacaaacccagcccggaacgguacuga

SEQ ID NO: 70971 - RNA, 8961 nt, Artificial Sequence
  derived and/or modified sequence opt5 from KALRN__Homo_sapiens__NP_001019831
augaccgacagauucugggaucagugguaccugugguaucuccggcugcuuagacugcucgacagaggcagcuuucggaaugaugggcugaaggccagcgacgugcuucccauccugaaggagaaggucgcuuucguuucuggaggccgcgauaagagagggggaccuauucucaccuuuccggcccggagcaaucacgaccgcaucagacaagaagaucugcggaagcuggugacguaccucgccuccgugcccucugaggacgucugcaaacgcggcuucaccgugauuaucgauaugagagggagcaagugggaccugauuaagccucuucugaaaacacuccaggaggcuuuucccgccgagauccacguugcccugaucauuaagccugauaacuucuggcagaaacagaagaccaauuuuggauccucuaaauucaucuuugaaacaagcaugguguccgucgagggccuuaccaagcugguggaccccagccaacucacagaggaguucgauggcucucuggacuauaaccacgaggaauggauugagcugcggcucucccuggaggaauuuuucaauagcgcuguucaccuucugucucgccucgaggaccugcaggaaaugcuugccagaaaggaguuuccuguggaugucgaagggucccggcgccugaucgacgagcacacccagcucaaaaagaaagugcugaaggcuccgguggaggaacuggauagagagggacagcggcuccugcaauguauuagaugcagcgacggcuucucugggcgcaacuguauccccggauccgccgauuuccagagccuugucccuaaaauuacgucccugcucgacaagcugcauucuacccggcagcaccuucaccagauguggcauguuagaaaacugaagcucgaucaaugcuuucagcugcgccuguucgaacaggacgcggagaagauguuugauuggaucagccacaauaaagaacucuuccugcaaucccauacagagaucggcgugagcuaccaguaugcccuugaccugcagacccagcacaaccacuuugcuaugaacucuaugaacgccuacgugaauauuaaccggaucauguccgucgcuagcagacucucugaggccgggcauuaugcgagccaacagauuaagcagaucuccacacagcuggaucaagaauggaaaucuuucgccgcugcccuggacgagcgcagcaccauucuugcuauguccgccguguuucaccagaaggccgaacaguuccucagcggaguugacgcuugguguaaaaugugcucugagggcggccugcccuccgaaaugcaggaucuggagcucgcgauccaucaccaucaaacgcuguacgaacaagugacacaggccuacaccgaagucagccaggacgggaaggcccuucucgaugugcuccaacggccucugucucccggaaauuccgagagccugacagcuaccgccaacuauuccaaggcuguucaccaggugcuugacgucgugcacgaaguccuccaucaccagagacgccuggagucuaucuggcaacaucggaaagugagacugcaccagcgccuccagcuguguguuuuucagcaagaugugcagcagguccuugacuggauugagaaucacggcgaagccuuccugagcaagcauaccggggugggaaaaucccuccaccgggcgagagcucugcagaagcggcaugaugacuuugaggaaguugcccaaaacacauacacgaacgccgauaaacugcuugaggcugccgaacagcucgcucagaccggcgagugcgacccggaggaaaucuauaaggccgcgcgccaccuggaggugcgcauucaggauuucguccggagaguggaacaacgcaagcugcuccuggacaugucugugagcuuucauacacacaccaaagagcuuuggacauggauggaagaucugcagaaggagaugcucgaggacguuugugccgacuccgucgaugcugugcaggaacugaucaaacaauuccagcagcagcaaaccgccacgcuggacgcuacacuuaaugugauuaaggagggggaagaucucauccagcagcugcggagcgccccucccucucugggagagccuuccgaagcgagagacagcgccgucucuaacaauaaaacaccccacuccagcucuaucagccauauugaguccgugcuccagcaacuggaugacgcucagguucagauggaggaacuuuuccacgagcgcaagaucaagcuggauauuuuucuccagcugagaaucuucgaacaauacaccauugaggugacagccgagcuggacgcuuggaacgaagaucuucugcggcagaugaaugacuuuaacaccgaggaucucacacuggccgaacagcgccuccagagacauacggagcggaaacuggccaugaauaacaugaccuucgaagucauccaacagggccaggaccuucaccaauauauuacagaggugcaggcuagcggcaucgagcugaucugcgaaaaggauauugaccucgcggcccagguucaggagcugcuggaauuucuucaugagaaacaacacgaacuggagcucaaugcugagcagacccacaagcgccuggaacagugucuccagcugagacaucuucaagccgaggugaaacagguccugggguggauccggaacggagaaucuaugcucaaugccucccuggugaacgcuagcucccugucugaggccgaacagcuucagcgcgagcacgagcaauuccagcuggcgauugaaagccucuuucaugcuacaucccugcagaagacccaccaaucugcccuccagguucagcagaaagccgaggugcugcuucaagcuggccacuacgacgccgaugcgaucagagaaugcgcugagaaggucgcccugcauuggcagcagcugaugcucaagauggaggaccggcugaaacuugugaaugccagcguggcuuucuauaagacguccgaacaggucugcucuguucuggagagccucgaacaagaguaccgcagagaugaagacuggugugggggacgggauaaacugggccccgccgcugagauugaccacgugaucccucucaucuccaagcaucuggagcagaaagaagccuuucuuaaggcgugcacccuggccagacgcaacgcugagguguuccugaaguacauucaccggaauaacgucagcaugccgucuguggccucccauacaagagggcccgaacagcagguuaaagcuauccucagcgagcugcuucaacgcgaaaaccgggugcugcacuuuuggacccucaagaaaagacgccuggaucagugucagcaguaugucguguucgagcggucugccaagcaagcccucgacuggauucaggagacaggcgaauuuuaccuguccacccacacgagcacaggagagaccacagaagagacccaggaacuucugaaagaguauggcgaguucagaguuccugcuaagcaaaccaaggaaaaagugaagcugcucauccagcuggcggauucuuucgucgagaaagggcauauucacgccacagaaauccgcaagugggugacgaccguugacaaacauuaccgggauuuuucccuuagaaugggaaaguaucgguacagccuggagaaggcucucggcgugaauacagaggacaacaaagaccuggaacucgauaucauucccgccucccugagcgaccgcgaggucaaacuuagagaugccaaucacgaagugaacgaggaaaaacggaagucugcucgcaaaaaggaguucaucauggccgagcugcugcagaccgaaaaagcguaugugagagaccuccacgagugccuggaaacauaccuuugggagaugaccagcggggucgaagagauuccucccggaauccugaauaaggagcauauuaucuuuggcaacauccaggaaauuuacgauuuccacaauaacaucuuucucaaggagcuggaaaaauaugagcaacugccggaagacguugggcauuguuucgugacgugggcugauaaguuucagauguacgugacauauugcaaaaauaagccugacuccaaccagcucauucuugagcacgccggcaccuucuuugaugagauccagcaacggcauggacuggccaauucuauuagcuccuaccugaucaaacccguccagagaauuaccaaguaucagcuccugcuuaaggaacugcucacauguugcgaggaaggcaaaggggagcugaaggacggacuggaggugaugcucucuguuccuaaaaaggcuaacgaugccaugcacgugagcaugcuugaaggcuucgacgagaaucuggauguccagggggaacugauccuccaagacgcguuucaggugugggaccccaaaucccugauccgcaagggacgggagagacaccuuuuccuguucgaaauuucucucguuuuuagcaaggagaucaaagauuccagcggccauaccaaguacguguauaaaaacaagcugcugacaucugagcucggggucacggaacacguggagggcgacccuuguaaauucgcucuuugguccggacgcacccccagcucugauaauaagacaguccugaaggccuccaacauugaaaccaaacaggaguggaucaagaacauucgggaagugauccaagagagaaucauucaucugaaaggcgcccucaaggagccgcugcagcuuccuaaaacacccgcuaagcagcgcaauaacagcaagcgggacgggguugaagauaucgacucccagggagauggcucuagccaacccgacaccauuuccaucgccagcagaacgucucagaauaccguggauuccgacaaacugagcgggggaugcgagcucacagucgugcugcaggauuuuucugcuggccacagcuccgaacugaccauucagguugggcaaacaguggagcuccuugaacgcccuucugagagaccgggcuggugucugguccggaccacagagcgcucucccccucuggaaggacucgugcccuccuccgcccugugcaucagccacuccagaagcucuguggagauggacugcuucuuuccucuuguuaaggaugcguacucccauagcuccucugaaaacggcgggaaaagcgaguccgucgccaaucugcaggcucagcccucucucaacagcauccacuccagcccuggacccaagcggucuaccaauacgcugaaaaaguggcugacauccccggugcgcagacucaacagcggcaaagccgacgggaauauuaagaagcagaaaaaggugcgggacggaagaaaaucuuucgaucuuggcuccccuaagcccggcgacgagaccaccccucaaggggauagcgcugacgaaaaaucuaagaagggauggggcgaggaugaacccgacgaggaaagccauacaccgcugccucccccuaugaaaaucuuugauaacgaccccacccaggaugagauguccucuagccugcucgccgcccgccaggcuuccacggagguccccacagcggccgaccuggugaaugcuauugaaaaacuuguuaaaaacaagcugagccucgagggguccucuuaccggggaagccugaaagauccugccggcugucugaaugaagggauggccccgcccaccccucccaagaacccugaggaagaacaaaaggcuaaagcccucagaggacgcauguucgugcuuaaugagcugguccagacagaaaaggacuaugugaaagaccugggcaucguuguggagggcuuuaugaagcggauugaagagaaagggguccccgaagauaugagaggaaaggacaagaucguguucggcaacauucaccagaucuacgauuggcauaaagacuuuuuccucgcggagcuggagaagugcauccaggaacaagaucggcuugcucagcuguuuauuaaacacgagcgcaagcuccacaucuauguuugguacugucagaacaaaccuagauccgaauauauuguggccgaguacgacgccuauuucgaggaagucaagcaggagaucaaucaacggcugacccugucugauuuccucauuaaaccgauccagcgcaucacaaaguaccagcuucugcugaaggacuuucucagauacagcgaaaaagcugggcuggagugcuccgauauugaaaaggccguggagcuuaugugucuggugcccaaacggugcaacgacaugaugaaucucggacgccugcagggcuucgaggggacccugacggcgcaaggaaagcuccuucagcaggauaccuuuuaugucaucgaacuggacgccggcaugcagucuagaacaaaagagcggcgcguuuuccuguuugaacaaauugugaucuucagcgagcuccugagaaagggcucccuuaccccuggguacauguuuaagcggagcauuaaaaugaacuaucuggugcucgaagagaaugucgauaacgaccccuguaaguucgcucugaugaauagagagacaucugaacgcgugguucugcaggccgcuaacgccgacauccagcaggcuugggugcaggauaucaaucagguccucgagacccagcgggacuuucuuaacgcccugcaauccccuauugaauaccagagaaaagagcgcagcacggcggugaugcggucucagcccgccagacugccgcaggcuuccccucgccccuauagcucuguucccgccggauccgaaaagccucccaaaggcagcuccuacaauccuccgcugcccccucugaagaucagcacaucuaacgggagccccggauucgaguaucaucaaccuggcgauaaguuugaggcuuccaaacagaaugaccuugggggaugcaacggcaccucuagcauggccgugauuaaggauuacuacgcccugaaagaaaaugagaucugugucucccagggcgaagugguccaggugcucgcuguuaaccaacagaauaugugccugguguaucagcccgcgucugaccacagcccggccgcugaggggugggugccuggauccauucuggcgccccucacaaaggccaccgcugccgagucuagcgauggcuccaucaaaaagagcuguucuuggcauacccugcggaugagaaagcgcgcggaagucgagaacacagggaaaaacgaagccacgggaccucggaagcccaaagacauucuuggcaauaagguuuccgugaaagagaccaacagcucugaagaguccgagugcgaugaccuggauccuaauacaagcauggaaauccucaaccccaauuucauccaagagguggcuccggaauuucuggucccucuuguggacguuaccugccugcucggggacacagugauucugcaguguaaggucugcggaagacccaaacccaccaucacguggaagggcccugaucagaacauucuggacacagauaauuccucugccaccuacaccgugagcuccugugacagcggcgagaucacacucaagauuugcaaccugaugccgcaggauucugggaucuauaccuguaucgcuacaaaugaccacggaacgaccuccacaagcgccaccgucaaagugcaaggcguucccgcggccccuaaccgccccauugcucaggaacggucuugcacaagcgugauccuuagauggcugccucccuccucuaccgggaauuguacgauuagcggauacaccgucgaguaucgcgaggaaggcucccagaucuggcagcaaucuguggccagcacacucgauaccuaccugguuauugaggaccuuuccccugggugcccguaucaguucagagugagcgcuucuaaccccuggggaaucucccugccuagcgaacccuccgaguucguccggcucccugaauacgaugccgcugccgacggcgcgacaaucucuuggaaggagaauuuugauagcgccuacaccgagcugaacgaaauuggccgcgggagauucuccaucgugaaaaaguguauucauaaagcuacacggaaggacguggccguuaaguuugucucuaaaaagaugaaaaagaaagagcaggcugcccacgaagccgcgcugcuccagcaucugcaacauccccaguauaucacgcuucacgauaccuacgagagcccgacauccuauauucugauccucgagcugauggacgacggaagacuucuggauuaccucaugaaucaugacgaacugauggaggaaaagguggcuuucuauauucgggauaucauggaggcccugcaguaccuccacaacugccgcguggcucaccuggacaucaagccugaaaaccuucugauugaucucagaauccccgucccccggguuaaacugauugaccuugaggaugccgugcagaucagcggccauuuucacauucaucaucugcucgggaauccugaguucgccgcucccgaagugauccaaggaaucccugucucucugggcaccgacauuugguccaucggggugcugaccuauguuaugcucagcggagugucuccguuucuggaugaguccaaggaagagacauguauuaacgucugccgcguggacuucagcuuuccccaugaauacuucugcggcguuucuaaugccgcgagagauuuuaucaacgugauucuucaggaggacuuccggcgcagaccuacggccgcuaccugucugcagcaccccuggcuccaaccucacaauggcuccuacagcaaaaucccccuggauacaucucggcuugccugcuuuaucgagcgcagaaagcaucagaacgacguccggccgauuccuaaugugaaaagcuauaucgugaaccgcgucaaucaggggaccuga

SEQ ID NO: 70972 - RNA, 4059 nt, Artificial Sequence
  derived and/or modified sequence opt5 from KANK1__Homo_sapiens__NP_001243806
auggcccacaccacaaaggugaacggcagcgcuuccgggaaagccggagacauccugucuggcgaucaggacaaggagcaaaaagaucccuacuucgucgaaacgccuuauggguaccagcucgaccuggauuuucuuaaguauguugacgauauucagaaaggaaauaccaucaagagacugaacauucagaagcggcgcaaaccgagcgugcccugcccugagcccagaacaaccuccggccaacaggggaucuggacaucuaccgaaagccucuccucuagcaauuccgacgauaacaagcaguguccuaauuuccugauugcgcggagccaggugacaucuacccccaucuccaaaccuccgcccccucuugagacgagccugcccuuucucaccaucccugaaaaccgccaacugcccccgccuucuccccagcugccuaagcauaaucuccacgucacaaaaacccugauggagacaagacggcgccuugagcaggaaagagcuaccaugcagaugacgcccggagaguuccggcgccccagacuggccuccuuuggcggcauggggacaaccagcucucucccuuccuucgugggaagcggcaaccauaauccggccaagcaccaacugcagaacggguaccagggaaauggcgacuauggguccuacgcucccgccgcuccuacaaccucuagcaugggauccagcauucggcauucuccccuuuccagcggcaucucuaccccuguuacaaacgugagccccaugcaucugcaacacauucgcgaacagauggccaucgcgcucaagagacugaaagagcuggaggaacagguccggacgauuccggugcuccagguuaagaucuccgugcugcaagaggaaaaacgccagcuugucucucagcugaagaaucagagagccgcuagccaaauuaacgugugcggcgugcggaaaagauccuauagcgccgggaaugcuucucagcucgagcagcugucccgcgcccggagaagcggaggcgaacuuuacaucgauuacgaggaggaagagauggaaaccgucgagcagucuacacaacgcaucaaggaauuucggcagcugaccgcggacaugcaggcccucgagcagaaaauucaagauuccagcugugaggcuuccucugaacugagagagaacggggaaugccgcagcguugccgugggagcugaggaaaacaugaaugacaucguggucuaucaccggggcuccagaucuuguaaggacgccgccguggggacacugguugagaugcgcaacugcggagugagcgucaccgaggcuaugcucggcgugaugacggaagcggauaaggagauugaacugcagcagcaaacaaucgagucccuuaaagagaagauuuaccggcuggaaguucagcucagagagaccacccacgaccgcgaaaugacaaaacugaagcaggagcuucaggccgcuggcagccggaaaaagguggauaaggccaccauggcccaaccucuggucuucucuaaaguggucgaagcugugguucagacaagagaccagaugguggggucccauauggaucucgucgacacgugugugggaaccagcguugagacaaauucugugggcaucuccugccagcccgaguguaagaacaaagucguggggccugaacugcccaugaauugguggaucgugaaggagcggguugaaaugcacgaucgcugcgccggaagaagcgucgagaugugugacaaaucugugagcguggaagucuccgugugcgagaccggcagcaacacagaggaaucuguuaaugaucugacccuccugaagacgaaccuuaaucugaaggaggugcgguccauugggugcggcgacuguagcgucgaugugaccguuugcuccccuaaagaaugugcgucuagaggagugaacacagaggcugucagccaaguggaagccgccguuauggcugugccccgcaccgccgaccaggacacauccaccgaucucgagcagguccaccaguuuacgaauacagagaccgcuacacugaucgaaucuugcaccaacaccugucugagcacacuugacaagcaaacguccacccagacaguggagacccggacaguggccgucggcgaagggagaguuaaagauauuaauucuagcaccaagacgcgcuccaucggagugggcacacuccugagcgggcauucuggauucgacagaccguccgcggugaaaaccaaggagagcggcgucgggcagauuaacaucaaugauaacuaucuggugggccucaagaugcggaccaucgccugcggaccuccccaacugacaguuggccuuaccgcuucucgcagauccgugggggucggagacgaucccgugggcgagagccuggaaaacccucagccgcaggcuccccucgggaugaugacaggacuggaccacuacauugagcggauccagaaacugcuugccgaacaacagacgcuccuggccgagaauuauucugaacuggcggaggccuuuggcgagccucauucccagauggggagccucaacucccagcugauuagcacccuuucuagcaucaauuccguuaugaagucugcuagcacagaggaacugcgcaaccccgauuuccagaaaaccucccucggcaagauuacaggaaauuaccugggcuauaccuguaaaugcgggggacugcaaucuggcagcccucuuuccucucagacgagccagcccgaacaagagguggggaccuccgaaggaaagccuaucagcucucucgacgccuuucccacacaggagggcacccuguccccggucaaccugacagaugaccagauugcugccgggcucuacgccuguaccaauaacgagagcacacugaaaucuaucaugaagaagaaagauggcaauaaggacuccaacggagcuaaaaagaaucuucaguucgugggcaucaacgggggauacgaaaccacgagcuccgacgauucuagcuccgacgagagcagcuccagcgaaucugaugacgagugcgauguuauugaauauccucuggaggaggaagaggaagaggaggacgaagauacaagaggcauggcggaggggcaccaugccgugaauaucgaaggacucaaaagcgcucgggucgaggacgaaaugcaagugcaggagugugagcccgaaaagguggagauucgcgaaagauacgagcuguccgaaaagaugcugucugccugcaaccuucucaaaaauaccaucaacgauccuaaggcccugaccagcaaagacaugcgguucugccugaacacacuccagcacgagugguuucgcgucuccucucaaaagagcgcuauucccgccaugguuggcgauuauaucgcggcuuucgaggccaucuccccggacgugcugagauacgugauuaaucuugccgauggcaacgggaauaccgcucugcacuauagcgucucucauuccaacuuugaaaucgugaaacuccugcuggacgccgacguuuguaauguggaucaccagaacaaggcgggauacacgccuauuaugcuugcugcccuggccgcugucgaggccgaaaaggacaugcggaucguggaggaacucuucggcugcggggauguuaaugcuaaagccagccaggcgggacagacagcccugaugcucgcugugucccauggcagaauugacauggucaaggggcugcuugccuguggagcugaugugaacauccaagacgaugagggcucuaccgcccugaugugcgccagcgagcacggccacgucgaaaucgugaaacuccugcuggcucagcccggguguaauggacaucuugaggacaacgauggcuccacagcgcugucuauugcccucgaagcugggcacaaggacaucgccguucugcucuaugcccaugugaauuuugcuaaagcccagagcccuggaacaccccgccugggccggaagaccucccccgggccuacccacagaggaucuuucgauuga

SEQ ID NO: 70973 - RNA, 2556 nt, Artificial Sequence
  derived and/or modified sequence opt5 from KANK2__Homo_sapiens__NP_001129663
auggcccaggugcugcacguccccgcuccuuucccgggcacccccgggccugccagcccucccgcguuucccgcuaaggacccugauccgcccuacuccguugagacaccuuauggauacagacucgaccuggauuuccuuaaauauguggacgauaucgaaaagggccauacgcugcggcgcguggccguccaaagacggccccgccucucuagccugccuagagggcccggauccugguggaccucuacagagagccuuugcuccaacgccucuggcgacagccggcacuccgcuuacagcuauugugggcgcggauuuuacccgcaguauggcgcccuggaaaccagaggcggguucaauccucggguggagcgcacacuccuggaugcuagacggcgccuggaagaccaggccgcgacccccacaggacucggcucucugaccccuuccgccgcugggagcacggccucucuuguuggagugggccugcccccucccaccccgagauccagcgggcucucuacacccgucccucccuccgcuggacaucuggcccacgugcgggagcagauggcgggcgcccuucgcaaacugagacaacucgaggaacagguuaagcugauuccugugcugcaggucaaacucagcgugcugcaggaggaaaagcggcaacuuaccgugcagcugaagucccagaaauuucucggccaucccacagcugggagaggacgcucugagcugugccuugaucugccggacccucccgaggauccugucgcccucgaaacccggagcguuggcacgugggugagagagcgcgaccuggggaugcccgauggagaagcugcccuggccgcuaagguggcgguccucgagacacagcugaaaaaggcccuucaagaacugcaggcugcccaggcccggcaagcugacccucagccccaggccuggccgccucccgacucccccgugagaguugauaccgugcgcgucguggagggcccucgggagguugaaguggucgcgagcacagcugccggggccccggcucagagagcccaaucucucgagcccuacggaaccggccugcgcgcucuugccaugccuggccggcccgaauccccucccguguucagaagccaggaggucguggaaaccauguguccuguucccgcggccgcuacaucuaacgugcacauggucaaaaagaucagcauuacggagcgcuccugcgacggggccgcuggacugccggaggugccugccgaaucuagcuccucucccccuggcagcgagguugcgucccucacccagcccgaaaagagcacagggcgggugccgacccaggagccuacacacagagaacccacccggcaagccgcuucucaggaguccgaggaagccggaggcacagggggcccucccgcuggaguccgcagcaucaugaaaagaaaggaggaaguggccgaucccacggcccaucggagaucccugcaguuugugggcguuaaugggggauacgagucuagcuccgaggacucuagcaccgcugaaaacauuuccgauaaugacagcaccgagaacgaagcgccugagccgcgcgaacggguccccucuguggccgaggcuccucagcugagacccgccggcacagccgcugccaaaaccucccgccaagagugucagcucagcagagaaucucagcacaucccuacagcggagggggcuuccggaagcaauacggaagaggaaauccggauggagcugucucccgaucuuauuagcgccugccuggcccucgagaaguaucuggacaacccuaaugcucugaccgaacgcgagcuuaaaguggccuacacaaccguccuccaggaauggcugagacuggcgugucgguccgaugcucauccggagcucgugcgcagacaccugguuacauuccgggccaugagcgcccgccuucuggacuauguggucaacaucgcugauucuaauggcaacaccgcccuccacuacuccgugagccaugcuaauuuucccguugugcaacagcugcuggacuccggggucugcaagguggacaaacagaacagagccggcuauucuccuauuaugcuuacggcgcucgccacccugaagacacaagaugacaucgaaaccguucugcaacucuuccggcugggaaauauuaacgcuaaggccagccaggcuggccagacagcccuuaugcuggccgugucccacgggcgcgucgauguggugaaagcucuccuggcgugugaggccgacgucaacguucaggaugacgauggaucuaccgcucugaugugcgccugugagcauggccacaaggaaaucgccgggcuucuccuggcugugcccagcugcgacauuucccugacggauagagacggaucuacagcccucaugguggcgcuggaugcuggccagagcgagaucgccuccaugcuuuacagccggaugaauaucaaaugcucuuuugccccuauguccgacgaugaaagccccaccucuuccagcgcugaggaguga

SEQ ID NO: 70974 - RNA, 1104 nt, Artificial Sequence
  derived and/or modified sequence opt5 from KANK4__Homo_sapiens__NP_001307198
auggagaagaccgacgaaaucagccccuccacaucucugaaaagcauuaugaagaaaaaggauuacggcuucagagccgggggaaacggcacgaaaaagaaucuccaguuugugggggucaacggaggcuaugagaccacauccucugaagagaccagcggggaagacuccacaccugaggaucugucugacagcgaggcugaaaagaaaugcgauggaccggaccacaagcauguuaaagaugcccaccuuaccugugaggcgggccaaggcauccccgaagggacaugccaugcugcccaggaguccggaccuggcgaggaagugccccacagcaaggccgagcgguacaaaccuucugaagaguuccugaaugcuugucgcgcccucucccagcaucugcccgaaaccgggacgaccacagaccagcuucugagacaaagccucaacaccauuucucaggagugguuucggguguccagccgcaagucuuccagcccugcugucguggccuccuaucugcacgagguucagccgcacucuccccauuuccugaagcuccuggugaaucuugcggaucacaacggaaauacagcccugcauuacagcgucucccacagcaacuuuucuaucgugaaacuccugcuugaaaccggcguuugcaauguggaccaccagaacaaggcuggguauacggccgucaugauuacaccucuggcuuccgccgagaccaaugaagauauggcggugguguggaaacuccugagagagggaaacgucaauauccaagccacacagggcggccagaccgcucugaugcucgggguuagccaugaccgggaagauauggugcaggcccugcuuucuugucaagcugacgugaaccugcaggaccacgauggaagcuccgcccucauggucgccugccaucacggcaauguggaccugguucgccuucugcucgcucaucccgcgugugauucuagccugaccgacaaggccgggagaacagcucuguccaucgcccucaaaagcccuacgcacauggagauugccggacugcuucgggcucacgccgagcagggccgcucucuggggcucuga

SEQ ID NO: 70975 - RNA, 3318 nt, Artificial Sequence
  derived and/or modified sequence opt5 from KANSL1__Homo_sapiens__XP_005275701
auggccgcuauggcccccgcgcugaccgacgcugccgccgaggcucaccauaucagauucaagcucgccccuccgagcuccacacugucucccggcagcgcugaaaacaaugggaacgccaauauucuuaucgcggccaacggaacgaaacggaaggcuauugccgcugaggauccuucccuggacuuucgcaauaaccccaccaaagaagaucucggcaagcugcagccucuuguggccucuuaccugugcagcgacgucacauccguucccucuaaagagagccucaagcugcaagggguguucuccaagcagaccgugcugaaaagccacccucuccugucucaguccuaugaacuuagagcggagcugcucggacggcagccgguccuggaguuuagccuugaaaaucugcgcacaaugaacaccucuggccaaacagcccucccccaggcuccugugaaugggcuggccaagaaacugaccaaguccagcacgcauucugaucacgacaacuccaccagccucaauggaggcaaaagagcucugacauccucugcccuucauggcggggagaugggaggcagcgaauccggggaucugaagggaggcaugaccaacuguacacucccccaccggagccuggacguugagcacaccacgcuuuacucuaauaacuccacagccaauaagagcucugugaacagcauggagcagccugcucugcagggguccucucgccucagccccggaaccgauuccagcucuaaccugggcggcgucaaacuggaagggaagaaauccccgcucagcucuauccuguucuccgcgcuugacagcgauacaagaauuaccgcccugcuccggcgccaagcugacaucgaguccagagcccggcgccugcagaagagacuucaggugguucaggccaaacaaguggaacggcauauccagcaccagcugggaggcuuucucgagaagacccugucuaaacugccuaaucucgaaagccugcgccccagaucccaacuuaugcugacacggaaggcugaggccgcgcucagaaaggcugccucugagacgaccacaagcgaagggcuguccaacuuccugaaaagcaauucuauuuccgaggaacuugagcgcuuuaccgccagcggaaucgcuaaccuccggugcucugaacaggccuucgauuccgacgucacagacagcucuagcggcggggaguccgauauugaggaagaggaacugaccagagcugacccugagcagcgccaugugccccugcggagacgcagcgaauggaagugggccgcggaucgggccgcuaucgugucuagauggaauuggcuccaggcccacgucuccgaccuggaguaucgcauucggcaacagacggauaucuacaaacagauuagagcuaacaagggacuuaucguucugggcgaggugcccccuccggaacacacaaccgaccucuuucugccccugagcuccgaggugaaaaccgaucauggcacagacaaacuuaucgaaucugucagccagccucucgagaaucacggggcccccauuaucggacauauuuccgagucucugagcaccaaguccuguggcgcgcugcgcccugugaacgggguuaucaauacacuccaacccgugcuggccgaucacauuccgggagacucuagcgaugcugaggaacagcuucauaagaagcagcggcugaaccucgucuccagcagcuccgacggcacgugcguggccgcuagaacccggccuguucugagcuguaaaaagcgcagacuggugcggcccaauucuaucgucccucuuuccaaaaaggugcacagaaacagcacaauccgccccgggugcgacgucaauccuucuugugcccucugcggcuccggaagcauuaacaccaugcccccggaaauccacuaugaggccccucugcuggaacggcucucccagcuggauagcugugugcaucccguucuugcuuuccccgacgaugugccuacaucucugcacuuucaaagcaugcucaagucccaguggcagaauaaaccguucgacaagauuaaacccccuaagaaacugucucugaagcauagagcgcccaugccuggcagccuucccgauccugcccgcaaggacagacacaaacucgucuccucuuuucugaccacggcuaagcugagccaccaucagacccggcccgaucgcacacacagacaacaucucgacgaugugggggccguuccgaugguggagcgggucaccgccccuaaagcugagcgccugcuuaaucccccucccccggugcacgacccuaaccauuccaagaugagacugcgggaucacucuagcgaacgcuccgaggugcucaaacaccauacagacaugucuucuuccagcuaccuggccgcgacccaccaucccccucacucuccccugguuagacagcuuuccacgagcuccgauucucccgcuccugccagcuccagcucucaggucacagccuccaccagccaacagccggugcggcgcagacggggagaaucuagcuucgacaucaacaacauugugauccccauguccgucgcugccacaaccagaguggagaagcugcaguauaaagaaauccucaccccuucuuggcgcgagguugaccugcagagccucaagggcucccccgaugaggaaaaugaggaaauugaggaccugucugaugcggcuuucgccgcccuucaugcuaagugcgaagagauggagcgggccagauggcuguggacaacgagcgugccuccccaacgccggggguccagaagcuaccggucuuccgacggacgcaccacaccucagcucggcagcgcuaacccguccacaccccagccugccucucccgaugucagcuccucucacagccuguccgaauacagccacgggcagucuccuagaucccccaucagcccggagcugcauucugcgccucuuacccccguggcccgcgacacgccccggcaccuggcuuccgaagauaccagauguagcacaccugagcucggccuggacgagcaaucuguucagcccugggaacggcgcaccuuuccucucgcccauagcccgcaggcugagugcgaagaucagcuggacgcccaagagagagccgcucggugcacccgcagaacauccggaucuaaaaccggccgggaaacagaggcggcccccacgagcccucccaccgugccucuuaaguccagacaccuggucgcugccgccacagcucagcgccccacccaccgguga

SEQ ID NO: 70976 - RNA, 2637 nt, Artificial Sequence
  derived and/or modified sequence opt5 from KANSL3__Homo_sapiens__NP_001108488
auggcccacagaggcggggagcgggacuuccagaccagcgcucgcagaaugggaacaucccugcucuuucaacugucugugcaugaacgggagcuugaucuggucuuccucgaccacagcuacgccaagcccugguccgcgcauccugaugcuucuagcgcccgcccgacgagaaugcuguuuguuacaccccggcgccagcacgaauccaccaucgagucugacgugccuauugauguggaaaccgucacaagcacccccaugccucuuuaugacaaccagaaagccagauccgugaugaaugagugcgagcggcauguuaucuucgcucgcacagaugccgacgcucccccuccgcccgaagauugggaggaacacgugaacagaaccggcuggacgauggcccagaauaagcuguuuaacaaaauucucaaggcgcugcaaagcgaccggcuggcccgccucgcuaaugagggggccuguaacgagccuguccugagacggguggcuguugauaaaugcgcccgcagagugcggcaggcgcuugccucugucuccugggacaccaagcugauccaguggcuccacacaacccugguggaaacacuuagccugcccaugcucgcugccuaccuggaugcucugcagacccucaagggaaaaauuccuacgcugaucgacagaaugcuugugucuuccaauacaaagaccggcgccgccggggcugaggcgcugagccuccugcuuaaacgccccugggacccggccgucggaguucugucucauaacaagccuuccaaacuccccggcagcccucugauccugauugcuuccucuggccccagcuccagcguguuccccacaucucggagacaccgcuuuuggcaaucccagcucagcugucuggggaaggugaucccugucgccacccaucuucugaauaacggaucuggcguggggguucuccagugccuggaacacaugauuggagccgugcggagcaagguccuugagauccacucccauuucccgcacaaacccauuauccugauuggcuggaauaccggggcucucguggccugucauguuucugugauggaauaugucacagcgguggucugccugggauuuccucugcucacgguggauggccccagaggcgacguugaugacccucugcuugauaugaagacccccgugcuguucgucaucgggcagaacagccuccaaugucacccggaggcuauggaggacuuucgcgagaaaauccgggccgaaaauucccuggugguugugggaggcgccgaugacaaccugagaauuagcaaggcuaaaaagaaaucugaagggcuuacacaguccauggucgaucgcugcauccaggacgagauuguggauuuccucaccggagugcugacacgggccgaaggccauauggggagcgagccuagagaccaagacgcugagaagaagaaaaagccccgcgauguugcccggagagaccuggcguuugaagucccugagcggggaucucgccccgccuccccugcugccaaacuccccgcuagcccguccggcucugaagaucugagcuccgugucuagcuccccuaccagcucucccaagacgaaagugacaaccgucaccuccgcccaaaagagcucucagaucggcuccagccagcuucugaagagacacgugcagcggacagaggcgguucucacccacaaacaggcccaggugcccauuucuagcgaaccuccggaggagggggaaaaggaggaccugagaguccagcugaaacgccaucaccccuccagcccucuucccggaucuaagacauccaaacggccuaagaucaaggugagccucaucucccaaggcgauacggcugggggacccugugccccuucucagggcagcgcucccgaagccgccgggggcaaaccgauuaccaugacacugggacaggcuuccgcgggcgccaaggagcugaccgggcuccugacaaccgcuaaaucuagcuccucugagggaggcguuagcgccuccccugugcccagcgucgugucuuccagcacggccccuucugcccuucauacccugcaguccagacucguugccacaagccccgggucuucccugccgggagcgaccagcgcuuccagccugcuucaaggccucucuuucagccugcaggacaucuccucuaagacaagcgggcugccugccaaucccuccccuggccccgcuccccaggcuaccucugugaaacucccuacgccgaugcagagccugggagccauuacaaccggcacauccaccaucguccgcaccauucccguggcgacaacgcuuucuagccugggggcuaccccuggaggcaagcccacagccauccaccaacuccugaccaacgggggacuggccaagcucgcuuccagccucccuggccuggcccagaucucuaaccaggcuuccgggcugaaagugcccacaaccauuacgcucacacugagaggccaaccuagccggaucaccacccuuucuccgaugggauccggcgccgcgcccagcgaagaguccucuagccagguccugccuuccagcucucagcgccuucccccugcccccuga

SEQ ID NO: 70977 - RNA, 1878 nt, Artificial Sequence
  derived and/or modified sequence opt5 from KARS__Homo_sapiens__NP_001123561
augcugacccaggccgcugugagacucguccggggcagccugcgcaagacauccugggccgagugggggcacagagaacuucggcugggacaacucgcgcccuucacggcuccucauaaagacaagucuuuuagcgaucagcgcuccgagcugaaaagacggcuuaaggccgaaaagaagguugccgagaaggaagcuaaacagaaggagcugucugagaaacagcucagccaagccaccgcugccgcgacaaaccacaccacagacaauggcguggggccggaagaggaauccguggaucccaaccaguacuauaagauccgcucucaggccauucaucagcugaaagucaauggagaggacccuuacccccacaaguuccauguggauaucagccugaccgacuuuauucaaaaguauucccaccuccagccuggcgaucaccugacagacaucacccuuaaaguugcugggcggauucaugccaagagagcuagcggaggcaaacugaucuucuacgaucuccgcggcgagggggugaagcugcaggucauggccaacucuagaaauuauaaauccgaagaggaauuuauccacauuaacaauaaacuucggcgcggagacaucauuggcgugcaggggaaccccggaaaaacgaagaagggcgagcugagcaucauuccuuacgaaaucacccuccugucuccgugccugcauaugcucccccaucugcacuucgggcuuaaagauaaggagacaagauaucggcaacgcuaccuggaccucauucugaaugauuuuguuagacagaaauucaucauccgguccaagauuaucaccuacauucgcagcuuucuugacgagcugggauuccucgaaaucgagacaccuaugaugaacauuauccccggcggcgcgguggccaaaccuuuuaucaccuaucacaaugaacuggacaugaaccuguacaugagaauugcucccgagcucuaucacaagaugcuggucgucgggggaaucgaucggguguacgaaauuggcagacaguuccgcaaugaggggaucgaccuuacgcauaacccggaguuuacaaccugugaguucuauauggccuacgcugauuaucacgaccugauggaaauuacagaaaagauggucucuggaaugguuaaacauaucaccggcuccuacaaggugaccuaccacccugaugggcccgagggacaagccuaugacguggauuucacaccucccuuucggagaaucaauauggucgaggaacucgagaaagcccugggcaugaaacuucccgaaacgaaccuguucgagaccgaagagacacgcaagauucucgacgauaucugcguggcuaaggcgguugaguguccuccgccccggaccacagccagacugcuggacaagcucgugggcgaauuucuggaggugaccugcauuaacccuacguucaucugugaucacccccagauuaugagcccucuugcuaaauggcaucgcuccaaggaagggcugacagagcgguuugaacucuucgugaugaaaaaggagaucugcaaugccuacaccgagcugaacgaccccaugagacagcgccagcuguuugaggaacaagccaaagcuaaggccgcgggagacgaugaagcuauguucauugacgagaauuuuuguaccgcccuugaauauggccucccgccuacagccggguggggaaugggcaucgaucggguugcuauguuccugaccgacucuaacaauaucaaggaggugcugcucuuucccgccaugaaaccugaggauaagaaagaaaacgucgcuacaacggacacccuggagagcacaaccguggggacauccgucuga

SEQ ID NO: 70978 - RNA, 2514 nt, Artificial Sequence
  derived and/or modified sequence opt5 from KAT2A__Homo_sapiens__NP_066564
auggccgagcccagccaggcuccuaccccggcccccgcggcucaaccuagaccccugcaguccccugcccccgccccuacaccgacgcccgcuccuucucccgccagcgcuccuauccccaccccgacacccgcccccgcgccugcccccgcugccgcucccgccggcuccaccgggacaggaggcccuggggugggaucuggcggggcgggaagcggcggcgacccggcccggcccgggcucucccagcagcaacgcgcuucucagagaaaggcccagguccggggacugccucgcgcuaaaaagcuggaaaaacuuggcguuuucagcgccugcaaggccaacgagaccuguaaaugcaauggguggaagaaccccaagccucccacagcuccgagaauggaucuccagcaaccugcggccaaucuguccgaacuuugucggagcugcgagcacccccuggcugaccaugugucucaccucgaaaacguguccgaggaugagauuaaucgccugcugggaauggucguggacguugaaaaccucuuuaugagcgugcauaaagaggaagauaccgacacgaagcaggucuacuucuaucuguuuaaacuucugagaaaguguauccuccagaugacccggccugugguugagggcucucugggguccccuccuuucgagaaacccaauauugaacagggagugcuuaacuuuguccaauacaaguucagccaccuggccccgcgcgagagacagacaauguuugaacucucuaagauguuccugcugugccucaauuauuggaaacuggagaccccugcccaguuucggcaacgcucccaggcugaagauguggccacauacaaggugaacuauaccagauggcuuuguuacugccaugucccccagagcugugacucccugccccgguaugagacgacacacguuuucggccgcucucuccugagaagcaucuuuaccgugacacggagacagcuucuggagaaauuccgcguggaaaaggauaaacucgucccugagaagcggacccugauucugacccacuuuccgaaauuccucuccaugcuggaagaggaaaucuacggcgcgaauagccccaucugggagucuggguucacaaugccucccuccgagggaacgcaacuugugccuagacccgcuagcguuucugccgccguggucccuagcacccccauuuuuagcccgucuaugggcgggggaagcaacuccagccugucucucgacuccgcuggcgccgaaccuaugcccggggagaagcgcacacugccugaaaaucuuacccuggaggaugcuaagcggcucagagugaugggagacauccccauggaacugguuaacgaggugaugcugacaauuaccgauccggccgcgaugcucggcccugagacgagccugcuuucugccaaugcugcccgcgacgaaacagcucggcuggaggaaagacgcggcaucauugaguuccaugucaucgggaacucccucacccccaaagccaaccggagagugcugcuguggcuugucggacuccagaauguguuuagccaccagcugccucgcaugcccaaggaguacauugcgcggcugguuuucgaccccaaacauaagacccucgcccugaucaaagauggcagagugaucgggggaauuugcuuucggauguucccuacacagggcuuuaccgaaaucgucuucugugcugugacauccaacgagcaaguuaagggguauggcacgcaccuuaugaaucaccugaaggaauaccauauuaaacacaacauccucuauuuucugaccuacgccgacgaguaugcuauuggauacuucaagaaacagggcuuuucuaaggauaucaaagugccgaagucccgcuaucugggguacaucaaggacuacgaaggagccacacuuauggagugcgagcucaauccccggauuccuuauaccgaacugucccauaucauuaaaaagcagaaagagaucauuaagaaacugaucgaaagaaagcaggcccaaaucagaaaggucuaccccggccucucuugcuucaaagagggggugcgccagauuccuguggaaagcguucccggaauccgggagacaggcuggaagccucuggggaaagagaagggcaaagaacuuaaggauccggaccagcuguauaccacgcucaaaaaccugcuggcucagauuaagucccaccccagcgcguggccuuuuauggagcccgucaagaaaucugaagccccugauuacuaugaggugaucagauuccccauugaccuuaagaccaugacagaacgccucagaucccgguacuaugugacccgcaaacuguucgucgcugaucugcaaagagugaucgccaauugucgggaguacaacccgccugacagcgaguacugccgcugugccucugcucucgaaaaguuuuucuauuuuaaacugaaggagggaggccuuauugauaaguga

SEQ ID NO: 70979 - RNA, 2499 nt, Artificial Sequence
  derived and/or modified sequence opt5 from KAT2B__Homo_sapiens__NP_003875
augagcgaggccggcggggcuggacccggcgggugcggagccggcgcgggggcuggagccggcccuggcgcccugccgccccagccugcugcccuucccccugcucccccucaaggguccccgugugccgcggccgcuggaggcucuggggccugcggacccgcuaccgccguggcggccgcuggcacagccgaagggccuggaggcggcgggagcgcuagaaucgccgucaagaaagcccagcugcgguccgcuccccgcgcgaagaaacuugagaagcugggaguuuacucugccuguaaagcugaagagagcugcaaguguaacggcuggaagaauccuaaccccuccccgacgccucccagagccgaccuccagcagauuaucgugucucugaccgaaagcugccgguccuguagccacgcccuugcugcccaugugucucaccuggagaaugucuccgaggaagagaugaaccgccuccuggggauugugcuggauguugaauaucucuucacaugcgugcauaaagaggaggacgcggauaccaagcaagucuacuuuuaucuguucaaacuucugagaaagagcauccuccagcggggaaaaccugugguugaaggcucucuggagaagaagccucccuuugaaaaacccuccauugagcagggggugaauaacuucguccaguacaaguuuagccaccuuccggcuaaagaacgccaaacaaucguggagcuggccaagauguuccucaauagaaucaacuauuggcaucuggaggcccccucucagcggcgccugagauccccuaaugacgauauuagcggauacaaagaaaacuauacccgguggcucuguuacugcaaugugccccaguuuugugacucccugccucgcuacgagacaacccaggucuucggcagaacgcuucugcggucuguuuuuaccgugaugcgcagacaacuccuggaacaggcucggcaggagaaggauaaacuuccccuggaaaagagaacacucauccugacccacuucccgaaguuucugagcaugcucgaggaggaaguguauucccaaaacagcccuauuugggaccaggauuuccugucugccuccagccgcacaucucagcuuggcauccagaccgucauuaaucccccucccguggcugggacgaucagcuacaacuccacaucuagcucccuggagcaaccuaaugccggaucuagcucccccgcgugcaaagccagcucuggccucgaagcuaacccgggggagaagcggaaaaugaccgacucccacguucuggaagaggccaagaaaccuagagugaugggagauauucccauggagcuuaucaacgaagucaugagcacaaucaccgaccccgcugccaugcugggcccugagaccaauuuucucuccgcgcauucugcccgcgaugaagcugcccggcuggaggagagacgcggggugauugaauuucacguugugggcaacagccugaaucagaagccgaacaagaaaauccucauguggcuggucggacuucagaauguguucucccaucagcugccccggaugccuaaggaguauauuacaagacucgucuuugaccccaaacacaagacgcuggcucugaucaaagacggccgcgugauugggggaaucugcuuccggauguuuccuucucaaggcuucaccgaaaucguuuucugugccgugacaagcaacgagcaggucaagggguacggaacccaccuuaugaaucaucucaaggaauaucacauuaaacaugauauccugaacuuccugacauacgccgacgaguaugcuauuggcuacuuuaagaaacagggguucuccaaggagaucaaaauucccaagaccaaguacgugggcuauaucaaagauuacgaaggagcgacgcucaugggcugcgagcugaauccuagaauccccuauacagaauuuagcguuauuaucaagaaacagaaggagauuaucaaaaagcucauugaacgcaaacaagcccagauccggaagguguacccggggcugucuuguuucaaggacggagucagacagauuccuaucgaguccauccccggcauucgggagaccggguggaaaccuagcggaaaggaaaaaucuaaggagccccgcgauccggaccagcucuauuccacccugaaaagcauccugcaacaggugaagucucaccagagcgcuuggccuuuuauggaacccgugaagagaacagaggccccuggcuacuaugaaguuauucgguuccccauggaucuuaaaaccauguccgagagacucaagaaccgcuacuacgucagcaaaaagcuguuuauggccgaccugcaacggguguucacaaauugcaaagaguauaaucccccugaaucugaguacuauaagugugcuaacauccucgaaaaguucuuuuucuccaaaauuaaggaggccgggcugaucgauaaauga

SEQ ID NO: 70980 - RNA, 1485 nt, Artificial Sequence
  derived and/or modified sequence opt5 from KAT5__Homo_sapiens__NP_001193762
auggccgagguggucagccccguuccuggcgcugggagacgggaaccgggagaggugggccgcgccagagggcccccuguggcggaccccggagucgcucuguccccucagggcgaaaucauugaggggugccggcuccccgugcugcgcagaaaccaagauaaugaagacgaguggccucuugccgagauccugucuguuaaggauauuagcggacggaaacucuucuacgugcacuauaucgacuuuaacaagcgccuggaugaaugggucacccaugagagacuugaccugaaaaagauucaguucccgaaaaaggaagccaagacacccacgaaaaauggccucccuggcucccggcccgggucuccugagcgcgaggugaagagaaaaguugaaguggucagccccgcuaccccggugccuuccgagacagcccccgcuucuguguuuccucagaacggagccgcgcggcgcgccgucgcugcccagcccggcagaaagcggaaaagcaauugucuggggaccgaugaagacucccaagauagcucugacggaauccccuccgcuccucgcaugacaggcagccugguuucugauagaucccacgacgauaucgugacccggaugaagaacauugagugcaucgaacucgggagacaucgccugaagccgugguacuucagccccuauccucaggagcuuacaacccugcccgugcucuaccugugugaguuuugccuuaaauauggacggucucugaagugucuccagagacaccugacgaaaugcgaccugcgccauccucccggcaaugaaauuuaccggaagggcaccaucuccuucuuugagauugacgggcgcaaaaacaagagcuauucccagaaucucugucugcuugccaaaugcuuccuggaucacaagacacucuacuacgacaccgauccguuucuguucuaugucaugacagaauacgacuguaagggauuucacaucgugggcuauuucucuaaagagaaggaaagcaccgaggauuacaacguugcgugcauucuuacgcugccucccuaucaaagacggggguacggaaaacuccugaucgaguuuuccuaugaacugagcaagguggagggcaaaacagggaccccugaaaagccccucucugaccugggacuucuguccuacagaagcuacuggucucagacaauccucgagauucugaugggccuuaagagcgaauccggcgagcgcccucagaucaccauuaaugagaucucugaaauuaccagcaucaaaaaggaggaugucaucuccacacugcaguaucucaaccugauuaauuacuauaaagggcaauacauccugacgcucagcgaagacauuguggauggacaugagcgggccaugcugaagagacuucugcgcaucgacucuaaaugucuccacuucacccccaaggauugguccaagcggggcaaaugguga

SEQ ID NO: 70981 - RNA, 6015 nt, Artificial Sequence
  derived and/or modified sequence opt5 from KAT6A__Homo_sapiens__NP_006757
auggugaagcuggccaacccccucuacaccgaguggauccuggaagcuauuaaaaaggucaaaaagcagaaacagcggccuagcgaggaacggaucugcaaugccguuuccucuagccacggccuugaccgcaagacagugcuggagcagcucgaacuguccgugaaggaugggacgauucuuaaagucucuaacaagggacugaauagcuauaaagaccccgauaaccccggcagaaucgcccucccuaagccccggaaucaugggaaacuggacaacaagcagaauguggauuggaacaagcugauuaaacgcgcuguugagggacucgccgaguccggcgggucuacccucaaguccaucgaaagauuccuuaaaggacagaaggacguguccgcccuguuuggcggcagcgcugccucuggguuccaccaacagcuccggcuggcuaucaaacgcgccauuggacauggcagacuucugaaggaugggccucucuaccggcugaauacaaaagccaccaacgucgacggaaaggaguccugugaaagccugucuugccugcccccugugucccugcuuccccacgagaaggauaaacccguugccgagccuauccccauuuguagcuuuugccugggcacaaaggaacagaaucgcgagaaaaagccugaggaacucaucucuugugcugacugcgggaacuccggacaucccagcugucugaaauucuccccggaacuuaccgugagagucaaggcccugcgguggcagugcauugaguguaagacaugcucuagcugucgcgaucaaggcaaaaaugcugacaacaugcucuuuugcgauuccugcgacagaggcuuccacauggaguguugcgacccuccccugacccggaugccuaaggggauguggaucugucagauuugccgcccccgcaagaagggacggaaacugcuccagaagaaggccgcgcagaucaaaagacgcuauacgaaucccaucggccggccuaagaacagacugaaaaagcaaaacaccgugagcaaagggccguuuucuaaggugcgcacaggacccggccgggggagaaagcgcaaaauuacccuuuccagccagucugccagcuccucuagcgaagagggauaccuggaacggaucgauggccucgacuucuguagagauuccaaugucagccugaaguuuaacaaaaagacaaaaggccuuauugacgggcugaccaaguucuuuacgccuucucccgauggacgcaaagcucggggcgagguuguggacuauuccgaacaguacagaauccgcaagcgggggaauagaaagagcucuacauccgauuggccuaccgacaaccaagauggaugggacggcaaacaggagaaugaggaaagacucuucgggagccaggagauuaugacagaaaaggauauggagcuguuucgcgacauccaggaacaagcccugcagaaagugggcgucaccggacccccggacccucaggugagaugccccuccguuaucgaguucggcaaguaugagauucacaccugguacucuagcccuuacccccaggaauauucccggcucccuaaacuguaccuuugugaguucugccugaaguauaugaagucuagaacaauccuccaacagcauaugaaaaagugugggugguuucaucccccggcuaacgaaauuuaccgcaaaaauaacaucagcguguucgaggucgauggaaauguguccacgauuuauugccagaaccugugucugcuugccaagcucuuucuggaccacaaaacccuguacuaugauguugagccuuuccucuuuuacgugcugacacagaaugacgucaagggcugccaccuugugggguacuucagcaaggaaaaacacugccaacagaaguauaacgucucuuguaucaugauccugccccaguaccagcggaaaggauauggcagauuucucauugauuucuccuaccugcugagcaagcgcgaggggcaagccggcucucccgaaaaaccucuuuccgaccucggaagacugagcuauauggcuuacuggaagucugugauccuggagugccucuaucaucagaaugauaagcagauuagcaucaaaaagcuguccaaacuuaccggcauuuguccgcaagacaucacaagcacccugcaccaucuccggaugcuggauuuucgcucugaccaguucguuauuaucagacgggaaaagcugauccaggaucacauggcgaaacuucagcucaaccugcgccccguggacgucgauccugagugccugagauggacgcccgugauuguuuccaauagcguggucuccgaggaagaggaagaggaagccgaggagggggaaaacgaggaaccucaaugucaggagcgggaacucgagaucucugugggaaagagcgugucccaugagaacaaagaacaggacucuuacagcguugaguccgaaaagaagcccgaggucauggcuccugugucuagcacacgccuguccaaacaggugcuuccccacgacagccugccggccaauucucaaccuuccagacggggccgcugggggagaaagaaccggaaaacccaggagagauuuggagauaaggacagcaaacuccugcuggaagagaccucuuccgcgccccaggaacaguacggcgagugcggggaaaagagcgaggcuacacaagagcaguauaccgaaucugaggaacagcuugucgccuccgaggaacaaccuagccaggauggcaagcccgaccucccgaaacgccggcuguccgagggaguggagccuuggagaggccagcugaagaaaagccccgaagcgcucaagugucgccugacagaggggucugaacggcuuccuagacgcuacagcgagggagaucgggcuguucugagaggcuucuccgaaucuagcgaggaggaagaggaacccgagucccccagaucuagcuccccuccgauucucacgaaacccacccugaagcggaagaaaccuuuucugcacagacggcgcagagugcggaagcgcaaacaucacaauucuagcgucgugacagagaccaucuccgaaacaaccgagguucuugacgaacccuucgaggauagcgacucugaaagaccuaugccccggcuggagccuacguucgagauugaugaagaggaagaggaagaggacgagaacgaacucuuuccgagagaguauuuccgccggcuguccagccaggaugugcucagaugccaaucuuccagcaagcgcaaauccaaggacgaagaggaagaugaggagucugacgacgccgaugacacccccauccugaagccugucagccuucugcggaaaagagaugugaaaaauagcccccucgaaccugacacaagcacaccccugaaaaagaaaaagggguggccgaagggaaaaucucgcaagccuauccauuggaaaaagcggcccggcagaaaacccggguuuaagcugucccgcgagauuaugccuguuagcacacaggccugugugaucgaacccauugucucuaucccuaaagcuggcagaaagccgaagauucaggagagcgaggaaaccguggagcccaaagaagauaugccucuucccgaggaacggaaggaggaggaagagaugcaggccgaagcugaggaagccgaggagggagaagaggaagacgcggccuccucugaggugccugcugccagccccgcugauuccucuaacagcccggaaacggagacaaaagagccugaagucgaggaagaggaggaaaagccccgcguuuccgaggaacaaagacagagcgaggaggaacagcaggagcuggaggaaccugaacccgaggaagaggaggacgccgcggccgaaaccgcucaaaaugaugaccacgaugccgacgacgaggaugacggccaccucgaaucuaccaaaaagaaggagcuggaggaacagccuacccgggaggaugugaaagaggaacccggggugcaggaauccuuccucgacgcuaacaugcaaaagagccgcgagaaaaucaaggauaaagaggaaaccgagcuggacuccgaagaggaacaaccgucucaugauacaagcgucguguccgagcagauggccggaucugaggacgaucacgaagaggacagccauacgaaggaggaacuuaucgaacugaaggaggaggaagagauuccucacuccgaacucgaucuggagaccguucaggccgugcaaagccugacacaggaagagucuuccgagcaugaaggcgcuuaccaggacugcgaggaaacccuugcggccugucagacacugcaaagcuauacccaggcugaugaggacccccagaugucuauggucgaggacugccacgccuccgaacacaauagccccaucucuagcgugcagucccauccuucucaaagcguuagauccgugagcuccccgaacguccccgcccucgagucuggguacacgcagauuagcccugaacagggaucccugucugcucccagcaugcagaauauggagacauccccuaugauggaugugcccucuguuagcgaccacucccaacagguggucgauagcggcuuuucugaccucggcuccaucgaaagcaccaccgagaacuaugagaauccuucuuccuacgauagcacaaugggagggucuauuugcggcaacuccagcucccagagcucuuguagcuacgggggacuguccucuagcuccucucuuacccaaagcuccugcguggugacacagcagauggccucuaugggcagcuccuguagcaugaugcagcaaucuuccguccagccggcggcuaauugcagcaucaaaucuccccaguccuguguuguggaacggccucccagcaaccagcaacagcagccucccccgccuccgccccagcaaccucagcccccuccgccccagccucagcccgccccucaacccccgccuccccagcagcaaccucagcagcagccccaaccucagccccagcagccgccucccccucccccgccccaacagcagccuccccugucccagugcucuaugaacaauagcuucacgccugcccccaugaucauggagauuccugaauccgggagcaccggaaacaucucuauuuaugagagaauccccggcgacuuuggcgcuggguccuacagccaaccgucugccacauucagccuggcgaagcuccagcagcugaccaauacaauuauggauccucaugcuaugcccuauucccacucuccugccgugaccagcuacgccacguccgucucucuuagcaacaccggacuggcucaacucgcccccucccauccgcuggcuggcacaccucaggcccaggcgaccaugacaccgcccccuaaucucgccagcaccacaaugaaccugaccucuccccuucugcaguguaauauguccgcuacgaacaucgggauuccucacacacaacgccugcagggacagaugccggugaaaggccacaucagcauccgguccaagucugcgccccucccuagcgcugccgcccaucagcaacagcuguaugggagaucccccucugcuguugcgaugcaggccggaccucgcgcucuugccgugcagcggggcaugaauaugggcgucaaccugaugcccaccccugccuacaaugugaacagcaugaauaugaacacccucaaugcuaugaacuccuauagaaugacacaaccgaugaugaacagcucuuaccacuccaaucccgccuacaugaaccagaccgcgcaguauccuaugcaaaugcagauggggaugaugggaagccaggcuuacacgcagcaacccaugcagccuaauccccauggcaacaugauguauacagggccgucucaccacuccuacaugaaugccgccggaguuccuaaacagagccugaacggccccuauaugcggcgcuga

SEQ ID NO: 70982 - RNA, 5673 nt, Artificial Sequence
  derived and/or modified sequence opt5 from KAT6B__Homo_sapiens__NP_001243397
auggugaagcuggccaauccccucuacaccgaguggauccuggaagcuauucagaagaucaagaagcagaagcagagaccuagcgaggaacggauuugccacgccguguccaccucucauggccuugacaagaagacgguuagcgagcagcuggaacucuccgugcaggaugggucugugcugaaggucaccaauaaaggacuugcgagcuauaaggacccggauaaccccggccgcuucuccucugugaaaccugggacauuucccaagagcgcuaaaggauccagaggcagcuguaaugaccugcggaacguugauuggaauaagcuccugcgcagagccaucgaggggcuggaggaaccuaacggaucuucccucaagaauauugagaaauaccugcggagccaaucugaccuuaccuccacaaccaacaaucccgccuuccagcagcgccugagacucggcgcuaagcgggccgugaacaauggccgccugcuuaaagaugggccucaguauagagucaacuacggaagccuggacggcaagggggcuccgcaauaucccucugccuuuccuuccagccugcccccugugucccugcugccccacgaaaaagaucagccgcgggcggacccuauccccaucugcucuuucugucucggaacaaaggagagcaaucgcgagaaaaagccugaggaacuccuuuccugcgccgauuguggcagcucugggcaucccuccugccugaaguuuugucccgaacucaccacgaacguuaaagcucugagauggcagugcauugaguguaagaccugcagcgccugucgggugcagggacgcaaugcugacaacaugcuuuucugcgauucuugcgacagaggcuuucacauggaauguugcgacccuccgcugagccggaugcccaaaggcauguggaucugucaagucugcagaccuaagaaaaaggggcgcaagcuccugcaugagaaagccgcgcagauuaagcggagauacgccaaacccaucggacgcccuaagaacaaacugaagcagcggcuccuguccgugacaucugaugagggcagcaugaaugcuuucaccgggagaggaucccccggccgcgggcaaaagacaaaaguguguaccacgccgagcucuggacacgccgcuuccggcaaggacagcucuagccggcuugccgucacagauccuaccagacccggcgccacaaccaaaauuaccacaacgagcaccuauaucuccgcuucuacacugaagguuaacaaaaagaccaaggggcucauugacggacugacaaaauuuuucaccccuagccccgauggccgccgguccagaggggaaaucaucgacuuuucuaagcacuaccgcccucggaaaaaggugagccagaaacaguccugcacgagccaugugcuugcgacagauaccgagauuaagaucaauauuaaacaggaaucugccgacgucaacgugaucggaaauaaggauguugugaccgaggaagaccuggaugucuucaagcaagcucaggagcucuccugggagaaaauugaaugugagagcggcguggaagacugcgggagauaccccucuguuaucgaguuuggcaaguaugaaauccagacaugguacuccagcccguauccucaggaguacgcccggcugcccaaacuguaucucugugaguucugccugaaguacaugaaaucuaagaacauucuucugcgccacagcaagaaauguggaugguuccaucccccugccaaugaaaucuauagacggaaggaccucuccguguuugaggucgauggcaacaugagcaaaauuuacugccaaaaucugugccugcuugcuaaacucuuccuggaccacaaaacccuguacuaugauguggaaccguuucucuucuacguccugacaaagaacgacgagaaggggugucaccuugugggauauuuuucuaaagagaagcugugccagcagaaauacaauguuuccuguaucaugauuaugccccagcaucaaagacagggcuucgggcgcuuucucaucgauuucagcuaucugcugucccggagagaaggacaggccggcucuccugagaagccccuuagcgaccucgggcgccuguccuaccuggcguauuggaaaucugugauccucgaauaccuguaccaccaucacgagagacauauuagcaucaaggcuauuucccgggccacgggcaugugcccucacgauaucgccaccacacuucagcaucugcacaugauugacaagcgcgauggaagauuugucaucauucggcgcgaaaaacucauccugucucacauggagaagcugaaaaccuguagcagagcuaacgagcuugaccccgauucccuccgguggacaccuauccugauuagcaaugccgcugugucugaagaggaacgcgaggccgaaaaggaggcggagagacugauggaacaagccuccugcugggagaaagaggaacaggaaauccucagcacccgggcuaacucucgccagucccccgccaagguucaaagcaaaaauaaguaucugcauucuccggaguccagaccugugacgggcgagcgggggcagcuucuggaacucagcaaggaguccagcgaagaggaggaagaggaagaggacgaagaggaggaagaggaagaggaagaggaggaagaggaugaagaggaagaggaggaagaggaagaggaggaagaggaagagaacauucagucuucucccccuagacugaccaaaccccaguccgucgcuaucaagcgcaaacggccguucgugcugaagaaaaagagaggacgcaagcggagacgcauuaacuccagcgugacaaccgaaacaaucuccgagaccacggagguucuuaaugaaccuuuugacaacucugacgaggaacggcccaugccucaacucgagcccacaugugaaaucgaggucgaggaagauggcagaaaacccgugcugcgcaaggccuuccagcaccagccugggaaaaagcggcagaccgaggaagaggaaggaaaagacaaucacugcuuuaagaacgcggauccguguagaaauaacaugaaugacgauagcuccaaccugaaggagggcucuaaagacaaucccgagccucucaagugcaaacaaguguggcccaaggggacaaaacggggccugagcaaguggcgccagaacaaggaaagaaaaaccggauucaaacuuaaucuguacaccccucccgagacaccuauggaaccggaugagcaggucacgguggaggaacagaaagagaccuccgaaggcaagacaagccccucuccuauucggaucgaggaagagguuaaagagaccggggaagcccuccugccccaagaggaaaaccgcagagaggaaacaugugcuccugugucccccaauaccagcccgggagagaagccugaggacgaucugauuaagcccgaagaggaagaggaagaggaggaagaggaagaggaggaagaggaagaggaagagggcgaggaagaggaagggggaggcaacgucgagaaagaccccgauggggccaagucucaggaaaaagaggagccugaaaucuccacggagaaggaagacagcgcucggcuugaugaccaugaggaagaggaggaagaggacgaggaacccucccacaaugaggaucaugacgccgaugacgaagaugacucucacauggagagcgccgaaguggagaaagaggagcugccuagagaguccuucaaggaaguucucgagaaccaggaaacauuucuggaucucaacgugcaaccgggccauagcaaucccgagguccugauggacugcggaguggaucuuaccgcuucuugcaacuccgaaccuaaagagcuggcgggcgaccccgaggccguuccugaaagcgaugaggaacccccgccuggggagcaggcucagaagcaggaccagaaaaauucuaaagaaguggacaccgaguucaaggagggaaaccccgccacaauggaaauugauagcgagaccguccaagccgugcagucccucacacaggaaucuagcgagcaagacgauacguuucaggacugugcugagacccaggaagccugccgcucccugcagaauuauacacgggcggaucaaucuccucagaucgcuaccacacuggacgauugucagcagagcgaccacuccagccccgugucuuccguccacagccauccuggccaauccguuagaucugugaacagccccuccgugccggcccuugaaaauucuuacgcccagaucagcccugaucaguccgcuauuagcguccccucucugcaaaacauggaaaccucccccaugauggacgugccuagcguuucugaucacucccaacagguggucgacagcggguucucugaucucggaagcaucgaguccacgaccgaaaauuaugagaacccgucuagcuacgacuccacaaugggcggcagcauuugcgggaauggauccucucagaacagcuguuccuauucuaaucugaccagcuccucucucacacaaagcuccugcgccgugacccagcagaugagcaacaucucuggcuccuguagcaugcugcagcaaacaucuauuuccucucccccuaccugcuccguuaaaagcccccagggguguguggucgagcgcccucccagcuccagccagcagcuugcgcaaugcucuauggcugccaauuuuacgccuccgaugcagcuggccgaaauccccgagacaagcaacgcuaacaucggacucuacgaacggaugggccaguccgacuucggggccggacauuacccucaacccucugcuaccuuuagccuggccaagcugcagcagcuuaccaauacacugauugaucacucccucccuuauucucauagcgcggccgugaccuccuacgcuaacucugccagccuguccacgccccucagcaauacaggccugguucagcuuucucaauccccgcacagcgugccuggcgggccccaggcucaggccaccaugacacccccucccaaccugaccccuccgcccaugaaucugccucccccucuccugcagagaaacauggccgcuucuaauaucggaauuucccacagccaacgccuucagacacagaucgcguccaaaggccauauuucuaugcggaccaagagcgccucccugagccccgcugccgccacgcaccagucucaaaucuaugggagaucccagaccgucgcuaugcagggaccggcccgcacacucaccaugcagagaggcaugaacaugagcgugaaucugaugccugcgcccgcuuacaacgucaauucugucaacaugaauaugaacacacucaaugccaugaacggguauagcaugucccaaccuaugaugaacucuggauaccauagcaaccacggcuauaugaaccagacaccccaguacccuaugcaaaugcagaugggcaugauggggacgcagcccuacgcccagcaaccgaugcagacaccuccccacggaaauaugauguauaccgcucccggccaucacggguacaugaacacaggaauguccaagcagucucugaauggcagcuauaugcggcgcuga

SEQ ID NO: 70983 - RNA, 1746 nt, Artificial Sequence
  derived and/or modified sequence opt5 from KAT7__Homo_sapiens__NP_001186084
augcccagacggaagcgcaacgccggcagcuccucugacgggaccgaggauagcgacuucuccacagaucuggaacacacggacucuagcgaguccgauggaaccucuagacggagcgcucgcgugacaagauccagcgcccggcucucucaguccagccaagacucuuccccuguccgcaaucugcagagcuuuggcaccgaggagccggcguacucuacaagacggguuacccgcucccagcagcaacccacaccugugacccccaaaaaguauccucuuagacagacgcggagcuccgggucugaaaccgaacagguggucgauuucagcgaccgcgagacaaagaacaccgcugaucaugacgaauccccucccagaacaccgaccggaaaugcccccagcucugaguccgauaucgacauuagcucuccuaacgugagccacgaugaauccaucgccaaggacaugucucugaaagacagcggcuccgaucucagccaucggcccaagcgcagacgguuucacgagucuuacaauuucaacaugaagugcccuacgcccggguguaauucccugggacaucuuacaggcaaacacgagagacacuuuagcauuucuggcugcccgcuguaucauaaccucuccgcugacgaauguaaggccccuaccgagcgccagcugcgguacaaagaaaagguugcugagcugagaaagaagcgcaauagcgggcucuccaaggaacaaaaagagaaguauauggagcaccggcagacauacggaaacaccagagaaccccugcuugagaaucugaccucugaauaugaucucgaccuguuccgccgggcccaggcgagagccagcgaggaucuugaaaaacugcgccuccagggccaaaucacagagggguccaacaugauuaagacgaucgcuuuuggacgguacgagcuggacaccugguaccauucuccuuaucccgaagaguacgccagacugggccgccucuauaugugcgaguucugucugaaauacaugaaaagccagacaauccuucggagacacauggcuaaaugcguguggaagcaucccccuggggaugaaauuuaucggaagggauccaucagcgucuuugaaguggacggcaaaaagaauaaaauuuacugucagaaccugugccuccuggccaaacuuuuccuggaucacaaaacccucuauuacgacguugagccguuucuguucuacgugaugacagaggcggauaauaccggcugucaccugaucggguauuuuucuaaggaaaagaacuccuuccucaacuacaaugucagcugcauucugacgaugccccaauauaugcgccagggauacggcaaaaugcuuaucgacuucucuuaucugcucuccaagguggaggaaaaaguggggagcccugagagaccccugucugaccuuggacugauuagcuaccgguccuauuggaaggagguccuccugagauaccugcauaacuuucagggcaaagaaaucagcaucaaggagauuucucaggaaacagccguuaauccuguggauaucguguccacccuccaagcucugcagaugcuuaaguacuggaaagggaagcaccugguccucaaacgccaggaccugauugaugaguggaucgccaaggaagcuaaacggagcaacuccaauaagaccauggaccccucuugucugaaguggacaccgccuaaaggaaccuga

SEQ ID NO: 70984 - RNA, 1377 nt, Artificial Sequence
  derived and/or modified sequence opt5 from KAT8__Homo_sapiens__NP_115564
auggccgcccagggcgccgcggcugccguggccgcugggaccagcggagucgccggcgagggggaacccggaccuggcgagaacgcugccgcggaagggacagccccgucccccggaagaguuucuccucccacgccugcucggggcgagcccgaagugaccguggagaucggcgagacauaccugugccgcagaccugacagcaccuggcacuccgccgaagucauucaaucucgggugaaugaucaggaggggcgcgaagaguucuauguucauuacgugggauuuaacagacggcucgacgagugggucgauaagaaucgccuggcucuuacaaaaaccgugaaggacgccguucagaaaaacagcgaaaaguaucuguccgagcucgcggaacagccggagagaaaaaucacacggaaucaaaagcgcaagcacgaugaaauuaaccaugugcagaaaaccuacgccgagauggaccccacgaccgcugcccuggagaaggaacacgaggcuaucacaaaagucaaguauguggauaaaauucauaucggcaauuacgaaaucgacgccugguauuucucuccuuuucccgaggauuacgggaagcagccuaaacuuuggcugugugaauacugccucaaguauaugaaguacgagaaaagcuauagauuccaccugggacagugucaauggcggcagcccccgggcaaggagauuuaccgcaaauccaacaucagcguguaugaagucgacgggaaggaucacaaaauuuacugccagaaucugugucuccuggccaaacuuuuucuggaccauaagacccucuauuucgauguugagccuuuuguguucuacauccugacagaaguggacagacagggagcucacauugucggcuacuuuucuaaggagaaggaaucccccgacggcaacaauguggcgugcauccuuacccugccucccuaucaacggcgcggguacggaaaauuccucauugccuuuagcuaugagcugucuaagcuggaguccacgguuggcagccccgaaaaaccucucucugaucuggggaaacuuuccuacagaagcuauugguccugggugcugcucgagauccugcgggacuucagaggaacacuuucuaucaaggaucugagccagaugaccuccauuacacagaacgacaucauuagcacccuccaaucucugaauauggucaaguacuggaagggccagcaugugaucuguguuaccccgaaacugguggaggaacaccucaaguccgcucaguauaaaaagcccccuauuacagucgauagcgugugccugaagugggcucccccuaaacacaagcaggucaaacuuucuaagaaauga

SEQ ID NO: 70985 - RNA, 936 nt, Artificial Sequence
  derived and/or modified sequence opt5 from KATNA1__Homo_sapiens__NP_001191005
augagccugcucaugaucuccgagaacgugaagcuggccagagaauacgcccuucugggcaauuaugacucugcuauggucuacuaucaggggguucucgaucaaaugaacaaauaccuguauagcgugaaggacaccuaccuucagcagaaauggcagcaaguguggcaggagauuaaugucgaagcgaagcacgugaaagauaucaugaagacacuggaguccuucaagcucgacucuacgccccugaaagcugcccagcaugaucugccugccagcgaaggagagguuugguccaugccggugcccgucgagcggcgcccuucucccggcccuagaaagcggcagagcucccaauauagcgaccccaaaucucacgggaaccgcccuuccaccacagugagaguucaucggagcucugcucagaaugugcacaacgaucgcggaaaggccgucagaugccgggagaaaaaggagcagaauaagggccgcgaagagaaaggggugcucauggugggaccgcccggcaccggcaagacacugcuugcuaaagccgucgcgaccgaguguaagacaaccuuuuucaacguuuccagcucuacgcugaccuccaaauacagaggggaaagcgagaagcucgugcggcugcuuuuugaaauggcccgcuucuacuccccugcuacaauuuuuaucgacgagauugauucuaucugcagcagacggggaaccuccgaagaacaugaggccagccgcagagugaaagcugaacugcucguccagauggacggcguugggggaacaucugagaaugaugaccccuccaagauggugauggugcuggccgcgaccaacuucccuugggauaucgacgaagcccugcggagacgccucgagaagcggauuuauaucccccugccgagcggcaugagaccuuga

SEQ ID NO: 70986 - RNA, 1695 nt, Artificial Sequence
  derived and/or modified sequence opt5 from KATNAL2__Homo_sapiens__XP_005258414
augaagaaaaucgagcagagaaagacccggcccugcuucagcacauccaacgaaaaucgcgugcuggcccaaugucucauggagcugucuuaccagacgcuuaaauuuacccaccaggcuagagaagccugcgagaugcggacagaagcgcgcagaaagaaccugcucauucugaucagccauuaucuuacccaggagggcuacauugacacagcuaaugcccuggagcaagaaaccaaacucgggcugcggcgcuucgaggucugugauaacaucgaccuggaaacaauucucauggaguaugaguccuacuauuuuguuaaguuccagaaguacccuaaaaucgugaagaaaucuagcgauaccgccgaaaauaaccugccgcagagaucccggggaaagacgcgcagaaugaugaaugacucuugccagaaccuucccaaaaucaaucaacagcggccucgcagcaagaccacagcuggcaagaccggggauacaaaaucccugaacaaggagcaccccaaucaggaaguggucgacaacaccagacucgagagcgccaauuuuggacugcauauuucucggauccgcaaagauuccggcgaagagaacgcucacccuagacgggggcagauuaucgacuuccaaggacuucugacggaugccauuaagggcgcgacaagcgagcucgcccugaauaccuuugaccauaaccccgauccuucugaaagacugcucaaaccgcuguccgcuuucaucggcaugaacagcgagaugcgcgaacuugccgcugugguuucucgggacauuuaucugcacaaucccaacaucaaguggaaugauaucauugggcucgacgccgcgaaacagcuggugaaggaggccgucguguacccuaucagauacccccagcuuuuuacaggcauucuguccccuuggaagggacuccugcuguaugggcccccgggaaccggcaaaacccuccuggcuaaggccguugcuacagaauguaaaacgaccuucuuuaacaucagcgccuccacaauugugucuaaguggcgcggggacagcgagaaacuuguccgggugcuguucgagcucgccagauaccacgcuccuuccaccaucuuucuggaugaacuugagagcgugaugucucaacgcggaacagcguccggcggcgaacaugaggggagccugcggaugaagaccgaacuccugguccagauggacggacuggccagaucugaggaucucguuuucgugcuggcugccagcaaucuucccugggagcuggacugcgccaugcuccgccggcuggaaaagagaauccugguggaucuuccuucccgcgaggcucggcaggccaugauuuaucacuggcucccucccgucucuaaaagcagagcgcuggaacugcauacggagcucgaguacuccgugcugagccaggaaacagagggcuauucuggguccgacaucaaacuuguuugucgggaagcugccaugcgccccgugagaaagauuuucgaugcccuggagaaccaccaaagcgaaucuuccgaccucccgcggauccagcuggauauugucaccaccgcugacuuucuggaugugcuuacacacaccaagcccagcgccaaaaaucucgcucagagauacuccgacuggcagcgcgaguucgagucuguuuga

SEQ ID NO: 70987 - RNA, 1968 nt, Artificial Sequence
  derived and/or modified sequence opt5 from KATNB1__Homo_sapiens__NP_005877
auggccacccccguggucacaaagacggcuuggaaacugcaggagaucguugcccacgcgagcaacguguccucucucgugcugggcaaggcuagcgggagacuucuggccaccggaggcgacgauugccgggucaaucucugguccauuaacaaaccuaauuguaucaugucucugacagggcauaccagcccgguggaauccguucgccuuaacacacccgaggaacugauuguggccggaucucaaagcggcuccaucagagucugggaccucgaggcugccaagauucugcggacccugauggggcacaaagcuaauaucugcagccucgauuuccauccuuacggagaauuuguggccucuggcucccaggacacaaacaucaagcugugggauauucgcagaaagggcuguguuuuccgguaucgcgggcacagccaggcggugagaugccuucgguuuucucccgacggaaaauggcuggccuccgcugccgaugaccauaccgucaagcucugggaucugacggcuggcaaaaugaugagcgaguucccugggcacaccggacccgugaauguggucgaguuucacccuaacgaauaccuucuggccucuggcuccagcgaccgcacaaucagauucugggaucucgagaaguuucagguuguguccuguauugaaggggagccgggacccgugcggucuguccuguucaauccugacggcugcugucuguauagcggcugccaagauucccuccgcguguacgggugggagcccgaaagauguuuugacguugugcuggucaacuggggaaaaguggcggaccuugccaucugcaaugaucagcugauuggcguugcuuucagccagucuaacguguccagcuaugucguggaccucacccgggucacacgcaccgggacgguggccagagauccuguucaggaccaucggccccuggcucaaccgcuuccuaaucccucugccccucugagacgcaucuacgagcggcccagcacaaccuguuccaagccccagagagugaagcagaacucugaaagcgagcgccgguccccuagcucugaagaugacagagaugagcgcgagucccgggccgaaauucagaaugcugaggacuauaacgaaaucuuucaaccgaaaaacagcaucucuagaacacccccucgccgguccgagcccuucccugcgcccccggaagaugacgccgcuaccgccaaggaggccgcuaaaccuagccccgccauggauguccaguuuccugugcccaaucucgagguucugccuagacccccgguggucgcguccaccccugcucccaaggccgaacccgccauuaucccugcuacacgcaacgagccgauuggacugaaagccucugacuuccuccccgcugugaagaucccucagcaagccgaacugguggacgaggaugcgaugagccagauucggaaaggccacgacacgaugugcguuguccuuaccuccagacauaagaaucuggauacagugcgggccguguggaccaugggggacaucaagacaucugucgauagcgcuguggccaucaacgaccucuccguuguggucgaucugcuuaauauugugaaccagaaagcuagccuguggaagcucgaccugugcaccacgguucugccccagaucgaaaaacuccugcaaucuaaguacgaguccuacgugcagacaggauguaccagccuuaaacugauucuccagcgcuuccugccucugaucaccgauaugcuugccgcgcccccuucugucggcguggacauuuccagagaggaacggcuccacaagugcagacuguguuauaagcagcugaaaagcaucucuggccucguuaagagcaaauccgggcugagcggacgccacggcucuacauuucgggagcuucaucugcucauggccucccuggauuga

SEQ ID NO: 70988 - RNA, 693 nt, Artificial Sequence
  derived and/or modified sequence opt5 from KAZALD1__Homo_sapiens__XP_005270251
augcugcccccuccgagacccgccgcugcccucgcgcugccugugcuucugcuccugcuugucguucugacgcccccucccacaggcgcucggccuagcccggggcccgacuaccuccgcagaggauggaugcggcugcuggccgagggcgaagggugcgccccuugucgccccgaggaaugcgcugccccuagaggaugucucgcuggccgggugcgcgaugccugcggguguugcugggagugugcgaaccuggaaggacagcuuugcgaccuggaucccuccgcccacuucuauggccauuguggcgagcaacucgagugcagacuggacaccgggggagaucuuucucggggcgaagugccggagccucugugugcuugccgcagccagucuccccucugcggguccgacggacacaccuacagccagaucuguagacugcaggaagccgcucgggcccgcccugaugcgaaucugacagucgcccaucccggccccugcgaguccgggccucaaauugugucucacccguaugacaccuggaacguuacaggacaggaugugaucuuuggcugugaggucuucgcuuaccccauggccagcauugaauggagaaaggacggccucgauauccagcugccuggggacgauccccauauuuccgugcagggauggaccccugagguuuga

SEQ ID NO: 70989 - RNA, 2628 nt, Artificial Sequence
  derived and/or modified sequence opt5 from KAZN__Homo_sapiens__XP_011539377
augcgggccgcugacagcggcuccugggagcgggugcgccagcuggccgcgcaaggggaacccgcuccuucuugcggagccggcgccgggccggcuagacccccuggacccgccgcuugugagcagugcgucgaugccgcgggcccuggggaccggccccgcgccggaguuccuagagugcgggcugauggcgacuguagccagccggugcuccugcgcgaagaggucuccagacuucaggaagaggugcaucugcuccggcaaaugaaggagaugcuggccaaagaucuugaagagucucagggcgggaaaagcuccgaaguucugucugcuaccgagcuccgcgugcagcuggcccagaaagagcaagaacuggcgagagccaaggaggcucuccaggccaugaaagcugaccggaagcgccugaagggagaaaagacagaucuugucagccagaugcagcaacuguacgccacgcucgaguccagagaggagcagcugcgggacuucauccgcaacuaugagcagcacagaaaggaaagcgaggaugccgugaaagcucuugcgaaggaaaaagaccugcucgagcgggaaaagugggagcugagacgccaagccaaggaggcuaccgaucacgccacagcccugcggucucagcucgaccugaaagauaauagaaugaaggaacuugaggcugaacuggccauggcgaaacagucccucgcuacccugacaaaggacguucccaaacgccauagccuugccaugccuggcgagaccgugcugaacgggaaucaggaaugggucgugcaagccgaccucccccugacagcugccauucggcagucucagcagacccuguaccacucccauccuccccacccggcugauagacaagccgugcgcgucagcccuugccacucucggcagcccuccguuaucagcgacgcguccgccgcugagggagauagaucuagcacgccuuccgacauuaacagcccccgccaucggacccacucucucuguaauggcgauucccccgggccugugcagaagaaccugcauaauccgaucgugcagagccuugaggaccuggaagaucagaaaagaaagaagaaaaaggagaaaaugggauuuggcucuauuagccgcgucuucgcccggggcaagcagagaaaaucccucgaccccgggcuguuugaugacucugauagccagugcuccccuacacggcagagccuuucucuguccgaaggagaggagcaaauggaccgccuccaacagguggaacugguuagaaccacacccaugagccacuggaaggcuggcaccgugcaagccuggcuggaggucgugauggcgaugccuauguauguuaaggccuguacggaaaacgugaaaucugggaagguccuccugucccuuagcgacgaggaucugcagcucggacugggcgugugcuccucucugcaccggagaaaacuucgccucgcuaucgaagacuaccgggaugccgaggcugggagaagccuguccaaggccgccgagcuggaccaucacugggucgcuaaagcguggcucaaugauaucggacugucucaguauagccaggccuuccaaaaccaucuuguggacggccgcaugcucaauucccugaugaagagagaucuggaaaagcaccugaacguuagcaaaaaguuucaucaggugucuauucuucucggcaucgagcugcuguaccaggucaauuucucccgggaagcucuccaggagcgcagagcccggugugaaacacaaaacauugaccccgugguuuggaccaaucagcgcgugcugaaaugggucagagauaucgaccuuaaggaguaugccgauaaccugacaaacagcggggugcacggagcugugcucguucuggagccgaccuuuaaugccgaagcgauggcuaccgcccugggcauuccuucugggaaacacauccuucggcgccaucucgccgaggaaauguccgcugucuuccaccccgccaacagcacaggaauuagagaggcggaacgguuuggcacgccucccgggcgcgcuucuagcgugaccagagccggcaaggaggaaaauuccagcggacugaaguacaaagccggccgggugucucuguccauggaccucccugucagccccgcugauccggggaagguguucuuuuccccucccggaucuagcguugcccccgugcuggcuugcgaaggcggggucccuggaagagugacaggcgccucccgcaccgacgcgcuugacguuccgucucggaaccugcaugaugcccucgggacagugcacaaagcucccgccggccugagagucgcuccuggaagccaguccgccggccugaccugucuucacgagaaucaucucgggcugcugcucaaccugcagauccuuggacccacgcuggugucuuggaagcgcagcucccucggcagagggggaagcugcauccaacugggcugcccugaagggucuggcgccgcucccaauuccgagccucagagccugauuucuaucugugacuucuccgaucuuacaaacagcaaagacgagcccucuggagauuccaaucagaccguuuga

SEQ ID NO: 70990 - RNA, 1872 nt, Artificial Sequence
  derived and/or modified sequence opt5 from KBTBD11__Homo_sapiens__NP_055682
auggagcacgccguggcucccugcguccuguacccuggcaccgaaccgggggccgcgggagagagcgaauccgagggcgcugccucucccgcccagacaccuuguagccucggggcuucccugugcuucucuagcggagaagagucucccccucaaucccuugccagcgcugccgagggcgcggccacguccccucccagcucugggggaccgagaguuguggaacggcagugggaggcuggcuccgccggcgcugccagccccgaggaacuggcgucuccugaggaacgcgccugucccgaggaaccugcugcccccuccccggagccuagaguguggcucgaagaccccgcuagcccugaggagcccggggaacccgccccugucccgcccggauuuggcgccguguauggggagccugaucugguucuugaagugucuggacggcgccugagagcucauaaggcgguccucgccgcucgguccgacuacuuccgcgccagagccagccgggaugugcugcgcguucagggcgugucccugaccgcucucagacugcuucuggccgacgcguauucugggcggauggcuggaguccgccccgauaacguggccgagguggucgccggcgcuagacggcuccagcugccuggcgccgcucaacgcgccacagacgcgguugggccccagcuuagccuggccaauugcuacgaagugcucuccgcugccaaaagacagcggcugaacgagcugagagaugcugccuauuguuuuaugagcgaccacuaccucgaggugcugcgcgaaccggcggucuucggacggcuuucuggcgccgagagagaucugcuccugcgccggagacuucgcgcugggcgggcccaucugcucgcugccgcccugggaccugcuggcgaaagagcggggucccgcccccagagcccuucuggagacgccgaugcucggggcgacgccgccguguauugcuuucacgcugccgcgggcgaguggagagaacugacccgccuccccgagggggcuccugcccggggauguggccugugcguucuuuacaauuaccuguucguggccgggggagucgcucccgccggcccggaugggagagcgcggccuagcgaccaaguguuuuguuauaaccccgcuacagacuccuggucugccguucgcccccucagacaggcccggagccagcugagacuucuggcucucgauggccaucuguacgccgugggaggcgagugccugcucuccgucgaacgcuaugacccucgggcugauagaugggccccgguggcgccccugccucgcggggccuucgcugucgcccacgaggcuaccacaugucacggagaaaucuacgugagcggcgggucucuguuuuauagacuucucaaguacgacccccggcgcgaugaguggcaggagugcccuugcuccagcucuagagaacgguccgccgacaugguugcccuggauggauucauuuaucgcuuugaccugagcggcuccagaggggaggcucaagcggccggccccucuggagugagcgucucccgguaccauugucuugcuaaacaguggucuccuugcguggcuccccuccgccugccgggcgggccuaccggacugcagcccuucagaugugccgcccucgauggcgccaucuacugcguuagccgggcggggacguggcgcuuucaaccugcuagagaaggagaggccggcggggacgccggccagggaggcggguucgaagcucugggagcgccccuugaugugcggggcguccugauuccguucgcccucucccugccugagaagcccccuagaggggagcagggagcucccuga

SEQ ID NO: 70991 - RNA, 1377 nt, Artificial Sequence
  derived and/or modified sequence opt5 from KBTBD13__Homo_sapiens__NP_001094832
auggccagaggcccccagacccuggugcaagucuggguugggggacaacucuuccaggcugaccgggcccugcuuguggagcacugcggcuuuuuccgcgggcuguuuagaagcggaaugcgggaaacacgcgcggcugaggugagacucggcguccuguccgccgggggauuccgggccacgcuucaggugcugcgcggcgauagaccugcucucgccgcugaagacgagcugcugcaggccguugaaugugcggccuuucuccaggcuccggcccuggcucgguuccuugagcauaaccugaccucugauaauugcgcccuccugugugacgcggccgcugccuuuggccuucgcgauguguuccacagcgcugcccuguuuaucugcgacggggagagagaacucgccgcugagcuggcgcugcccgaagcccgggcuuacgucgccgcccuccgcccuuccucuuaugcugccgugagcacacauacccccgcgccuggauuccuggaggaugcuuccagaacacuuuguuaccuggacgaggaagaggaugccuggcggacccucgccgcucugccccuugaagccucuacacugcucgcuggcguugccacccuggggaacaagcuguauauugugggaggcguccgcggggcgagcaaagaggugguggaacucggauuuugcuacgacccugauggcggcacguggcacgaguucccgagcccccaucagccuagauaugacaccgcccuggcuggguuugauggacggcuuuacgccaucggcggggaguuccagagaacacccauuuccucugucgaacgcuaugacccugcugccggauguugguccuucguugcggaccugccccaaccggccgcuggcgugccuugcgcccaggcuugugggcggcucuuugugugccuguggagacccgccgauaccacagccgucguggaguacgcuguucgcaccgacgcguggcuuccuguggccgaacugcggagaccccagagcuacggacacuguauggucgcucaccgcgauucucucuaugugguucggaauggccccuccgacgauuuccugcauugcgccaucgacugccugaaccucgccacgggccaguggacagcucugccugggcaauuugugaauagcaagggagcccuuuucaccgcggucgugagaggcgauacagucuacaccgugaaccgcauguuuacccugcucuaugcuauugaagggggaacauggcggcugcugagagagaaagccggcuucccgcgccccgggucucuucagacguuucuccugcggcugccucccggcgccccuggacccguuaccuccacaaccgcugagcucuga

SEQ ID NO: 70992 - RNA, 1806 nt, Artificial Sequence
  derived and/or modified sequence opt5 from KBTBD8__Homo_sapiens__NP_115894
auggccgcuagcgccgaccuguccaagucuagccccaccccuaacggcaucccguccucugaucccgcgagcgacgcuauggauccuuuccacgccugcuccauucucaaacagcugaagacaauguacgacgaggggcaacuuacggauaucguggucgaaguugaccauggaaaaaccuuuucuugucacagaaaugugcuggccgcuauuagccccuauuuccgguccauguuuacaagcggccucaccgagucuacacagaaggaagugcgcaucgucgggguggaggccgaauccauggaucugguucuuaacuacgcuuauaccagcagagugauucugacagaggccaauguccaggcucucuucaccgccgcuucuaucuuucagaucccuuccauucaagaccagugcgccaaauacaugaucagccaucuggauccccagaacucuauuggaguguucaucuuugcugaccacuauggccaucaggagcugggggaucgguccaaggaauacauucgcaagaaauuccucuguguuacgaaggagcaagaauuucugcagcuuaccaaagaccagcugaucagcauucucgauuccgacgaccugaauguggauagagaggagcacgucuaugaaucuaucauccggugguucgagcacgaacagaacgagcgcgaagugcaucuuccugagauuuuugccaagugcaucagauucccgcugauggaggacacauuuauugaaaagauucccccucaauucgcgcaggccaucgcuaagagcuguguggagaagggacccuccaauaccaacggcugcacacagcggcucggcaugaccgccagcgaaaugaucaucuguuucgaugcugcccacaaacauucugggaagaaacaaacggucccuugccuggacauuguuacaggacgcguguuuaagcuguguaaacccccgaaugaucucagagaggugggcauccuggucuccccugacaacgauauuuacaucgccgggggauaccggcccagcucuagcgaaguguccauugaccacaaggcugagaaugauuucuggauguaugaccacucuaccaaccgcuggcuuagcaaaccuucccugcucagagcgcggaucggcugcaagcugguuuacuguugcgggaagauguaugccaucggaggccgcguguacgagggcgaugggagaaauagccuuaaaucugucgaaugcuaugacucccgggagaacuguuggacaaccgugugcgcuaugcccguugccauggaauuucauaaugccguggaguacaaggagaaaauuuauguccugcagggagaguucuuucucuucuacgagccccagaaggacuacuggggcuuucugaccccuaugacagugccgagaauccaggggcuggcugccgucuauaaagauagcauuuacuauaucgcgggaacguguggcaaccaccaacgcauguucaccguggaagcguacgacauugagcucaacaaguggacacggaagaaagauuuucccugcgaccagucuaucaauccuuaucugaaacuuguucuguuccagaacaaacuccaucuguuugugagagccacccaggucacaguggaagaacacguuuuccgcaccucccggaagaauagccuuuaccaauaugaugacauugccgaucaguggaugaaaguguacgagacgcccgacagacugugggaucucgggcgccauuuugaaugugcugucgccaagcuguacccucagugccugcagaaggugcucuga

SEQ ID NO: 70993 - RNA, 1146 nt, Artificial Sequence
  derived and/or modified sequence opt5 from KCMF1__Homo_sapiens__NP_064507
augagccggcacgagggcguguccugcgacgccugucugaaggggaacuuccggggacgcagauacaaaugccucaucuguuaugauuacgaccugugcgcuucuuguuaugaaagcggcgccaccacaacgcggcauaccacagaucaccccaugcagugcauucuuacccgcgucgacuuugaucuguacuaugggggagaggcguucuccguugaacaaccucagucuuuuacauguccguacugcggcaagaugggguauaccgagacaagccuccaggaacaugugaccuccgagcacgcugagacgucuaccgaagugaucugucccauuugcgccgcccugccuggaggcgaccccaaucaugucacagaugacuucgcugcccaccuuacccuggagcacagagcuccucgggaucucgacgaaagcuccggcgugcgccauguuagacggauguuucaccccgggcgcggacugggcgggccuagagcccggcgcagcaacaugcauuucacaucuuccagcaccggaggccugucuuccagccagucuuccuacagcccguccaauagagaggcgauggaucccaucgccgagcuccugucucaacuuagcggggugcggcgcuccgcuggaggccagcugaacagcucuggcccuuccgccagccagcuccagcaacugcagaugcagcuucagcuggaaagacaacacgcucaggccgcgcggcagcaacucgagacggccagaaaugcuacacgccggaccaacacaucuagcgucaccaccacaauuacgcaguccaccgccacaaccaauaucgcuaacacagaaucuagccagcagacccugcaaaauucccaguuucugcucacgagacugaacgaccccaaaaugagcgagacagaacgccagucuauggaguccgagcgggccgauagaagccuuuucgugcaggaacugcuccugucuacccuuguucgcgaggaauccagcuccucugacgaggacgauagaggggaaauggccgacuuuggagcuaugggcuguguggauaucaugccucuggacgucgcgcucgagaaucugaaccugaaggagagcaauaaagggaacgaacccccgccucccccucucuga

SEQ ID NO: 70994 - RNA, 1488 nt, Artificial Sequence
  derived and/or modified sequence opt5 from KCNA1__Homo_sapiens__NP_000208
augaccgugaugagcggcgagaacgucgacgaagccuccgcugcccccgggcacccucaggauggaucuuacccgagacaagcggaccaugaugaccacgagugcugugaacggguugugaucaauauuagcggccugcgcuucgagacacagcucaagacgcuggcucaguuucccaacacccuucuggggaauccuaaaaagagaaugcgguauuucgauccccuccgcaacgaauacuuuuucgacagaaaucggccuuccuuugaugccauccuguauuacuaucagucuggaggccgccuuagacggcccgugaacgucccucuggacauguucagcgaggagauuaaauuuuacgaacucggggaggaagccauggagaaguuccgcgaggaugaaggauuuaucaaagaggaagagagaccgcugcccgaaaaggaguaucaacgccagguguggcugcucuuugaguacccugaauccucuggccccgcucggguuauugccaucgugagcgucauggugauccugauuuccaucguuauuuucugccuugagacacugccugaacucaaggacgauaaagacuucaccggcacagugcauagaaucgauaauaccacagucauuuacaacagcaauaucuuuaccgaccccuucuucauuguggagacgcuguguaucaucugguuuucuuucgaacuugugguccgguuuuucgcuugcccguccaagaccgacuuuuucaaaaacauuaugaauuuuaucgauauuguugccaucauuccuuauuucaucacacuggggaccgagaucgcggagcaggaaggaaaccagaagggcgagcaagccacaagccucgcuauucugcgcgugaucagacuggugcgggucuuuagaauuuucaaacucucucgccacuccaaggggcugcagauccuuggacagacccugaaggccagcaugcgggaacucggccugcuuaucuuuuuccuguuuauuggggugauccucuucucuuccgcuguuuacuucgccgaggcggaagaggccgagagccauuuuuccucuauucccgacgcuuucuggugggccguggucagcaugacgacagugggauauggcgauauguacccuguuaccaucggcgggaaaauugugggaucccugugugcuaucgccggcguccugacaauugcccuccccgugcccgucaucgugagcaauuuuaacuauuucuaccacagagaaaccgagggggaggaacaggcucaacugcuucacguuucuuccccuaaucuggcgagcgacucugaucucagccgccgguccucuagcaccauguccaagagcgaguauauggaaauugaggaagacaugaacaacucuaucgcccauuacagacaggugaauauccgcacagcuaacugcacgaccgccaaucagaacugugucaauaaauccaagcugcuuacagauguguga

SEQ ID NO: 70995 - RNA, 1962 nt, Artificial Sequence
  derived and/or modified sequence opt5 from KCNA4__Homo_sapiens__NP_002224
auggagguggccauggucagcgcugaauccucuggcugcaacagccacaugcccuacggguaugccgcgcaggcuagagcccgggagcgcgaaagacuggcccauucccgggcugccgcugccgcggccguugcugccgcuaccgccgcgguggagggaucuggcgggagcggaggcgggucccaccaucaccaucaaucucgcggagccuguacaagccacgacccucaguccagcagaggcucucggcgcagacggcgccagagauccgaaaagaaaaaggcucacuaccggcagagcucuuucccgcauugcuccgaucucaugcccagcggcucugaggagaaaauccugcgcgaacuuuccgaggaagaggaggacgaagaggaagaggaagaggaggaagaggaagggagauuuuauuacagcgaggaugaccacggagaugaauguuccuauacggaccugcucccucaagaugagggcgggggaggcuacucuagcgugcgguauuccgacugcugugagcgcgucgugauuaauguuagcgggcugagauucgaaacccagaugaagacacuugcccaguuucccgagacccugcucggagauccugaaaaacggacacaguacuucgacccccugagaaacgaguacuuuuucgaucgcaaucggccuucuuuugacgcuauccuguauuacuaucaauccggcggcagacucaagcgcccggugaacguccccuucgauauuuuuaccgaagaggugaaguucuaccagcugggggaggaagcccuucugaaauuucgggaggacgaaggauucguuagagaggaggaagaccgcgcccucccugagaaugaauuuaagaaacagaucuggcugcuuuucgaguaucccgaaagcucuagcccugcucggggcauugcgaucguguccguccuggugauccucauuucuaucgugauuuucugccuggagacacugcccgaguuuagagaugaccgcgaucucgucauggcccugagcgcugggggacauggcgggcuucugaacgacaccuccgccccgcaccucgaaaauagcggacacacgaucuucaacgaucccuuuuucauuguugagaccguguguaucgugugguuuucuuucgaauuugucgugcggugcuucgccuguccuucccaggcucuguuuuucaagaauauuaugaacaucaucgacauuguuagcauccuuccuuacuuuauuacacugggcaccgaucucgcccaacagcagggcgggggaaauggccaacagcagcaggcgaugucuuucgcuauccugagaauuauccgccuggugcgggucuuuagaaucuucaaacucucccggcauagcaaggggcugcaaauucuuggacacacacugcgcgccuccaugagagagcucggccugcuuaucuucuuucuguucauuggggugauccucuuuucuagcgccguuuauuucgcugaagccgacgagcccaccacgcauuuucaguccauucccgaugcuuucuggugggccguggucacaaugaccacagugggcuacggagacaugaagccuaucaccgucggcgggaaaaucgugggaucucugugcgcgauugccggcguucugaccaucgcucucccggugcccgucauugugagcaacuuuaauuacuucuaucaccgggagacagaaaacgaggaacagacgcagcugacccaaaaugccguuuccuguccuuaccuucccagcaaccugcucaagaaauuuagaucuuccacaucuagcucccugggggauaagagcgaguaucuggaaauggaggagggagugaaagaaucucuuugcgcuaaggaggaaaaaugccagggcaagggggacgacagcgagaccgauaagaacaauuguuccaacgccaaagcggucgagacagacguguga

SEQ ID NO: 70996 - RNA, 1842 nt, Artificial Sequence
  derived and/or modified sequence opt5 from KCNA5__Homo_sapiens__NP_002225
auggagaucgcccuggugccccucgaaaacggcggggcuaugaccgucagaggaggcgacgaggcccgggcggggugcggacaggcuacaggcggggaacugcaauguccuccgacggccggacuuagcgauggccccaaggagccugcccccaaaggccgcggggcucagagagacgccgauuccggaguucggccucugcccccucucccggaccccggcgugcgcccucugcccccucuucccgaagaacugccgagaccucggcggcccccucccgaggaugaagaggaagagggggaccccggacucggcaccguggaggaucaggcucuggggacagccucucugcaccaucagagaguccacauuaauaucagcggacuccgguucgaaacccaacugggcacacuugcgcaguuuccuaacacccugcucggcgacccggccaagcgccugagauacuucgauccccuucggaaugaguacuuuuucgaccgcaacagaccuuccuuugaugggauucuguauuauuaccagucuggaggccggcuccgcagacccgugaauguuagccuggacguguucgcugaugaaauccgguuuuaucagcugggggacgaggccauggaaagauuccgcgaggacgagggauuuauuaaagaagaggaaaagccucucccccggaacgaguuccaaagacaggucuggcugaucuuugaauacccggaguccucuggcagcgcucgcgccaucgcgauuguguccguucuugugauccugauuagcaucauuacauucugccucgagacccugccugaauuucgggaugagagagaacuucugcgccaucccccugcuccccaccagccucccgccccggccccuggggcuaauggaucuggcgucauggccccucccuccggccccacgguggccccgcuccugccccggacccuggcugacccuuucuucaucguggagacaaccugugucauuugguuuacauucgaacuccugguuagauuuuucgcgugccccagcaaagccggguuuucucgcaacaucaugaauaucauugaugugguggcuaucuucccuuauuuuauuacccuuggaacggagcuggccgagcagcaacccggcgggggaggcgggggccagaacggacagcaagccaugucccucgcuauccugcgggucauuagacuugugcgcguuuuccggaucuuuaagcugagcagacauucuaagggccuccagauccuggggaaaacacugcaggccuccaugcgggaacucggacugcuuauuuucuuucuguucaucggcgugauucucuuuagcuccgcggucuacuucgcugaggccgacaaucaggggacccacuucucuagcaucccugaugccuuuuggugggcugugguuacaaugaccaccgugggauacggcgacaugcgccccauuacagucgggggcaagaucgugggaucccugugugccaucgcuggcguccugacgauugcccuuccggugccuguuaucgugagcaacuucaauuauuuuuaccacagagaaaccgaucaugaggagcccgcgguccucaaagaggagcaagggacacagucucagggaccuggccuggaccgcggggugcagagaaagguuuccggaagccgcggcucuuucugcaaagccgggggcacccuggaaaacgcugauagcgcccggagaggauccuguccccucgagaagugcaaugugaaggcuaaaucuaacgucgaccugcgcagaagccuuuaugcccugugucucgauacaucccgggaaaccgaccuguga

SEQ ID NO: 70997 - RNA, 1590 nt, Artificial Sequence
  derived and/or modified sequence opt5 from KCNA6__Homo_sapiens__XP_011519257
augagaagcgagaagucccugacccucgccgcucccggcgaagugcgggggccugagggagaacagcaagacgccggcgauuucccggaggcgggcggaggcgggggaugcuguucuagcgaacgccuggucaucaacauuuccggccuuagauuugagacacagcugcggacgcucucucuguuccccgacacccuucugggcgauccugggcgcagaguucgguuuuucgacccccuccgcaaugaguacuuuuucgauagaaaccggccuagcuuugacgcuauccuguauuacuaucaguccggaggccgccugagacggcccgugaaugugccucucgauauuuuccuggaagagauccgcuuuuaccagcuuggggacgaagcccuggccgcuuucagagaggaugagggaugccucccggaaggcggggaggacgaaaaaccccugccuucucaacccuuucagcggcaggucuggcuucuguucgaguauccugaaagcuccggacccgcccgcggcauugcuaucgugagcguucucgugauccugauuucuaucgucaucuuuugucuggagacacucccgcaguucagaguggauggcagagggggaaacaauggcgggguuucccgggugagcccugucucucgcggaucccaagaggaagaggaagacgaggaugacagcuacaccuuccaccauggcauuacacccggggaaaugggaaccggcgggucuuccagccuguccacacuugggggaucuuucuuuaccgaccccuuuuuccugguggagacgcucugcauugugugguuuaccuucgagcugcuuguccgguuuagcgccugucccuccaagcccgcguucuuuagaaacaucaugaauauuaucgaucugguugccaucuucccuuauuuuauuacacucggcaccgaacuggugcagcagcaggagcaacagccggcuagcgggggaggcgggcagaacggccaacaggccaugucucuggcuauccuccgcgugauucggcuggucagaguguuccgcaucuuuaaacuuucccggcacagcaagggacugcagauucucggcaaaacacugcaggccucuaugagagaacuugggcugcucaucuucuuccuguuuaucggaguuauucuguucagcuccgcgguguacuuugccgaggcugacgaugacgauucucucuuccccagcaucccugacgccuuuuggugggcugucgugaccaugacgacaguuggcuacggggauauguaucccaugaccgugggaggcaagauugucgggucccugugcgccaucgccggcgugcuuacaauugcucugccuguccccgugaucguuagcaauuucaacuacuuuuaucaucgcgaaaccgagcaagaggaacagggacaguacacccacgugacauguggccagccggcgccugaccuccgggccacggauaaugggcugggaaagcccgacuucccugaggcuaacagagaacgccggcccucuuaucugccuaccccucauagagccuacgccgagaaacggaugcuuacagaggucuga

SEQ ID NO: 70998 - RNA, 1371 nt, Artificial Sequence
  derived and/or modified sequence opt5 from KCNA7__Homo_sapiens__NP_114092
auggagcccagaugcccuccgcccuguggcugcugugaacggcuggugcucaacgucgccgggcugcgcuucgagaccagagcucggacacuuggacgcuuuccugacacgcugcucggcgaucccgccagacgggggcgcuucuacgacgaugcgagacgggaauacuuuuucgaccgccacagaccuagcuuugaugcuguucuguauuauuaccaguccggaggccggcuucgcagacccgcccaugugccucuggacguguuccucgaggaagucgccuuuuaugggcugggagcugccgcucuggcccggcuccgcgaggaugagggcugcccggugcccccugaaagaccccugccucggagagcguucgcccgccaacuuuggcugcucuuugaguuccccgaaucuagccaggcugcccggguucuggcuguggucuccgugcuuguuauccuggugucuauugucguguuuugucucgagacccugccggacuucagagaugaccgcgauggcacagggcuggccgcggccgcugccgcuggaccuuuucccgccccucucaauggcagcucccagaugcccgggaaucccccucggcugccguucaacgaccccuucuuuguggucgagacccuuugcaucuguugguucucuuuugaacugcucguuagacugcuugugugcccuagcaaggccauuuucuuuaaaaacgugaugaaucugaucgauuucgucgcuauucuccccuacuuuguggcgcugggaacagagcuggcccgccagcggggcguugggcaacaggcuaugucccucgccauccugagagugauccgccuuguccggguguucagaauuuuuaagcugagccgccacucuaaaggacuccagauccugggccagacccuucgggccuccaugagagaacugggccuccugauuuucuuucuguucaucgggguugugcucuuuagcucugcugucuauuucgccgagguggaccgggucgacucccauuucacaagcauuccugaaucuuuuuggugggcggugguuaccaugacgaccgugggauacggcgauauggcucccgucacaguugggggaaagaucgugggcucccugugugccauugccggggugcuuaccaucagccugccggucccugugaucguguccaacuucucuuacuuuuaucaccgcgagacagagggagaagaggcuggcauguucagccauguugacaugcaacccugcggcccucucgaagggaaagccaauggaggccuggucgauggggaggugcccgaacugccucccccgcuuugggcuccucccggaaagcaccucgugaccgaggucuga

SEQ ID NO: 70999 - RNA, 1227 nt, Artificial Sequence
  derived and/or modified sequence opt5 from KCNAB1__Homo_sapiens__NP_003462
augcaccuguacaagcccgccugcgcugacaucccuagcccgaaacucggccugcccaaguccucugagagcgcccuuaaauguagauggcaucuggcggugaccaagacacagccucaagcugccugcaaacccguccggccuuccggggccgcugaacagaaguauguugagaaguuccuccgcgugcacggaauuucucugcaggaaacgaccagagccgagacaggcauggcuuaccggaaccuugggaaaagcggacugcgcguguccugucucggccuggggaccugggucacauuuggaggccagaucucugaugaaguggccgagagacugaugaccauugcguaugagagcggcguuaaucucuucgacacagccgaaguguacgcugccgggaaggcugaggucauccugggauccauuaucaaaaagaaaggcuggcggcgcagcucucuugugaucaccacgaagcuguauuggggagggaaggccgaaaccgagagaggccucucccggaaacauauuaucgaggggcugaagggaagccuucaacgccugcagcucgaauacguugauguggucuuugcgaacagacccgacucuaauacaccuauggaggaaauugugcgggccaugacccacgugaucaaccagggcauggcuauguauuggggcacaucccgcuggagcgccauggagauuauggaggcuuacucugucgccagacaguucaauaugaucccgcccguuugcgaacaagccgaguaccaucuguuucagcgggaaaaaguggaggugcagcugccugaacucuaucacaagauuggggucggagcuaugaccuggagcccccuggcguguggcaucaucuccgggaaauacggaaacggcgugccugaguccucucgcgccagccuuaagugcuaucaguggcugaaagaaagaauuguuuccgaggaggggcggaagcaacagaauaagcucaaagaucugagccccaucgcugaaagacuuggauguacgcugccgcagcucgccguggccuggugccugcgcaacgagggcgucucuuccgugcugcucggcagcucuacaccugaacaacugauugagaaucuuggggcuauccagguucugcccaagaugaccagccacguggucaacgaaauugacaauauccuccggaacaaaccuuacuccaagaaagauuauagaucuuga

SEQ ID NO: 71000 - RNA, 1203 nt, Artificial Sequence
  derived and/or modified sequence opt5 from KCNAB2__Homo_sapiens__XP_011540622
augcugagcaugaccuacuccgagucucucagaagcguguccucucggugccacagcgaaugggcccugcaucccguccgccagacagacacgcuugagcugcaaagacuccgggaaguucgcgcugccgcgcaggcuagaaacauggaguccuuccugcggaugcacggccuuucucuggauggguguaccgcccagcgcacaggaaugaaguauagaaaucucggcaaaagcgggcugcggguguccugccugggacucggcaccugggugacauuugggggacagaucaccgacgaaauggccgagcaacugaugacacuugcuuacgauaacggcauuaaucuguucgacaccgccgaggucuaugcugccggcaaggcggaagugguucucgggaacaucauuaaaaagaaaggauggcgcagaagcucucuggugaucacgaccaagaucuuuuggggcgggaaggccgagacagaacggggacuuucccgcaaacauauuaucgagggccugaaggcuagccucgagagacugcagcuggaauacgucgaugugguuuucgccaaucggccugacccgaacacccccauggaggaaacagugcgcgcuaugacccacgucauuaaucaggggauggccauguauuggggaacgucuagaugguccagcauggagaucauggaagcguacucuguggcccggcaguuuaaccucacaccucccauuugugagcaagcugaguaucauauguuccagagagaaaaaguggagguccagcugccugaacuuuuucacaagaucggcguuggcgccaugaccuggagcccccuggcuugcgggauuguguccggaaaauacgauuccggcaucccuccguacucucgcgccagccucaagggguaucaguggcugaaggacaaaauucuuuccgaggaaggacggagacaacaggccaagcugaaagagcuccaggcuaucgcggagcgccugggcuguacacugccccaacucgccaucgcuuggugccugcggaaugaaggggugagcucuguccuucugggagccuccaacgccgaucagcucauggagaauauuggcgcuauccaggugcugccuaaacuuagcucuagcauuauccacgaaauugacuccauccugggcaacaagcccuacucuaagaaagauuauagaagcuga

SEQ ID NO: 71001 - RNA, 1215 nt, Artificial Sequence
  derived and/or modified sequence opt5 from KCNAB3__Homo_sapiens__NP_004723
augcaagugagcaucgccugcaccgagcagaaccugagaucccggucuagcgaagaccgccucuguggccccagaccugggccgggaggcgggaauggaggccccgcugggggaggccacggcaacccucccgggggaggcggguccggaccuaaggcccgggcggcucuggucccccgcccuccggcccccgccggcgcucuuagagagucuacagggcggggaacgggcaugaaauaccgcaaucugggcaagagcgggcucagaguuuccugccugggacuuggcaccugggugacauucgggucucagauuagcgaugaaaccgccgaggacgugcugacagucgcuuaugaacauggagugaaccucuuugauaccgccgagguuuacgcggccggcaaagcugagcggacacuggggaauauccugaaguccaaaggauggcgcagaagcucuuaugugauuaccacgaagaucuucuggggcggccaggccgaaaccgagcgggggcucucccgcaagcacauuaucgaaggacugagaggcagccuugagcggcugcagcucggguacgucgacaucguguuugcuaaccgcucugauccuaauugucccauggaggaaauuguuagagccaugacauaugugaucaaccaaggacuggcgcuuuacuggggcaccucccgguggggcgccgcugagauuauggaagccuauagcauggcuagacaguucaaucugaucccucccgucugcgagcaggccgaacaucaccucuuucagcgcgagaaaguggagaugcaacugccggaacuguaccauaagauuggggugggaucugucacaugguacccucucgccuguggccugaucaccuccaaauaugacgggcggguucccgauacgugcagagcuagcauuaagggauaccaguggcuuaaagacaaggugcaguccgaggauggcaagaaacagcaagcgaaggugauggaccugcucccugucgcccaccagcugggguguacaguggcucagcuugccaucgccuggugccugcgcucugaaggaguuagcuccgugcuccugggcgucagcucugcugagcaacugaucgaacaccucggggcccuucaggugcugucccagcugacaccccagaccguuauggagauugauggccuccugggaaacaaaccccauagcaagaaauga

SEQ ID NO: 71002 - RNA, 2577 nt, Artificial Sequence
  derived and/or modified sequence opt5 from KCNB1__Homo_sapiens__XP_011527101
augcccgccggcaugaccaagcacgggagcagauccacaucuagccugccuccggagcccauggaaaucgugcgguccaaggcuugcucucgcagaguccggcucaacguuggaggccuggcccaugaggugcuuuggcgcacgcuggacagacucccucggacccgccuggggaaacuuagagauuguaauacacacgacagccugcucgaagugugcgaugacuacucccuggaugacaacgaguauuucuuugaucggcaucccggagcguucaccucuauucugaauuuuuaccgcacaggcagacuccacaugauggaagagaugugugcucugagcuucucccaggagcuugacuauugggggaucgaugaaauuuaccuggagagcugcugucaagcccgguaucaucagaaaaaggaacagaugaacgaggagcucaaacgcgaagccgagacccugagagaacgggagggagaagaguuugacaauacaugcugugcugagaagcgcaagaaacuuugggaucugcucgaaaagccuaacucuuccgucgccgcuaaaauccuggccauuaucagcaucauguucauugugcugucuaccaucgcgcucucccugaauacgcuucccgagcugcagagccucgacgaauuuggccaaucuaccgauaacccucagcuggcccacguugaggcugugugcauugccugguucacaauggaauaccuucugagauuucucuccagcccgaagaaauggaaguucuuuaagggcccccugaaugcuaucgaccugcucgccauucugccuuauuacgucaccaucuuccuuacagaguccaacaaaucugugcugcaguuucagaauguucggagagugguccaaauuuuccgcaucaugcggauccuccgcauucugaaacuugcgagacacagcaccgggcugcagucccucggauucacgcugcggagaagcuacaacgagcugggccuccugauccuuuuucuggccauggggauuaugaucuucucuucccucguguuuuucgcugaaaaggacgaggaugacacaaaguuuaaaagcauucccgccucuuucuggugggcuaccaucacaaugaccaccgugggauauggcgauaucuacccuaagacacugcuggggaaaauugucggaggccuuuguugcaucgccggcguucucgugauugcccugcccaucccgauuaucgugaauaacuuuagcgaguucuauaaggagcagaagcgccaggaaaaagcuaucaagcggagagaggcgcuggagcgcgccaaacggaauggguccauugucucuaugaacaugaaggacgcuuuugccagaagcaucgaaaugauggauauugugguugagaaaaacggagaaaauaugggcaagaaggacaaagugcaagauaaccaucucuccccuaauaaguggaaauggacgaagcgcacccugagcgagacaucuuccagcaaaucuuucgagaccaaggaacaggggucccccgagaaggcccggagcuccucuagcccucagcaccuuaacguccaacagcuggaagacauguacaauaaaauggcuaagacacagucccagcccauccucaacaccaaagagucugccgcgcaaagcaagcccaaagaagaacuggagauggaauccauuccuagcccgguggcuccccugccuacgagaacagagggaguuaucgauaugcggucuauguccagcauugacucuuuuaucuccugugccaccgauuuccccgaagccacccgcuuuagccauucuccucuuacaagccuccccuccaagaccggcgggagcacagcuccggaggugggauggagaggcgcccugggcgcuucugggggacgguucgucgaagccaauccuucccccgacgcgagccagcacuccucuuucuuuaucgagagcccuaaguccucuaugaaaacgaacaauccccugaagcucagagcccugaaagugaacuucauggagggcgacccuagcccccuucugccgguccucgggauguaucacgauccucugcgcaaucggggauccgcugccgcugccguggcgggccuggaaugcgccacccuucucgacaaggcuguucugucucccgagagcuccauuuacacaaccgccagcgcuaaaacacccccuagaucuccggaaaagcauaccgccaucgccuuuaacuucgaggcuggggugcaccaguauauugaugcggacacggaugacgaaggccagcugcucuacuccgucgauagcucucccccuaaaucccugcccggaagcaccucuccuaaguuuuccacaggcacccgcagcgagaagaaucauuucgaguccagcccccuuccuacaucucccaaauuucugagacaaaacugcaucuacagcaccgaagcccucacggggaagggaccguccggccaggagaaauguaagcuggaaaaucacauuucuccugacgugcggguucugcccgggggaggcgcucaugggagcacacgcgaucaguccaucuga

SEQ ID NO: 71003 - RNA, 2736 nt, Artificial Sequence
  derived and/or modified sequence opt5 from KCNB2__Homo_sapiens__NP_004761
auggccgagaaggcucccccuggccugaacagaaaaaccagccgguccacacucucucugccgcccgaaccuguggacaucauucgcagcaagacgugcuccagacgggucaaaaucaauguugggggacuuaaccacgaggugcuguggcgcacccucgauagacugccccggacacgccuuggcaagcugagagacuguaauacccaugaaucucuccuggaggugugcgaugacuacaaccugaaugaaaacgaguauuucuuugaucggcacccuggggccuucacaagcauucucaauuuuuaccgcaccggaaaacugcauaugauggaggaaaugugugcgcuuuccuucggccaggagcuggacuauugggggaucgaugaaauuuaccucgagucuugcugucaagcuagauaucaccagaagaaggagcagaugaacgaagaacugcggcgcgaagccgagacaaugagagaacgggagggagaggaauuugacaauaccugcugucccgauaaacgcaagaaacuuugggaccugcucgagaagccuaacagcuccgucgccgcuaaaauccuggccaucgugagcauucuguucaucguucucucuacgauugcucugucccuuaauacccugccggaacuccaggagacagaugaauuuggccaacugaacgacaauagacagcuugcccauguggaggcggucugcaucgccugguucaccauggaguaccugcuccgguuucugagcucucccaacaaguggaaguucuuuaaaggcccucugaaugugauugaucuccuggcuauccuucccuauuacguuacaauuuuccugaccgaauccaacaagagcgugcuccaguuucagaacgucagacgcguggugcaaaucuuccggaucaugcgcauucugagaauccuuaaacuggcccggcacucuacggggcuccagucccugggauucacacugagacgcagcuacaaugagcucggccugcuuauucuguuucucgcuauggggaucaugauuuucuccucucuggucuuuuucgccgaaaaggacgaggacgcgaccaaauuuacaagcaucccugccuccuucuggugggcuaccaucaccaugacaacgguuggauauggcgauauuuaccccaagacccugcuugggaaaaucgugggaggccucuguugcauugccggcgugcuggucaucgcucugccgauuccuaucaucgugaacaauuuuagcgaguucuauaaggagcagaagcggcaggagaaagccauuaagagacgcgaagcccucgagcgggcuaaaagaaacgggucuaucguuuccaugaaucugaaggacgcguuugcccgcagcauggaacuuauugauguggcugucgagaaagccggagagucugccaacacaaaggacagcgcugaugacaaucaccugucccccucucgguggaagugggccagaaaagcgcucagcgaaaccuccagcaacaagucuuucgagaauaaauaccaagaagugucccagaaggauagccaugagcagcugaacaauacaucuuccagcuccccucaacaccugucugcucagaaacuugaaaugcucuauaacgagaucaccaagacgcagccccauagccaccccaauccugacugucaggagaagccggaacggcccuccgccuacgaggaagagauugaaauggaggagguugugugcccucaagaacagcuggccgucgcucagacagaggugaucgucgauaugaaaucuaccagcuccauugacagcuuuaccucuugcgccacagauuucaccgaaacagagcgcagcccccugccucccccguccgcuucucaccuccagaugaaguuuccuacggaccugcccggcaccgaggaacaucaaagagcccgggggccucccuuccuuacacuguccagagagaaaggaccugcggcccgcgacggcacccucgaauaugcucccguggauaucacaguuaaccuggacgccagcgggucucaguguggacugcacagcccgcuucaguccgauaaugcuaccgacagcccuaagucuucccucaaaggcagcaacccccugaagucccggucucugaaggugaacuucaaagagaauagaggcagcgcgccccagacgccuccguccaccgcccgcccccucccugucacaaccgccgauuuuucucugacaacgccccaacauaucagcaccauucuucuggaagagacaccuucccagggggacagaccccuccugggaaccgaggugucugcuccuugccagggccccagcaaggggcuguccccgcgguucccuaaacagaaacuuuuucccuucagcucucgcgaaagacgguccuuuacagagaucgauaccggagacgaugaagacuuccucgagcugccuggcgcccgcgaagagaagcaaguugauagcucucccaacuguuuugcugacaagccguccgaugggagagacccucugcgggaggaaggcagcgugggaucuuccagcccccaggacaccggccacaauugccgccaggauauuuaccaugccgucuccgaggugaaaaaggacagcucucaagaaggguguaagauggagaaccaccucuucgccccugaaauccacagcaaucccggagauacaggcuacugccccacgagagagaccuccauguga

SEQ ID NO: 71004 - RNA, 1758 nt, Artificial Sequence
  derived and/or modified sequence opt5 from KCNC1__Homo_sapiens__NP_001106212
augggccagggggacgagagcgaaagaaucgugauuaacgucggaggcacccggcaccaaacauaccgcuccacgcugagaacccuccccgggacacggcuggccuggcuugcugagccugaugcccauucucacuucgacuaugauccgcgcgcggacgaauuuuucuuugauagacaucccggaguuuucgcucacauccugaauuacuaucggaccggcaagcuccauugcccugccgacgugugugggccccuguacgaggaggaacuugccuuuuggggaauugaugagacagacguggaaccuugcuguuggaugaccuaucgccagcacagagaugcugaggaagcccuggacagcuucggcggcgcuccccucgauaacuccgccgacgaugcggacgccgacgggccuggagauucuggcgacggggaggaugagcuggaaaugacaaaacggcuggcucucagcgacuccccggauggacgccccggcggguuuuggagacgguggcagccucgcaucugggcccuguucgaggaccccuacucuagcagauaugcucgguacgucgccuuugcgucccuuuucuuuauucuggugagcaucaccacguucugccucgaaacccacgagcgcuuuaauccuaucguuaacaagacagaaauugagaaugugagaaacggaacccagguccgguacuauagagaggccgaaacagaggcuuuccugaccuacaucgaaggcguguguguugugugguucacguuugaguuccuuaugcgcgucauuuucugccccaauaaaguggaauuuaucaagaacucucugaauauuaucgauuuuguggccauucucccguucuaucuggaggucggccuguccgggcucagcucuaaagcugccaaggacguucugggauuucuucggguggugagauucguccgcauccugcggaucuuuaagcucacaagacauuucgugggccugcgcguucuugggcacacccugcgggccuccacaaacgaguuucuccugcugauuaucuuccucgcucugggagugcuuauuuuugcgaccaugaucuacuaugccgaaagaauuggcgcucaaccuaaugaucccagcgccucugagcauacccacuucaaaaacaucccuaucggguucuggugggccgucgugacaaugacgacccugggauacggcgacauguauccccagacaugguccggcaugcucguuggggcucugugugcccuugcgggagugcugaccauugcuaugcccgucccugugaucgucaauaacuuuggcauguacuacagccucgccauggccaagcagaaacugccgaagaaaaagaagaaacacauuccccgcccuccccagcugggguccccuaauuauugcaagucugugguuaacagcccccaucacuccacacaaagcgauaccuguccgcucgcucaggaagagauccuggaaauuaaccgggccgacucuaaacuuaauggagagguggcuaaggccgcgcuggccaacgaggacugcccucauaucgaucaggcucucacgcccgacgaaggccugccuuucacaagauccgggacccgcgagcgguacggccccuguuuucugcuuagcaccggagaauaugccugcccucccggcgggggaaugagaaaagaucucugcaaggagucuccggucaucgcuaaauacaugccuacagaggccgugcggguuaccuga

SEQ ID NO: 71005 - RNA, 1890 nt, Artificial Sequence
  derived and/or modified sequence opt5 from KCNC2__Homo_sapiens__NP_001247427
augggcaagaucgagaacaaugaaagagugauucugaacgucgggggaacccggcacgagacauaccgcagcacgcucaaaacccugcccggcacaagacuugcccugcucgcuuccucugaaccuccgggggacugccugaccacagccggagauaaacuucagcccagcccucccccucugucucccccuccgcgggcgcccccucucucccccggcccugggggauguuucgagggcggcgcugggaauugcagcucccgcggaggcagagccucugaccaucccgggggaggccgggaauuuuucuuugaucgccacccggggguuuucgccuaugugcugaacuacuauagaaccggaaaacugcauuguccugcugacgugugcggcccccucuuugaggaggaacuggccuucuggggcaucgaugagacagacgucgaaccuuguugcuggaugaccuaccggcaacaccgcgaugcugaggaggcccuugacauuuuugaaacgcccgaucugaucgggggagaccccggcgaugacgaggaucucgcggccaagagacuggggauugaagacgcugccggacuuggcgggccugacggaaaaagcggccgguggcgcagacugcagccgcggaugugggcucucuucgaggaucccuauuccagccgcgccgcgagauuuaucgccuucgcuucucuguuuuucauccugguguccauuaccacauuuugucucgaaacccaugaggccuucaauaucguuaagaacaagacagagccugugauuaauggcaccagcgucgugcugcaguacgaaaucgagacggaccccgcucuuacauauguugaaggggugugcgucgugugguucaccuuugaguuccuggugcggauugucuuuucuccuaacaaacucgaguucaucaagaaucugcuuaacauuaucgauuuuguugccauccugcccuucuaccucgaagugggacuguccggccugagcucuaaagccgcuaaggacgugcucggguuucugagagucgugcgcuucguucggauucuuagaaucuuuaaacugacacgccacuucgugggacuccggguccugggccacacccuuagagcguccaccaaugaguuucugcuccugauuaucuuccuggcccucggggugcugauuuuugcuacaaugaucuacuaugccgaacgcguuggcgcccagccgaacgauccuagcgcuuccgagcauacgcaauucaagaauauccccauuggauucuggugggccguggucaccaugacaacccuuggcuacggggacauguauccucagacauggucuggaaugcuggugggcgcgcucugugcucuggccgggguccugaccaucgccaugcccgugccuguuauugugaacaauuuuggaauguacuauagccuugcuauggccaagcagaaacucccccggaagagaaagaagcacaucccgccugcuccccaggccuccagccccacguucugcaaaacagaacugaacauggcguguaacucuacccaauccgauaccugccugggcaaggacaaucgccuccuggagcauaaccggagcguccuuucuggggaugacagcacaggcuccgaaccuccgcugucucccccugagagacuccccauucgccggagcuccaccagagauaaaaaucggcgcggagagacaugcuuucugcugacgaccggcgacuacacaugugccagcgacgggggaaucagaaaggugcuuuaucggaucuaccacggccuccugaccgcugaaaaggggacaguugaguucucucacaccaaagauuacacgggaaacagacugcuccugcuuaaugugccuuga

SEQ ID NO: 71006 - RNA, 2274 nt, Artificial Sequence
  derived and/or modified sequence opt5 from KCNC3__Homo_sapiens__XP_006723266
augcugagcuccgugugcgucucuagcuucagaggccggcagggggccuccaagcaacagcccgcuccuccgccccagccucccgagucuccucccccuccgccccucccuccccagcaacagcagccugcccagcccggaccggcggcuagcccugccggccccccugccccccgcgggcccggagacagacgggcugaaccuuguccgggccugcccgccgcugccauggggcgccacggaggcggcgggggagauuccggcaaaaucguuauuaacguggggggagugagacaugagaccuaccggucuacacuucgcacgcugccuggcaccagacucgcggggcugacagaacccgaggccgcugcccgguuugacuaugauccuggagcugacgaauucuuuuucgaucgccaccccggcgucuuugccuacgugcuuaauuauuacagaaccggcaagcugcauugcccggcggacguuugugggccucucuucgaggaggaacugggauuuuggggcaucgaugagacagacguggaagccugcuguuggaugaccuaucggcaacaccgcgaugcugaggaggcccuggacagcuucgaagcucccgauccugccggggccgcuaacgcggccaaugcugccggagcccaugacggcgggcucgaugacgaggcuggagccggcggcgggggacuggacggcgcggggggagaacuuaaaagacugugcuuucaggaugcuggcgggggcgccggaggccccccugggggagccggcggggcuggaggcacaugguggcggcgcuggcagcccagagucugggcccucuucgaggacccguacuccagccgggcugccagauauguggcguuugccucucuguucuuuauucuuaucuccauuaccacguucugucuggaaacccacgagggguucauccacaucagcaacaagacaguuacccaggcuucuccuauucccggcgcccccccugagaauaucacaaacguggaagucgagaccgaaccguuucucacguacguggagggagugugcgucguuugguucacauuugaauuccugaugcgcauuaccuuuugucccgauaaaguggaguuccugaaguccagccucaauaucauugacugcguggcuauccugccuuuuuaccuugaggucggccugucugggcucuccagcaaggccgcgaaagaugugcugggauuccuucggguugugagauuuguccgcauucugcggaucuucaagcucacaagacauuuugugggccugcgcguucuggggcacacccuccgggccuccaccaacgaauuccugcuucugaucauuuuucucgcucugggagugcuuaucuucgccacaaugauuuauuacgcugagagaaucggcgccgaccccgaugacauucuggggucuaaucauacguauuucaaaaacaucccuaucggcuuuuggugggccgucgugaccaugacaacccucggauacggcgauauguaucccaagacauggagcgggaugcuggucggagcucugugugcgcucgccggcgugcugaccauugcuaugccuguucccgugaucgucaauaacuucgggauguacuauucccuugccauggccaaacaaaagcugccgaagaaaaagaauaaacacauuccucgccccccucagcccggaagcccgaacuacugcaagccugaccccccuccccccccuccgccccacccucaucacggcucugggggcaucucccccccucccccuauuacgccgcccagcaugggagugacaguugcuggcgccuacccugcggggccccauacccacccuggacuccugcggggcggggcuggaggccugggcaucauggggcuucccccgcucccugcccccggagaacccugcccucuggcccaggaggaagugaucgagauuaauagagcugauccccgcccuaacggcgacccggccgcggcugcccuggcccaugaggacugucccgcuaucgaucaaccugccaugucucccgaagacaaaagcccuauuacccccgggucccggggaagauauucucgggaucgcgcuugcuuucuccugacagacuacgccccgagcccugauggcuccaucagaaaggcgaccggggcccccccucuucccccucaggacuggcggaaacccggaccgccuagcuuccugcccgaucucaacgcuaaugccgcugccuggauuucucccuga

SEQ ID NO: 71007 - RNA, 1893 nt, Artificial Sequence
  derived and/or modified sequence opt5 from KCND2__Homo_sapiens__NP_036413
auggccgcuggcguggccgcguggcugcccuucgcuagagccgccgcuaucggguggaugccugucgccagcggaccgaugcccgcuccuccccggcaggagcgcaagagaacccaagacgcccucauuguucugaacguguccggcacacgguuucagacguggcaggauacccuugaacgcuacccugacacacugcucgggucuagcgagagagauuucuuuuaucaccccgaaacccagcaauacuucuuugaccgggauccugacaucuuccgccauauucugaauuuuuauagaacaggaaaacuucacuacccgcggcaugagugcaucuccgcguaugaugaggaacuggccuucuuuggccucauucccgagaucaucggggacuguugcuacgaagaguauaaggaucgcagacgggaaaacgcugagcgccugcaggacgaugccgacaccgauacagcuggagagucugcccugccuaccaugacggcgagacagcggguguggcgcgccuucgaaaauccccacaccagcacaauggcucucgucuuuuacuacgugaccggcuucuuuauugccguuuccgugaucgcuaacgucguggagacaguuccuuguggcucuagccccgggcauauuaaagaacugccgugcggagagagauaugccguggccuucuucugucuugacaccgcuugcgucaugaucuuuacgguggaauaccugcuccggcuggcggccgcuccuuccagauaucgcuucgugcggagcgucaugucuauuaucgacguuguggccauucuucccuacuauaucggccuggugaugacagauaaugaggacgucuccggggccuuugugacccucagaguuuuccgcguguuucggaucuucaaguuuagcagacacucucagggacugcgcauucugggcuacacacucaaauccugugcuagcgagcugggguuccuucuguuuucucucaccauggccaucauuaucuucgcgaccgucauguuuuaugcugaaaagggauccagcgccuccaaguucacaucuauuccugccgcuuuuugguacacgaucgugaccaugacaacccugggcuacggcgauaugguucccaaaacaaucgccgggaagauuuucggaagcaucugcucccuuagcggcgugcuggucauugcucuccccgugccugucaucgugucuaacuucucccggauuuaucaccaaaaucagagagccgacaaacgccgggcgcagaagaaagccagacuggcucgcauccgggccgcuaagagcgggucugccaacgcguacaugcagagcaagagaaauggacugcucuccaaccaacugcagucuagcgaggaugaacaggccuuuguuuccaaaagcgggucuuccuucgagacccaacaucaccaucuucugcacugucucgaaaagacgacaaaucacgaguuuguggacgagcaggucuucgaagagagcugcauggaaguggcuaccguuaaccggccgucuucccauagccccucccugucuagccagcagggcgugaccuccacauguugcucucgcagacacaaaaagaccuuucggaucccuaaugccaacgucagcggaucccaucaaggcagcauucaggagcuuucuacaauccagauuagaugcguggaacgcacgccccuguccaauagccggucuucccucaacgcuaaaauggaggagugugugaagcugaacugcgaacagccuuauguuaccacagccaucauuagcauccccaccccgccugucacaacccccgagggcgaugacagaccugaaucucccgaguacagcgggggaaauauugugcgcguguccgcccuguga

SEQ ID NO: 71008 - RNA, 390 nt, Artificial Sequence
  derived and/or modified sequence opt5 from KCNE1__Homo_sapiens__NP_001257334
augauccugagcaacaccacagccgugacgcccuuccucaccaagcuguggcaggagacaguccaacagggcgggaauauguccggacuugcuagacggucuccucgcagcuccgacggcaaacuggaagcccucuacguucugauggugcuuggguuuuucggauuuuucacccugggcauuaugcucucuuauaucagaagcaagaaacuggagcacuccaacgauccguuuaauguguacauugaaucugacgcguggcaggagaaggauaaggcuuauguccaggcccgggugcuggaaagcuaccgcuccugcuauguuguggagaaccaccucgccaucgagcaacccaauacacaucugccugaaaccaaacccagcccuuga

SEQ ID NO: 71009 - RNA, 372 nt, Artificial Sequence
  derived and/or modified sequence opt5 from KCNE2__Homo_sapiens__NP_751951
augagcacccuguccaacuucacacagacgcucgaggacguguuuagacggaucuucauuaccuacauggauaauuggcgccaaaacacaaccgccgaacaggaggcucugcaggccaaggucgacgcggaaaauuuuuauuacguuauccuuuaucugauggugaugauuggcauguucucuuuuaucauuguggcuauccucgucagcacagugaaauccaagagacgggagcacucuaacgaucccuaccaucaguauaucguugaagacuggcaagagaaauacaagagccagauucugaaucuugaggaauccaaagccaccauccacgagaacauuggggccgcuggauucaagaugucuccuuga

SEQ ID NO: 71010 - RNA, 312 nt, Artificial Sequence
  derived and/or modified sequence opt5 from KCNE3__Homo_sapiens__NP_005463
auggagaccacaaacggcacggaaaccugguacgagagccugcacgccgugcucaaggcucugaaugccacacuucauuccaaccugcucugcagacccgggccuggacugggcccggacaaucagaccgaggaacggcgcgcgucucuucccgggagagaugacaacagcuauauguacauccuguucgucauguuucucuucgcuguuacagugggaucccugauucugggcuauacccggucucgcaaaguggauaagagaagcgacccuuaccacgucuauaucaaaaaucggguguccaugauuuga

SEQ ID NO: 71011 - RNA, 666 nt, Artificial Sequence
  derived and/or modified sequence opt5 from KCNE4__Homo_sapiens__NP_542402
augcacuuccugaccaucuaccccaacugcagcuccggcguggucagagcccagucucggacagagcagaagaauccucucgggcuggacgaucuuggcauucagaaccugggacagacgguuagccucgcuccggccguggaagcggcuuccaugcugaaaauggagccccuuaauucuacccauccugggacagccgccagcuccucuccccuggaaagccgcgcugccggaggcggguccggaaacggcaaugaguauuuuuacauccucguggucaugagcuucuauggcauuuuucugaucgggauuaugcugggauacaugaagucuaaaagacgggaaaagaaauccagccuccugcuucuguauaaggacgaggagcgccucuggggcgaagcuaugaagccucugcccgugguuucugggcuuagauccgugcaggucccucugaugcucaacaugcugcaagagagcguggccccggcgcugucuuguacccucugcuccauggaaggagauagcguuuccucugagagcuccagccccgacgugcaccugacaauccaggaggaaggcgccgaugacgagcuugaagagaccucugaaacaccucugaaugaguccagcgaggggucuagcgaaaacauccaucaaaauuccuga

SEQ ID NO: 71012 - RNA, 429 nt, Artificial Sequence
  derived and/or modified sequence opt5 from KCNE5__Homo_sapiens__NP_036414
augaacugcagcgagucccagagacugcggacccuccugucucgccuucugcucgaacugcaccauagaggcaaugccagcgggcuuggagcuggcccccggccuuccauggggaugggaguggucccggaccccuucguuggccgcgaggugacaucugccaagggggaugacgcguaccuguauauccuccugauuaugaucuuuuacgcuugucuggccggaggccucauucuggccuauacgagaagccggaaacuuguggaagcuaaggaugagccuucccaagccugcgcugaacacgagugggcccccggcggggcgcugaccgccgacgcugaggccgcugccggaucucaggcggaaggccgcagacagcucgccagcgaggggcugccugcucuugcccagggagcugaacgggucuga

SEQ ID NO: 71013 - RNA, 1311 nt, Artificial Sequence
  derived and/or modified sequence opt5 from KCNG3__Homo_sapiens__NP_579875
augaccuucggcagaagcggggccgcuuccgugguccugaacguuggaggcgcccgguacucucucagccgcgagcugcuuaaggacuuuccccugagacgggugucccgccuccacgggugcagaucugaacgggaugugcuggaggucugugacgauuaugaccgcgaaagaaaugaguacuucuuugaucggcauagcgaagcguucggauuuauccuucuguaugugcgcggccacgggaaacucagauucgcuccucggaugugcgagcuguccuuuuacaacgagaugauuuauuggggacuggaaggcgcccaucucgaguacuguugccagcgcagacuggacgaucggaugucugacacauauacguucuacagcgccgaugaaccgggcguucuugggcgcgacgaggcuagacccggaggcgccgaggcugccccuucccggagauggcuggaacgcaugcggagaaccuuugaggaacccacaagcucucucgcggcccaaauccuggcuuccgugagcgucguguucguuauugugucuauggucgugcuuugugccuccacccugccugauuggcgcaaugcugccgcggacaaccggagccucgaugacagaucucgcuacuccgccgggcccggacgggagccuagcggcaucauugaagcuaucugcaucgggugguuuacagccgaguguauugugagauucaucgucuccaagaauaaaugcgaguuuguuaagcgcccgcugaacauuaucgaccugcucgcuauuacccccuauuacaucucugugcugaugacaguguucaccggagaaaauagccagcuucagcgggccggcgucacgcugagagugcuccgcaugaugcggauuuucuggguuaucaaacuggccagacacuuuaucggccuucagacccuggggcucacacugaagcgguguuaucgcgagauggugaugcugcucgucuucauuugcguggcuauggcgaucuuuuccgcccugagccaacuucuggaacauggacucgaucuggagaccucuaacaaggacuucacauccauuccugcugccuguugguggguuaucauuagcaugaccacggugggcuacggggauauguaucccaucacagucccuggaagaauccuuggcggggugugcgucgugucuggaauuguucugcucgcccugcccaucaccuuuauuuaccacagcuucgugcagugcuaucacgaacugaaauuucgguccgcuagauacucucgcagccucuccacagaguuccugaauuga

SEQ ID NO: 71014 - RNA, 1560 nt, Artificial Sequence
  derived and/or modified sequence opt5 from KCNG4__Homo_sapiens__NP_758857
augcccaugccuagcagagacggcgggcugcacccgcggcaucaccauuacggaucccacucucccuggagccagcuccuguccucuccuauggagacccccagcaucaagggccuuuauuaccgcagagugcggaaagucggggcccuggaugcuuccccuguugaccucaagaaagaaauucugaucaacgugggaggccgcagauaucuucugcccuggucuacacucgaucgguucccucugagccgccuguccaagcucagacugugccggagcuacgaggaaauugugcaacuuugugacgauuaugacgaggauucucaggaauuuuucuuugaccgcuccccgagcgccuucggggucaucgugucuuuucuggcggcuggaaaacucguucugcuucaggagaugugcgcccuguccuuccaggaggaacucgccuacuggggcauugaggaagcucaucuggagagauguugccugcggaagcuccugcgcaagcuggaggaacuggaggaacucgccaaacugcacagagaggaugugcuucggcaacagcgcgaaacgagacggcccgcuagccacucuuccagauggggccuguguaugaaucgccuccgggagauggucgagaacccucagagcgggcugcccggaaagguguuugccugccuguccauccucuucguugcgaccacagccgugucucugugugucagcaccaugccugaccuuagagcugaagaggaucagggcgaaugcucccgcaaauguuauuacaucuuuauuguggagacaaucugcguggccugguucagccuggaauuuugucuccgguucguccaagcucaggacaagugccaguuuuuccaggggccccugaauauuaucgauauucuugccaucucuccguacuauguuucccuggcggugagcgaggagccucccgaagacggagagagaccuucuggcagcuccuaccucgaaaaaguggggcugguccugcgcgugcuccgggcccugcgcauucuuuauguuaugagacuggcucggcauucucucggacugcaaacccugggccuuacagugagacgcugcacccgggaguucggccuccugcugcucuuucuggccgucgcuaucacgcuuuucagcccccugguguacguugccgaaaaggaguccgggagagugcucgaguuuaccagcauccccgccucuuauuggugggcuauuaucuccaugacaaccgucggauacggcgacauggugccucggagcgucccggggcagaugguggcgcugucuuccauucugagcggaauccuuauuauggccuuccccgcuacauccaucuuucacaccuucucucauagcuaucucgaacugaagaaagagcaggaacaacugcaggcccgccucagacaccuucagaacacgggcccugccuccgagugugagcuucuggauccccacguugcuucugaacaugagcucaugaaugacgugaacgaucugauccuggaagggccugcccuucccauuaugcacauguga

SEQ ID NO: 71015 - RNA, 2889 nt, Artificial Sequence
  derived and/or modified sequence opt5 from KCNH1__Homo_sapiens__NP_002229
augaccauggccggcgggagacggggacugguggcuccccagaacacauuccucgagaauaucguccgcagaagcaacgacacgaauuuuguucugggcaacgcccaaauuguggauuggccuaucguguacuccaaugacggguucugcaagcugucuggauaucaccgggcggaagucaugcagaaaagcuccaccuguucuuuuauguacggcgagcugacagauaaggacaccauugaaaaagugcgccagacauucgagaacuaugaaaugaauagcuuugagauccucauguacaagaaaaacagaaccccgguuugguucuuugugaagauugcucccauccggaaugagcaggauaaggucgugcuguuccuuugcacauuuuccgacaucaccgccuucaaacaaccuauugaagaugacucuuguaagggguggggaaaauuugcccgccugacgagagcucucaccagcucccggggcguucugcagcagcuggcccccagcgugcagaagggcgagaacguccauaaacacucucgccucgcugaagugcugcaacuuggguccgauauccugccucaguauaagcaggaggcccccaagacaccuccgcauauuauccuccacuacugcguguucaaaaccacaugggacuggauuauccugauucuuaccuuuuauacggcgauccugguccccuacaauguuagcuucaagacaagacagaacaauguggccuggcucguggucgauucuaucguggacguuauuuuccugguggauaucguccugaacuuucauaccacauucgugggaccugcuggcgagguuauuuccgaccccaaacucauccggaugaauuaccugaagaccugguuugugauugaccuucugagcugucucccuuaugaugucaucaacgccuucgaaaacguggacgaggggaucucuucccuguuuagcucccuuaaagucgugcgccugcucagacugggacggguugcucgcaagcuggaucacuacauugaauauggcgccgcggugcucguccugcuugugugcguuuucgggcuggccgcucacuggauggccuguaucugguacucuauuggagacuaugagaucuuugaugaagacaccaaaacaauuagaaauaacagcuggcucuaccaacuggcuauggauaucggcacgcccuaucaguucaauggcuccgggagcggaaagugggagggcgggccgucuaagaacuccguguacaucagcucucuuuacuuuaccaugacaagccugaccuccgucggauucggcaauauugccccuucuacagacaucgagaaaauuuuugccguggcuaucaugaugauugggagccuccuguaugcgaccaucuucggaaacgugacgacaauuuuucagcaaauguacgccaauaccaaccgguaucaugaaaugcuuaauuccguuagagauuuccucaagcuguaccagguccccaaaggccuuagcgagcgcgugauggacuauaucgugucuaccugguccaugagccggggcaucgauacagaaaagguccugcagauuugcccuaaagacaugagagcugacaucugugugcaccucaaccgcaagguuuucaaggagcaucccgccuuucggcuggccucugaugggugccugagagcucuugccauggaguuccagaccgugcacugugcgcccggagaccucauuuaccacgcuggcgaauccgucgauagccugugcuuugugguuuccgggucucuggaggugauccaagacgaugaagucguggccauucucggaaaaggcgacguuuucggggauguguuuuggaaggaggccacacuggcucagagcugcgccaauguccgcgcucuuacguauugugaccugcaugugaucaaacgggaugcccuccagaaggugcuggaguucuacaccgcguuuucccacucuuucagcagaaaccugauccuuacauacaaucuccgcaaacggauugucuuuagaaagaucuccgacguuaagcgcgaagaagaggagcggaugaaaagaaagaacgaagccccucugauucugccgcccgaucauccugugcggcgccucuuccagagauuucggcaacagaaagaggcuagacuggccgcugaacgcggcggacgggaccuugaugaccuggacguggagaagggcaauguccucaccgagcacgccagcgcgaaccauucucuggugaaagccuccguugugacagucagagaaagccccgcuaccccugugucuuuccaggccgcuuccacgagcgggguucccgaucacgccaagcugcaggccccgggaucugagugccuuggcccuaaagggggaggcggggacugugcuaagcgcaagagcugggcgagauuuaaagaugccugcggcaaguccgaagacuggaacaaagugagcaaggcugagucuauggaaacccuccccgagcggacaaaagccuccggagaggccacccugaagaagacagauagcugugacuccggcaucaccaaaucugaucugcgccucgacaaugucggggaagcuagaagcccucaagaucggucccccauucuggccgaggugaagcacucuuucuauccuauccccgaacagacgcuucaggcgacaguucuggaggugcgccaugaacucaaagaggacaucaaggcucugaacgccaaaaugaccaauauugagaagcagcugagcgaaauccuucggauucucacauccagacgcucuagccaauccccgcaggagcuguucgaaaucagcagaccucagucucccgaguccgaacgggauauuuuuggagccagcuga

SEQ ID NO: 71016 - RNA, 3480 nt, Artificial Sequence
  derived and/or modified sequence opt5 from KCNH2__Homo_sapiens__NP_000229
augcccgugagacggggccacgucgccccucagaacaccuuccuggacacaaucauucgcaaguuugaggggcaaagcagaaaauucaucauugcuaaugcccggguugaaaacugcgcggugaucuacuguaaugauggauuuugcgagcucuguggcuauucccgcgcugaagugaugcagagaccgugcacgugugacuuccugcaugggccccggacccagcgcagagccgccgcucagauugcccaagcccuucugggagccgaggaacggaaggucgagaucgcguuuuaccgcaaagauggcucuugcuuccucugucugguggacguugugccugucaagaacgaggauggggccgugaucauguuuauucuuaauuucgaaguugugauggagaaagacauggucggaagccccgcucacgauacaaaccauagaggcccucccaccuccuggcuggccccuggccgggcuaagacauuucgccucaagcugccggcccugcucgcgcugaccgccagagaaucuagcgugcgguccgggggagcuggcggggccggagcucccggcgccguggucguugacguggaucuuaccccugccgcucccucuagcgagucccuggcgcucgacgaggugacagccauggauaaucacgucgcugggcugggaccugccgaagaacgcagagcccuugugggccccggcagcccgccucggucugcucccgggcagcugccuucccccagagcccauagccucaaccccgacgcgucuggauccagcugcucucuggcucgcacgcgguccagagaaagcugugccuccguucgccgggccucuagcgcugaugacaucgaggccaugagagcuggcgugcugccuccgcccccucgccacgccuccaccggggcgaugcacccccuccggagcggacugcuuaauucuacauccgacagcgaucuggucagauaucgcaccauuucuaaaaucccucagauuacacucaacuucguggaccugaagggcgaucccuuucuugccagcccgaccuccgaccgggaaaucauugcuccuaaaaucaaggagagaacgcauaauguuacagagaaagugacccagguccugucucucggggccgaugugcugcccgaauacaagcugcaagcuccucgcauccaccgguggacaauucuccauuauagccccuucaaggccgucugggacuggcugauccuucugcucgugauuuacaccgcgguuuuuaccccuuauuccgccgcuuuccugcuuaaagagacagaagagggacccccggccacggaaugcggcuacgcuugucagccucuggccguggucgaucucaucguggacauuauguucaucguugauauccugauuaacuuuagaaccacauacgugaaugccaacgaggaggucgugagccaccccggccggaucgcugugcacuauuucaaggggugguuucugauugacaugguugcggccauccccuucgaucuccugauuuuuggaucuggcuccgaggagcuuaucgggcugcucaaaaccgcucgccugcugagacuuguccggguggccagaaagcucgaccgcuacagcgaauauggagccgcugugcuguuccugcucaugugcacauuugcccugaucgcgcauuggcuugcuugcauuugguacgccaucggcaauauggagcagccucacauggacucucggauuggguggcugcauaaccucggcgaucagaucggaaaaccguauaacuccagcggccuugggggacccuccauuaaggacaaauacgucaccgcccuguauuucacguuuucuagccugacauccgugggcuucgggaauguuucuccuaacaccaauagcgaaaagaucuuuuccauuugugugaugcucaucggaagccugauguacgcuucuaucuucggcaacgucuccgccauuauccaaagacuguacagcgggaccgcgcgcuaucacacacagaugcucagagugcgggaguuuauucgcuuccaucagauccccaauccucugagacaacggcuugaggaauacuuccagcacgcuuggucuuauaccaacggcauugauaugaaugccguucugaagggauuucccgagugccuccaggccgacaucugucugcaccugaaccgcucccuucuccagcauugcaaaccuuucagaggcgcuacaaaggggugucugcgggcccuggcuaugaaauuuaagacgacccacgcucccccgggagauacacucgugcaugcgggcgaccugcuuaccgcccuguacuucaucagccgcgggucuauugaaauccucagaggagaugucgugguugcuauucugggcaaaaaugacaucuuuggggagccucugaaccuuuaugcccggcccggcaagagcaauggagaugugcgcgcucucacauacugcgaccugcacaagauucacagagaugaccugcucgagguccuggauauguauccugaauuuuccgaccauuuuuggagcucucuugagaucaccuucaaccugcgggacacgaauaugauccccggcuccccggggagcaccgaacucgagggaggcuuuuccagacaacgcaaacggaagcugucuuucagacgccggacagauaaagacaccgaacagccuggggaggugagcgcccugggacccggcagagccggggcuggcccuuccucucgcggacggcccggcgggcccuggggagagagcccuuccucuggcccgagcucccccgaaagcucugaggaugaagggccuggaagauccagcucuccccuucgccuggugccuuuuuccagcccccggccuccgggcgagcccccuggcggggaaccccucauggaggacugugagaagucuuccgauacaugcaacccucugagcggagcguucuccggcgucagcaauauuuucucuuucuggggagacagcagagggcggcaguaccaggaacucccccgcuguccggccccuacccccucccugcuuaacaucccccugucuagcccuggcagacggccccgcggggauguugaguccagacucgacgcucugcaacggcagcugaacagacuugaaacgcgccugucugccgauauggccacagugcuccagcugcuccagcggcaaaugacccuggugccuccggcuuacagcgccgucacaacccccggaccuggccccaccuccacaucuccucuucugcccgugagcccgcucccuacgcugacccuggacucccuuagccagguuucucaguucauggcgugcgaggaacugcccccuggcgcucccgagcucccucaggaggggcccacaagacgccugucccucccgggacaacugggcgcccuuaccagccagccucugcaccggcaugggucugaucccggauccuga

SEQ ID NO: 71017 - RNA, 3252 nt, Artificial Sequence
  derived and/or modified sequence opt5 from KCNH3__Homo_sapiens__NP_036416
augcccgccaugagaggccugcucgcuccucagaacaccuuccuggacacaaucgccacgcgguuugaugggacccacagcaauuucgugcuuggaaacgcgcaagucgcuggccuguuuccgguuguguacugcuccgacggguucugugaucucacaggauuuucucgcgccgaggugaugcagagaggcugcgccuguagcuuccuguaugggcccgacaccuccgaacuuguccggcagcagauucgcaaggcucuggaugagcauaaagaauuuaaggccgagcucauccuguacagaaaaucuggacugccuuucuggugccuccuggacgugauucccaucaagaaugaaaaaggcgagguugcucuuuuucuggugagccacaaggauauuuccgagacaaagaaccggggcgggccugaccgcuggaaagaaaccggaggcgggagacggcgcuauggacgggcccggucuaagggcuucaaugcgaaccgcagacggagccgcgccguccucuaccaucuguccgggcaccuucaaaaacagcccaagggaaaacauaagcugaauaagggcguguuuggcgagaaaccuaaccucccggaauauaagguugcugccaucagaaaaagccccuucauccugcugcacuguggggcucuccgggccacaugggauggauuuauucugcuugcgacccuguacguggccgucacggugccuuauucugugugcgucuccaccgcuagagagcccagcgccgcucgcggcccucccucuguuugugaccucgccguggaggugcuguucauccuugauauuguccugaauuuccggacaaccuuuguguccaagagcgggcagguuguguucgccccgaaaucuaucugccuccacuacgucacaaccugguuucugcuggacgugauugcugcgcucccuuucgaucugcuucaugccuuuaagguuaacguguacuucggagcucaucugcucaaaacggucagacugcuucgccugcuccggcugcugcccagacucgaccgcuauucccaguacagcgccgugguccugacacuucugauggccguguuugcucuccuggcccacuggguugcgugugugugguucuauaucggccaacgggaaauugaguccucugaaagcgagcugccugaaaucggguggcuucaggagcucgcuagacgccuggagacccccuacuaucuggucggacggagacccgccggcggcaauuccagcgggcagucugacaacugcuccagcucuagcgaagccaauggaacaggccucgagcugcuugggggaccuucccugcgcucugcuuacaucaccagccucuauuuugcccuguccagccugaccucugugggcuucgggaacguuuccgcuaauacagauacggaaaagauuuuuagcaucuguaccaugcuuauuggcgcccucaugcacgcgguggucuucggaaacgugacagccaucauucagcggauguacgcuagacgguuucuguaccacucucgcaccagagaccugcgggauuauaucagaauccaucgcauuccgaagccccucaaacaacggaugcuggaguacuuccaggccacaugggcugugaacaauggcaucgacaccacggaacuucugcagucccucccugaugagcugagagccgacauugcgaugcaucugcacaaggagguucuucaacucccccuguucgaagccgcuagccgcgggugccugagagcccucucccuggcccuucggccugccuuuugcacacccggagaguaucugauccaccagggcgaugcccuccaggcucuguacuucgucuguucugggagcauggaagugcugaaaggaggcaccgugcuugcgauucucgggaagggcgaccugaucggaugcgagcugccgcgcagagaacaggucgugaaagccaacgcugauguuaagggccucaccuauugugugcugcaaugccuucagcuggccgggcuccaugacucccuggcccuguacccugaguuugcuccccgguucucucgcggacuuagaggcgagcugagcuauaaucucggggccggaggcggguccgcggaagucgauacaagcucucuguccggcgacaacacccucaugagcacacuggaggaaaaggagacggacggagagcagggcccuaccgugucucccgcuccugccgaugaacccuccagcccgcuucugucuccuggguguacaagcuccagcucugccgcuaaacuccugucccccagacgcaccgcccccagaccucggcugggaggccgcgggagaccgggacgggcgggcgcucuuaaggccgaggccgggcccagcgcuccucccagagcccuggaaggccuccgccugccucccaugccuuggaauguucccccggaccucuccccucggguggucgauggaaucgaggacggcugcgggucugaucagcccaaauuuagcuucagagugggacaauccggcccugaauguucuagcucccccucuccggggccugagagcggacugcuuacaguuccccacggcccuuccgaggcucgcaacaccgacacgcuggauaagcuccggcaggccgugaccgaacugagcgagcagguccugcagaugagagaaggccuucaaucucugcgccaggcggugcagcucgugcuggcuccccaccgggaggggcccugcccuagagcuuccggagaaggcccgugucccgccagcacaucugggcuccugcagccucuuugcgucgacaccggagcuuccagcuacugucugcaacccccugccggcucuguucuguccgggacauggccccauccucgcccgggacccccuccccucauggccccuuggcccuggggcccgccugcuagccaguccagccccuggccccgggcgaccgccuuuuggacgucuacaagcgauuccgagccucccgcuucuggcgaccugugcagcgagccuuccaccccggccucucccccucccagcgaagagggggccagaacaggaccugcugaacccgugucccaggccgaggcgaccucuaccggcgaaccgccucccgggagcggaggccuugcucugccuugggauccccacucccucgagauggugcugauugggugccauggaagcggcacaguccaauggacgcaggaggaaggcaccgggguguga

SEQ ID NO: 71018 - RNA, 3054 nt, Artificial Sequence
  derived and/or modified sequence opt5 from KCNH4__Homo_sapiens__NP_036417
augcccgugaugaagggccugcucgccccucagaacaccuuccuggacacaaucgcuacgagauuugaugggacccacagcaauuuccuucuggccaacgcgcaaggaacacggggcuuuccgauugucuacugcuccgacggguucugugagcucaccggauauggccgcacagaaguuaugcagaaaaccugcucuuguagauuucuguacgggcccgagacaagcgaaccugcucuccagcggcugcauaaggcccucgagggacaccaggaacaucgcgccgagaucugcuucuauagaaaagauggcuccgcuuuuuggugucugcuggacaugaugcccauuaagaaugagaugggcgaaguggugcuuuuccuguuuucuuucaaagauaucacccaaagcggguccccuggacuuggcccccaagggggacggggcgacucuaaccacgagaauagccuggggcgcagaggagccacguggaaguuucgguccgcucgcagacggagccgcaccguccuccauagacugacaggccacuucggccggcgcgggcagggaggcaugaaggccaacaauaacguguuugaaccuaaaccgucuguucccgaguacaagguggcguccgucgggggaagcagaugccuucugcuccacuauucuguguccaaagccauuugggauggccugauccugcucgcuaccuucuacguugccgugacagucccuuauaauguguguuucagcggggacgaugacacccccaucacgucucggcauacacugguguccgauauugcugucgagaugcuuuuuauccuggacauuauccucaacuucagaaccacauacguuagccaguccggacaggugauuucugccccucgcagcaucggccugcacuaccuugcgaccugguuuuucauugaucugaucgccgcucuccccuuugaccugcuguauaucuucaauauuaccgugacaucccucguccaucugcuuaagacggugcggcugcucagacugcuucgccugcuccagaaacuggaacgguacagccagugcucugccguugugcugacccuccugauguccgucuuugcccuucuggcccacuggauggccuguaucugguaugugauuggcagacgcgagauggaagcuaacgacccgcuccugugggauaucggguggcugcacgagcuuggaaagcggcucgaaguuccuuacgugaauggcagcgucgggggacccucuagacgcagcgcguauauugccgcucuguacuucacacuguccucucucaccagcgugggcuuugggaacgucugcgccaauacagacgccgagaagaucuucuccaucuguaccaugcugauuggcgcucuuaugcaugccgugguuuuuggaaacgugacggcgaucauucagcggauguauagcagacgcucucuguaccacucccggaugaaagaucucaaggacuucaucagaguccaucggcugccucgcccccugaaacaaagaaugcuugaguacuuucagacaaccugggcugugaacagcggcauugaugccaaugaacuccugcgggacuuccccgaugagcugagagccgacaucgcuaugcaccucaaccgcgaaauccugcagcuuccucuguucggggccgcuucucggggaugccucagagcccugucccugcauauuaagaccagcuuuugcgcgccgggcgaguaucuucuccgcagaggggaugcccugcaagcucacuacuauguuuguuccggaucucuggaagugcuccgggacaauaugguccuggccauccuuggcaaaggggaucugauuggcgcugacauccccgagccuggacaggagcccggccucggggccgacccuaacuucgugcugaagacaagcgcggaugugaaagcccugaccuacugcggacuucagcagcucuccucucgcggccuggcugaaguucugagacucuaucccgaguacggggccgcuuuucgggccggacugccgcgcgaccuuacauucaaucugagacaaggcagcgauacguccgggcucagccgguuuucucgcuccccuagacugagccagccccggucugaaucccugggcagcucuagcgacaagacccuuccuuccauuacagaggccgaaagcggagcugagcccggcgggggaccucgccccagacggccgcugcuccugccuaaccucucucccgcgagaccccgcggcucccuggucagccuucugggggaggaacucccuccguucuccgcccuggugucuagccccucccugucuccuagccuuucccccgcucuggccggacagggccacucugccagcccucaugggcccccucgguguuccgcugccuggaagcccccgcagcuccugaucccuccccucggcaccuuuggaccucccgaucugagcccgagaauuguggacggcaucgaggauucuggguccacagcggaagcuccuagcuuccgcuuuucucggagacccgagcuuccucgcccccggucccaagcucccccuaccggaacgagaccgagccccgagcuggccucugaagcugaggaagucaaagagaaggugugccgccucaaucaggaaaucucccggcugaaccaggagguuagccagcuguccagagagcuucggcacauuaugggccugcuccaagcccgccuggggccucccggacauccugcgggcagcgcuuggacccccgacccuccguguccccagcucagaccucccugccugucuccuugugccagccggcccccgccuucccuucaggauacaacccuggccgaagugcacugccccgcuucugucggcacaauggagaccgggacggcccugcucgaccugcgccccagcauccuuccucccuauccuuccgaaccggauccccugggaccuucucccgugccugaggcuagcccgcccacaccuucccuccugagacacucuuuccagagccgguccgacaccuuucauuga

SEQ ID NO: 71019 - RNA, 2967 nt, Artificial Sequence
  derived and/or modified sequence opt5 from KCNH5__Homo_sapiens__NP_647479
augcccggcgggaagagaggacugguggccccucagaacaccuuccucgagaauaucguccggcgcagcuccgaaucuagcuuucugcuuggcaacgcucaaauuguugacuggccggugguguacuccaaugauggguucugcaaacugucuggauaucacagagccgacgucaugcagaaguccuccacauguucuuuuauguacggcgagcucacggauaaaaagaccaucgaaaaagugcggcagacauucgacaacuaugagagcaauugcuuugaaguucugcuuuacaagaagaaccgcacccccgugugguucuauaugcagauugcgccuaucagaaaugagcaugagaaagucgugcuguuucucuguacauucaaggauauuacccuguuuaaacaacccaucgaagacgauuccacaaagggguggaccaaauucgcucggcugacgcgcgcccucaccaacagcagaucuguucugcagcagcuuacaccuaugaauaagaccgaggugguccacaagcauucccggcuggccgaagugcuccagcugggaagcgacauccuuccccaauacaaacaggaggcuccuaagacaccgccccacauuauccugcauuauugcgccuuuaaaaccacgugggauugggugauucucauccugacauucuacaccgcuauuauggucccuuacaacguuucuuuuaagacaaaacagaauaacaucgccuggcuggugcucgacuccguggucgaugugauuuuccugguugacaucgugcuuaauuuccacaccaccuuugucggccccggcggggaggugaucagcgauccuaagcugauucgcaugaacuaucucaaaacaugguucguuaucgaccugcuuucuugucugcccuacgacauuaucaaugcguuugaaaacguggaugagggaauuuccagccucuucuccucucugaaggucgugagacugcuccggcugggccgcgucgccagaaaacuugaccacuaucuggaauacggggcugccgugcucguucugcuugugugcgucuuuggacugguggcucauuggcucgccuguaucugguauagcaucggcgauuacgagguuauugacgaagugacgaacaccauccagauugauuccuggcuguaucaacuggcgcucagcaucgggacaccguaccgguacaauaccucugccggaauuugggagggcggcccuuccaaggacagccuguaugucucuagccuuuacuucacaaugaccucccugacgacaaucggguuuggaaacaucgcucccaccaccgauguggagaagauguucucuguggccaugaugaugguuggcagccuccuguaugcuacaauuuuugggaaugucaccacaaucuuccagcagauguacgccaacacgaaucgcuaucacgaaaugcugaacaaugugagagacuuucuuaaacucuaccaagugccuaagggacuguccgagcgggucauggauuauauugugagcaccuggucuauguccaaaggcaucgacacagaaaagguucugagcauuugccccaaggauaugagagccgacaucugugugcaucucaaccgcaaagucuucaaugagcaccccgcuuuucggcuggcgucugacgggugccuuagagcccuggcuguggaguuccagaccauucacugugccccuggagaucucaucuaccaugccggcgaauccguugacgcucugugcuucguggucagcggcucccuggaggugauccaggaugacgaaguuguggccauucuugggaagggagaugucuuuggcgacaucuucuggaaagagacaacccucgcgcacgcuugcgccaacgugcgcgcccugacguacugugaucugcauauuaucaagcgggaagcucuccugaaagugcuugacuuuuauaccgccuucgcuaauucuuuuagcagaaaccugacacugaccugcaaucugcgcaagcggauuaucuucagaaagaucuccgaugucaaaaaggaggaagaggagcgccugcggcagaaaaacgaaguuacacuuucuauuccgguggaccaccccgugagaaagcucuuucaaaaauucaagcagcagaaggagcugcgcaaucaggggagcacccaaggagauccugaacggaaccagcugcaggucgaguccagaagccuccagaacggcgccucuaucacggggacauccgugguuaccgugagccaaauuacacccauccagaccucucuggcguacgucaaaaccuccgagagccuuaagcagaauaaccgggacgccauggaacugaaaccuaauggcggagcugaucagaagugucucaaagugaacucucccauucgcaugaagaauggcaacgggaaaggauggcugagacugaagaauaacaugggcgcccaugaggaaaagaaagaggacuggaauaacguuacaaaggcugaaagcauggggcuucucuccgaggacccgaaaagcucugauuccgagaauagcgugacgaagaacccucugcggaaaaccgacuccugcgauucuggaaucacaaagagcgaccugagacucgauaaggccggcgaagcgcgcagcccccuggagcacucuccuauccaagccgacgcuaaacaccccuuuuauccuauucccgaacaggcccuucagaccacacugcaagaggucaagcaugaacucaaagaggauauccagcugcugagcugucggaugaccgcucuugagaaacagguggccgaaauucugaagauccucuccgagaagucuguuccgcaggccagcuccccuaagagccaaaugccccuccaggugcccccucagauuccgugccaggacaucuucucugucuccagacccgaaagcccugagucugauaaagacgaaauccacuuuuga

SEQ ID NO: 71020 - RNA, 2985 nt, Artificial Sequence
  derived and/or modified sequence opt5 from KCNH6__Homo_sapiens__NP_110406
augcccgugagacggggccacgucgccccucagaacaccuaccuggacacaaucauucgcaaguucgaggggcaaagcagaaaauuucucaucgcuaaugcccagauggaaaacugcgcgauuaucuauuguaaugauggauucugcgagcuguuuggcuacucccggguugaagugaugcagcagccguguacgugcgacuuccuuaccgggcccaacacaccuucuagcgcugugucccgccuggcccaagcccuccugggagcugaggaauguaaggucgauauucuuuauuacagaaaagacgccucuagcuuucggugccugguggauguugugcccgucaagaaugaggacggcgcugugaucauguucauccucaacuuugaggaucuggcccagcugcucgcgaaauguuccucucgcagccugucccagagacuucugagccagucuuuccucggguccgaaggaagccauggccggccuggcgggcccggaccuggcaccgggcgcggaaaguauagaacaauuucucaaaucccgcaguuuacccugaauuucguugaguuuaaccuugaaaagcaccgguccagcucuacaaccgagauugagaucauugcuccccauaaaguggucgaacgcacgcagaaugugaccgagaaggugacacagguccugucccucggcgccgacguucugccugaauacaaacugcaagcccccagaauccaccgguggaccauucuccauuauagcccuuucaaggcugugugggauuggcugauccuucugcucgugaucuacacagccgucuuuacccccuacuccgcggccuuccugcuuucugaccaggaugagagccgcagaggggcuugcuccuauacguguagcccgcugacagugguugaccucauuguggauaucauguucgucguggacauuguuaucaacuuucggaccacauacgugaauaccaacgacgaagucgugucucacccuagacgcauugccguccacuauuucaaaggaugguuucugaucgauaugguggcugccauccccuucgaccugcucauuuuucggaccggcuccgaugagacaacgacccugaucggccuucugaagacagccagacuccugcgccuuguucggguggcuagaaagcuggaccgcuacagcgaguauggggcggccguccucuuccugcugaugugcaccuuugcucucauugcccauuggcuggccuguaucugguacgcuauuggaaauguggaacggccuuaucuugagcacaaaaucggcuggcuggauucucucgggguucagcugggaaagagauacaacggcagcgaccccgccuccgggcccucugugcaagauaaauacgucacagcgcuguauuucaccuuuagcucccuuacgagcgugggauucggcaaugugucuccuaacacaaacuccgaaaagguuuuuagcaucugcgucaugcucauuggcucucugauguacgcuuccaucuucgggaaugugagcgccauuauccagcgccuguauuccggaaccgcccgguaccauacccagaugcucagagugaaagaguuuauucgcuuccaccagaucccgaacccccugcggcaaagacuugaagaguauuuccagcacgcuuggucuuacacaaauggcauugacaugaacgccguccugaagggguuuccugagugccuccaggcugauaucugucugcaucugcaccgggcccuucuccagcauugccccgcguucagcggagccggcaaagggugucugcgcgcucuggccgugaaguuuaagaccacacacgcuccucccggcgacacgcucguucaucugggagaugugcuuuccacccuguauuucaucucuagaggcagcauugaaauccuccgggacgacgucgugguugccauucuggggaaaaaugauaucuuuggagagccggugucccugcacgcgcaaccuggcaagagcucugccgacgucagagcucuuacauacugcgaucuccacaaaauucagcgcgccgaccugcuggaagugcucgauauguaccccgcuuucgccgaguccuuuuggagcaagcuggaaguuaccuucaaccuucgggacgccgcugggggacugcauucuuccccuagacaggcgcccggcagccaggaucaccaaggguuuuuccucucugacaaucagagcggcuccccucaugagcugggaccccaguuuccgagcaaaggcuauucucugcuugggccuggaucccagaacagcaugggcgccgggcccugugcucccggacacccugaugccgccccgccccucuccaucucugacgcuagcggccuguggccugagcugcuccaagaaaugcccccucgccacucuccccaguccccucaggaggaucccgacugcuggccgcugaaacuugggagcagacuggaacaacuccaggcccagaugaaucggcuggagucccgcgugucuagcgaucuguccagaauccuucagcugcuccaaaagccuaugccccagggccaugcgagcuacauucuggaggcuccugccucuaacgaccucgcccugguccccaucgcuuccgaaacaaccagcccgggaccucggcuuccccagggcuuccugccucccgcccagacgcccucuuauggggaccucgaugacuguuccccuaagcaccgcaauagcucuccgagaaugccccaucuggcgguggcuaccgauaagacacuggccccuuccagcgagcaagaacagcccgagggacuuuggccuccccuggccuccccucuccacccgcuggaagugcagggccucauuugcgggcccuguuuuagcucucugccugagcaucuuggaagcguccccaaacagcuggacuuccaacggcacggcuccgauccuggguucgcuggcucuuggggacacuga

SEQ ID NO: 71021 - RNA, 3591 nt, Artificial Sequence
  derived and/or modified sequence opt5 from KCNH7__Homo_sapiens__NP_150375
augcccgugagacggggccacgucgccccucagaacaccuuccuggggacaaucauucgcaaguuugagggacaaaauaaaaaguucaucauugcuaacgccagaguucagaauugcgcgaucauuuacuguaacgacggcuuuugcgaaaugacgggguucagccggccggaugugaugcagaaacccuguaccugcgacuuucuccauggaccugagacaaagcgccacgauaucgcucagaucgcccaagcccugcuuggcuccgaagagagaaaaguggaagucaccuauuaccauaagaaugggucuacauucauuuguaacacccacaucauucccgugaagaaucaggagggaguugcuaugauguuuaucauuaacuucgaguaugugacagacaaugaaaacgccgcuaccccugagcgggucaaucccauccugccuauuaaaacggugaaccgcaaguuuuucggcuuuaaauucccgggccucagaguucugaccuaccggaagcagagccuuccccaggaagauccugacguggucgugaucgauuccucuaaacauagcgacgauuccguggccaugaagcacuuuaagucucccacaaaagagagcugcuccccuagcgaggcggacgauaccaaggcccugauccaacccucuaaauguuccccgcucgucaauauuagcgggccucuggaccacucuucccccaagcgccagugggauagacuguauccugacaugcuccagucuagcucccagcugagccauucccggucucgcgaaagccuuugcuccaucagacgggcuagcucuguucacgacauugagggauucggcgugcaucccaaaaacaucuuccgcgauagacacgccuccgaagacaaugggcggaacgugaagggacccuuuaaccacauuaaaagcucucugcucggcagcacauccgauucuaaucugaacaaguacagcaccaucaauaagaucccucaacuuacgcugaacuucuccgaggucaaaacagaaaagaaaaauagcucuccgcccuccagcgacaagaccauuaucgcuccuaaagugaaggauagaacacauaacguuaccgagaaggugacccagguccucucucugggggccgacgugcugcccgaguauaaacuccagacaccucgcauuaauaaguuuacgauccugcacuacucccccuucaaagcgguuugggauuggcuuauucugcuccuggugaucuacaccgccaucuuuacaccguauagcgcugccuuccuucugaacgaccgggaagaacaaaagagacgcgaauguggauacuccugcucuccucucaaugucguggaucugauugucgacaucauguuuauuaucgauauucugaucaacuuccggaccacauaugugaaucagaacgaggaaguugugagcgaccccgcuaaaauugccauccauuacuuuaagggcugguuccucaucgacauggucgccgcuauuccuuuugaucugcuuaucuucggcuccgggucugacgagaccacgacacugauuggacuccugaagaccgcgagacuucugcgccucgugcggguugccagaaaacuggaucgcuauagcgaguacggcgcugccgugcugaugcuccugauguguaucuuugcccuuauugcucacuggcuggccugcaucugguaugcgaucgggaaugucgaacggcccuaccucaccgacaagauuggauggcuggauucccugggccagcagaucgggaaaagauacaacgacagcgauucuuccagcggaccuucuauuaaggacaaauaugugacagcucuuuacuucaccuucuccagccucacaucugugggcuuuggcaauguuagccccaacacgaacuccgagaagaucuucagcauuugcgucaugcugaucgggucucugauguaugccuccaucuuuggaaaugugagcgccauuauccaacgccucuacuccggcaccgcucgguaucauaugcagaugcugagagugaaggaguucauucgguuucaccagaucccgaacccucuucgccagagacuggaggaauacuuccaacacgccuggacauauaccaaugggauugauaugaacaugguccucaaaggauuucccgagugucugcaggcugacaucugccugcaucuuaaucagacacuccugcagaacuguaaggccuuccggggcgcgucuaaagggugccugagagcccucgcuaugaaguuuaaaaccacgcacgcucccccuggcgauacccuggugcauuguggagacguucuuacagcccuguacuuccucagccgcggcuccaucgagauucugaaggaugacaucguggucgccauucuggggaaaaaugacaucuuuggagaaauggugcaccuuuacgcgaagccgggcaagucuaacgccgauguucgggcucucaccuauugcgaccugcacaaaauucaaagagaggaucugcucgaagugcuggacauguaccccgaguucagcgaucauuuucuuacaaaucuggagcucaccuucaaccugcgccacgaauccgccaaggcugaccugcuuagaucucagagcaugaaugauuccgagggggacaacuguaaacuccggcgcagaaagcugagcuucgaaucugagggagaaaaagaaaauuccacgaacgauccugaggacagcgccgauacaauccggcauuaucagucuuccaagcgccacuuugaagagaagaaaagcagaucuuccagcuucauuuccagcaucgacgaugaacagaagccccuguuuucuggcaucgucgacagcuccccugggauuggcaaagccucuggacucgacuucgaggaaaccgugcccacaagcggccggaugcauaucgauaagcgcucccacucuugcaaagacauuaccgauaugagaagcugggagcgggagaaugcucacccucaacccgaagacuccucuccgagcgcgcugcagcgcgccgcuugggggaucuccgagaccgaaagcgaucuuacauacggagagguugaacagagacuggaccuccugcaagagcagcugaaccggcuugagucucagaugacgaccgauauucagacaauccugcaacuccugcagaagcagaccacaguggucccucccgccuauuccauggugaccgccggcagcgaauaccagagaccuaucauucaacucaugcgcacgucucagcccgaggcuuccaucaagacagaccggagcuuuuccccgucuagccaguguccugaguuccuggaucuugagaaauccaagcugaaaagcaaggagucucucuccagcggggugcaucugaacaccgccucugaagacaaucugaccagccuucugaaacaggauuccgaccucucucuggagcuccaccugagacaacgcaagacauauguccaucccauucggcacccuagccuucccgacuccucucugagcaccguuggaaucgugggccuccauagacacguguccgaucccgggcugccuggcaaguga

SEQ ID NO: 71022 - RNA, 3324 nt, Artificial Sequence
  derived and/or modified sequence opt5 from KCNH8__Homo_sapiens__NP_653234
augcccgugaugaagggccugcucgccccucagaacaccuuccuggacacaaucgcuacgagauuugaugggacccacagcaauuucauucuugccaacgcgcaagucgcuaaaggauuuccgaucguuuacugcuccgacggcuucugugagcuggccggguuugcccggacagaagugaugcagaagucuugcagcuguaaauuccucuuuggaguggagaccaaugaacagcugaugcuucagauugagaagucccuggaagagaaaacagaguucaagggcgaaaucauguuuuauaagaaaaacgggucucccuucuggugccuccuggauauugucccuaucaagaaugagaaaggagacgugguucuguuucucgcuagcuucaaggauaucaccgacacaaaagugaagauuacccccgaagauaagaaagaggacaaggucaaaggccgcuccagagccggcacgcauuuugauucugcucggcgcagaagccgggccgugcuguaccacaucuccgggcaucuucaacgcagagagaagaacaaacugaagauuaauaacaauguuuucguggacaaaccugcguuccccgaauauaaggucagcgaugccaagaaaucuaaguuuauccuccugcacuucuccaccuuuaaagcuggaugggacuggcuuauucugcucgccacauucuacguggcugugaccgucccuuauaacguuuguuuuaucggcaaugaugaccugagcacaacccggucuacgacaguguccgacauugccguggagauccuguucaucauugauaucauucucaacuuucgcaccacauacgucagcaagucuggacaggugaucuucgaagcgagauccauuugcauccauuauguuaccaccugguuuaucauugaccugaucgccgcccuuccguucgaucugcucuacgcuuuuaaugugacagucgugagccugguucaccuucugaaaacggugcggcuccugcgccugcucagacugcuucagaagcuggaccgguacucccagcacucuaccauuguccucacacugcuuaugagcauguucgcucugcucgcccauuggauggccuguaucugguaugugauugggaagauggagcgcgaagauaacucccugcugaaaugggaggucggcuggcuccacgagcuggggaagagacuugaaagccccuacuauggaaauaacacccugggcggcccuucuauccgguccgcuuacaucgcggcccucuauuuuacacugagcucucugaccagcgugggguucggaaacguuuccgcuaauacggacgccgagaaaauuuucucuaucugcacaaugcuuauuggcgcccucaugcaugcucugguguuugggaacgucaccgccaucauucaaagaauguacagccgcuggucccuguaucacacccggacaaaggaucucaaagacuucaucagagugcaccaucugccccagcagcuuaagcagcgcaugcuggaauacuuucaaaccacauggagcguuaauaacggaauugauucuaaugagcuccugaaggacuucccugaugaacugcgguccgacaucacgaugcaccuuaacaaagagauccuccagcugagccuguuugagugugcgucuagaggcugccuccgcucccugagccuucauauuaagaccuccuucugugcucccggggaauaccugcuccggcagggagacgcccugcaagccaucuauuuugugugcucuggcagcauggagguccugaaagauuccauggugcuugcuauucucggcaagggggaccugaucggagccaaucugucuauuaaagaucaggugaucaagacaaacgcugacguuaaggcccucaccuacugcgaucugcaguguaucauucuuaaaggccuguucgaaguccucgaccuguauccggaguacgcgcacaaguuuguggaagauauccagcaugaccugacauauaaucuuagagaggggcacgagagcgaugugauuucccgccucagcaacaaaucuauggucucccaaagcgaaccuaagggaaauggcaacaucaauaaacggcugcccucuauuguggaggacgaagaggaggaagaggaaggggaggaagaggaggccguuucccugagcccuaucugcaccagaggcucuagcucccgcaacaagaaagugggaagcaauaaggcuuaccucggccugucucuuaagcagcuggccuccgggacgguccccuuccacagccccauccggguguccagaucuaacagcccuaaaaccaagcaggaaauugauccgcccaaccauaauaaacggaaggagaaaaaccucaagcugcagcuguccacacuuaauaacgcuggaccucccgaccugucuccucgcaucguugauggcauugaagacgggaauagcuccgaggaaucucaaaccuuugacuucggaagcgagagaauccgguccgagcccagaauuagcccgccucucggcgaucccgaaaucggggccgcggugcuguuuaucaaggccgaggaaacaaaacagcagauuaacaagcucaauucugaggucaccacgcugacacaggaagugucccaacuuggcaaagacaugcgcaacguuauccagcugcucgagaaugugcugagcccucagcagcccucucgguucuguucccugcacagcaccucugucugcccuuccagagagagccuucaaacacgcaccuccuggagcgcucaucagcccugucugcaccuccagaccggaggcgccgcuuauacacaagcccagcugugcucuagcaacauuacguccgauaucuggucuguggacccgagcuccguggggucuagcccucagagaaccggagcccacgaacagaaucccgcugauuccgagcucuaccauucucccagccuggacuacuccccuagccacuaucaagucguucaggaaggccaucuucaguuccugcgguguauuucuccgcacuccgauagcacacucacaccccugcagucuaucuccgcgacccugagcuccucugugugcagcuccagcgagaccucucuucaucuggugcucccuucccgcagcgaggaagggucuuuuagccaaggaacggucuccucuuucagccuggagaaccuccccggcuccuggaaucaggaagggauggccucugcuagcacaaagccucuggagaaccuuccccuggaagugguuaccuccaccgccgaggugaaagacaauaaggccauuaacgucuga

SEQ ID NO: 71023 - RNA, 684 nt, Artificial Sequence
  derived and/or modified sequence opt5 from KCNIP1__Homo_sapiens__NP_001030009
augggcgccgugauggggaccuucagcucccugcagacaaagcaaagacggcccucuaaagacaucgcuuggugguacuaucaguaccagcgcgauaagauugaggacgaacucgagaugacgauggucugccacagaccugaaggacuggagcagcuugaagcccaaaccaacuuuacaaaacgggagcugcagguucucuaucgcggcuucaagaaugaguguccgagcgggguggugaacgaagauaccuuuaaacagaucuacgcgcaguucuuuccccauggagacgcuuccacauaugcccacuaccuguucaaugccuuugauaccacacaaaccggcucugucaaguucgaggacuuugugacggcucuuagcauucugcucagagggaccguucaugaaaagcugcgguggacauucaaccuguaugauaucaauaaagacggauacauuaacaaggaggagaugauggauaucgugaaagccaucuacgacaugaugggcaaguauaccuacccuguccucaaagaagauacaccccgccagcacguggacguguuuuuccagaagauggauaagaauaaagacggcauuguuacccuggacgaguuucuugaauccugccaggaggaugacaacaucaugagaucucugcaacucuuccagaaugucauguga

SEQ ID NO: 71024 - RNA, 858 nt, Artificial Sequence
  derived and/or modified sequence opt5 from KCNIP2__Homo_sapiens__NP_055406
augagaggccaggggcggaaggagagccuguccgacucucgcgaucucgacggaagcuacgaucaacugaccggccaucccccugggccgacgaaaaaggcccuuaaacagagauuccugaagcuccugcccugcuguggaccucaggcucugcccuccgugucugaaaucggccgggucuuucgcuuccugggggacagcucccucccuucugcccuggcggcucccgccagccugagaccucaccggccgcgccuccuggaucccgacuccguugaugacgaguuugaacuuagcacagugugccacagaccugagggacuggaacagcuccaagagcagaccaaauucacacggaaggagcuucaggugcuuuaucgcggcuuuaagaacgaaugucccucuggcauugucaaugaggaaaacuucaaacagaucuacucccaauuuuucccucagggggauagcucuaccuaugccacauuucuguucaaugcuuuugacaccaaccaugauggauccgugagcuucgaggacuuuguugccggccucucugugauucugagagggacagucgaugaccggcugaauugggcuuucaaccucuacgaccugaauaaggauggaugcaucaccaaagaggaaaugcuugacauuaugaaguccaucuaugauaugaugggcaaauacacguaucccgcccugcgcgaggaagcgccgagagagcacguggagagcuucuuucagaagauggaccggaacaaggaugggguugugaccaucgaagaguucauugaauccugucagaaagacgagaauaucaugcgcucuaugcaacucuuugauaacgucauuuga

SEQ ID NO: 71025 - RNA, 693 nt, Artificial Sequence
  derived and/or modified sequence opt5 from KCNIP3__Homo_sapiens__NP_001030086
augggcauccaggggauggagcugugcgccauggcuguggucguucuccuguucauugccgugcuuaagcaauuuggaauccuggaacccauuagcauggaggacuccucugauagcgaacucgagcuguccaccgugagacaccagccugaaggccuugaccagcugcaggcgcaaacaaaauucacgaagaaagagcuccagucucuguaccggggguuuaagaacgaguguccgaccggacuggucgaugaagacacauucaaacucaucuaugcucaguuuuucccccagggcgaugccaccacauacgcccauuuucuguucaaugcuuuugacgccgaugggaacggagcuauucacuucgaggacuuugugguuggccuuagcauccugcuccgcggcaccgugcaugaaaagcugaagugggccuucaaucuuuaugauaucaacaaagacggguacauuacaaaggaggagaugcuggcgaucaugaaauccauuuaugauaugaugggaagacacaccuacccuauccuccgggaagacgcccccgcugagcaugucgaacgcuuuuucgagaagauggauagaaaucaagacggcgugguuacgauugaagaguuccuggaggccugccagaaagacgaaaacaucaugucuagcaugcagcuguuugagaaugugauuuga

SEQ ID NO: 71026 - RNA, 678 nt, Artificial Sequence
  derived and/or modified sequence opt5 from KCNIP4__Homo_sapiens__NP_001030175
augagcggcugcagaaagcgguguaaacgcgagauccugaaguucgcccaguaccuccugagacuucugaccgggucccuccacacagacucuguggaagaugagcuggaaauggcuacgguccggcaucgccccgaggcccuugaacugcucgaggcgcaaagcaaauuuaccaagaaagagcugcagauucuguauagaggauucaagaacgaaugcccuuccggcguugugaaugaggaaacauuuaaggagaucuacucucaguucuuuccgcagggggacagcaccacauaugcucacuuccucuuuaacgccuucgauaccgaccauaauggagccguguccuuugaggauuucauuaaaggccugucuauccuucugcgggggacaguccaagaaaagcucaacugggcuuuuaaucuguacgacauuaacaaagauggauauaucaccaaggaggaaaugcuugacaucaugaaagccauuuacgauaugaugggcaaguguacguaucccgugcugaaggaggacgcuccucgccagcacguugaaaccuucuuucagaaaauggauaagaauaaagacggcguggucacaaucgaugaguucauugagagcugccagaaggacgaaaacaucaugagauccaugcaacucuucgagaaugugauuuga

SEQ ID NO: 71027 - RNA, 1140 nt, Artificial Sequence
  derived and/or modified sequence opt5 from KCNJ10__Homo_sapiens__NP_002232
augaccagcguggccaaggucuacuauucccagacaacgcaaaccgagucuagaccccugaugggcccugggauccggcgcagacggguucucacaaaagacggacgcagcaacgugagaauggaacacauugcugauaagcgguuccuguaccuuaaagaccuguggaccacauuuaucgauaugcaguggcgcuauaagcuccugcuuuucuccgccaccuuugcgggcacaugguuccuguuugggguggucugguaccucguggcuguugcccauggagaccugcuggagcucgauccgcccgccaaucacaccccuugcgugguccaggugcauacgcugaccggcgcuuuccuguuuucucuugaaagccagacaaccauuggguauggauucagauacaucuccgaggaauguccccucgccauuguucugcuuaucgcucaacuggugcucacaaccauccuggagauuuuuaucacgggcacauuccuggccaaaauugcgcggccuaagaagcgcgccgagaccaucagauuuucucagcacgcugucguggccagccauaacggcaaacccugccucaugauucggguggcuaauaugcgcaagucccugcuuaucgggugucaggucacaggaaaacugcuccagacccaccaaaccaaggaaggcgagaacauuagacugaaucagguuaacgugacauuccagguggacacggccagcgauucuccuuuucuuauccugccgcucaccuucuaucacgucguggacgaaacauccccucugaaagaucugccucuccggagcggggagggagacuucgagcugguucuuauccugucuggcaccguggaauccacaagcgcgaccugccagguccgcacgucuuaccuccccgaggaaauucuguggggguacgaguuuacacccgccaucucccuuagcgcuuccggaaaguauauugccgauuucucucuguuugaccaagugguuaagguggcuagccccuccggccucagagauagcaccguccgguacggcgacccggaaaaacugaagcuggaggagucucucagagaacaggccgagaaagaaggguccgcccugagcgugcgcaucucuaaugucuga

SEQ ID NO: 71028 - RNA, 1173 nt, Artificial Sequence
  derived and/or modified sequence opt5 from KCNJ11__Homo_sapiens__NP_000516
augcugagcagaaagggcaucauucccgaggaauacgugcucacccggcuggccgaggacccugcuaaaccgcgcuauagagcccggcagcgcagagcgcgguucgucuccaagaaagggaacugcaauguugcucacaagaacauccgcgaacaaggaagauuucuucaggauguguucacaacgcugguggaccucaaauggccccauacccugcuuauuuuuacaaugucuuuccuguguagcuggcuccuguuugccauggccugguggcugaucgcuuucgcccacggcgaucucgcuccuuccgaggggaccgccgaacccugcgucacaucuauucauagcuuuuccucugcguuccuguuuagcaucgaggugcagguuaccaucggauucggcgggcggauggugacagaggaauguccucuugccauucugauccucauuguccagaauaucgugggacugaugauuaacgcuaucaugcuuggcugcauuuuuaugaagaccgcccaagcucaccgcagagccgagacgcugaucuucuccaagcaugcgguuaucgcccuccggcacggccgccuguguuuuaugcugagagugggggaccuccggaaaagcaugauuaucucugcuaccauucacaugcaggucgugcgcaagacaaccucccccgaaggagagguggucccucugcaucagguugauaucccgauggagaauggcgucgggggaaacagcauuuuccuuguggcuccccugaucaucuaccacgugauugacgccaauucuccucucuaugaucuggcccccuccgaccuucaucaccaccaggaucuggaaaucauugugauccucgagggcguuguggaaacaaccgggauuacgacacaagccagaaccagcuaccuggcugacgagauccuguggggacagcgguucgucccuaucguggcggaagaggauggcagauauucuguugacuacuccaaauuuggcaacacagugaagguccccaccccgcucugcaccgcccgccagcuggaugaggaccauagccuucuggaagcucucacacuggccuccgcccgggggccucuuagaaaacgcucugugcccauggcuaaggccaagccuaaauucagcauuucccccgacagccugucuuga

SEQ ID NO: 71029 - RNA, 1302 nt, Artificial Sequence
  derived and/or modified sequence opt5 from KCNJ12__Homo_sapiens__NP_066292
augaccgccgcuagcagagccaaccccuacuccaucgugucuagcgaggaagacggccugcaccucgucacaauguccggggcgaauggauucggcaacgggaagguucauacgcggcgcagaugccggaaucgcuuugugaaaaagaacggacaguguaauauugaguucgcuaacauggaugaaaaaucucaaagauaucuggccgacauguuuaccacaugcguggauauccgguggcgcuacaugcuucugauuuucagccucgccuuucuggcuuccuggcuucuguucggcaucaucuuuugggucauugccguggcucacggggaccucgagccugccgaaggaagaggccggaccccguguguuaugcaagugcauggcuucauggcggccuuucuguucucuaucgagacacagaccacaauuggguauggacugcgcugcgucaccgaggaaugucccguggcuguuuuuaugguggucgcccagagcaucgugggcugcauuaucgauuccuucaugauuggggcuaucauggccaagauggcgagaccuaaaaagcgggcccagacgcuccuguuuagccacaaugcuguggucgcccuucgcgacggaaagcugugucucauguggagaguuggcaaccugcggaaaucucauauuguggaggcucacgugcgcgcccagcuuaucaagcccagagucaccgaagagggggaguacaucccucuggaucagauugacaucgaugugggauucgacaaaggccucgaucggauuuuccugguuucccccaucacaauucugcacgaaaucgacgaggccagcccucucuuuggcaucucuagacaggaucuggaaaccgacgacuucgagauuguggucauccuugaagggaugguggaggcuacagcgaugaccacgcaagcccgcuccagcuaucuggcuaaugagauucucuggggacaucgguuugaaccgguucuguucgaggaaaagaaccaguacaaaaucgauuauucucacuuucauaagacauacgaggugcccuccaccccuagaugcagcgccaaggaccuugucgaaaauaaauuccugcuccccuccgccaacucuuuuuguuacgagaaugagcuggcuuuccugagccgcgaugaagaggacgaagccgauggcgaccaggaugggcgguccagagacggacucagcccucaggcgcgccacgauuuugaccggcugcaagcuggcgggggagugcuugagcagagacccuaucgccgggaaucugagauuuga

SEQ ID NO: 71030 - RNA, 285 nt, Artificial Sequence
  derived and/or modified sequence opt5 from KCNJ13__Homo_sapiens__NP_001165887
auggacagcuccaacugcaaggugaucgcuccccugcucucucagagauaccggcgcauggucaccaaagauggccacagcacacugcaaauggacggggcccagagaggacuugccuaucugcgggaugcguggggcauucucauggacaugcgcuggagauggaugaugcugguuuucuccgcuucuuuuguggugcauuggcuugucuucgccgugcugugguguuuuugcggggaggauuguccugccaagaaaagcuccuucuuuaauucucucuacuga

SEQ ID NO: 71031 - RNA, 1311 nt, Artificial Sequence
  derived and/or modified sequence opt5 from KCNJ14__Homo_sapiens__NP_037480
augggccucgccagagcucuccggcgccugagcggggcccuugacuccggagauucuagagcgggcgacgaggaagaggcugggcccggacugugccggaacggcugggccccugccccggugcagagccccgucgggcgcagacggggacgcuucguuaagaaagauggccacuguaaugugagauuugugaaccucggcgggcaaggagcucgguaccuguccgaccuuuucaccacaugcgucgaugugcgcuggagauggaugugucugcucuuuucuugcagcuuccuggccuccuggcugcucuuuggccuggcuuucuggcuuaucgccucucugcauggggaccucgcggccccucccccucccgcuccuuguuuuagccacguugccuccuuccuggcugccuuucuuuucgcgcuggaaacgcagaccagcauuggauauggcgugcggucugucacagaggaaugcccggccgcuguggccgcuguugugcuccaguguaucgccgggugcguccuggaugccuuuguggugggagcugucauggcgaagauggccaaacccaagaaacgcaaugagacccugguuuucuccgagaacgcugugguggcccucagagaccaucggcugugucuuauguggcgcgucggcaaucugagacggagccaccucguggaagcccauguuagagcucagcugcuucaaccucgcgugacacccgagggcgaauacauuccucuggaucaccaggacgucgaugugggguuugacggaggcaccgaucggaucuuccucguuucucccauuacaaucgugcacgagaucgacuccgccagcccgcuguaugagcuggggagagcggaacucgcucgcgccgacuucgagcuggucgugauucuugaaggaauggucgaggccaccgcuaugacgacccagugccggucuuccuaccugccuggcgaacuccugugggggcauagauuugagcccgugcuuuuccagcgcggaagccaauaugagguugauuaccggcacuuucauagaacauaugaagugccuggcacccccgucuguuccgccaaggagcuggacgaacgcgcugagcaggccucucacagccucaaguccagcuuccccggcucucugacagcguuuugcuacgaaaacgagcuggcccucuccugcugucaggaggaagaugaggacgaugaaaccgaggaagggaauggaguggagacggaggacggcgcugccagcccucggguucugacaccgacccuugcucugacacugcccccuuga

SEQ ID NO: 71032 - RNA, 1128 nt, Artificial Sequence
  derived and/or modified sequence opt5 from KCNJ15__Homo_sapiens__XP_011527863
auggacgccauccacauuggcaugagcuccacaccccuggugaagcauaccgcuggggccggacucaaagcgaacagaccucgggucaugucuaagagcggccacuccaauguucgcaucgauaaaguggacgggauuuaccugcuuuaucugcaggaucucuggacgaccgugaucgacaugaaguggagauacaaacugacacuuuucgcugccaccuuugucaugacaugguuccuguuuggagugauuuauuacgccaucgcuuucauccauggcgaucucgagccgggggaacccauuucuaaccacaccccuugcaucaugaagguugacagccugacaggagccuuucuguucucccucgagucucaaaccacgauuggcuauggcgugcggagcaucaccgaagaguguccccaugcuauuuuucugcuugucgcccagcuggugaucacaacccucauugaaaucuucaucacagggaccuuucuggcgaagauugcccgcccuaaaaagagagcugagacgaucaaauucucccacugcgccguuauuacaaagcagaauggaaaacuuugucuggugauccaggucgcuaacaugcgcaagagccuccugauucaaugccagcugucuggcaagcuccugcagacccacgugacaaaagagggggaacggauccuucugaaucaggccaccgugaaguuucaugucgauuccagcucugagucccccuuccucauccugccuaugaccuuuuaccacguucuugacgaaacaagcccgcugagagaucucacgccccaaaaccugaaagagaaggaguucgaacugguggugcuccugaaugcgaccgucgagucuacauccgccgugugucagagccggaccuccuauauuccugaagagaucuacuggggauucgaauuuguucccguggucucucuuagcaaaaacggcaaguacguggcugacuucucccaguuugagcagauucgcaaaagcccugauugcacauucuauugugccgacucugagaagcaacagcuggaagagaaguacagacaggaagaucaacgggagcgcgaacucagaacccugcuucugcagcaguccaauguuuga

SEQ ID NO: 71033 - RNA, 1362 nt, Artificial Sequence
  derived and/or modified sequence opt5 from KCNJ16__Homo_sapiens__NP_001278551
augcugaagauggugcucaccgagaaccccaaucaggaaaucgccacaagccuggaguuccuucugcuccaaaacuccccuggcucucugagagcucagcagcggaugagcuacuauggguccucuuaccacauuaucaaugccgacgcgaaauauccgggauaucccccugaacauauuaucgcugagaagcgcagagcccggcgcagacuucugcacaaagauggcagcugcaacgucuacuuuaagcauauuuucggggaauggggauccuacguuguggacaucuuuacgacccucguggauacaaaauggcggcacauguucgucaucuuuucucugagcuauauucuguccuggcucaucuucggcagcguguuuuggcugauugccuuccaucacggggaccuucugaaugaucccgacaucaccccuuguguugauaacgugcacucuuuuacaggagcuuuccucuuuucccuggagacccagacaaccauuggcuacggcuaccgcugcgucacggaggaauguagcguggccguucuuauggugauccugcaaucuauucucuccugcaucaucaauaccuucauuaucggggcugcccuggcgaagauggccacagcuagaaagcgggcccagaccauucgcuuuagcuauuucgcucugaucggaaugagagacggcaaacucugucugauguggcggauuggggauuuccgccccaaccaugucguggagggaacagugagagcccagcuucugcgguacaccgaagacucugagggccgcaugacgauggcguuuaaggaucucaaacuggucaaugaccagaucauccuuguuacaccugugaccauugugcacgagaucgaucaugaauccccgcuguaugcccucgacagaaaggcugucgccaaagacaacuucgagauucuggugacauuuaucuacaccggggauagcaccggaacaucccaccaaucucggagcuccuauguucccagagaaauucuguggggccaccgcuucaaugacgugcucgaggucaagcggaaguacuauaaagugaacugccugcaguuugaaggcagcguugagguguacgcuccuuucuguucugccaagcagcuugauuggaaagaccagcaacugcauaucgagaaggcucccccugucagagaauccugcacgagcgauaccaaagcccgccggagaucuuuuagcgcgguggccaucgucuccucuugugagaaucccgaagagacaaccacaagcgcuacccacgaauaccgcgagacgccguaucagaaggcccuccugacacuuaaccggauuuccguggagagccagauguga

SEQ ID NO: 71034 - RNA, 1302 nt, Artificial Sequence
  derived and/or modified sequence opt5 from KCNJ18__Homo_sapiens__NP_001181887
augaccgccgcuagcagagccaaccccuacuccaucgugucucuggaggaagacggccuccaccuggucaccaugagcggggcgaauggauucggcaacgggaagguucauacgcggcgcagaugccggaaucgcuuugugaaaaagaacggacaguguaauauugcuuucgccaacauggaugagaaaucccaaagauaucuugccgacauguuuaccacaugcguggauauccgguggcgcuacaugcugcucauuuucucucuggcuuuucuugccagcuggcuccuguucggcgucaucuuuugggugauugcuguugcccacggggaccuggaaccugcggagggacauggcagaaccccgugugugaugcagguccacggcuucauggccgcuuuucuguucuccaucgaaacacagaccacaaucggguauggacuccggugcgugaccgaggagugucugguugccguguuuauggucguggcucagucuauugugggcugcaucauugauagcuucaugaucggggccauuauggcgaagauggcccgccccaaaaagagagcucaaacgcuucuguuuucccauaaugccgucguugcucuccgggacggaaagcugugucuuauguggcgcgugggcaaccugagaaaaagccacaucguggaagcccacguccgggcccagcucauuaagccucgcgugaccgaggaaggggaguacaucccccuggaucagaucgacauugauguuggauucgacaaaggccuggauagaaucuuccucgugucuccuauuacaauccugcaugagauugacgaagcuagcccccuuuuuggcaucucccggcaggaucuggagaccgacgacuucgaaaucgucgugauucucgaggggaugguugaagcgacagccaugaccacgcaagcuagaucuuccuaucuggccaaugagauccuuuggggacaccgcuuugagccugugcuguucgaagagaagaaccaguacaaaauugauuauagccauuuucacaagacauacgaagucccgucuacaccccggugcuccgccaaggaccucguggagaauaaauuccugcugccuagcgcuaacuccuuuuguuacgaaaaugagcucgccuuccugucuagagaugaggaagacgaggcggauggcgaccaggaugggcgcagccgggacggacuuagcccccaggcuagacacgauuuugaccgccugcaagccggcgggggaguccucgaacagcggccuuauagacgcggcuccgagaucuga

SEQ ID NO: 71035 - RNA, 1176 nt, Artificial Sequence
  derived and/or modified sequence opt5 from KCNJ1__Homo_sapiens__NP_000211
augaacgccagcuccagaaauguguucgacacccugauccggguccucacagagucuauguuuaagcaucugcgcaaauggguugugacgagauucuuuggccacagccggcagcgcgcuagacuuguguccaaggaugggcggugcaacauugaauuuggaaaugucgaggcccaaucucgcuuuaucuucuuuguggacauuuggaccacaguucuggaucucaaauggagauacaagaugaccaucuucauuacagcguuucugggcagcugguucuuuuucgggcuucugugguaugcuguggccuacauccacaaagaccuccccgaauuucauccuuccgccaaccacaccccgugugucgagaauaucaacggacugacaucugcuuuccuguucagccucgaaacccaggugacgauuggcuauggguuucggugcguuaccgagcagugugccacagcuaucuuccugcuuauuuuucaguccauccugggagugauuaucaauagcuucaugugcggcgccauucucgcgaagaucucucgccccaagaaaagagccaagaccaucacauuuuccaaaaacgcugucauuagcaagcggggcgggaaacugugucuucugauccgcguggccaaucucagaaagucucugcugauuggaucccauaucuacggcaagcuccugaaaaccacggugacaccugagggggaaaccauuauccuugaucaaaucaacauuaauuucgucguugacgcuggaaacgagaaucuguuuuucaucagcccccucacaauuuaucacgugaucgaucacaacucuccuuucuuccauauggccgcggaaacccugcuucagcaggacuuugagcugguggucuuccucgauggcaccguggaguccacaagcgccacgugccagguucggaccuccuacgugcccgaagagguccuguggggguaucgcuuugcuccuauugugucuaagacaaaagaaggaaaguacagaguugacuuccacaauuucagcaaaaccguggaggucgaaacaccgcauugugccaugugccuguacaacgagaaggaugugcgggcuagaaugaaacgcggcuaugacaaccccaauuuuauccucuccgaggucaacgaaaccgaugacacgaagauguga

SEQ ID NO: 71036 - RNA, 1284 nt, Artificial Sequence
  derived and/or modified sequence opt5 from KCNJ2__Homo_sapiens__XP_011523081
augggcagcgugagaaccaaccgguacuccaucgucucuagcgaggaagacgggaugaagcuggccacaauggcuguugccaauggauucggcaacgggaaauccaaggugcacacgcgccagcaaugcagaucucgguuugugaaaaaggauggacauuguaauguccaguucauuaacgugggcgagaaagggcagcgcuaucucgcggacaucuuuaccacaugcguugauauuagauggcgguggaugcuggugaucuucugucuugcuuuuguccugagcuggcuguucuuuggaugcguguucuggcugauugcccuucugcacggcgaccucgaugccuccaaggaaggcaaggcuuguguuucugaggugaauagcuuuaccgccgcuuuccuguuuuccaucgaaacacagaccacaaucggguacggauuccgcugcgucaccgacgagugucccauugccguguuuaugguggucuuccaaagcaucguuggcugcauuaucgaugcguucauuaucggggccgugauggcuaaaauggccaagccuaaaaagagaaacgagacgcugguguuuucucauaaugcugucauugccaugcgggacggaaaacucugucugauguggcgcgugggcaaccuuagaaagucccaccugguugaagcgcaugugcgggcccagcuccucaagagccgcaucaccucugagggggaauauaucccgcuugaucagauugacaucaaugucggauucgauuccggcauugacagaaucuuucuggugagccccauuacaaucguucacgagaucgaugaggacucuccucucuacgaccuguccaaacaggauauugacaacgcugauuucgaaaucguggucauucuggagggcaugguggaagccaccgcuaugacaacccaaugccggagcuccuaucucgccaaugagauccugugggggcaccgcuacgaacccguccuuuuugaggagaagcauuauuacaaaguggacuacucuagauuccacaagacguaugaaguuccuaacacaccccuguguagcgcccgggaucucgcugagaaaaaguacauucuguccaaugcgaacagcuuuugcuaugaaaaugagguggcccuuaccucuaaagaagaggacgauuccgagaacggagucccugaaagcacaucuaccgacaccccgcccgauaucgaccugcauaaccaggcuagcgugccucucgagcccagaccucugcgccgggaauccgagaucuga

SEQ ID NO: 71037 - RNA, 708 nt, Artificial Sequence
  derived and/or modified sequence opt5 from KCNJ3__Homo_sapiens__NP_001247437
augagcgcccugagacggaaguucggcgacgauuaccagguggucaccacauccucuagcggguccggacuccaaccccagggcccugggcaggacccgcagcaacagcugguucccaaaaagaaacgccagagauuuguggauaagaacggacggugcaaugugcagcacggcaaccuugggucugagacgagccgcuaucuguccgaccucuucaccacacuggucgaucuuaaauggagauggaaucuguuuaucuucauucucaccuacacaguggcuuggcuguuuauggccucuaugugguggguuaucgcguauacccggggagaccugaacaaggcucaugugggcaauuacacaccuugugucgccaacguguauaauuuccccagcgccuuucucuucuuuauugaaaccgaggcuacgaucggcuacggguaucgcuacauuaccgauaagugcccugaaggaaucauccuguuccuuuuucaauccauucugggcagcaucguugacgccuuccucauuggguguauguuuaucaaaaugucucagcccaagaaaagagcugagacacugauguucuccgaacacgccgugauuagcaugcgggauggaaaacuuacccugauguuccgcgucggcaaccucagaaauucucauaugguguccgcgcagauccggugcaagcugcugaagggguga

SEQ ID NO: 71038 - RNA, 1338 nt, Artificial Sequence
  derived and/or modified sequence opt5 from KCNJ4__Homo_sapiens__NP_690607
augcacggccauagcagaaacgggcaggcccacgugccccggcgcaagagacggaaucgcuucgucaaaaagaacggacaaugcaauguuuacuuugcuaaccuguccaauaaaucucagagauauauggccgacaucuucaccacauguguggauacgcgguggcgcuacaugcucaugauuuuuagcgcggcuuuccugguguccuggcuguuuuucggccuucucuuuuggugcaucgccuucuuucauggggaccuggaggccucuccuggagucccggcugccggcgggcccgcugccggaggcggcggggcggccccuguggcucccaagccuuguauuaugcacguuaacggauuccuuggcgccuuucuguucagcguggaaacccagacaaccaucggguauggauuuagaugcgucacagaggaauguccccucgcugugauugccguugugguccaguccaucgugggcugcgugaucgauucuuucaugauugggaccaucauggcgaaaauggcccggccuaagaagcgcgcucaaacacugcuguucagccaucacgccgucauuuccguuagagacggaaaacucugucugauguggcgggugggcaaucuucgcaagagccacaucguggaggcucaugucagagcccagcugauuaaaccguacaugacccaggaaggcgaguaucucccccuggaucagcgggaccuuaacgugggguacgauaucggacuggaccgcauuuuucucguuucuccuaucaucauugugcacgagaucgaugaagacagcccccuguauggcauggggaaggaggaacuggaguccgaggauuucgaaauugucgugauccucgagggaaugguugaagccacggcuaugaccacacaagcgagaucuuccuaccuggccagcgagauucuuuggggccaucgguuugaaccuguggucuucgaggagaaaucucacuacaagguggacuauuccagauuucacaagaccuacgaagucgcugggacacccugcuguagcgcccgcgagcugcaggaauccaaaaucaccgugcucccggccccucccccuccucccucugcuuucugcuaugagaaugaacuggcccuuaugagccaggaggaggaagagauggaagaggaagcggcugccgccgcugccguugcugccggacugggccucgaggcgggcuccaaggaggaagccgggaucauucggaugcuggaguuuggaagccaucuggaucucgaaagaaugcaggcuucucugccccuugacaacaucuccuaccgccgggagagcgccauuuga

SEQ ID NO: 71039 - RNA, 1260 nt, Artificial Sequence
  derived and/or modified sequence opt5 from KCNJ5__Homo_sapiens__XP_011541112
auggccggcgacagcagaaacgcuaugaaucaggauauggagaucggggugacccccugggacccuaagaaaauuccgaagcaagcccgggauuacguccccaucgcgacagaccgcacgagacugcucgcugaaggcaaaaagccucggcagcgcuauauggagaaauccggaaagugcaacguucaccaugggaaugugcaggaaaccuacagauaucugucugaucuuuucacaacccugguggaccucaaguggcgguuuaaccugcuugucuucacaaugguguacaccguuacauggcuguuuuucggauuuauuugguggcucaucgccuauauucgcggcgaucuggaccacgugggggaucaggaguggauccccugugucgaaaaucugagcggauucguguccgccuuucucuucucuaucgagaccgagacgaccauuggcuacggcuuuagaguuaucacagaaaaaugcccugaggggauuauccugcuucuggugcaagcuauucucggaagcaucgucaacgccuucauggugggcuguauguuugugaagauuucccagcccaaaaagcgggcugaaacccugauguucucuaauaacgccgucaucagcaugcgcgacgagaaacuuugccugauguuuagaguuggggaucuccgcaauucccauaucguggaggcgagcauucgggccaagcugaucaagucuagacagacaaaagaaggagaguucauuccucugaaccagaccgacaucaaugugggcuucgauacgggggacgaccggcucuuucuggucuccccgcuuauuaucagccacgaaaucaaccaaaagucucccuucugggagaugucccaggcucagcugcaucaggaagaguuugaggugguugugauucucgaaggaauggucgaggccacaggcaugaccugucaagcucgcagcucuuauauggauacagaagugcuguggggccacagauucaccccuguucuuacccuggagaaaggguuuuacgaaguggacuacaauacauuccacgauacguaugagaccaacacacccuccugcugugccaaggagcucgcggaaaugaaacgggagggaagacugcugcaguaccucccuagcccgccccugcuuggcgggugcgccgaagcuggacuggacgccgaggcugaacagaaugaggaggaugaaccuaagggccucgggggaucccgcgaggcccggggcucugucuga

SEQ ID NO: 71040 - RNA, 1272 nt, Artificial Sequence
  derived and/or modified sequence opt5 from KCNJ6__Homo_sapiens__NP_002231
auggccaagcugaccgagagcaugacaaacgugcucgaaggcgacuccauggaucaggacgucgagucucccguugcuauccaccaaccuaaacugccgaagcaggccagagaugaccuuccccggcauauuagccgcgauagaacgaaacggaagauccagcgcuacgugagaaaagacgggaagugcaaugugcaccauggaaacguccgggaaaccuaucgcuaccugacagauauuuucaccacacucguggaccugaaguggagauuuaaucuucugaucuucguuaugguguauaccgucacauggcucuuuuucggcaugauuugguggcugaucgcguacauccgcggggauauggaccacauugaggauccuuccuggacccccugugugacgaaccugaauggauuuguuucugcuuuccucuuuagcaucgaaaccgagacaaccauuggcuauggguaccgggugaucacagacaaaugcccugagggaauuauccugcuucugauucaguccguccucggcucuaucgugaacgccuucauggugggcuguauguuugucaagaucagccaacccaaaaagagagccgaaacccugguuuucuccacgcaugcugugauuagcaugcgggaugggaaacuuugccugauguuucgcgugggagaccucagaaauucucacaucgucgaggccuccauucgggcuaagcugaucaagagcaaacagacaucugaaggcgaguucauuccucugaaccagaccgacaucaaugugggguauuacacaggagaugaccgccucuuucugguuuccccgcuuaucauuagccacgagaucaaccagcaaucucccuucugggaaauuuccaaggcccagcugccuaaagaggaacucgagaucguggucauucuggaaggcaugguggaggcgaccgggaugaccugucaggccagaagcuccuacaucacaucugagauccuuuggggauaucgguucacgcccguucugacccucgaagauggcuuuuacgagguggacuauaauagcuuccaugaaacauacgagaccuccacaccuagccugucugcuaaggaacuggccgagcucgcuuccagagccgagcugccccuuagcuggucugucagcuccaaacugaaccagcacgcggaacucgagaccgaagaggaagagaagaaucuggaggaacaaacggagcgcaacggcgauguggccaaucuugaaaacgagucuaaagucuga

SEQ ID NO: 71041 - RNA, 1275 nt, Artificial Sequence
  derived and/or modified sequence opt5 from KCNJ8__Homo_sapiens__XP_005253415
augcuggccagaaagagcaucauucccgaggaauacgugcucgcucggaucgccgcggagaaccugcgcaaaccucggauucgggaccgccuuccgaaggcuagauucaucgccaaauccggcgccugcaaucuggcucacaagaacauucgggaacaggggcgcuuucuccaagauaucuucaccacacuggucgaccuuaaauggagacauacgcugguuaucuuuaccaugucuuuccucuguagcuggcugcuguuugccauuaugugguggcucguggcuuucgcccacggagauaucuaugcguacauggagaaguccggcauggaaaagucugggcuggagagcacagugugcgucaccaaugugcgguccuuuacaucugccuuccuuuuuagcauugagguucaggugaccaucggauucggcgggcgcaugaugacagaagaguguccccuggcuauuaccguccucauccugcagaacauugugggacuuaucaucaaugccguuaugcugggcugcauuuuuaugaaaacggcucaggcccauagacgggcggaaacccucaucuucucccgccacgccgugauugcugucagaaacggcaagcuguguuuuauguuccgggugggggaccugcgcaaaagcaugaucauuucugccuccgugagaauccaagucguuaagaaaacaaccacaccugagggagagguggugcccauccaucagcucgauauuccugucgacaaucccaucgaaagcaacaauauuuuccugguggcuccucuuaucauuugccacguuaucgauaagcggucuccgcuguaugacaucuccgccaccgaucucgccaaccaggaccuggaggugauugucauccuugaaggcgugguugagacgacagggauuaccacacaggcuagaaccagcuacaucgcggaagagauucaauggggacaccgcuuugugucuaucgucaccgaggaagagggcguguauuccgucgauuacagcaaguucgggaauacagugaaaguugccgcuccccgguguuccgccagagaacuggacgagaagccuucuauucucauccagacgcugcagaaaagcgaacugucccaucagaacagccuccgcaagagaaauucuaugagacgcaacaauuccaugcggagaaacaacagcauccgccggaauaacucuagccugauggugcccaaaguccaauuuaugaccccugagggaaaucagaacacauccgagucuuga

SEQ ID NO: 71042 - RNA, 1371 nt, Artificial Sequence
  derived and/or modified sequence opt5 from KCNJ9__Homo_sapiens__XP_006711368
augagaagccggcucgaggaacucaaguuccuggagggccgcuggagaaaccaggugcuugaccuggaaaucgagccccuccaagauccucggcgcagacugggggcccagcggcgcgcugccggaggcuccucuagcgggccgagacggacccccggagcgcgcuccgcuagaccugacgccgccgcuauggcccaggaaaaugcugccuuuucucccggccaggaggagccuccccggcgcagagggcggcaacgcuacgucgaaaaagauggaagaugcaacguucagcagggcaaugugcgggagacauauagauaccuuacggaccuguucaccacacucguggaucugcaguggcgccugagccuccuguuuuucguccuugcguaugcccugaccuggcucuuuuucggcgcuauuugguggcugaucgccuacgggcggggagaccuugaacaccuggaggauacagcuuggaccccuugugugaacaaucucaacggcuuuguugccgcguuccuguuuuccauugagacagaaaccacgaucggguauggacauagagugauuaccgaccaaugcccggagggcaucguccugcuccugcuucaggccauccuggggucuauggugaaugcuuucaugguuggauguauguuugugaagauuagccagcccaacaaacgcgccgcuacacucgucuucuccagccacgccguggugucucugcgggauggcagacuuugccugauguuucgcgucggcgaccuccgguccagccauaucguugaagccucuauuagagcuaagcugauccgcucccggcagacccuggagggggaguucauuccucuccaccaaacagaucugagcgugggauucgacaccggcgaugacagacuuuuucuggugucuccccucgucaucucccaugaaauugacgcggccagcccuuucugggaggcuucccgccgggcccuggaaagagaugacuuugagaucgugguuauccuugaagggaugguggaggccacgggaaugacaugucaggcucggucuagcuaccuggucgaugaagugcucuggggccaccgcuucaccuccguucugacacuggaggacggguuuuaugagguggauuacgccagcuuccacgaaaccuuugagguccccaccccgucuugcuccgcgagagaacucgcugaggccgccgcucggcuggacgcccaucuuuacuggagcauuccuucuagacuggaugaaaaaguggaggaggaaggagcuggcgagggcgccgggggagaagcgggcgccgacaaggagcagaaugggugucugcccccucccgagagcgaauccaaggucuga

SEQ ID NO: 71043 - RNA, 1617 nt, Artificial Sequence
  derived and/or modified sequence opt5 from KCNK10__Homo_sapiens__NP_066984
auguucuuucuguacaccgacuucuuucucagccugguggccguccccgcugccgcgccuguuugccagccgaaguccgcuacaaacggccaacccccugcccccgccccuacgcccaccccuagacuuucuaucagcucccgggcuacagugguggcccgcauggaggggaccucucagggaggccugcagacagucaugaaauggaagaccgugguugcuauuuucguggucgugguuguguaucucgucacagggggacugguguuuagagcccuugaacagccguucgagagcucccagaaaaauaccaucgcgcuggaaaaggccgaguuucuccgggaucacgugugugucucuccccaagaacuggagacgcugauucagcaugcucucgacgccgauaacgcuggcguuagcccuaucggaaauuccagcaacaauucuucccacugggaccuggggagcgccuucuuuuucgcgggcaccgugauuacaaccaucggcuacgggaacaucgcccccucuacagagggaggcaaaaucuuuugcauucuuuaugcuauuuucgggaucccucuguuuggauuccuccuggccggcauuggggaucagcuuggaaccaucuucggcaaguccauugcucgcguggaaaaggucuuucggaaaaagcaagugagccagacgaaaaucagaguuaucucuacaauucuguucauccucgccggcuguauuguguuugucaccauccccgccgugauuuucaaguacaucgagggguggacagcucuggaauccaucuauuuuguuguggucacccugaccacagugggauucggcgacuuugucgccgggggaaaugcgggcauuaacuaccgcgagugguauaaaccgcucgugugguucuggauccugguugggcuugcuuacuuugccgccgugcugagcaugauuggagauuggcucagaguccuguccaagaagacgaaagaggaagugggcgagaucaaggcucaugccgcggaauggaaagcuaauguuaccgccgaguuccgggaaacacgcagacggcuuucuguggagauucacgacaagcugcagcgcgccgcuaccaucagaagcauggagcggcgcagacucggccuggaucagcgggcccauucccuggacaugcucagcccugagaaaagaucugucuuugcugcccuggauacagggcgcuucaaggcguccagccaagaaucuaucaacaaucggcccaacaaucuuagacugaaaggaccugaacagcucaacaagcacggccagggggccagcgaggacaauauuaucaacaaguuuggauccaccucucgccugacgaaacggaagaacaaagaucuuaagaaaacacugcccgaagacgugcaaaagauuuacaagaccuucagaaauuauagccucgacgaggagaaaaaggaagaggaaaccgagaaaaugugcaacuccgauaauagcucuacagcuaugcugaccgacuguauccagcagcacgccgaacuggagaacggcaugauucccacagauacgaaggaccgcgagccugaaaauaacucccuccuggaggaucggaauuga

SEQ ID NO: 71044 - RNA, 1293 nt, Artificial Sequence
  derived and/or modified sequence opt5 from KCNK12__Homo_sapiens__NP_071338
augagcuccagaucuccccggccuccgccccgcagaagccggcgcagacugccucggcccuccugcuguugcuguugcugucgcagaucucaccucaacgaggacaccggccgguucgugcugcuugccgcucugaucgggcucuaccuggucgccggagcgacaguuuuuagcgcucuugaauccccuggcgaggccgaagcccgcgcuagauggggagccacgcugcggaauuucucugcugcccaugggguggcggagcccgaacuccgcgccuuucugagacacuaugaggcugcccuggcugccggcgugcgggcggaugcccuccgcccuagaugggacuucccgggggcuuuuuacuucgucggaaccgugguuagcacaauuggcuuuggcaugaccacacccgccaccgucgggggaaaggcuuuccugaucgccuauggccuuuuugggugcgccggaacaauucuguucuuuaaccucuuccuggagcggaucauuucccuucuggcuuuuaucaugagagcgugucgcgaacggcagcucagacgcagcggccugcugccugccaccuuccggagagggucugcucucuccgaggccgauagccuggccggauggaaacccucuguguaccaugugcuucugauccucggccuguucgcuguucuucuguccugcugugccagcgcgauguauacgucuguggaaggcugggacuacgucgauucccucuauuuuugcuucgugaccuuuagcacaauuggguucggagaccugguguccucucaacacgcugccuaccgcaaucagggccuguaccggcucgggaacuuucuguucauccuucugggagucuguugcauuuauagccucuuuaauguuaucuccauucugaucaaacaggugcuuaacuggaugcugagaaagcucagcugccgcuguugcgcccgguguugcccugcucccggcgccccgcuggcuagacgcaaugccauuaccccugggucucggcugagacggcgccucgcggcccugggagcugaucccgccgcuagagacuccgaugccgagggccggagacuuagcggcgagcugaucucuaugcgcgaccucacagcgagcaacaaggugucccuggcccugcuucagaaacaacucucugaaaccgcuaauggguacccucggagcgucugugugaacacgagacagaauggauucuccggcgggguuggagcccugggcaucaugaacaaucgccuggcugagacaagcgccucuagauga

SEQ ID NO: 71045 - RNA, 969 nt, Artificial Sequence
  derived and/or modified sequence opt5 from KCNK16__Homo_sapiens__NP_001128577
augcccagcgccggccugugcuccuguuggggagggagagugcucccucugcuucuggcuuacgucugcuaucuccugcuuggcgccaccaucuuccagcugcucgagcggcaagcggaagcucagucucgcgaccaguuucagcuggagaagcugagauuccucgaaaacuacacaugucuggaucaaugggccauggagcaguuuguucaggugauuauggaagccugggugaaaggggucaauccgaagggaaacagcacgaaucccuccaacugggacuucggcucuagcuuuuucuuugcugggaccgugguuacaaccaucggauauggcaaucuugccccuuccacagaggcuggccagguguucugcgucuuuuacgcccugcucgggauuccccugaacgugaucuuccuuaaucaccugggaaccggccuccgggcgcaucuggccgcuauugagcgcugggaagauagaccucggcgcucucaaguucuccaggugcuggggcuggcccuuuuucugacacucggaacccuggucauccuuaucuuucccccuaugguguucagccacguggagggcugguccuucagcgaaggguucuauuuugcuuucauuacgcugucuaccaucggauuuggcgacuacgucguuggccauccgcucaacuucauuacacccuccgggcugcugccuagccaggagcccuuucagaccccucacggaaaacccgagucucaacagaucccgggcuccuuccagaaggugagcucuaugaauguguggccucucuccgggaugcauagccccggacuggccuuuccucuucccgauuguaacauucccgaccaagaaagauuccggccucugcacccgggcgcguggaaauuuuggccccucccucugcccuccucuaauagcaagugggccccuauguggcuuggguccagcgcucaggucuga

SEQ ID NO: 71046 - RNA, 816 nt, Artificial Sequence
  derived and/or modified sequence opt5 from KCNK17__Homo_sapiens__NP_001128583
auguacagaccccgggcccgcgcugccccugagggcagagugcgggggugcgcggucccgagcaccguucugcuccugcuugcuuaucuggccuaccucgcccugggaacaggcguguucuggacgcuugaagggcgcgcugcccaggacuccucuagaucuuuucaacgggauaagugggagcugcuccagaacuucaccugucuggaccgccccgcucuggauucccucaucagagacgugguccaggccuauaaaaauggagcgucucugcuuagcaacacaaccuccaugggccggugggaacugguggggagcuuuuucuuuagcguuuccacaauuaccacaaucggauacggcaaucucagcccuaacaccauggccgcucgccuguucugcaucuuuuucgcccuugugggcauuccccugaaucucgucgugcugaacagacuggggcaccucaugcagcaaggaguuaaucauugggcuucucggcugggcgggacguggcaggauccugacaaggcccgcuggcuugcgggauccggcgcccugcucagcgggcugcuucuguuucuccugcugcccccucuccuguucucucacauggagggaugguccuauaccgaaggcuuuuacuucgcuuuuauuacacuuagcaccgugggcuucggggauuaugucaucgccucuugucugaucuccgacacaagaaaaccgaaccgggauuggcagacccucgagcgcacgagcaaguccucuggaggccugcuuaaauacagauuccuggcugggcauggaggcagccaccucuga

SEQ ID NO: 71047 - RNA, 1155 nt, Artificial Sequence
  derived and/or modified sequence opt5 from KCNK18__Homo_sapiens__NP_862823
auggaggugagcggccacccccaggccagacggugcuguccugaagcucuggggaaacucuucccgggacugugcuuucuuuguuuccuggucaccuacgcccucguuggcgcggugguguuuuccgcuaucgaggacgggcaaguccugguggccgccgaugacggagaauuugagaaguuucuugaagaacugugccgcauucucaacuguucugagacaguuguggaagauagaaagcaggaccugcagggccaucugcagaaagucaagccccaaugguucaaucggacgacccacuggagcuuucucuccucucuguucuuuugcuguacaguguucagcaccguuggguauggauacaucuauccugugacacgccuuggcaaauaccugugcaugcucuaugcucuguuuggcauuccccuuauguuccugguccucaccgauacaggggacauccuggccaccauucuguccacgucuuacaacagauuucggaaguucccuuucuuuacccgcccccuccugagcaagugguguccuaaaucccuuuucaagaaaaagccggaucccaaaccugcugacgaggccgugccccagaucaucauuagcgcggaggagcugccuggacccaagcucggcacaugcccgucuagaccuuccuguagcauggagcuguuugaacggucucaugcccuugagaagcagaauacccugcagcugcccccucaagcuauggaacgcuccaacagcugccccgagcucgugcuggggagacucucuuauuccaucauuagcaaucuggaugaagucggacagcagguugagcggcuugacaucccccugccuauuaucgcccucauuguguucgcuuacaucuccugcgccgcggccauccugccguuuugggagacacagcuugauuucgaaaacgcuuuuuacuucuguuuugugacccugacgacaauuggcuucggggacaccguccucgagcaccccaauuucuuccuguuuuucucuaucuauauuaucgugggaauggaaauuguuuucaucgccuuuaaacuggugcaaaaccgccucaucgauauuuacaagaaugucaugcuguucuuugcuaaaggcaaguucuaucaucuugugaaaaaguga

SEQ ID NO: 71048 - RNA, 1011 nt, Artificial Sequence
  derived and/or modified sequence opt5 from KCNK1__Homo_sapiens__NP_002236
augcugcagagccucgccggcuccucuugcgugagacuggucgagcggcaccgcagcgcuugguguuucggguuucuuguucugggauaccuccuguaucuuguguucggcgccguggucuuuuccucuguggaacugcccuacgaggaccuccugagacaagaacugcggaagcucaaacgcagauuccuggaggaacaugagugccuuagcgagcagcagcuggaacaguuucucgggcggguucuggaggcguccaacuauggagugucuguccuuagcaaugcuuccggcaacuggaauugggauuucaccagcgcccuguuuuucgccucuacagugcucuccacgaccggguacggacacacaguuccucugagcgacggcggcaaggcuuuuuguaucauuuauucugugaucgggauuccguucacccugcucuuucugacagccgucgugcaacgcaucaccgugcaugucacaagacggcccguucuuuacuuccacauucgcuggggauuuuccaaacaggugguggcuaucguccaugccgugcugcucggcuucguuaccgugagcugcuucuuuuucaucccugcggccgucuuuucugugcuggaagaugacuggaacuuccuugaguccuuuuauuucuguuuuauuagccuguccacgaucgggcucggagauuacguucccggcgagggguacaaucagaaguucagagaacuguauaaaauuggaauuaccugcuaccugcuccugggccuuaucgcuaugcuggugguccucgagacauuuugugaacugcacgagcuuaagaaguuccggaaaauguuuuaugugaagaaagacaaggaugaagaccagguccacaucauugagcaugaucaacugucuuucagcuccaucaccgaccaggccgcuggcaugaaagaggaucagaagcagaacgaaccuuuuguggccacacaaagcucugcgugcguugacgggcccgccaaucacuga

SEQ ID NO: 71049 - RNA, 1269 nt, Artificial Sequence
  derived and/or modified sequence opt5 from KCNK2__Homo_sapiens__NP_001017424
augaugaaccccagagccaagcgggacuucuaccuggcugccccugaucuccuggacccgaaaagcgcggcucaaaauuccaagccccgccuuucuuuuagcaccaaaccuaccgugcuggccuccagagucgagucugauacgaccaucaacguuaugaaguggaaaacagugagcaccauuuuccucguggucgugcuguaucuuaucauuggcgccacaguuuuuaaggcucuggaacagccccacgagaucucccagcggaccacaauugugauccagaagcagaccuucaucucucaacauagcugcgucaauuccacggaacucgacgagcugauucagcagaucguggccgcuauuaacgccgggaucauuccucugggaaauaccagcaaccagaucucucacugggaucucggcuccagcuuuuucuuugcggggacaguuauuaccacaaucggauucggcaauaucucuccccgcaccgaagggggaaaaaucuuuuguauuauuuacgcccugcuuggcaucccucuguucggcuuucuccuggcuggggugggagaccaacuuggcacgauuuucgggaagggaaucgccaaagucgaggauacauuuaucaaguggaacgugucccagaccaaaauuagaaucauuagcacaaucauuuucauccuguucggcugcgugcucuuugucgcucugccggccaucauuuucaagcauaucgagggguggucugcgcuggacgccauuuauuuuguugugaucacccucaccacaauuggauucggcgauuacguggcuggcggguccgacaucgaauaucuggauuuuuacaagcccgucgugugguucuggauucuuguuggacuggccuauuuugcugccgugcucagcaugaucggcgacuggcugcgggucaucuccaaaaagacgaaagaggaagugggggaguuccgcgcccacgcugcggaguggaccgccaauguuacagcugaauuuaaggagaccagacggcgccuuucuguggaaauuuacgauaaauuccagagagccacaagcaucaagcggaaacuguccgccgagcucgcuggaaaccauaaucaggaacugaccccuugucgcagaacgcugagcgucaaccaccucacaucugagcgggacgugcugcccccucuucugaagaccgaguccauuuaccucaauggccugacaccccacugcgccggggaagagaucgcggucauugaaaacaucaaguga

SEQ ID NO: 71050 - RNA, 1185 nt, Artificial Sequence
  derived and/or modified sequence opt5 from KCNK3__Homo_sapiens__NP_002237
augaagagacagaacgugcggacccuggcccucaucgucugcacauucacguaccugcuuguuggcgcugccguguuugacgcgcuggagagcgaacccgagcucauugaacgccaaagacuggagcuucggcagcaggaacugcgcgcuagauauaaucucucccaagggggauacgaggagcuggaacgggugguccugcgccucaaaccucacaaggccggcgugcaguggagauucgccgggucuuuuuauuucgcuaucaccguuauuacaaccaucggauacggccaugccgcuccgagcacagaugggggaaaaguguuuuguauguucuaugcccugcuuggcauuccccugacccucgucauguuucagucccugggcgagcggaucaacacacuugugcgcuaccugcuccacagagcgaagaaagggcugggaaugcggcgcgccgacguuucuauggcuaauauggugcugaucggcuucuuuagcugcauuuccacccucuguaucggggccgcugccuucucucauuaugaacacuggacguuuuuccaggcguacuacuauugcuuuauuacccugacaaccaucggauucggcgauuacgucgcccuucagaaggaccaagcucugcagacacagccucaguauguggccuucagcuuuguguacauucucaccgggcugacggucaucggagcuuuccuuaaccugguugugcucagauuuaugacaaugaaugccgaggaugagaagcgggacgccgaacaucgcgcucugcugaccagaaacggccaagcgggcgggggaggcgggggaggcuccgcccacacaaccgauaccgcuagcucuacagccgccgcugggggaggcggcuuccggaauguguaugccgagguccuccacuuucaguccauguguagcugccugugguacaaaucuagagaaaaacuucaguauuccauucccaugaucaucccucgcgaccugagcacgucugauaccuguguggagcaaucccauagcucccccgggggaggcgggcgguacucugacacaccuagcagacgcugccucuguuccggagcgccgcggagcgcuauuucuuccguuagcaccggccugcacucucuuagcacauucagagggcugaugaagcgccgguccucuguguga

SEQ ID NO: 71051 - RNA, 1500 nt, Artificial Sequence
  derived and/or modified sequence opt5 from KCNK5__Homo_sapiens__NP_003731
augguggacagaggcccccugcucaccagcgccaucauuuucuaccuggcuaucggggccgcgauuuuugagguccuugaggaaccucacuggaaggaagcuaaaaagaacuauuacacacagaaacugcaucuccugaaggaguucccgugccuuggacaagaaggccuggauaaaauccucgagguuguguccgacgccgccgggcagggaguggcuauuacgggcaaucagaccuuuaacaauuggaacuggcccaaugccaugaucuucgcugccacagucaucaccacaauuggguauggaaacguggcgccuaagacccccgccggccggcuguuuuguguuuucuacggccuguuuggggugccucucugccugacauggaucucugcucuuggaaaguucuuuggcgggcgcgccaaaagacugggacaguuccucaccaagcggggcgucagccugcgcaaagcucaaauuacguguaccgugaucuuuauuguuuggggagugcuuguccaccuggugauucccccuuucguguuuauggucacagagggguggaauuauaucgaaggccucuacuauuccuucaucaccaucucuacaauuggcuucggggauuuuguugccggagugaacccgagcgcgaauuaccaugcccuguacagauauuucguggagcuguggaucuaccucggccuggcuuggcuuucccuguuugucaacuggaaggugucuauguucguugaagugcacaaagccauuaagaagcggcgcagacggcgcaaagagagcuuugaguccagcccccauucuagaaaggcucuccaggucaaaggguccaccgccagcaaggacgugaauaucuucucuuuucuguccaaaaaggaagagacguauaacgaucuuauuaaacagaucggaaagaaggccaugaaaacaagcggcgggggagaaaccggcccuggccccgggcugggaccucagggcgggggacuccccgcucugccgccuucucugguuccccucguggucuacuccaagaaucgggugccuacacuggaggaagucagccaaacccuucgcuccaaaggccacgugucuagaagccccgacgaggaggcgguugcccgggcucccgaagauuccagcccugccccggagguguucaugaaccagcuggaccgcaucucugaagagugcgaacccugggaugcccaggacuaucacccucucauuuuucaggaugcuuccaucaccuucgucaauacagaggccgggcugagcgacgaggaaacgucuaagagcucccuugaggauaaccuggcgggcgaagagucuccccaacagggagcugaagccaaagccccucucaacaugggcgaguuucccagcuccagcgagucuaccuucacauccaccgaaagcgagcugucugugccguacgaacagcugaugaaugaguauaacaaggcuaauuccccuaaggggacauga

SEQ ID NO: 71052 - RNA, 942 nt, Artificial Sequence
  derived and/or modified sequence opt5 from KCNK6__Homo_sapiens__NP_004814
augagacggggcgcccugcucgcuggggcccuggcggcuuacgccgccuaucuugugcugggagcucuccuggucgcccgccuugagggcccccacgaagcuagacugcgggccgagcucgaaacccugcgcgcgcagcugcuccaaagaagcccuugcguugccgcuccggcccuggacgcuuucguggagcgggugcuugccgcggggcgccugggaagagucgugcucgccaacgcuuccggcucugccaaugcuagcgaucccgccugggacuuugccuccgcucuguucuuugcgucuacacuuaucacgaccguuggguacggauauacaaccccucugacagaugccggcaaggcuuucagcauugccuuugcccuccugggcgugcccaccacaaugcugcuccugaccgcuuccgcccagcggcuuucucugcuccugacgcaugucccucuuagcuggcuguccaugcgcugggggugggaccccagacgggcggcuuguuggcaccucguggcccugcugggaguuguggucaccgugugcuuccucgugccugccgucaucuuugcucaucuggaagaggccuggagcuuccuugaugcuuuuuacuucuguuuuauuucucuguccacaaucggccucggggacuauguuccgggagaggcccccggccagccuuaccgcgcgcuguauaaagugcuugugaccgucuaccuguuccucgggcugguggccaugguucuggugcuccagacauuuagacacgucagcgaucugcauggacuuaccgaacugauucuccugcccccucccugcccggcuucuuucaacgccgacgaggaugaccggguggauauccugggcccucaacccgaaucccaccagcagcuuagcgcuucuucccacacggacuacgccagcaucccucgcuga

SEQ ID NO: 71053 - RNA, 1125 nt, Artificial Sequence
  derived and/or modified sequence opt5 from KCNK9__Homo_sapiens__XP_011515404
augaagagacagaacgugcggacccugagccucaucgucugcacauucacguaccugcuuguuggcgccgccguguuugacgcccuggaguccgaucacgaaaugcgcgaggaagagaaacucaaggcggaagagauuagaaucaaagggaaguauaauauuucuagcgaggacuaccggcaacuggaacuugugauccugcaguccgagccccaucgcgcuggaguccaguggaaauucgccggcucuuuuuauuucgccauuaccgugaucacaaccaucggguacggacacgcugccccuggcacagaugcugggaaggccuuuuguauguucuaugcgguucucggcauuccgcugacccuggugauguuucagagccucggagaaagaaugaacacauucguccgguaccugcuuaagcgcaucaaaaagugcuguggcaugagaaauaccgacguguccauggagaacaugguuacggugggguuuuucucuugcaugggaacccuguguauuggcgccgcugccuuuagccaaugcgaggaaugguccuucuuucaugcuuauuacuacuguuucaucacacucaccacaauuggguucggagauuaugucgcccugcagaccaaaggcgcgcuucagaagaaaccccuguacguggccuuuagcuucauguauauccucguggggcugacggucauuggagcuuuucugaaucucguugugcugcgguuccuuacaaugaacucugaggacgaacgcagagaugccgaggaacgggcuucccuggccggcaaucgcaacagcauggugauccacaucccugaggagcccagaccuucucggccccgcuacaaggccgacgucccugaucuccaguccgugugcagcuguaccugcuauagaucucaagacuacggcgggcgguccguugcuccgcagaauagcuuuuccgcgaagcuggcuccccauuauuuccacucuauuagcuacaaaaucgaagagauuuccccuagcacacuuaagaacucucuguuucccuccccuaucagcucuauuagccccggacuccacuccuucaccgaucaucagagacugaugaaacgccggaagucuguguga

SEQ ID NO: 71054 - RNA, 3711 nt, Artificial Sequence
  derived and/or modified sequence opt5 from KCNMA1__Homo_sapiens__NP_001154824
auggccaacggcgggggaggcgggggaggcagcuccgggggaggcggcgggggaggcgggucuagccugagaauguccucuaauauccacgcuaaccaucucagccuggacgccuccucuagcuccagcagcuccagcagcuccucuucuuccagcuccucuagcuccucuucuuccagcgugcacgagcccaagauggaugcgcuuauuaucccugucaccauggaaguuccgugcgacucucggggacagcgcauguggugggcuuuccuggccagcuccauggugacauuuuucggcgggcucuuuauuauccugcuuuggagaacgcugaaauaccucuggaccguguguugccauuguggaggcaagacaaaagaggcccaaaagauuaauaacggcucuagccaggcugaugggacccugaaacccgucgacgaaaaggaggaagccguggcugccgagguuggauggaugacauccgugaaggauugggcgggcgucaugaucagcgcccagacccugacagggcgggugcucguugugcuggucuucgcucuuucuaucggagcccuggugauuuauuuuaucgacuccagcaauccuauugagucuugccagaacuucuacaaagauuuuacccuccaaaucgacauggcuuucaauguguuuuuccugcuuuauuuuggccugcgcuucauugccgcgaacgauaagcucugguuuuggcuggaagucaauuccguuguggacuucuucacggugcccccugucuuugugagcguuuaccugaacagauccuggcucgggcugcgguuccuucgcgcccugagacucauccaguuuucugagauucugcaguuccuuaauauccugaaaaccagcaacuccaucaagcucgugaaucugcugucuauuuuuaucagcacauggcucaccgcugccggauucauucaccuggucgaaaacuccggcgaucccugggagaauuuucagaacaaccaagcucuuacauauugggaguguguguaccugcucaugguuaccaugagcacggugggcuauggggacgucuacgccaaaacaacccugggacggcuuuucaugguguuuuucauccugggcgggcucgccauguuugcuucuuacgucccugaaauuaucgagcugaucggaaaucgcaagaaguauggcggguccuacagcgcggugucuggcagaaaacauauuguugugugcggacacaucacacuggaauccgucagcaacuuccucaaggauuuucugcacaaagaccgggacgaugugaauguugagauuguguuccuucauaacaucucuccgaaucuggaacucgaggcccuguucaagcgccacuuuacccaggucgaguucuaucagggcagcgugcugaacccccaugaccuugcuagagugaaaauugaauccgccgaugccugucucauccuggcuaauaaguacugcgccgacccugaugcggaggacgcuagcaacaucaugcggguuauuucuaucaaaaauuaucaccccaagauucgcaucauuacccagaugcugcaauaccacaacaaggcccaucuccugaauaucccuuccuggaacuggaaagaaggggaugacgccauuugucuugcugagcugaagcucggauuuaucgcccagagcugccuggcucagggccuguccacaaugcuugccaaucucuucucuaugcggagcuuuaucaaaauugaagaggauacguggcaaaaguauuaccuggagggggucuccaacgaaauguacaccgaguaucugucuagcgcguucgugggacucuccuuucccacagugugugaacugugcuucgucaaacuuaagcugcucaugaucgccauugaguacaagucugcuaauagagaaagcagaauccugauuaacccgggcaaccaccugaaaauccaggaggggacccuuggcuuuuucaucgccuccgacgcuaaggaggugaaacgcgccuuuuucuauugcaaggcgugucaugaugacauuacagacccuaaacggaucaagaagugcggauguaaaagacccaagaugagcauuuacaaacgcaugcggagagccugcuguuuugauugcggccgcucugaacgggacuguuccugcaugagcgggagaguucgcggaaauguggauacccucgagcgggcuuucccucugucuuccgucagcgugaacgacuguucuacguccuucagagccuuugaagaugagcagcccagcacacugucccccaagaaaaagcagcgcaauggcgggaugcggaacagcccuaauaccucuccgaagcucaugagacacgacccccugcuuaucccuggaaacgaucaaauugacaauauggauagcaacguuaaaaaguaugacuccaccggcauguuccauuggugcgcucccaaagagaucgaaaaggugauccugacacggucugaggccgccaugaccguccucagcgggcacgugguuguguguauuuuuggcgaugucuccucugcucugaucggacugcgcaaucuugugaugccucucagagcgagcaacuuccacuaccaugaacugaaacacauuguguuugucggcuccaucgaguaucugaagcgggaaugggagacacuccauaauuuccccaaaguuucuauucugccggggacgccucuuagcagagccgaccugcgcgcugugaacaucaaucucugcgauaugugcgugauccuguccgccaaccagaauaacauugacgacaccagccugcaggauaaggaguguauccuugccucucugaacauuaaguccaugcaguuugacgauagcaucggaguccuccaagcuaauucucagggcuucacacccccugggauggaccgguccagccccgauaacuccccugugcacggaaugcugagacagcccucuauuaccacaggcguuaauaucccgauuaucaccgaacucgugaacgacacgaauguccaguuucuggaucaagacgaugacgaugacccugauaccgagcuuuaccugacacagcccuucgccugcgggaccgcguuugcugugagcguucucgacucccugaugagcgccacauacuucaacgacaauauccugacccuuauucgcacgcuggugacaggcggagccacccccgaacucgaggcucugaucgccgaagagaacgcgcucagaggcggguauucuacaccucagacccuggcuaaucgggaucgcuguagagucgcccagcuugcccugcucgacggaccguucgcugaucugggcgacgggggaugcuacggcgaucuguuuuguaaagcccuuaagaccuauaacaugcugugcuucggcauuuaccggcuccgcgacgcucaccuguccacacccagccaauguacgaaaagauaugugaucaccaauccucccuacgaguuugaacucguuccuacagaucugauuuucugccuuaugcaguuugaccauaacgccgggcagucucgggcgagccugucccacucuagccauuccucucaaagcuccagcaagaaaucuuccagcgugcacuccauccccucuaccgccaaucgccagaacagaccuaagagccgggagucccgcgauaagcagaaauauguccaggaagagagacuguga

SEQ ID NO: 71055 - RNA, 576 nt, Artificial Sequence
  derived and/or modified sequence opt5 from KCNMB1__Homo_sapiens__NP_004128
auggugaagaaacuggucauggcccagaagagaggcgagacccgggcucucugccuggggguuacaaugguggugugugccgucaucacguacuauauucuugugaccacaguucugccccucuaccagaaaagcguguggacccaagaauccaagugccaccugaucgagacaaacauucgcgaccaggaggaacuuaaaggaaagaaggucccucaguauccgugucugugggugaauguuucugcggcuggcagaugggccgugcucuaccauaccgaagauacacgggaccaaaaccagcagugcagcuauauccccggguccgucgauaauuaccagaccgcccgcgcugacguggagaaagugagagccaaguuccaagagcagcaggucuuuuauuguuucucugcuccucggggaaacgaaacgagcguucuguuucagcgccuguacggcccccaagcccuccuguucucccuguuuuggccuaccuuccuucucacagggggacugcuuauuaucgcgauggugaaaucuaaucaguaccugagcauccucgccgcucagaaguga

SEQ ID NO: 71056 - RNA, 708 nt, Artificial Sequence
  derived and/or modified sequence opt5 from KCNMB2__Homo_sapiens__NP_001265840
auguucaucuggaccagcggcagaacauccucuagcuaccggcacgacgagaagcgcaacauuuaucagaaaaucagagaucaugaccugcucgauaagcggaaaacggugaccgcccugaaggcuggggaagaccgcgccauucuucugggacucgcgaugauggucugcuccaucaugauguacuuucugcuuggcauuacacugcucagaucuuauaugcaaagcguuuggaccgaggaaucccaguguacacugcugaaugcuucuaucaccgagacauucaacugcagcuuuuccugugggcccgauugcuggaaacucagccaguacccuugucuucagguguaugugaaucugaccucuuccggagaaaagcugcuccuguaccacacggaggagaccaucaagauuaaccaaaaaugcagcuauaucccgaaguguggcaaaaauuucgaagagucuaugucccuugucaacgugguuauggaaaauuuucggaaguaccagcauuucagcugcuacucugaccccgaggggaaccagaaauccgugauucugacaaagcucuauagcuccaauguccuguuucacucucuguucuggccuaccuguaugauggccggaggcguggccaucguugcuauggugaagcucacacaguaccugagccuucugugcgagcgcauucaaagaaucaaccgguga

SEQ ID NO: 71057 - RNA, 522 nt, Artificial Sequence
  derived and/or modified sequence opt5 from KCNMB3__Homo_sapiens__NP_001157149
augcagcccuucagcaucccugugcaaauuacccugcagggcuccagacggcgccaggggagaacagccuuuccggcuucuggaaagaaacgggagacggacuacagcgauggcgacccccucgauguccacaagcgccugccuuccucugccggggaagacagagcgguuaugcuuggauucgcuaugaugggcuuuagcgugcugauguucuuucuccuggggaccacaauccuuaaacccuucaugcuguccauucagcgggaggaaucuaccugcacagccauccauaccgauauuauggacgauuggcucgacugugccuuuacaugcggagugcacugucauggccaaggcaaguauccuugccugcaggucuucgugaaccugagccaccccgggcagaaagcucuccugcauuacaaugaggaagccguucagaucaacccuaagcgcgaugugaccgacuguagagucaaggagaaacaaacgcuuaccguguccgaugagcacaagcaguga

SEQ ID NO: 71058 - RNA, 633 nt, Artificial Sequence
  derived and/or modified sequence opt5 from KCNMB4__Homo_sapiens__NP_055320
auggccaagcugagaguggcuuacgaguauaccgaagccgaggacaaaagcauccggcucggccuguuccuuauuaucuccggggucguuucucuguuuauuuucggauuuugcuggcucagccccgcgcugcaggaucuucaagcuacagaagccaacuguacggugcuguccgugcagcagaucggcgaggucuucgaaugcaccuuuacauguggggccgacugccgcggaaccucucaguacccuugugugcaaguuuaugugaauaacagcgaguccaauucuagagcucuccugcacagcgaugagcaucagcugcucacaaacccgaagugcuccuacauucccccuuguaaacgggaaaaucagaagaaccuggagagcgucaugaauuggcagcaauauuggaaagacgaaaucggcucucagcccuuuaccugcuacuucaaccagcaccagcgcccugaugacgugcuucugcauagaacacacgaugagaucguucuccugcauuguuuccuuuggccccuggugaccuuugucgugggggugcucauugucguucugacgaucugcgccaagucccuggcugugaaggccgaggcgaugaaaaagcggaaauucagcuga

SEQ ID NO: 71059 - RNA, 1632 nt, Artificial Sequence
  derived and/or modified sequence opt5 from KCNN1__Homo_sapiens__NP_002239
augaacagccacuccuacaauggcucuguggggagaccccugggaagcggcccuggggcccucggacgggacccgcccgauccugaggcuggccaucccccucagcccccucacuccccggggcugcaagucguuguggccaagucugaacccgcgcgcccuagccccggauccccuagaggccagccccaggaccaggaugacgaugaggacgaugaagaggacgaagcuggccggcaacgcgccucugggaaaccgagcaacgugggacauagacuuggccaccggcgcgcccuguucgagaagagaaaacggcucuccgauuaugcucugaucuuugggauguucggaauugucgugaugguuaccgagacagaacuuagcuggggcguguacacgaaggagucucuguauuccuuugcccucaaaugccugaucagccugucuaccgcuauucuccuggggcuugucgugcuguaccaugcccgcgaaauccagcuuuucaugguugacaauggagcggaugacuggagaauugccaugacaugugagcggguguuucugaucucccuugagcuggcugucugcgccauccacccugugcccggccacuaucgcuucaccuggacagcuagacucgccuuuaccuacgcgccuagcguggccgaagcugaugucgacguucugcugucuauucccauguuccuccggcuguaucuucugggccgcgugaugcuccugcauuccaagaucuuuacagacgccagcuccagaucuauuggggcucuuaacaagaucaccuucaauacgcgguuugugaugaaaacccugaugacaauuugucccggaaccguccuccugguguucagcaucuccagcuggauuaucgccgccuggacaguuagagugugcgagcgcuaccacgauaagcaggaagucaccucuaacuuucugggcgcuauguggcucaucuccauuacguuccugagcaucggguacggagacauggugccucauacauauuguggcaaagggguuugccuucugaccggaauuaugggcgcgggcuguacagcccucguggucgcuguggucgcccggaagcuggagcuuaccaaagccgaaaagcacgugcacaauuucaugauggauacccagcugacaaagagaguuaaaaacgcugccgcgaaugugcuccgcgagacguggcugaucuacaagcauacccggcuggucaaaaagccggaccaagcuagagugcgcaaacaccagcggaaguuucuccaggccauucaucaggcccaaaaacugagaucuguuaagaucgagcaggggaagcucaacgaucaggcuaauacacugaccgaccucgccaaaacacaaaccgugauguaugaucuggucagcgaacugcacgcucagcaugaggaacuugaggcccgccucgcgacgcuggaaucccggcuggacgcccucggagcuucucugcaggcccuucccggccugaucgcucaggccauuagaccucccccucccccgcucccuccccgcccugggcccggaccucaagaucaggcggcccggagcucccccugcagauggacaccgguggcuccuagcgacuguggcuga

SEQ ID NO: 71060 - RNA, 1740 nt, Artificial Sequence
  derived and/or modified sequence opt5 from KCNN2__Homo_sapiens__NP_067627
augagcuccugcagauacaacggcggggugaugcggccccugucuaaucucagcgccucccgcagaaaccugcacgagauggacucugaagcccagccucuucaaccgcccgccagcgucggaggcgggggaggcgcguccucuccuagcgcugccgccgcugccgcugccgcgguuuccagcucugcccccgagaucgugguguccaagccugaacauaauaacagcaauaaccuggcucucuaugggaccggaggcggcgggucuacaggaggcgggggaggcgggggaggcuccggccacgggucuagcuccggaacgaaaagcuccaagaaaaagaaucagaacauuggcuacaaacuggggcaucggcgcgcccuuuucgagaagagaaagcggcugucugauuaugcucucaucuuuggaauguucggcauugucgugaugguuaucgaaaccgagcugagcuggggagccuacgacaaagcgucccuguauagccucgcccugaagugucuuauuucucuguccacaaucauccuccuggggcuuauuaucguguaccacgcucgcgagauucagcuguuuauggucgauaauggcgccgacgauuggagaaucgcuaugaccuaugaacggauuuucuuuaucugccucgagauucuggugugugccauccaucccaucccuggcaacuacacauucaccuggacagcccgccuggcuuuuagcuacgcgccgucuaccacgaccgccgacguugauauuauccucagcauucccauguuccugagacuuuaucugaucgcucgggugaugcuccugcacuccaaacuuuuuacagacgccucuagccgcuccauuggggcccugaauaagaucaacuucaauaccagauuugucaugaaaacacucaugaccaucugcccuggaacggugcugcugguguucagcauuucucucuggaucauugcugccuggacaguccgggcgugugaacgcuaccacgaucagcaagacguuaccuccaacuuucugggcgcuauguggcuuaucagcauuacauuccugucuaucggguauggagauauggugcccaauaccuacugcggcaagggggugugucuccugaccggcaucaugggagccggcugcacagcccuugucguggcuguuguggccagaaagcuggagcucacgaaagcugagaagcauguccacaacuucaugauggacacccagcugacaaaacgggugaagaacgccgcggccaauguucugagagaaaccuggcucauuuauaaaaacacaaagcuggugaaaaagaucgaucaugcuaagguccgcaaacaccagcggaaguuucuucaggccauucaccaacugagauccgugaaaauggagcagcgcaagcucaaugaccaggcuaacacccuggucgaccuggccaaaacgcagaauaucauguacgauaugauuagcgaccuuaacgaacgguccgaggauuucgaaaagagaaucgugacacucgagaccaagcuggagacccugauugggucuauccaugcgcucccuggacugaucagccaaacaauucgccagcagcaacgggacuuuaucgaagcccagauggaguccuaugauaaacacguuaccuacaaugcugaaagaucucgcagcuccagccggagacgccggucuuccagcacagcucccccgacgucuuccgagagcucuuga

SEQ ID NO: 71061 - RNA, 2196 nt, Artificial Sequence
  derived and/or modified sequence opt5 from KCNN3__Homo_sapiens__NP_002240
auggacaccagcggccacuuccaugauuccggggugggagaccuggaugaggaccccaagugcccuuguccgucuagcggcgaugaacagcaacagcagcagcaacagcagcagcaacagcagcccccucccccugcucccccugccgccccgcagcaaccccucgggccuucccugcagccccagccuccccaacuucagcagcagcaacagcagcagcaacagcagcagcaacagcagccgccucacccccugucucagcucgcgcaacugcagagccagccuguccaucccggacuucugcacuccucucccacagcuuuuagagccccuccgagcuccaacagcacggccauccuccaucccucuucccggcaaggcagccagcugaaucugaacgaccaccuccuggggcacucuccuuccagcaccgcuacaucuggacccggcggcgggucccgccauagacaggccagcccucuuguucaccggcgcgauuccaaucccuucaccgagauugcuaugucuagcugcaaguacuccggaggcgugaugaagccgcugagcagacucucugccucccggcgcaaccugaucgaagcggagacagaagggcagccucuucaacuguuuagccccucuaauccucccgagauugugaucagcuccagagaggacaaccaugcccaccagacccuccugcaccauccuaaugcuacacacaaccaucagcacgccggaaccacggcuucuagcaccacauuccccaaagccaauaagcggaaaaaccagaauauuggcuauaagcuggggcaucgcagagcgcucuuugaaaagcggaaacgccuguccgauuacgcccuuaucuucggaauguuuggcaucgucgugaugguuauugagaccgaacugagcuggggccucuauucuaaggacuccauguucagccuggcucuuaaaugucugaucucucucuccacaauuauccugcuggggcucauuaucgccuaccacaccagagaggugcaacuguuugucauugauaacggagcugacgauuggcggaucgccaugacguaugagcgcauccuuuacauuagccuggaaaugcucgugugcgccauccacccgauuccuggcgaguauaaguucuuuuggacagcuagacuggcguucuccuacacccccucucgggccgaagcugacguugacaucauucuuagcauccccauguuucugagacucuaccugaucgcccgcgugaugcugcuccauuccaaacuguucacagaugccucuagccgguccauuggggcucuuaauaagaucaacuucaauaccagauuugucaugaagacccugaugacaauuuguccuggaacggugcuccugguguucagcaucucucuguggauuaucgccgcguggaccguccgcguuugcgagcgguaucacgaccagcaggaugugacauccaacuuucuuggcgcuauguggcucaucagcauuaccuuccugucuaucggguacggagacauggugccgcauacauauuguggcaaaggcgucugccugcucaccgggauuaugggagccggcuguacggcccuggugguugcuguggucgccagaaaacuugaacugacaaaggcugagaagcacgugcacaacuuuaugauggauacccagcucaccaaacgcaucaagaaugccgcggccaacguucugcgggagacauggcugauuuacaaacauaccaaacuucucaagaagaucgaccacgcuaaggugagaaaacaucaacgcaaguuccugcaggccauucaccagcugcgguccgucaaaauggaacaaagaaagcucagcgaucaggcuaauacacugguggaccuuucuaagaugcagaacgucauguaugaucugaucacggagcucaaugaccgcagcgaagaucuggagaaacagaucgggucccuggaaagcaaacuugagcaucucaccgccucuuuuaacucccugccccugcucauugcggacacacugcggcaacagcagcagcaacuucugagcgccaucauugaggcuagaggaguguccguugccgugggcaccacacacaccccuaucucugacagccccauuggggucuccucuacgagcuucccuacccccuacacauccucuagcuccugcuga

SEQ ID NO: 71062 - RNA, 1284 nt, Artificial Sequence
  derived and/or modified sequence opt5 from KCNN4__Homo_sapiens__NP_002241
augggcggggaccuggugcucggacugggcgcccuuagacggcgcaagagacugcucgagcaggaaaagagccuggcugggugggcccuuguccuggcgggaaccggcaucgggcucaugguucugcacgcugagaugcugugguucggaggcugcuccugggcccucuaccuguuucuugugaaguguacaauuucuaucagcacguuccugcuccugugccuuauuguggccuuucaugcuaaagaaguccaacuguucaugaccgauaacggccuccgggacuggcgcguggcccugacagggagacaggcugcccagaucguucuggagcucguggucuguggacugcaccccgcgccugugcggggcccgcccugcguucaggaucuuggggccccucugaccucuccccaaccuuggcccggauuucucggccagggggaagcucugcuuucccuggccaugcuccugcgccuguaucucgugccuagagcuguccugcuucggagcggagugcugcucaaugccuccuaccgcucuauuggcgcgcugaaccaggugagauuccggcauugguuugucgccaaacuuuauaugaauacacacccgggccgccugcuccuggggcugacccucggacuguggcuuacaaccgcuuggguucugagcguggccgagagacaggcugugaacgccacgggccaucucuccgacacccuguggcugauccccaucacauuccuuaccauuggguacggagaugucgugccuggcacaaugugggggaaaaucguuugucucugcaccggagugaugggcgucuguugcacggcccugcugguggcuguuguggcgcggaagcucgaguuuaauaaggccgaaaaacacguccacaacuucaugauggacauucaauauacaaaggagaugaaagaaagcgcugcccgcgugcugcaggaggccuggauguuuuacaagcauaccagacggaaagagucucacgcugccagacgccaucagcggaaacuucuggcggcuaucaaugccuucagacagguccgccucaagcaccggaagcugagagaacaagugaacuccaugguugauauuagcaagaugcacaugauccuguaugaccuucagcagaaucucucuuccagccaucgcgcccuggagaaacaaauugauacacuggcuggcaagcucgacgcccugaccgaacuucugucuaccgcucucgggccccggcagcugccugagcccucccagcagagcaaauga

SEQ ID NO: 71063 - RNA, 2031 nt, Artificial Sequence
  derived and/or modified sequence opt5 from KCNQ1__Homo_sapiens__NP_000209
auggccgcugccagcucucccccuagagcggagcggaagcgcuggggcugggggagacugccgggagcucggcgcggcuccgccgggcucgccaaaaagugccccuucagccuggaacuugcugagggaggcccugccgggggagcucuguacgcccccaucgcgccuggcgcccccggcccugcuccgcccgccuccccugcugcccccgcggccccucccguggcuucugaccucgggccgagaccucccgucagccuggauccucggguuuccauuuauucuacccgcagacccgugcuugcccggacacacgugcagggacgcgucuacaacuuucuggaaagacccacgggcuggaaauguuucguguaucauuuugcuguuuuccucaucgugcuggucugccugauuuuuagcgugcucuccaccaucgagcaauacgccgcccuggcuacagggacccuuuucuggauggaaauuguucugguggucuuuuucggaacagaguauguggugcggcucuggagcgcgggcugucgcucuaaguacgucgggcuguggggaagacuucgguuugcccgcaaaccuaucuccaucauugaccugaucguugugguggcuagcauggucgugcucugcguuggcucuaagggccagguguucgccaccuccgccauuagagggauccgguuucugcagauucugagaaugcuccacgucgaucgccagggaggcacauggcggcugcuugggagcgugguuuucauccauagacaagagcugauuaccacgcucuauaucggauuucugggccuuaucuucucuuccuacuucguguaccuggcugaaaaggacgccgucaaugagagcgggcgcguggaauuuggauccuaugcggaugcucucugguggggcgucgugaccguuacaaccauuggcuacggggacaaagugccgcagacaugggucggaaagaccaucgccucuuguuucagcguguuugccauuuccuucuuugcucugcccgccggcauccuggggagcggauucgcucucaaaguucagcagaagcaacggcagaaacacuuuaacagacagauuccugccgcggccucucugauccagacggcuuggcgcugcuaugccgcugagaaucccgauuccagcacauggaagaucuacauucggaaggccccuagaucucauacccuucugagccccuccccgaaaccuaagaaaucuguggucgugaagaaaaagaaauucaagcucgacaaggauaacggcgugacacccggggagaaaaugcugaccguuccucacaucaccugugaucccccugaggaacgccggcuugaccacuuuagcgucgacggcuaugauuccagcgugagaaagucucccacacugcucgaaguguccaugccgcauuucaugcgcacgaauagcuuugcggaggaccuggaccuggaaggagagacccuccugacaccuauuacccacaucucucaacuucgggagcaucacagagccacaauuaaagucauccggcgcaugcaguacuucguggcuaagaaaaaguuucagcaagccagaaagcccuaugauguucgggacgugaucgaacaguacucccagggccaccugaaccucauggucagaauuaaagagcugcagcgccggcuggaucaaagcaucgggaagcccucccuuuucauuucugugagcgaaaaauccaaggacagaggaucuaauaccaucggcgcucgccucaacagaguugaggauaaagugacgcagcuggaccagcggcuggcccucauuacagauaugcugcaucagcuucugagccuccacgggggauccaccccuggcagcgggggcccgccccgcgaaggaggcgcccauaucacccaaccuugcgggucuggaggcuccgucgaccccgagcuguuccugccuagcaauacacuucccaccuacgagcagcucacagugccuagacgggggcccgaugaaggaucuuga

SEQ ID NO: 71064 - RNA, 2535 nt, Artificial Sequence
  derived and/or modified sequence opt5 from KCNQ2__Homo_sapiens__NP_004509
auggugcaaaagagcagaaacggcggggucuaccccggaccuuccggcgagaaaaagcugaaaguuggguucgugggacucgacccgggcgcccccgauucuacccgggacggggcucugcuuaucgccggaagcgaagcgccuaagcgcggcuccauucugucuaaacccagagcuggcggggccggagccggcaagccucccaagcggaaugcuuuuuaucgcaaacuccagaacuuccuguacaaugugcuugagagaccucgggggugggccuuuaucuaucacgcuuacgucuuccugcucguguuuagcugccugguucuguccguguucucuacaauuaaggaauaugagaaaagcuccgaaggagcccucuacauccuggagauugucacgaucgugguuuuuggcguggaguauuucguccgcaucugggcggccggguguugcuguagauaccggggauggcgcggcagacuuaaguuugcucggaaaccguucugcgugauugauaucauggugcugauugccagcaucgcuguccucgccgcgggcucucaggggaacguuuuugccaccuccgcucugcgcagccuuagauuccugcagauucuccggaugauccgcauggacagacggggaggcacauggaagcugcuggggucugugguguacgcccauuccaaggaacucgucaccgcuugguauauuggauuucugugucuuauccuggccagcuuccucguguaccuggccgagaaaggcgaaaaugaucacuucgacacauaugcugaugcgcuuuggugggggcugaucacccucacaaccauuggauacggcgacaaguauccccagacguggaacggcagacugcuggccgcuaccuuuacacucaucgggguuucuuucuuugcccugccugccggaauccuuggcuccggguucgcucugaaagugcaagagcagcaucgccagaagcacuuugagaaacggagaaaucccgccgcgggacucauccagagcgcuuggcgcuucuacgccaccaaccugucccggacagaucuucauucuaccuggcaauauuacgaaagaacggucacagugccuauguaccgccugauucccccgcucaaucagcuggagcugcuccggaaccuuaagagcaaauccggccuggccuuuagaaaggacccucccccugaacccagccccucucagaagguuucccugaaagaucgcguguucagcucuccuagaggggucgcugccaagggcaaaggaagcccgcaggcucaaaccgugagacgcucccccucugccgaccagagccucgaggauuccccuagcaagguccccaaaucuugguccuuuggcgaccggagcagagcgcggcaggccuuccgcaucaagggggcugccucuagacaaaauuccgaagaggcuagccugccuggagaggacaucguggaugacaaguccugccccugugaauuuguuacagaggaucugaccccgggccuuaaagugucuauucgggccgucugcgugaugagauuccucguuagcaagcgcaaauuuaaggaaucccugcggccuuaugacgugauggaugucaucgagcaguacucugcggggcaccuggacaugcucagcagaauuaaaucccugcagagccgcguggaucagaucgugggaagaggccccgccauuaccgacaaggaucggacaaaggggccugcugaagccgagcuucccgaggacccuucuaugaugggccgccugggaaaaguugaaaagcaaguccucuccauggagaaaaagcuggauuuccuggugaacaucuauaugcagagaaugggcauucccccgacggaaaccgaggcuuacuucggggccaaagaaccugagcccgccccucccuaucacagcccggaggacucucgggaacauguggaccgccacggauguauugucaagaucgugagauccagcucuagcacaggccagaagaauuuuuccgcucccccugcggcucccccuguucagugucccccuagcaccucuuggcaaccccagucccauccgcggcaggggcacggaacaagcccugugggcgaucacgggucccuuguccgcauucccccucccccggcccaugagagaucucucagcgccuacggcggaggcaaccgggccuccauggaguuccugcgccaggaagacaccccugggugcagacccccugagggaaaucugcgggauucugacacgagcaucuccauucccucuguggaucacgaggaacucgaacggagcuuuuccggcuucagcaucucucaauccaaagagaaccuggacgcucuuaacagcugcuaugccgcgguugcucccugcgccaaggugcgcccuuacauugccgaaggggagucugauacagacuccgaucuguguaccccgugcggacccccuccccggagcgcuaccggcgaggggccuuuuggcgacgucggaugggccggccccagaaaauga

SEQ ID NO: 71065 - RNA, 2259 nt, Artificial Sequence
  derived and/or modified sequence opt5 from KCNQ3__Homo_sapiens__NP_001191753
augaagcccgccgagcacgcuaccauguuccugaucgugcucggcugccugauucuugccguccugacaacguuuaaagaauacgagaccguuagcggggacuggcuccugcuucuggaaacauucgcgaucuuuauuuucggagcugaguuugcccucagaaucugggccgcuggcuguugcugucgguauaagggguggcgcggaagacugaaauucgcccggaagccucugugcaugcucgauauuuuugugcugaucgcuuccgugccggucguggccguuggcaaccaggggaaugugcuugcgaccucucugcgcagccucagauuccugcaaauccuucggaugcugcgcauggacagacggggaggcacauggaaacuccugggcuccgccauuugugcucauucuaaggaacugaucaccgccugguacauuggguuucucacacugauccuuagcuccuuccuggucuaucucguggagaaggauguucccgagguggacgcucagggagaagagaugaaagaagaguuugagaccuacgccgaugcgcugugguggggccuuauuacgcuggccaccaucggguauggagacaagacaccuaaaaccugggaaggccgccucauugcugccacauucucucugaucggggucagcuuuuucgcucugcccgccggaauccucggcuccggccuggcccuuaaggugcaggagcagcacagacaaaaacauuucgaaaagcggcgcaagccugcugcggagcugauucaggccgcuuggagauacuaugccaccaaccccaaucggaucgaucucguggccacguggcgcuuuuacgaaagcgucguuucuuuccccuuuuucagaaaagagcagcuggaggcugccuccagccagaaacuugggcugcucgaccgggugagacugucuaacccgcgcggauccaauacaaagggcaagcuguuuacaccccucaacguggaugcgauugaagagagcccuucuaaagaacccaagccugucgggcugaauaacaaagagcgguucagaaccgcuuuucgcaugaaggccuacgccuucuggcaauccagcgaagacgcuggaaccggcgaucccauggccgaggaccggggguauggaaaugauuuuccgaucgaggacaugauuccuacccuuaaggcugccaucagagcggugcgcauccugcaguuccggcucuacaaaaagaaauuuaaggaaacacugagacccuaugacguuaaagaugugauugagcaguacuccgccggccaccuggacaugcuuucucgcaucaaguaucuccagacgcggauugauaugaucuucaccccuggcccucccagcacaccuaagcauaaaaagucccaaaaagggagcgcuuuuaccuucccgucucagcagucccccagaaacgaaccuuacgucgcccgccccagcacaucugagauugaagaccaaagcaugaugggaaaguucgugaaaguugagagacaggugcaggauaugggcaagaagcuggacuuucuggucgauaugcacaugcagcacauggagcggcuccaagugcaggucaccgaauauuacccuacgaaagggacauccucucccgcugaggccgaaaagaaagaggacaaucgguacagcgaucugaagaccaucaucugcaacuauuccgagaccggaccgccugaacccccuuacagcuuccaucaggugacaauugacaaaguuucucccuauggcuuuuucgcgcacgauccugugaaucuuccccgcgggggcccguccagcggaaagguccaggccaccccucccucuuccgcuacaacguacguggagagacccaccguucugccuauccucacacugcuggacagccggguguccugucauucucaagccgaccuucagggcccguauagcgauagaauuucuccccgccagcggagauccaucacccgcgacagcgauacaccucucucccugaugagcgucaaccacgaggaacuggaaagaucucccuccggguuuagcauuucucaggaccgggaugacuacguguucggaccuaauggcggguccagcuggaugcgcgagaagagauaucucgcugagggagaaaccgauacggacaccgaucccuuuacaccuucuggcagcaugccccuguccagcaccggggacggcaucucugauuccguguggacaccgagcaacaaaccuauuuga

SEQ ID NO: 71066 - RNA, 2772 nt, Artificial Sequence
  derived and/or modified sequence opt5 from KCNQ5__Homo_sapiens__NP_001153602
augcccagacaccaugccggcggggaggaaggaggcgcugccgggcugugggugaaaagcggagcggcugccgccgcugccggcgggggacggcucggcuccggcaugaaagacgucgagucugggcgcggaagaguucugcuuaacagcgcugccgcgcggggcgaugggcugcuccugcuuggaacccgcgccgcuacacugggcgggggaggcggcgggcucagagaaucccggcgcggaaagcagggcgccagaaugucucugcuggggaaaccucucagcuacacguccucucaaagcugccggcgcaaugugaaguauagacgggugcagaacuaccuguauaauguccuugagcgcccgagaggaugggcuuucaucuaccacgccuuuguguuccugcucguuuuuggcugucugauucuuuccguguucagcaccauccccgaacauacaaaacuggcgucuuccugccuccugauucuggaguuugucaugaucgugguuuucgggcucgaguuuauuauccggaucuggagcgccggauguugcugucgcuauagaggcuggcagggccggcugagauucgcucgcaagccuuuuugcgugauugacaccaucguccuuauugccucuaucgcugugguguccgccaagacacaggggaacauuuucgccaccagcgcucugcggucucucagauuucugcaaauccuucgcaugguccggauggauagacgcggaggcacauggaaacugcucggguccguuguguacgcgcacagcaaggaacugauuaccgccugguauaucggauuccuggugcucaucuuuuccucuuuccuggucuaccuuguggagaaagacgcuaauaaggaguucagcacguacgccgaugcccugugguggggcaccauuacacucaccacaaucggguauggcgacaaaacgccccugaccuggcuuggacggcugcucuccgcuggcuuugcccugcuggggauuagcuucuuugcgcucccugcuggaauccugggcucuggguucgcccuuaagguucaggaacagcauagacagaagcacuuugagaaacgccggaaccccgccgcuaaucugauucaauguguguggagauccuacgccgcugaugaaaagagcgucucuaucgccacauggaaaccucaccucaaggcgcugcauaccugcagcccgacaaaccagaaacuguccuucaaggagcgcgugcggauggccucucccagaggacagagcaucaaaucccggcaggcuagcguuggcgaccgcagaucuccuuccaccgauauuaccgccgaagggagccccacaaaggugcaaaagucuugguccuuuaaugaccggacgagauuccgcccuagccuucggcucaaauccucucagcccaagccggucaucgaugcugacaccgcccugggcacagaugacguguaugacgagaaaggaugucagugcgaugucagcguggaagaccugaccccuccccucaagacaguuauuagagcgauccgcauuaugaaauuucacguggccaagagaaaguucaaagagacccugcggccuuacgaugucaaggacgugaucgagcaauauuccgcuggccaucuugauaugcugugucgcaucaaaucucuccagacgagaguugaccagauucuggggaagggacagaucacaagcgauaaaaagucccgggaaaagauuaccgccgagcacgaaaccacagacgaucugagcaugcuuggccgcguggucaaaguggagaagcaagugcagucuaucgaauccaaacucgacugccugcuggauauuuaccagcagguucucagaaaggggagcgcuucugcccuggcccuugcuuccuuucaaaucccucccuucgagugcgagcagaccagcgacuaucagucucccgucgacagcaaagaucuguccggaagcgcgcagaacucuggcugucucucccggagcacauccgccaauauuucucgcgggcugcaauuuauccugacgccgaacgaguucagcgcucagaccuucuacgcccuuucccccacaaugcacucucaggccacccaggugccuaucagccaauccgacggcucugcuguggccgcgacaaauaccauugcuaaccagaucaauacggcccccaagccugccgcucccaccacacuccagauuccgccuccccugccugccaucaagcaucugcccagaccugaaacccuccaccccaacccggcgggacugcaagaaagcauuuccgaugucacaaccugccuuguggcuagcaaagagaacguucagguggcccagucuaaucugacgaaggaccgguccaugcgcaagagcuuugauaugggcggggaaacacuccugucugucuguccuauggugcccaaggaccugggaaaaucccuuagcguucagaaccucaucagaucuaccgaggagcugaauauccaacuguccggcagcgaauccagcgggucucggggaagccaggauuucuaccccaaguggagagaguccaaacucuuuauuacagacgaagaggugggcccugaggaaaccgagaccgauacauucgacgccgcuccgcagcccgcccgcgaagcugccuuugcgucugauagccugcggacggggagaucccgcucuagccaguccaucugcaaggccggcgagucuaccgacgcucuuagccugccucaugucaagcucaaauga

SEQ ID NO: 71067 - RNA, 819 nt, Artificial Sequence
  derived and/or modified sequence opt5 from KCNRG__Homo_sapiens__NP_775876
augagcucccaggagcuggugacccucaacgucggcgggaagaucuucacaacgagauuuucuaccauuaaacaauuccccgccagccggcuggcucgcaugcuugacggaagagaucaggaauuuaagaugguuggcgggcagaucuucguggaccgggauggagaccuguuuuccuucauucucgauuuucugcgcacacaccagcuucugcucccuaccgaguucucugacuaccugagacugcaacgggaagcccucuuuuaugagcugcgcagccuuguggaucugcucaauccguaccugcuucagcccagaccugcgcuggucgaagugcauuuccucucccggaacacacaggccuuuuuccgcguuuuuggcucuugcagcaaaaccaucgagaugcugacagggagaauuaccguguucacggagcagcccuccgcuccuaccuggaauggaaacuucuuucccccucaaaugacacugcucccgcugcccccucagcggcccagcuaucacgaccuugucuuccaguguggcucugauuccaccacagacaaucagaccggcgugcgcuacguuagcaucaagccugauaacagaaaacuggccaaugggacgaacgugcucggacugcuuaucgacacacugcucaaggaaggcuuucaucuggucucuacccggacaguguccagcgaggauaagaccgaaugcuauucuuucgagcgcauuaaaucccccgaggugcugaucaccaaugaaacaccgaagccugagacgauuaucauucccgaacaaagccagaucaaaaaguga

SEQ ID NO: 71068 - RNA, 1581 nt, Artificial Sequence
  derived and/or modified sequence opt5 from KCNS1__Homo_sapiens__XP_005260466
augcugaugcuccuggugagaggcacccacuacgagaaccuucggagcaaggucguucugcccacaccucucgggggacgcuccacggaaaccuucgugucugaguuuccgggccccgacacagggaucagauggcggcgcagcgaugaagcccugagagugaaugucggaggcgugcggcgccagcuuuccgcuagagcccuggcgcgguucccugggacccgccucggaagacugcaagcugccgccucugaggaacaggcucggcgccugugcgacgauuaugacgaggccgcuagagaguuuuacuucgaucggcaucccggcuuuuuccucagccugcuucacuuuuaucgcacaggccaucugcacguucucgacgaacuguguguguucgccuuugggcaggaggcggauuacuggggacuuggcgaaaacgcccuggcugccugcuguagagcucgguaucucgagagacgccugacccagccucaugccugggacgaggauuccgacacacccucuagcgucgauccuugcccggacgaaauuuccgaugugcaacgggagcuggcgagauacggggccgcucgcuguggacggcucagacgccggcuguggcuuaccauggaaaaucccggcuauagccugccuucuaaacucuucuccugcguuagcaucucugugguccuggccuccauugcugccauguguauccacagccuucccgaguaccaggccagagaagcugcggccgcuguggccgccguggcugccgggcgcucuccugagggaguccgggacgaccccguucugagacgccucgaguacuuuugcauugcgugguucuccuuugaagugagcucccggcugcugcucgcuccgucuacgagaaacuucuucugucacccucugaaucuuaucgauaucgugagcguccugcccuuuuaucucacccugcuugccggcguggcccugggcgaccaagggggaaaggaguucggccaucucgggaaaguugugcaggucuuucggcugaugcgcauuuucagagugcugaagcucgcucggcacuccacaggacugagaagccuuggcgccacccugaaacauucuuaccgcgaaguugggauccuccugcuguaucuugcugugggagucuccguguuuagcggcgucgccuacacagcggagaaggaagaggaugugggcuucaacaccauuccugccugcugguggugggggacgguuucuaugacaaccgugggauauggcgacgucgugcccguuacaguggcugggaagcucgccgcuagcggauguauccugggcgggauucuggucguggcccuccccaucaccauuaucuuuaauaaauucucccacuuuuaccggagacagaaggcgcuggaggccgcugugcgcaacucuaaucaccaggaguucgaagaucuucugagcuccaucgacggcguuagcgaagccucucucgagaccuccagagaaacaagccaggagggacagucugcugaucuggagucccaagccccuagcgaaccgccccauccucagauguauuga

SEQ ID NO: 71069 - RNA, 1476 nt, Artificial Sequence
  derived and/or modified sequence opt5 from KCNS3__Homo_sapiens__XP_011531127
augguguucggcgaguuuuuccacagacccgggcaggacgaagaacuggucaaccucaauguuggaggcuuuaagcaaagcguggaucaguccacccugcuucgguucccucauacacgccuggggaaacuccugacgugccacucugaagaggccauccuugaacugugugacgauuacagcguggcugacaaggaguauuacuuugauagaaacccgucccucuuccgguauguccugaauuuuuacuauaccggaaaacugcaugugauggaggaacucugcguuuucucuuuuugucaggagauugaauacuggggcaucaacgagcuguucauugacagcugcuguuccaaucgcuaucaggagagaaaggaagagaaccacgaaaaagauugggaccaaaagucucaugaugugagcacagacuccagcuuugaggaaucuucccuuuucgagaaggagcuggaaaaauuugauacccuccgguucgggcagcugcgcaagaaaaucuggauuagaauggagaaucccgccuacugccuuagcgcgaagcugaucgcuaucucuucccucagcgucgugcuggccucuauuguugccaugugugugcacuccaugagcgaguuccagaacgaggacggagaagucgaugacccugugcuggagggcguggagaucgcuugcauugccugguuuacaggcgaacucgcuguccggcuggccgcggcccccugucagaaaaaguucuggaagaauccucuuaacaucauugacuuuguuuccaucauucccuucuacgcuacccuggccguggauacaaaagaggaagagucugaagacaucgagaauauggggaaggugguccaaauccuccgccugaugagaauuuuucggauccuuaaacuggcucgccacagcgugggacucagaucccugggcgccacccugcggcauagcuaucacgagguugggcuccugcuucuguuccucucugugggaauuuccaucuuuagcguccugauuuacucuguggaaaaggaugaccauacgagcucccuuaccucuaucccuaucugcugguggugggcgacaauuagcaugaccacaguuggcuauggggauacccacccggugacgcuggccggaaaacucaucgcuuccacauguauuaucugcggcauucuggucguggcccugcccaucaccaucauuuucaacaaguuuagcaaauacuaucagaagcagaaggacaucgaugucgaccagugcucugaggaugcuccugaaaaaugucacgagcuccccuacuucaauauucgcgacaucuaugcccaaagaaugcauacauuuauuaccucccugagcucugugggcaucguuguguccgauccugacagcaccgacgccuccucuauugaggauaacgaagacaucugcaauacaacgagccuugagaacuguaccgcuaaguga

SEQ ID NO: 71070 - RNA, 3708 nt, Artificial Sequence
  derived and/or modified sequence opt5 from KCNT1__Homo_sapiens__NP_065873
augccccugccugacggcgccagaacccccgggggagugugccgggaggcucgcggcgggggauacacaaacagaacguucgaauuugaugacggccagugugcccccagacgcccuugcgcgggggauggagcucuccuggacaccgccggcuucaagaugagcgaucuugacuccgagguccugccccucccucccagauaucgguuucgcgaucugcuucugggcgacccuucuuuccaaaaugaugacagaguucagguggaauuuuacgugaacgagaauacauucaaagaacggcucaagcuguuuuucaucaaaaaccagcgcagcucccugcggauucggcucuuuaauuucucucugaaacuucugaccugucuccuguauaucguccgcgugcuucuggaugacccggcccucgggauuggaugcuggggcugucccaagcagaacuacagcuuuaaugauuccucuagcgagaucaacugggcuccuauucuguggguugagagaaagaugacacugugggccauccaagugaucgucgcuauuaucuccuuccucgaaaccaugcugcuuauuuaucugagcuacaaggggaauaucugggagcagauuuuucgggugucuuucguucucgaaaugaucaacacacugcccuucauuaucaccaucuuuuggccuccccuucgcaaucuguucauuccgguguuucucaacugcuggcuggccaaacacgcgcuggagaauaugaucaacgacuuccauagagccauucuccggacgcaguccgcuauguuuaaucagguccugauccuuuucuguacccugcucugccugguguuuacaggaaccuguggcauucaacaccuugagagagccggggaaaaccugagccuccugacaucuuucuauuuuugcaucgugaccuucuccacggucggauacggcgacguuacaccuaagaucuggcccagccagcugcucguggugauuaugaucugugucgcucuggugguucuuccucugcaguuugaggaacucguguaccuguggauggagcgccagaaaucuggcgggaacuauucccggcauagagcccaaaccgaaaagcacgucgugcugugcguuagcucccuuaaaauugaucuccugauggacuuccugaaugaguuuuacgcgcauccccgccuccaggauuauuacguggucauccugugccccacagagauggacgugcagguccggagagugcuucaaauuccucuguggucucagcgcguuaucuaucuccagggaagcgcccugaaggaucaggaccugaugcgggcuaagauggauaacggcgaagccuguuucauccuuuccagcagaaaugagguggaccgcaccgcugccgaucaccaaaccauucuccgggccugggcugucaaagacuucgcgccgaacugcccccuguacgugcagauccugaagccugaaaauaaauuucacguuaaguucgccgaucauguggucugugaggaagagugcaaauaugcuaugcucgcccugaacuguauuugccccgccacaucuacgcuuaucacccugcucgugcacacauccagagggcaggagggacaggaaagcccugagcaauggcagcgcauguacggccgguguucugggaaugaaguguaccauauuagaaugggagacagcaaguuuuuccgggaguaugaaggcaaauccuuuaccuacgcugccuuccacgcgcacaagaaguauggcguuugccugaucgggcugaaacgcgaggacaacaagucuauucuucucaaucccggaccgagacauauccuggcugccagcgauacauguuuuuacaucaacauuaccaaagaggaaaauuccgccuucaucuuuaagcaggaggaaaaacggaagaagagagcuuucagcggccaggggcugcacgagggaccugcccgccuccccguccauucuauuaucgcuuccaugggcacgguggccauggaccugcaagggacagagcaccggccuacccagagcggcggaggcgggggaggcucuaaacuugcgcugcccaccgaaaacggguccggaagcagacgcccuuccauugcccccgugcucgagcuggcugauucuagcgcccugcuuccgugcgaccuccuguccgaucagucugaagacgaggucacaccuagcgaugacgaaggccuguccgugguugaguaugugaagggguacccgcccaauagcccuuauaucggaucuuccccgacccucugucaucugcuucccgucaaagcuccuuuuugcugccugagacucgauaagggcuguaaacacaacagcuacgaggacgccaaggcguacggcuucaagaauaaacugaucauugugucugccgaaacagcugggaacggacuguauaacuuuaucguuccccuucgggccuacuaucgcuccagaaaggagcugaauccuauugugcuccugcucgauaacaaacccgaccaccauuuccuggaagcuaucugcuguuucccuauggucuacuauauggagggcagcguggauaaucuugacucucugcuccagugcgggauuaucuacgccgacaaccugguuguggucgauaaggaaagcacgauguccgccgaggaggacuauauggcugaugcgaaaaccaucgugaaugugcaaacaauguuucggcuguuccccagccuuucuauuaccacagaacugacccacccguccaacaugcgcuuuaugcaguucagagccaaggacagcuacucccucgcucugucuaagcucgagaaacgggaacgcgagaauggaagcaaccuggccuuuauguucagacuuccuuuugccgcuggccgggucuucuccaucucuaugcuggauacgcuccuguaccagagcuuuguuaaggacuauaugauuaccaucacacgccugcuucuggggcucgauaccacacccggcuccggauaccugugugccaugaaaauuaccgaaggcgaccucuggaucagaacguaugggcggcuguuccaaaaacuuugcucuagcuccgcggagaucccuauuggaaucuacagaacagagagccauguguuuucuaccuccgaaccccacgaucugcgcgcucagagccagauuucugugaaugucgaggacugugaagauacacgggaggugaagggcccguggggguccagagccggaaccggcgggagcucucagggccgccacaccggaggcggggacccugccgagcauccccugcuccggagaaagucccugcaaugggcucgccggcuuagcagaaaagccccuaagcaggcgggacgcgcugccgccgcugaauggaucucccagcagcggcugagccucuauagacggucugagcgccaagaacugagcgagcucguuaagaacagaaugaaacaccugggccuucccacaacgggguacgaugaaaugaaugaccaucagaacacccuguccuaugugcugauuaaucccccuccggacacacggcucgagcccucugauaucgucuaccugauucgcagcgacccucuugcccacguggcuuccucuagccaguccagaaagucuagcugcucccauaaacugagcucuuguaaccccgagacccgggaugaaacacagcucuga

SEQ ID NO: 71071 - RNA, 3336 nt, Artificial Sequence
  derived and/or modified sequence opt5 from KCNT2__Homo_sapiens__NP_001274748
augguggaccuggagagcgaaguucccccucucccgcccagauaccgguuccgcgaucugcuucugggcgaccagggguggcaaaacgaugacagaguccagguggaguuuuauaugaaugaaaacaccuucaaggagcggcucaaacuguuuuucaucaagaaucagcgcuccucucuucggauuagacuguuuaacuucagccucaaacugcuguccugccuccuguacaucauucgcgugcuucuggaaaauccuucucagggaaacgaguggagccacaucuuuugggucaauagaucccucccccuguggggccuucaagugucuguugcccugauuagccucuucgagacaauccugcugggguaucucuccuacaagggaaacaucugggaacagauucugcggaucccuuuuauucuugagaucauuaaugcugugcccuucaucauuagcaucuuuuggccuucucugcgcaaccucuucgucccgguguuucugaauuguuggcuugccaaacaugcgcuggaaaacaugaucaaugaucuccacagagcuauucagcggacgcaguccgccauguucaaccaaguucugauccugauuagcacccuccugugccuuaucuucacauguauuugcggcauccagcaucuggagcgcaucgggaagaagcucaaucuguuugacucucuuuauuucuguauugugaccuuuuccacagucggauucggcgaugugacccccgagacauggagcucuaaacuguuuguggucgccaugaucugcguugcucucguggugcugccuauucaguucgaacagcuggccuaccucuggauggagagacaaaaguccggcgggaacuauagccggcaccgcgcucagaccgaaaaacaugucgugcuguguguuuccucucuuaagaucgaccugcucauggauuuucugaacgaguucuacgcccaccccagacugcaggacuacuauguggucauucuuugcccuacggaaauggaugugcaaguucggagagugcuccagauccccauguggagccagcgcgucaucuaccugcagggauccgcgcugaaagaccaagaucuccugcgggccaagauggacgacgcugaggccuguuuuauucuuagcucuagaugcgagguggaucgcaccuccagcgaccaccagacaauccugcgggcuugggccgucaaggauuucgcgccgaauuguccucucuaugugcagauucugaaacccgaaaacaaguuucauaucaaauucgccgaccacguugugugcgaggaagaguuuaaguacgcuaugcuggcccuuaauugcauuuguccugcuaccucuacacucaucacccugcugguccauacgagcagaggccaggaagggcaacagucccccgagcaguggcagaaaauguauggacgcugcucuggcaacgagguguaccacauuguucucgaagagagcacauucuucgccgaauaugaggggaaguccuuuaccuacgccagcuuccacgcucauaaaaaguuuggagugugucugaucggcguccggagagaagauaauaagaacauccuucugaaucccggcccucgcuacauuaugaacucuacagacaucugcuucuauauuaauaucaccaaagaggagaacuccgcguuuaagaaucaagaucagcagcggaaaagcaacgugucuagauccuucuaccacgggccgagccgccuccccgugcauuccauuaucgccucuaugggaaccguugcuaucgaccugcaggauacaagcugucgguccgccucuggcccuacgcugagccuucccaccgaaggguccaaggagauuagacggccuagcaucgcccccguccucgaaguggcugacacaucuuccauucaaaccugcgaucugcugagcgaccagucugaggacgagacaaccccggaugaagagauguccagcaaucucgaauaugccaaaggauacccucccuauucuccuuacaucggcagcucccccacguuuugucaucugcuucacgagaaggugccuuucugcugucugcgccucgacaagagcugccagcacaacuauuacgaagaugcgaaggcuuacggguuuaaaaauaaacugauuaucgucgccgccgagacagcuggaaacggccuguauaacuucaucgugccccuuagagccuacuaucggccgaagaaagagcucaauccuauuguucugcugcucgacaacccccuggaugaccuucugagauguggcgugaccuuugcugccaauauggucgugguugauaaggaaucuaccauguccgcggaggaagacuacauggccgaugcuaagacaaucgugaacguccaaacccucuuccgccuguuuagcucccugucuauuaucacagagcuuacgcaccccgccaauaugcgguucaugcaguucagagcuaaagacugcuauagccuggcccucuccaagcuggagaaaaaggaacgcgagagagggucuaaccucgcguuuauguuccggcugccuuuugccgcuggacgcguguucagcauuuccaugcuugauacccugcucuaccagucuuuuguuaaagacuauaugaucagcaucacaagacugcugcuuggccuggauaccacaccgggguccggauuccucugcagcaugaagauuaccgccgacgaccuguggauccggacguacgcucgccucuaccagaagcuguguucuuccaccggcgaugugcccauugggaucuauagaacagaaagccaaaaacuuaccacaucugagucccagauuagcaucucugucgaagagugggaagacaccaaggauuccaaagagcagggccaucaccggagcaaucaucgcaacuccacgagcucugaccagagcgaucacccucugcucagacggaaguccaugcaaugggcccgcagacugucucggaaaggacccaagcacagcggcaaaacagccgagaagauuacccagcagagacugaaucuuuaccgccgguccgaaagacaggagcuggcugaacucgugaagaaccgcaugaaacaucuggggcucucuacagugggauaugacgagaugaaugaucaccaaagcacccuguccuacauccuuaucaacccuucucccgacacccggauugagcugaaugaugucguuuaucugaucagaccugacccccucgcguaccugccgaacagcgaaccuucccgccggaauagcauuugcaacgugacaggccaggauucuagagaggaaacgcagcuuuga

SEQ ID NO: 71072 - RNA, 3450 nt, Artificial Sequence
  derived and/or modified sequence opt5 from KCNU1__Homo_sapiens__NP_001027006
auguuccagaccaagcugagaaacgagacaugggaagaccuccccaaaaugagcugcacgaccgagauccaagccgcuuuuauucuguccucuuucgugacauuuuucagcggccuuaucauucugcucaucuuucggcugauuuggcgcuccgucaagaaauggcagaucaucaaggggaccggaauuauccuugaacuguucacaucuggcaccauugccagaagccacguucggucccuccauuuucaggggcaguuccgcgaucacaucgagaugcugcugucugcgcaaacauuugugggacaggugcucgucauucugguguucguucuuagcaucggcucccugauuaucuacuuuaucaauagcgcugacccuguggggucuugcuccagcuaugaagauaaaaccauuccgaucgaccucgucuucaacgccuuuuucucuuucuacuuuggacugagauucauggccgcugaugacaagauuaaguuuuggcuugagaugaacuccaucguggauauuuucacgauucccccuaccuuuaucagcuauuaccugaaaucuaauuggcucggccugcgguuccugcgcgcccucagacugcuugagcugccccagauucuccagauccugcgggcuauuaagacauccaauagcguuaaauuuuccaaacuucugucuaucauucucagcaccugguucacagccgcgggcuuuauccaucugguggaaaacuccggggacccuuggcugaaaggacgcaauagccaaaacaucucuuauuucgaguccauuuaccucgucauggccaccacgagcacagugggcuuuggggauguggucgcuaagaccucucugggaagaacauucaucauguuuuucacccuuggcagccugauucucuucgccaauuauauccccgaaaugguugagcuguuugcuaacaagcggaaauacaccuccucuuacgaggcccuuaaggggaaaaaguucauuguggugugcggaaauaucacagucgacagcgugacggcguuucugcgcaacuuccucagagauaaauccggcgaaauuaauaccgagaucguuuuucugggcgaaacaccuccgagccuggagcucgaaaccaucuucaaguguuaucuggccuacacaaccuuuauuucuggguccgcuaugaaaugggaggaccuucggcgcguggccgucgagagcgcugaagccugccugaucauugccaacccccucuguucugauucccacgcugaggacaucagcaauauuaugagagugcuguccaucaagaacuaugacucuacgacacggaucauuauccagauucugcagagccauaacaagguuuaccuuccuaaaauccccuccuggaauugggauaccggagacaacauuaucugcuucgcggaacucaagcugggcuuuaucgcccaggggugucuggugccuggacucugcaccuuccugacaucucuuuuugucgagcaaaauaaaaaggugaugcccaaacagaccuggaagaagcacuuccugaacagcaugaaaaauaagauucucacacagagacuguccgaugacuuugcuggcaugagcuucccggaagucgcccgccuguguuuccuuaaaaugcaccuccugcugaucgccauugaguauaagucucucuuuacggauggguucugcggacugauccuuaacccucccccucaagugcggauuagaaagaauacccugggcuuuuucaucgcugagacacccaaggacguucgccgggcccucuuuuacuguuccgugugccaugaugacgucuucauccccgaacugauuaccaacugcggcuguaagagcagaucucgccagcacaucacagugccuuccguuaaacggaugaagaaaugccugaaggggauuagcucuagaaucagcggacaggauuccccgccccgcgugagcgcgucuaccuccagcauuuccaauuuuacgacccggacacuucagcaugacgucgagcaagauucugaccagcucgacagcuccggcauguuccacugguguaaaccuaccucucuggauaaggugacacugaagagaaccgggaaaagcaaguauaaauuucgcaaccacaucguggcuugcguuuucggagacgcccauuccgcccccaugggccuccggaauuuugucaugccucugagagcuucuaacuacacgcggaaggaacuuaaagauauuguguucaucgggagccuggacuaccuccagcgcgaguggagauuccuguggaauuuuccccagaucuauauucugccgggcugugcccuuuacuccggagaucuccacgcugccaacaucgaacaaugcagcaugugugcggugcugucuccucccccucagcccuccagcaaucagacacuggucgacaccgaggccauuauggcuacacucaccaucggcucucugcagauugauuccagcucugacccuucccccagcguguccgaggaaaccccgggguauacaaacggacauaacgaaaagagcaauugccggaaaguuccuauccuuacggagcugaagaaccccucuaauauccacuucauugagcaacucggcgggcuggagggaagccugcaggaaaccaaccuucaucuguccacagccuuuucuaccggcacaguguucagcggguccuuucucgauucucugcucgcuaccgccuucuacaauuaucacguccuggagcuucugcagaugcucgugacgggcggaguuagcucccagcuggaacaacaccuggacaaggauaaaguguacggcgucgcggacucuuguacaagccuucuguccgggagaaaccgcugcaagcucggacugcucagccugcaugagaccauccuuucugaugugaauccccggaacaccuuuggccagcuguucugugggucccucgaccuguuuggaauccugugcguuggccuuuauagaaucauugacgaagaggagcugaauccugaaaacaaacgcuucgugaucacaagaccggccaaugaguuuaagcuccugcccagcgaucucgucuucugcgcuaucccuuuuucuaccgccuguuacaaacggaacgaagaguucucccugcaaaagagcuacgaaauugugaauaaggcuucccagacaacggagacccacucugacacaaacugucccccuaccaucgauagcgugacagagacccuuuauucccccgucuacagcuaucagccucgcaccaauucucuguccuuccccaaacagauugccuggaaccagagcagaacgaacucuaucauuagcucccaaaucccgcugggggacaaugccaaggaaaacgagcggaaaacaucugaugaaguuuacgacgaggauccuuuugcuuauagcgaaccccucuga

SEQ ID NO: 71073 - RNA, 1503 nt, Artificial Sequence
  derived and/or modified sequence opt5 from KCNV1__Homo_sapiens__NP_055194
augcccagcuccggcagagcccugcucgacucuccucuggauagcgggucccuuaccucucuggacagcuccguguucugcucugagggagaaggcgagccgcucgcucugggggauuguuuuacagucaacguuggaggcagccgguucgugcuuucccagcaagcccugagcugcuuuccccacacgcgccucgggaagcuggcgguggucguggcuucuuacagacggccuggagcccuggccgcuguucccuccccucucgaacugugugacgaugccaaucccguggacaacgaguauuucuuugaucgcagcucucaggcuuucagauacguccuucauuauuaccggaccggccgccugcacgugauggaacagcucugcgcccuguccuuucuucaggagauccaauauuggggcauugacgagcugagcaucgauucuuguugcagagaccgguacuuccgcagaaaagaacucuccgagacacuggauuuuaagaaagacaccgaagaucaggagagccagcaugaguccgaacaggacuucucucaagggccuuguccgacaguucggcagaagcuguggaauauucucgagaaacccggaagcuccaccgcggcccgcaucuuuggcgugauuagcaucaucuucgucguggugucuauuaucaacauggcucugauguccgccgaacuuagcuggcuggaccuccagcugcuugagauucuggaauaugucugcaucucuugguuuacaggggaguucguucucagauuccugugugugcgggaucgcugcagauuucugcggaaggugccuaauauuaucgaccuccuggcuauucuucccuucuacaucacccugcucgucgagagccuguccggaucucagacgacccaagaacuugagaacgugggcagaaucguucaggugcugcgccuccugcgggcccugagaaugcucaagcuggggcgccacagcacaggacuucggucccugggcaugaccauuacacaguguuacgaagaggucggccuccugcugcuuuuucucagcguggggaucucuauuuucuccaccguugaauauuuugcggagcaaagcaucccugauacgacauucaccucugugcccugcgccugguggugggcuacaaccuccaugaccacagucggauacggcgacauuagaccggauacgaccacagggaaaaucguggccuuuaugugcauccugagcggcauucugguccucgcucugccuaucgccauuaucaaugaccgcuucuccgccuguuauuuuacccuuaagcugaaagaggcugcggugcggcagagagaagcccucaagaaacugacaaagaacauugcuaccgauucuuacaucagcguuaaucugcgcgacguguaugcccgguccaucauggagaugcuuagacucaagggacgcgaacgggccucuacgagaagcuccgggggagaugacuucugguuuuga

SEQ ID NO: 71074 - RNA, 1638 nt, Artificial Sequence
  derived and/or modified sequence opt5 from KCNV2__Homo_sapiens__NP_598004
augcugaagcagagcgagagacggcgcuccuggucuuacagacccuggaacaccacagaaaaugagggcagccaacaccggcgcuccaucugcucucucggggccagaagcggaucccaggcuucuauucauggcuggacggaagggaacuauaauuacuauaucgaggaagacgaggauggagaggaagaggaccaguggaaagaugaccuggccgaagaggaucagcaagcgggcgaggugaccacagcuaagccugaagggccgagcgaucccccugcccuucuguccacccucaacgucaauguuggaggccacagcuaccagcuggacuauugugagcuugccggcuuccccaaaacacggcuggggcgccucgcuaccucuacauccagaagccggcagcugucucugugcgacgauuacgaagaacagaccgacgaauacuuuuucgaucgcgacccugccguguuucaacucguguauaacuucuaccuguccggaguccuucuggugcucgauggccugugucccagacgguuucuugaggagcugggguauuggggaguucgccucaaguacacgccuagaugcugucggauuugcuucgaggagcgcagagacgaacugagcgagcggcugaaaauccagcaugaacucagagcucaggcccagguggaggaggcggaggaacuguuucgcgacaugcgguucuauggcccgcaaagacgccggcuuuggaaucugauggaaaagcccuuuucuuccgucgccgcuaaggccauugggguggcuagcuccaccuucguucucgugucugucguggcccuggcgcuuaacacaguggaggaaaugcagcagcacagcggacaaggcgagggcgggccugaucugagacccauccucgagcaugucgaaaugcuguguaugggauuuuucacccuggaguaccuccugcgccuugccuccacaccugaccugcggagauuugcucgcagcgcccucaaucugguugaucuuguggcuauccugccccucuaucugcagcugcuccuggaaugcuucaccggcgaggggcaccagcggggacagacggugggcucugucgggaaagugggacaaguucuuagagugaugcgccugaugcggauuuucagaauccucaagcuggcccggcacuccacaggccugcgcgccuuuggcuucacccuuagacaguguuaccagcaggucgggugccuccugcuguuuauugcuaugggaaucuucacauuuagcgcggccguguauucuguugagcaugacgugccgagcaccaacuucaccacaauuccucacuccugguggugggcugccgucucuaucagcacggugggcuacggggauauguaccccgaaacccaucucggacgguuuuucgccuuucuguguauugcuuucggcaucauccuuaaugggaugccuauuuccauccuguauaacaaauuuagcgacuacuauucuaagcucaaagccuacgaguauacaaccauuagacgcgaacggggcgaggucaauuucaugcaaagagcgcgcaagaagaucgcugaaugccugcugggauccaacccccagcuuacacccagacaggagaauuga

SEQ ID NO: 71075 - RNA, 942 nt, Artificial Sequence
  derived and/or modified sequence opt5 from KCTD10__Homo_sapiens__NP_114160
auggaggaaaugagcggcgaguccguggucucuagcgccguucccgcugccgcgaccagaacaacguccuucaaggggaccucuccuagcuccaaauacgugaagcugaacgugggaggcgcucucuauuacacaaccaugcagacacugaccaaacaagacacaaugcuuaaggccauguuuucugggcggauggaaguccugaccgauagcgagggauggauccucauugaccgcugcggcaaacacuucgggacgauccugaauuaucuuagagauggagccgugccgcugcccgaaucccggcgcgagauugaggaacuccuggcugaggccaaguacuaucugguucagggccucguggaagagugucaggcugcccugcagaacaaggacaccuacgagccuuuuugcaaaguccccgugaucacaagcucuaaggaggaacaaaaacuuauugcgaccuccaauaagccugccguuaaacugcucuauaacagaagcaauaacaaguacucuuacacauccaauagcgaugacaacaugcugaagaauaucgaacuuuucgauaaacugucucuccgguuuaacggccgcgugcuguucaucaaggacgucauuggggaugagaucuguugcugguccuuuuauggacagggcagaaaaauugcugaaguguguugcaccagcaucguguacgccacggagaagaaacagacaaaggucgaguuccccgaagcucggauuuaugaggaaacccugaauauccuccuguacgaggcccaggacgggcgcggaccugauaacgcgcuucuggaagccacaggcggggcugccggaagaucccaucaccucgacgaggaugaggaacgggagcgcauugaaagaguucggcgcauccauaucaaaagaccggacgaccgggcucaucugcaccaauga

SEQ ID NO: 71076 - RNA, 699 nt, Artificial Sequence
  derived and/or modified sequence opt5 from KCTD11__Homo_sapiens__NP_001002914
augcugggcgccauguucagagcugggacccccaugccuccgaaccucaauagccagggaggcgggcacuacuuuaucgaccgggauggaaaggccuuccgccauauucugaacuuucuuagacugggccggcucgaccugccccgcggguauggagagacagcgcuucugagagcugaagccgauuucuaccaaauccggccucuccuggacgcccugcgcgagcucgaagccucccagggcacgcccgccccuaccgcugcccugcuucacgcggauguggacgucucucccagacugguucauuuuagcgcccggcgcggcccucaccauuaugagcucuccucuguccagguggauacauucagagcuaaucuguuuugcaccgacagcgaaugucuuggggcccugcgggcucgcuucggaguggccuccggcgauagagcggaggggucuccgcacuuucaccucgagugggcuccccggccuguggaacugcccgagguugaauacggacgccugggccuccagccucuguggacagggggacccggcgagagacgggagguggucggcaccccgagcuuccuugaagaggugcugagaguugcucucgaacauggguuucgccuggacuccguguucccugaucccgaggaccuucugaacagccggucucucagauuuguccgccacuga

SEQ ID NO: 71077 - RNA, 978 nt, Artificial Sequence
  derived and/or modified sequence opt5 from KCTD12__Homo_sapiens__NP_612453
auggcccuggcugacagcaccagaggccuccccaacgggggaggcgggggaggcggguccggaucuagcuccucuagcgccgagccuccgcuguuccccgauaucguggaacuuaaugucggcggccagguuuacgugacacggcgcugcacgguggucuccgugccugacucucugcucuggagaauguuuacccaacagcagccccaggagcuggcgcgggauagcaaggggcgcuucuuucuugacagagauggauuccuguuucgguauauucucgacuaccugcgcgaucugcaacucguucugccugacuauuuccccgaaagaucccggcuucagcgcgaggcugaauacuuugagcugccugagcucgugagacggcugggcgccccgcagcagcccgggccuggacccccucccagccgcagaggcguccacaaagaagggucucuuggagaugagcugcucccgcugggcuauuccgaaccugagcaacaggagggcgccagcgcuggggcccccucuccuacacuggaacucgcuucccggagccccucuggaggcgccgcggggccccugcuuaccccuucccagagccuggacggaucccgcagaucuggcuacaucacaauuggguaucggggaagcuacaccaucggcagagaugcccaggcugacgccaaguuccgccggguggcuagaauuacaguuuguggcaaaaccucccucgccaaggagguguuuggggauacgcugaacgaaagccgcgacccggaccggcccccugagagauacaccucucgcuauuaccuuaaauucaauuuucuggaacaagcguucgauaagcucuccgagagcggauuucauauggucgccugcucuagcacaggcaccugugcuuucgccuccucuacagaccagagcgaggauaagaucuggaccuccuauacggaauacguguucugccgggaguga

SEQ ID NO: 71078 - RNA, 990 nt, Artificial Sequence
  derived and/or modified sequence opt5 from KCTD13__Homo_sapiens__NP_849194
augagcgccgaggcuuccggccccgccgcggcugccgccccuucucuggaagcuccgaagcccagcgggcucgagccuggacccgccgcuuacggccugaaaccucuuacccccaacuccaaguaugugaaacugaaugucgggggaucucuccacuacacaacgcugagaacccuuacaggccaggacaccaugcugaaggccauguucagcgggcggguugaagugcucacagaugcgggaggcugggugcugaucgaccgcuccggcagacauuuugggaccauucugaacuaucuccgggauggaucugucccucugccggagagcacacgcgaacuuggcgagcugcucggggaggccagauacuaucuggugcaaggacuuaucgaagacugccagcuggcucuccagcagaaacgggagacccuguccccucugugucucauucccaugguuacgagcccccgcgaggaacaacagcugcuugccucuaccuccaagccuguggucaagcugcuccacaauagaagcaacaauaaauacucuuauacauccaccagcgaugacaaccugcuuaagaauaucgagcuguucgauaaacucgcucugcgguuucauggccgccuccuguuccugaaggacgugcuuggggaugaaauuugcuguuggucuuuuuacggacagggcagaaaaaucgccgagguuugcuguacauccaucguguacgcgaccgaaaagaagcagacgaaagucgaguuccccgaagcccggauuuuugaggagacacugaacauccucauuuaugaaaccccgcgcggcccugaccccgcucugcuugaggccacagggggagcugccggcgccgggggagcuggcagaggggaagaugaggaaaaucgggagcaccgcgugagacggauccaugugagacgccacauuacccacgacgagcggccucauggacaacagaucgucuucaaggauuga

SEQ ID NO: 71079 - RNA, 705 nt, Artificial Sequence
  derived and/or modified sequence opt5 from KCTD15__Homo_sapiens__NP_076981
augccccacagaaaggagcggccuagcggcuccucucugcauacccacgggagcacaggaacggccgaaggcgggaacaugucccgccucucucugaccagaagcccggugucuccccuugcugcccagggaaucccucugcccgcgcaacucacaaaauccaaugcuccuguccauauugacguuggcgggcacauguacaccagcucccuggccacacuuaccaaguaucccgauagccggaucucucgccuguucaacggaacagagccuauugugcucgacucccugaaacagcauuacuuuaucgauagagacggcgaaauuuuccgguaugugcugagcuuucuccgcaccucuaagcugcuucugccggaugacuucaaagauuuuucccuccuguacgaggaagccagauauuaccagcuucagcccaugguccgggagcuggagcgcuggcaacaggaacaggagcagagacggcgcagcagagcuugcgacugucucgugguucgggugacgccugaucugggcgaacgcaucgcccugucuggggagaaggcucucaucgaggaagucuuccccgagaccggagacgugaugugcaauuccguuaacgccggcuggaaucaagauccuacacacgugauuagauuuccccugaacggguauugucggcuuaauagcguccaggacgugcuguga

SEQ ID NO: 71080 - RNA, 1287 nt, Artificial Sequence
  derived and/or modified sequence opt5 from KCTD16__Homo_sapiens__XP_005268550
auggcccugagcggcaacugcuccagauacuauccccgggagcaggggucugcugugccuaauagcuucccggaagucguugagcucaacgugggaggccaaguguacuuuacccgccacuccacacugaucucuauuccccauagccuucuguggaagauguucuccccuaaaagagacacggccaaugaucucgcgaaggacucuaaagggcgguuuuucaucgaucgcgacggauuucuguucagauauauucuugauuaccugcgggaccgccaggucgugcuccccgaucacuuuccugaaaagggcagacugaaacgggaggcugaauauuuccagcugcccgaccucguuaagcugcuuaccccugaugagaucaagcagagcccggacgaguuuugucauuccgauuucgaagacgccagccaagggucugauacacgcauuugucccccuuccagccugcuccccgccgacagaaaauggggauuuaucaccgugggcuaccggggcucuugcacacuggggcgcgagggacaggcugacgccaaguucagacgggucccucgcauccuugugugcggcagaauuucccuggcuaaagaaguuuuuggggagacccucaacgagagccgggaucccgacagagccccggaacgcuauacaucucgguucuaccugaaguucaaacaccuggagagagcguuugauaugcucuccgaauguggauuccauaugguggccugcaauagcuccgucaccgcuucuuuuaucaaccaguacacggacgauaagauuuggagcuccuauaccgaguacguguucuaucgcgaaccuagccgguggucucccucccacugugacugcuguugcaagaauggcaaaggggauaaggagggagagagcggcacaucuuguaacgaccugagcaccuccucuugcgauagccaguccgaagccagcucuccucaagagacagugaucugcggccccgucaccagacagacgaauauucagacacuugaccgccccaucaaaaaggggccuguucagcugauucaacaguccgaaaugcggagaaaaagcgaucuccugcgcacccuuacaucuggaucccgggagagcaacauguccucuaagaaaaaggcugugaaggaaaaacugagcaucgaggaggaacucgagaaguguauccaggacuuucugaaaauuaagaucccggacagauuccccgaacgcaaacacccuuggcaauccgagcugcuccggaaguaccaucuguga

SEQ ID NO: 71081 - RNA, 2598 nt, Artificial Sequence
  derived and/or modified sequence opt5 from KCTD1__Homo_sapiens__NP_001136202
auggccagaaugcccggcagcggggacugcaacaccuccgcuggaggcucugccagcgcggcugccgccgcugccgagaauaacggggaacggggagagggcgaacgcggggcuggaggcagaggccggcgccacuccagaccucauuacuguucugccggggaggaagaggaggaagaggaagaggaggaugaaauccaggaggugcaaauuacaggagacgaagaggaagaggaggauggcgggggaggccuggaagaggacgaagaggaagaggaggaagaggaaauggggcucgauugggacgagccgcuggaacccgaggauagcgcgggagaggaacuugagccugaacccguccacaugaucaauauggaccaguccgccgcucuggagccugaggcucccccucggcuccuggccccgcgcgccagaggcgggcccccuggcgauggaucugaacuugaccccgauguucugcagcggccugagcgcgcgagacucagcgaaaacacgcggcuggccacccgcuaugcugugagaauuuuccgggaguaccuguccgaaaaggcccagagccccgacuuugagacaauggauaaaggcgcucucugccgcgugcugagaucuuucuaugccgaggcccgguccaagagcgggcaacuuuacucuaaauccagccugaucucuauuagauccagccucaaucgcuaucugaacgaaccgccuuacugucggacccuugaccugacaaaggaccccgagcucagauccgcuaaucugacccuggcggccgucauccgcaaacucgaagaacagggagcuggcccugugguucagaagcaggccaucacacgggccgaucugagaaaacuuuauaccucuagcguguuuuccacgaacacccccuucgggcugcucaauaaggucugguuugaaacaugcauguacuucuguacccgcggacgggagaaccaaagagagcuggaagaggacagcuuuggccuugcuauggaugaagacggccgcaaguucguguacuuuaaaucucuggggcccuaucauaagucccggagcucuagcugguccaaaaagagagccgagucuagcgaugaagagaaucucccucgcauguacgagacaggaaccgaguucugcccguaugcguccuuuguuaaguaccugagcaaacggaacccccuguguaaggcuuucuuucagagaccucgggaccacugcucugagggcgaugugacgugguaugaaaauaaagccauugggaagaaccuccugggaacacgcaugcagaugcuuuccaaagccgcuaagcugagcaaaaccuacacaaaucauuguaucggcgccgucucuauugcuacccucaacuccaucgccgggauuggcaccaagcugggaagccccgcgccucagggcugcuaugccgaggcucuuaacggggccgcuagacaccacucccaucaucccccgacacacccuucucaccaccaucggccccaaccucccagccugggaaauacguacauccucccuaaggacucccaggugggccccgaugugaaaucugaggccgcgccgaagagagcccuguacgaaagcgucuucggguccggagagauuuguggcccuaccagccccaaacgccugugcauccggcccucugaaccuguugacgcugugguggucguguccguuaagcacgauccgcucccccugcuuccugaggccaacgggcauagaagcacaaauucucccaccaucguguccccugcuauugucagccccacacaggacucucgcccuaacaugagcagaccccugaucacccgguccccggccagcccucucaauaaccaaggcauucccacgccugcccagcugacaaaaucuaaugcucccgugcacaucgacguuggaggccauauguauaccuccagccuggcgacccuuacaaaguacccggaaucccgcauugggagacucuucgauggaaccgagccuaucgugcuggacucucugaagcagcacuauuuuaucgaucgggacggccagauguuccgcuacauucucaacuuucugagaacaagcaaacuucugauccccgaugacuucaaggauuauacgcuccuguacgaggaagccaaauauuuucaacugcagccuaugcuucucgagauggaacgguggaagcaggaccgcgagaccgggagauucucccggcccugcgaaugucuggucgugcgcgucgcucccgaucugggagagagaauuacacucucuggcgacaaaagccugaucgaggaaguguuuccugagauuggggauguuaugugcaauuccgugaacgccggcuggaaucacgacucuacccaugucauccgguucccgcuuaacggauacugucaccugaauagcgugcagguucucgaaagacugcaacagcgcggcuuugagaucgugggguccugcggaggcggggucgauagcucucaguucuccgaauacgugcugcggagagagcuucgccggacacccagagugccuagcguuauucgcaucaagcaggagccccucgacuga

SEQ ID NO: 71082 - RNA, 990 nt, Artificial Sequence
  derived and/or modified sequence opt5 from KCTD21__Homo_sapiens__XP_005273982
auggaguucgcccuggacgcucccagcugcgaggaaccuagagaaaacuaccagucccggaaggccgcgcaccgcccgagaaccgcuacaccccucggcugggccccuacgcugcggcccccucgcaaagccgcucuugccgcuagagggggacggggcugucgcgccagagccgggggacugcuccccgccacccaaucuccugcuaugagcgauccgaucacacugaaugugggcgggaaacuuuauaccacaucccuggccacccucacaucuuuucccgacagcaugcugggagcuauguucuccggcaagaugccuaccaagcgggauucucagggcaacugcuuuauugaccgcgaugggaaagucuucagauacauccugaauuuucuccggacgagccaucuggaccuucccgaggauuuccaggaaaugggacugcuccgcagagaggccgacuuuuaucagguucaaccucugauugaggcgcuucaggaaaaggagguggaacuguccaaggccgagaaaaacgcuaugcucaauaucacccugaaccagcgggugcagacaguccacuucaccgugcgcgaggcgccccaaauuuacagccugucuuccagcucuauggaaguuuuuaaugcuaacaucuucuccacaagcugucucuuucugaagcugcuuggcucuaaacucuucuauugcuccaaugggaaccugagcuccaucaccucucaucuucaggauccgaaucaccugacgcucgacuggguggccaacgucgagggacugccugaagaggaauacacaaagcagaaucugaaaagacucugggugguucccgccaacaagcagauuaauagcuuucaaguguucgucgaggaggugcugaagaucgcucuuuccgauggcuucuguauugacagcucucauccucacgcgcuggauuuuaugaacaacaaaaucauucggcucaucagauaucgcuga

SEQ ID NO: 71083 - RNA, 792 nt, Artificial Sequence
  derived and/or modified sequence opt5 from KCTD2__Homo_sapiens__NP_056168
auggccgagcugcagcucgaccccgcuauggccggccugggcggaggcgggggaagcggcgugggggauggaggcggcccugucagagggccgcccuccccucggcccgcgggaccuacaccccgcggccacgggagaccugcugccgccguugcucaaccgcuugaacccggaccugggcccccugagcgggccgggggaggcggcgcugcccgcugggugagacugaacgucgggggaaccuacuucgugacgacccggcagacacucggccgcgaacccaagucuuuucugugcagacuuuguugccaggaggacccggaacuggauagcgacaaagaugagaccggggcguaucucaucgaccgggauccuacauacuucggacccauucugaauuaucugcgccauggcaagcucaucauuaccaaagagcuggccgaagagggggugcuugaagaggcugaguuuuacaacaucgccucccugguuagacucgugaaggaacggauucgcgacaaugagaacagaacaucucagggaccugucaaacacguguaucggguucugcaaugucaggaagaggaacuuacccagauggugagcacgauguccgauggcuggaaguucgagcagcugaucucuaucggcagcuccuacaauuaugggaacgaggaccaagcugaauuucucugcgucgugagccgcgagcugaauaacucuaccaauggaauugugaucgaacccuccgagaaggccaaaauucugcaggaaagaggcagccggauguga

SEQ ID NO: 71084 - RNA, 2448 nt, Artificial Sequence
  derived and/or modified sequence opt5 from KCTD3__Homo_sapiens__NP_057205
auggccggcgggcacugcggcagcuuccccgcugccgcggcuggauccggggagaucgugcagcugaacgucggaggcaccagauuuucuacaagccggcaaacgcucauguggauuccugacuccuucuuuucuagccugcuuuccgggcgcaucucuacccugagagaugaaacaggagccauuuucaucgaccgggauccggccgcuuuugcccccauucucaauuuccugcgcaccaaggagcuugaccugagaggcguuagcaucaacgugcuccggcaugaagcugaguuuuacggcaucacaccucuggugcgcagacugcuccugugugaagaacuugagcgguccagcugcgggucuguccuguuccacggauaucuucccccucccggcauuccuucccgcaaaaucaauaacaccgugagaagcgccgauucucggaaugggcugaacuccacagaaggagaggcgcgcggcaaugggacccagccgguucuuagcggaacgggcgaagagaccgugagacugggcuuucccgucgacccucggaaggugcucauuguugccgggcaucacaacuggaucguggcugccuacgcucauuucgccgucuguuaucgcauuaaagagucuuccggauggcaacagguguuuacaagccccuaccuggauuggaccaucgaaagaguggcgcugaaugccaaggucguuggcgggccucacggagacaaagauaagaugguggcuguggccuccgagucuagcauuauccucugguccguccaggacggcgggagcggaucugaaaucggcguguucucccugggcguucccguggaugcucucuuuuucauugggaaccagcuggucgccacaagccacaccggaaaggugggcguuuggaaugccgugacgcagcauuggcagguccaagacguggucccgaucacaucuuaugauaccgcugggagcuuccuccugcuuggaugcaacaauggcuccauuuacuauaucgacaugcagaaauuuccucugcggaugaaggacaacgaucuccuggugacagagcuguaccacgaccccucuaaugaugcgauuaccgcccucagcguuuaccugaccccuaaaacauccgugagcgggaacuggaucgaaaucgcuuauggcacgucuuccggagccgucagagugauuguucagcaucccgagaccgugggcagcgggccccagcuuuuccaaacauuuaccguccaccgcucuccugugacaaagaucaugcuguccgagaaacaccucgugagcguuugugccgacaacaaucauguccggaccuggacggugacaagauuccgcggaaugauuuccacccagccgggcucuacaccccuggcuagcuuuaagauccuuucccuggaagagaccgaaucucacgggagcuacuccagcggaaacgauauuggcccuuucggggagcgggacgaucagcaaguguuuauccagaaggucgugcccaucaccaauaaacucuucguuagacugucuuccacaggcaagcgcauuugcgaaauccaggccguggacuguacgaccauuagcucuuuuacaguccgggagugcgagggauccagcagaaugggcucucgcccucggagauaucuguucaccgggcauacaaacggaagcauccagaugugggaucucaccacggcgauggacauggugaauaaauccgaagauaaggacguuggcgggcccaccgaggaggagcugcuuaaacugcucgaccaaugugaucugagcacaucucgcugcgcuaccccgaacauuuccccugccacaagcgugguccagcacucccaucugcgggaaucuaauagcucccuucagcuccagcaccacgacaccacgcaugaggccgcuacauacggaucuaugagacccuaucgggagagcccucugcuggcccgcgcuagacggaccgaauccuuucacucuuacagagauuuccaaacaaucaaccucaaucgcaacguggagcgggccguucccgaaaauggcaaccuggggccuauucaggcggaggugaagggcgccaccggagaguguaauaucagcgaaagaaaaucccccggcgucgagaucaagagccuucgcgaacuggacucugggcucgaggugcauaagauugcugaaggauuuuccgagagcaaaaagagaucuuccgaggaugaaaacgagaauaaaaucgaguuccggaagaaaggcggguucgaaggaggcggguuucugggccgcaagaaggugccguaucuggccagcucuccuuccaccagcgacggaggcacagauucccccgggacggcuagccccucuccuaccaaaacaaccccgagccccagacacaagaaauccgacucuagcggacaggaauacucccuuuga

SEQ ID NO: 71085 - RNA, 714 nt, Artificial Sequence
  derived and/or modified sequence opt5 from KCTD6__Homo_sapiens__NP_699162
auggacaacggcgauuggggguacaugaugaccgaccccgugacacugaaugucggaggccaccucuauacgaccagccugacaacccuuacaagauacccugauuccaugcugggggccauguucggaggcgacuuuccgaccgcucgggauccccaggggaacuauuucaucgaccgcgauggaccucucuuuagauacguucugaauuuccuucggacaucugagcugacccucccccuggacuuuaaggaguucgaucugcuccgcaaagaagccgacuuuuaucaaauugaaccucugauccagugccuuaacgaucccaagccucuguacccgauggacacguucgaggaagugguggagcucagcuccaccagaaaacugucuaaguauagcaaucccgucgcggugauuaucacacagcuuaccauuacaaccaaaguucauucccugcucgagggcaucucuaacuacuuuacgaaguggaauaagcacaugauggauacacgggacugucaggugagcuucaccuuuggcccuugcgacuaccaucaagaagucucccugcgcgugcaccugauggaguauaucacaaaacagggguucaccauuagaaacacccggguucaucacaugagcgaacgcgcuaaugagaacacaguggagcacaauuggacguuuuguagacucgcccggaagaccgaugacuga

SEQ ID NO: 71086 - RNA, 867 nt, Artificial Sequence
  derived and/or modified sequence opt5 from KCTD7__Homo_sapiens__NP_001161433
augguggucguuaccggcagagagcccgacagccggcgccaggauggggccauguccucuagcgacgcugaagaugacuuccuggagccugccacaccgacggcgacccaagcuggacacgcccucccccugcuuccucaggaauuucccgagguggugccucugaacaucggcggggcccauuucacaaccagacucuccacacugcggugcuacgaagauaccaugcuugcugccauguuuucuggacgccacuauauucccacagacagcgagggcagauacuucaucgaucgggacgggacccauuuuggagauguccugaauuuccuccgcuccggcgaccugccuccgagagagcgggugcgcgcuguuuauaaggaagcccaguacuaugcgauuggcccccugcucgagcagcuggaaaacaugcaaccucuuaaaggggagaaggugagacaggccuuucugggacucaugcccuacuauaaagaucaccuggagcggaucgucgaaauugcucgccuuagagccgugcagcggaaggcucgcuucgccaaacugaagguuuguguguuuaaggaggaaaugccuaucacgcccuacgagugcccgcuccucaauucucugagauucgaacggagcgaguccgacggccagcuguuugagcaucacugugaagucgaugugagcuucgggccuugggaggcgguggccgacgucuacgaccugcuucacugccugguuaccgaucucucugcucaaggacugacaguggaccaucaguguaucggcgugugcgauaaacaccuugucaaccauuauuacuguaagagacccauuuaugaauuuaaaaucaccugguga

SEQ ID NO: 71087 - RNA, 1170 nt, Artificial Sequence
  derived and/or modified sequence opt5 from KCTD9__Homo_sapiens__NP_060104
augagacgggugacccuguuccucaacggcagccccaagaaugggaaagucguugccguguacggaacacuguccgaccuucugucuguggcuagcuccaagcucggcaucaaagccacgucugucuauaacgggaagggaggccugauugaugacaucgcgcuuauucgcgaugacgaugugcuguuuguuugcgagggggaaccuuucaucgacccgcagaccgauagcaaacccccugagggacuccugggcuuucacacagacuggcugacccucaaugugggcgggagauacuucacaaccacacgguccacccuggucaacaaggaacccgauucuaugcuugcucauauguuuaaggacaaaggaguguggggcaauaagcaagaucaccgcggggccuuccugauugacagaagcccugaguauuuugaacccauccucaacuaccugcggcauggacagcuuaucguuaaugauggcauuaaccugcucggggugcuggaggaggcccgcuucuuuggaaucgacucccugauugaacaccucgaggucgcuaucaaaaauagccagccuccggaagaccauucucccauuuccagaaaggaguucgugcgguuucugcuugccacgccuaccaaaagcgagcugcgcugucagggccucaacuucucuggcgcugaucuguccagacuugaccugcgguauaucaauuuuaagauggccaaccucagccgcugcaaucuggcgcacgccaaccuguguugcgcuaaucucgaaagagccgaucugucuggguccgugcuugacugugcuaaccugcaaggagucaagaugcucugcagcaacgccgagggcgcgucccugaaacuuuguaauuucgaagaucccucugggcugaaggccaaccucgagggagcuaaucugaaaggcguugacauggaagggagccagaugacaggaauuaaccugcggguggccacccucaagaaugcuaaacugaagaacugcaaucuucgcggcgccacacuggccggcaccgaucucgagaacugugaccuguccgggugcgaucugcaggaggcuaaucuuagaggaagcaacgugaaaggcgcgaucuucgaagagaugcucacgccucugcacaugucucaguccguccgguga

SEQ ID NO: 71088 - RNA, 1509 nt, Artificial Sequence
  derived and/or modified sequence opt5 from KDELC1__Homo_sapiens__NP_076994
auguucggcacccugcuccuguacugcuuuuuccuugccacagugcccgcucuggccgagacgggaggagaaagacagcucagcccugagaaguccgaaaucuggggcccggggcugaaagcggacgucguucuucccgcucgguauuuuuacauucaagccguggauaccucuggaaacaaguucacaagcuccccuggcgagaaaguguuucaggucaaggugucugcccccgaggaacaguucacccgcguuggggugcagguccuggacagaaaagaugggagcuuuaucgugcgguaucgcauguacgcuuccuauaagaaucucaagguugagauuaaauuccaaggccagcacguggccaagucuccuuacauccugaaaggccccgucuaucaugaaaacugugacugcccucugcaggauagcgcugccuggcucagagagaugaauuguccggaaacaauugcgcagauccaacgggaccuggcccacuuucccgcuguggauccugagaagaucgccguggagauucccaaacgcuucgggcagagacagucccuuugccauuacacccugaaggacaacaaggucuacaucaaaacacacggagaacauguuggcuuucggauuuucauggaugcuauccuccugagccuuacccgcaaggugaaaaugccugacguggagcuguuugucaaucucggggauuggccccuggaaaagaaaaagucuaacuccaauauucacccgaucuucagcugguguggaucuacggacuccaaagauauugugaugccuaccuaugaccugacagacagcguucucgagaccaugggcagagugucucuggauaugauguccguccaggccaacacagggcccccuugggaaagcaaaaauuccaccgcgguguggcggggacgcgacucuagaaaggagcggcuugagcugguuaagcucagccgcaagcaccccgaacugaucgaugccgcuuucacgaacuuuuucuuuuucaaacaugacgagaaucuuuacggccccaucgugaagcacauuuccuuuuucgauuucuucaaacauaaguaucaaaucaacauugacggcacagucgccgcuuacagacugccuuaucuccuggugggggauagcgucgugcugaagcaggacucuaucuacuaugaacacuuuuacaaugagcuccagccguggaaacacuacauucccguuaaguccaaccugagcgaucuucuggaaaaacucaagugggccaaagaccaugaugaggaggccaagaagaucgcuaaagcgggacaagaauuugcccggaauaaccugaugggcgacgacaucuuuugcuauuacuucaagcuguuucaggaguaugcuaaccuucaggugucugaaccucagauuagagaggggaugaaacgcgucgaaccccaaaccgaggaugaccucuucccuuguacaugccaccggaagaaaaccaaggaugagcuguga

SEQ ID NO: 71089 - RNA, 639 nt, Artificial Sequence
  derived and/or modified sequence opt5 from KDELR1__Homo_sapiens__NP_006792
augaaccuguucagauuucucggcgaccugagccaccuucuggccaucauucuccugcuucugaagaucuggaaaucccggucuugcgcugggauuagcggaaagucccagguccucuucgccgugguuuuuaccgcgcgcuaccuggaucuguucacaaauuauaucucucucuacaacacguguaugaaagugguguauauugcuugcagcuuuaccacagucuggcugaucuacuccaaguucaaagccaccuaugacggcaaucaugauacauuuagaguggaguuccuuguugugcccaccgccauccuggcuuuucucgucaaccacgacuucacaccucuggaaauucuuuggaccuuuucuaucuaccuggagagcguggccauucucccgcaacuguucaugguuuccaagacgggggaagcugagaccaucacaagccauuaucuguuugcccucggaguguaccggacccuguaccuuuucaauuggauuuggcgcuaucacuucgaaggcuuuuucgaucugaucgcgauugucgccgggcucgugcagacagugcuguacugugacuuuuucuaucuuuacaucaccaagguccugaaaggaaagaaacucucucugcccgcuuga

SEQ ID NO: 71090 - RNA, 2172 nt, Artificial Sequence
  derived and/or modified sequence opt5 from KDM2A__Homo_sapiens__NP_001243334
augugcagcggcagauuccagaacauccaagugaaucccgacuuuccucgggggcgcauuuccaacucuuucagacggaccagcuccacagagaauaagacgaaaacccugggaaagcuccaccaggaaccgcgccagcugcagucugauggcaaaagaaagauccuucuggaggaacucgccaacagcgaccccaaacuggcucuuacaggggucccuauuguucaauggcccaagcgggauaagcugaaauuuccuacccgccccaaggugagagugccuacaaucccgauuaccaaaccccauacaaugaagccugcgccccggcucaccccuguccgccccgccgcugccuccccgaucgugucuggagccagacggcgcagaguucggugucgcaaaugcaaggcuugugugcagggcgagugcggggucugucacuacugcagagacaugaagaaauucggaggcccuggccggaugaagcagagcugugugcugagacagugccuggcuccccgccucccucauuccguuacguguagccugugcggggaaguggaucaaaaugaggagacccaggacuuugaaaagaaacuuauggaguguugcaucugcaacgaaauuguccaccccggaugucugcagauggauggcgaggggcuccugaaugaggaacuucccaacugcugggaguguccuaaaugcuaucaggaagacucuuccgagaaggcccaaaaacggaagauggaagagagcgaugaggaagccgugcaggcgaaggugcugagaccgcuccgcucuugugacgagccccugacaccucccccucauucccccaccagcaugcugcagcucauccacgauccggucucuccucggggaaugguuacaagauccagccccggcgccgggccuuccgaccaccauucugcuagccgcgaugaacgguucaaaagacgccaacugcuucggcugcaggccaccgagagaacgauggugcgcgaaaaggagaauaaccccuccggcaaaaaggagcucagcgaaguggagaaagcuaagauucggggcucuuaccugacagucacccuucagagaccuacaaaggaacugcacggcaccuccaucgugcccaaacuccaggccauuaccgcgagcucugccaaucugcggcauagcccgcgcguucuggugcaacacugcccugcuagaacaccccagagaggggacgaggaaggacucggcggggaggaggaagaggaagaggaggaagaggaagaggacgauuccgccgaagagggaggcgcugcccggcugaacgggcgcggaucuugggcccaggacggcgaugagagcuggaugcagcgggaagucuggauguccguguuuagauaucuuagccgcagagagcugugugaaugcaugcggguuuguaagacgugguacaaauggugcugugacaagcgccucuggaccaaaaucgaucugucuagaugcaaggcuauugugccccaagcgcuuuccggcaucaucaagcggcagccugucagccuggaccucucuuggacaaauauuuccaaaaagcagcugaccuggcuggugaaccgccucccggggcugaaagaucuucugcucgccggaugcagcugguccgcugucucugcccugagcacauccucuuguccccugcuuagaacccucgaccugcggugggccgugggcaucaaggauccucagauucgcgaccugcucacgcccccugcugauaaacccgggcaagacaauagaagcaagcugcggaacaugacagacuuccgccuugccggacuggauaucaccgacgcgacccucagacugauuauccggcacaugccucugcuuuccagacucgaucugagccauugcucucaccugacagaccaguccagcaaccuccugaccgcuguuggaucuuccacacgcuauagccuuacggagcugaauauggccggguguaacaagcucaccgaucagacacugaucuaccugcggagaauugccaaugugacccuuaucgaccuccgcggcugcaaacagauuacacggaaggcuugugaacauuuuaucucugaucugagcauuaacucccuguauugccucagcgacgagaaacugauccaaaagaucucuuga

SEQ ID NO: 71091 - RNA, 3798 nt, Artificial Sequence
  derived and/or modified sequence opt5 from KDM2B__Homo_sapiens__NP_001005366
auggaggccgaaaaggacagcggcagacggcugcgccccaucgauagacagcgguacgacgagaacgaagaucucuccgacguggaggaaauugucucuguucgcggguucagccuggaggagaaacuuagaucccaacuguaucagggagauuuugugcacgcuauggaaggcaaggacuucaauuacgaguaugugcagcgggaagcccuccgcgucccucugaucuuuagagagaaagaugggcuuggaauuaagaugccggaccccgauuucaccgugcgggacguuaaacugcucgugggcucucgcagacuggucgaugugauggacguuaacacacagaaggggacggagaugagcaugucccaauuugugcgguacuaugaaaccccugaggcgcagcgcgauaagcuguacaaugucaucucucucgaguucagccauacaaaacuggaacaccuugugaagagacccaccguggucgaccugguugacuggguggauaacauguggccucagcaucucaaagaaaagcagacagaggcuaccaaugccauugccgagaugaaauaucccaaggugaagaaauacugccugauguccgucaagggauguuuuacagacuuccacaucgauuuuggcggcaccagcgugugguaccauguuuuccgcgggggaaaaaucuuuuggcuuauuccuccgacgcugcacaaccucgcucuguaugaagagugggugcugucuggcaagcaauccgacaucuuccucggggaucgcgucgaaagaugccagcggauugagcugaaacagggauacaccuuuuucauccccagcggcuggauucacgccguguauacaccuguugacucucuuguguucgggggaaauauccugcauuccuuuaacguccccaugcagcucagaauuuacgaaaucgaggaucgcacccgggugcaaccuaaguucagauaucccuuuuacuaugagauguguugguacguccuggaacgcuacguguauugcguuacacagcggagccaccuuacccaggaguaccaaagagaaucuaugcugaucgacgcuccgcgcaaaccuuccauugauggcuucagcuccgacucuuggcucgagauggaagaggaggccugugaucagcagccccaggaagaggaagagaaggacgaggaaggcgaggggcgggacagagcgccuaagccucccacggauggaagcacaucccccaccagcacaccgucugaagaccaagaggcccugggcaaaaagcccaaagcuccugcccugcgcuuucucaagcggacccuguccaaugaaagcgaggagucugugaaaagcaccacacuugcugucgauuaucccaagacgccuaccgggucccccgccacagaagugucugcgaaguggacccaucugacagaguucgaacucaaaggacugaaggcccuuguugagaaacuggaaagccucccggagaacaagaaaugcgugccugagggcaucgaagacccccaggcucugcuggagggggucaagaaugugcucaaggaacacgccgaugacgauccuucccuggcuauuaccggagugcccguugucacguggccuaaaaagacacccaaaaacagagccgugggccgcccgaagggcaaacuugggccugccagcgcugugaagcuggcggccaaucggaccaccgcuggagccagacggcgcagaacacgguguagaaagugcgaggccugucuccgcaccgaaugcggcgagugucacuuuugcaaagacaugaagaaauucgggggacccggccggaugaagcagucuugcaucaugagacaguguauugcucccguccugccucauacagccgugugccugguuuguggggaggcgggcaaagaagauacgguggaggaagaggagggaaaguuuaaccuuaugcucauggaaugcuccaucuguaaugagaucauucacccgggcugccugaaaaucaaggaaagcgagggggucgugaacgacgaacugcccaacuguugggagugcccuaaguguaaucaugcuggaaaaaccggcaagcaaaaacgcgggcccggauucaaguacgccucuaaccucccuggcucccugcuuaaagagcagaagaugaauagagauaacaaggaagggcaggagcccgccaaacggcgcagcgaaugcgaggaagcuccuagacggcgcuccgacgagcacucuaagaaaguucccccggauggccugcucagacggaagucugacgacgugcaucugcgcaaaaagagaaaguaugagaaaccucaggaacuguccggacggaagcgccuuaaacccggcaaggaggauaaacucuuuagaaagaagcggagaucuuggaaaaaugccgaagaccgcauggcucuggccaacaagccucugcggagauucaaacaagagcccgaagaugagcucccggaggcgccucccaagacacgcgaaagcgaccacucccggagcagcuccccuaccgccgggcccagcacagagggagcugaaggccccgaggagaaaaagaaagucaagaugagacgcaagcggagacugccuaauaaagaacuuucucgcgagcuguccaaggaacucaaccacgagauucagcggaccgaaaauagccuggccaacgagaaucagcagccgaucaaaucugagcccgaaagcgagggggaggaaccuaagagacccccuggaauuugugaacggccccaucgcuuuuccaaaggccugaacgggacgccuagagagcuucggcaccaacucggcccgagccugcgcucucccccuagagugaucucccggcccccucccagcguuuccccgccuaagugcauccagauggagagacaugugauucggcccccucccaucucucccccuccggauagccugccccucgacgauggagcugcccacgucaugcaccgggaaguguggauggcgguguucuccuaccugucucaucaggaccuuugcgucuguaugagaguuugccgcaccuggaaucggugguguugcgauaagagacuguggacacgcauugaccucaaccacuguaaaagcaucaccccucugaugcuguccggcauuauccggagacaacccgugucucuugaucucagcuggacaaauauuuccaagaaacagcugagcuggcugaucaaccgccucccugggcugagagaccuugugcugucuggaugcuccuggaucgccgucagcgcucucuguucuuccagcugcccccugcugcggacccuugaugugcaguggguugagggccugaaggacgcccagaugcgcgaccuccugucuccgccuacggauaacagacccgggcaaauggacaaucgguccaaacuccgcaacauuguggaacugagacuugcuggacuggauaucacagacgccagccuccggcugauuaucagacauaugccucugcuuuccaagcugcaccucagcuauuguaaucaugucaccgaucagucuauuaaccugcucacagccgugggcaccaccacacgcgacagccugacggagaucaaucuuuccgauugcaacaagguuaccgaccagugucugucuuucuuuaaacggugcgggaauaucugccacauugaucucagauacuguaaacaggugacaaaggaaggcugcgagcaauucaucgcugagaugagcuccuuucagggacgcucuuguagcaccacacggcugggcgacgaauga

SEQ ID NO: 71092 - RNA, 3966 nt, Artificial Sequence
  derived and/or modified sequence opt5 from KDM3A__Homo_sapiens__NP_060903
auggugcugacccucggcgagagcuggcccguccugguugggagacgguuccuuucccugucugccgcugacggaagcgauggcucccacgacucuugggauguggaacgcguggccgaguggccuuggcucagcgggacaaucagagcggucucccauacggacgugaccaagaaagaucugaagguuugcguggaauuugacggagagucuuggcggaaacgcagauggauugaagucuacagccuucugcggcgcgcuuuccucguggagcacaaccugguucuggccgagagaaaguccccggaaaucagcgagcggauugugcaguggcccgccaucacauauaaaccucuccuggauaaggcuggccuugggucuauuaccuccguccgcuuucugggagaccaacagagaguguuccucagcaaggaucugcuuaaacccauccaggacgugaacucucugcggcucucccugacagauaaccagaucgucagcaaggaauuucaagcccugauuguuaaacaucucgacgagucucaucugcuuaagggcgauaaaaaucuggugggcuccgaggugaagaucuacagccucgacccuuccacccagugguucucugcuacagucauuaacgggaaucccgccagcaagacccuucaggugaacugugaagagaucccugcgcugaaaauuguugacccgucccugauccacguggaagucgugcacgauaaucucguuacgugcggaaacagcgcccgcauuggcgcugugaagagaaaaucuuccgagaauaacgggacccuggucagcaagcaggccaaaucuuguagcgaagcuagccccucuaugugcccugugcaaagcguccccacaaccguguuuaaggagauccugcucggauguacagccgcgaccccucccuccaaagacccgcggcagcagagcacgccucaggccgcuaauucucccccuaaccugggcgccaagaucccccaagggugccacaagcagucccuucccgaggaaauuagcucuugucugaauacaaaauccgaggcucuccgcaccaagccugauguuugcaaagccggacugcuuagcaaguccucucagaucggcacaggcgaccugaaaauucucaccgaaccgaaggggagcuguacccaacccaagacaaacacggaucaggagaauagacuggaauccgugccucaggcccugaccggacuccccaaagagugccugccuacaaaggcuucuagcaaagcggagcuugaaaucgccaaucccccggagcugcagaagcaucucgaacacgcuccuucccccagcgacgucucuaacgccccugaggugaaagccggcguuaauuccgauagccccaacaauuguucugggaagaagguggaaccuuccgcucuggccugccggagccaaaaccugaaagagucuagcgucaagguggacaaugaguccugcuguagcagaucuaacaauaaaauucagaacgcgcccucccgcaagagcgugcuuaccgauccggcuaaacucaagaagcugcagcaguccggagaagccuucguucaagacgauucuugcgucaauaucguggcccagcugccuaaaugucgggagugcagacucgacagccugcgcaaggacaaagaacagcagaaggauucccccguguuuugucgguucuuucauuucagacgccuucaauuuaacaaacacggcguccugcggguggagggguuccucacacccaauaaguaugacaacgaggcuaucggacuguggcugccucuuaccaaaaauguugugggcauugaucucgacacggccaaguacauccuggcuaacauuggcgaucacuucugccagauggucaucucugaaaaggaggccaugagcacaauugaaccgcauagacagguggcguggaaacgcgccguuaagggggugcgggagaugugugacgucugcgauaccaccaucuuuaaucugcacugggugugucccagaugcggauucggcguuuguguggacugcuaucgcaugaaacggaagaacugccagcaaggggcugccuacaaaacauuuuccuggcucaagugugucaagucucagauccaugaaccugagaaccugaugcccacccagauuaucccuggaaaagcucuuuaugaugugggcgacauugugcacagcgucagagccaagugggggaucaaagcgaauugccccuguuccaaccggcaauucaagcuguuuagcaaaccugccucuaaggaggaucucaagcagacaucccuggcuggcgaaaaacccacgcugggagccguucuucagcagaauccgagcgugcucgagccugcugccgugggcggggaagccgcuucuaagcccgcgggauccaugaaaccugccugccccgcuagcaccucuccgcugaacuggcuggccgaccucacauccggcaaugucaacaaggagaauaaagaaaagcaaccuaccaugcccauucugaagaacgagaucaaaugucuuccuccccugcccccucucagcaaguccagcacagugcugcauaccuucaauucuacgauucugaccccgguuagcaacaauaacuccggguuucuucgcaaucuccugaacucuagcacaggaaaaaccgagaauggccugaagaacacacccaaaauccucgaugacaucuucgccucccuggugcagaacaagaccacgucugaccuuagcaaaagaccucaggggcugacaauuaagcccuccauccucggcuuugauaccccucacuacuggcugugcgacaaucggcugcuuugucugcaggaucccaacaauaagucuaacuggaaugucuucagagaaugcuggaaacaaggacagccugugaugguuagcggcgugcaccauaagcucaacuccgagcuguggaaaccggaauccuuucgcaaggaguucggggaacaggaggucgaccucgugaauugucggacaaacgagauuaucaccggagcuaccguuggcgauuuuugggacggguucgaagaugugcccaauagacugaaaaacgagaaggaaccuaugguccuuaagcugaaagacuggcccccuggagaggauuuccgcgacaugaugcccucuagauuugaugaccucauggccaauauuccgcugccugaguacacacggcgcgauggcaagcugaaccuugcguccagacugcccaauuauuucgugcggcccgaccucgggccuaaaauguacaacgcuuauggccugaucacgcccgaagaccgcaaguacggaaccacaaaucuccaccuggaugugagcgacgccgccaacgucaugguuuaugugggcaucccuaaagggcagugcgagcaagaagaggaagugcuuaagaccauucaggauggagacucugaugagcugacaaucaagagauuuauugagggcaaagaaaagccgggggcucucuggcauaucuacgccgcgaaagacaccgagaagauucgggaguuccugaaaaaggucuccgaagaacagggacaagagaaccccgcugaucacgacccuauccacgaucagagcugguaucuggaccgcucccuuagaaagcggcugcaucaggaguacggcgugcaggggugggccaucguucaauuucucggcgauguggucuucauucccgccggagcuccucaccaggugcauaaucuguacucuuguaucaaaguugccgaagacuuugugagccccgagcacgucaagcauugcuucuggcucacgcaggaauuucgcuaucugucccagacacacaccaaccacgaggacaaacuucaagugaagaaugucauuuaccaugcugugaaagaugccguugcgaugcugaaggccagcgaaucuuccuucggcaagccguga

SEQ ID NO: 71093 - RNA, 5286 nt, Artificial Sequence
  derived and/or modified sequence opt5 from KDM3B__Homo_sapiens__NP_057688
auggccgacgcugccgcgagccccgugggcaagagacugcuccugcuuuucgcugauaccgccgccuccgcuucugccagcgcuccugccgcggccgcugccuccggggacccgggacccgcucugcggacacgcgccuggagagcgggcacgguccgggccaugucuggggcuguuccucaggaucucgccaucuuuguggaguucgacggaugcaacuggaaacaacacagcugggugaagguccaugcugaagaggugauuguucugcuucuggaaggcucccucgugugggccccccgcgaggauccuguccugcugcaggggaucagagugucuauugcccaguggcccgcucucaccuuuacaccucugguugacaaacuuggacugggcagcguggucccgguggaauaccuccuggaucgggagcuucgcuuccuguccgacgcgaauggccuccaccuguuucagauggggaccgauagccaaaaccagauccugcucgagcaugccgcucugagagaaacagugaaugcccuuauuucugaccagaagcugcaggagaucuucucccggggacccuauagcguccaaggccaccgcguuaaaaucuaccagccugaaggggaggagggauggcucuauggcguggugucucaucaggauuccauuaccagacugauggaagucagcgugacagagucuggggaaaucaaguccguugacccccggcuuauucacgugaugcugauggauaacagcaccccucaguccgagggaggcacgcucaaggccgucaaaucuagcaagggcaaaaagaaacgcgaauccaucgaggggaaggacggaagacggcgcaagagcgcuucugacuccggcugugaucccgccagcaaaaagcugaaaggggacagaggagagguggauucuaauggcagcgacgggggagaagcgucccggggcccguggaagggcgggaacgcuucuggagagccuggccuggaucaaagagccaaacagcccccuagcaccuuuguuccccagauuaaucgcaacauccgguucgccacauacaccaaggaaaaugggagaacacucgugguccaagacgagcccgugggaggcgauaccccugcuuccuuuacgccguauagcacagccaccgggcagacaccccuggcuccugaagucggcggagccgagaacaaagaggcgggcaagacccuugaacagguggggcagggaauuguugccucugcugccguggucaccacagcuuccagcacgcccaauaccgugcgcaucucugacacaggccuggccgcggggaccguuccugagaagcaaaaaggaucccggagccaggccuccggcgaaaacucuagaaauagcauccucgcuuccucuggguucggcgccccccugccgagcuccagccagccucuuacauuuggaucuggccgcucccagagcaacggggugcuggcuaccgagaauaagccccucggauucucuuuuggcugcuccagcgcccaagaagcccagaaagauacggaccugucuaagaaccuguucuuccaguguaugagccagacacucccuaccuccaacuacuuuaccacagucagcgagucucuggcugaugacuccagcucccgggacucuuucaaacaaagccuugagucccugucuagcgggcucugcaagggaagauccgugcugggcaccgauacaaagcccgggucuaaagcgggcagcuccguggaccgcaagguuccugccgaaagcaugcccacgcugaccccggcuuuuccucggucucuucucaaugccagaacacccgagaaccacgaaaaucuguuccugcagcccccuaaacucucccgcgaggagccgagcaaccccuuucuggccuucgucgaaaagguggagcauucuccuuuuuccagcuucgcuucucaggccuccggaagcuccagcucugcgaccacagugaccagcaaagucgcucccuccuggccugaaucucacagcuccgccgauucugccagccuugcuaagaagaaaccccuguuuauuacgaccgacuccucuaagcucgugagcggcguucugggguccgcccugacaagcggaggcccuucucuuuccgcgauggggaauggacggagcucuucccccaccagcucccucacacagccgaucgagaugccuacccugucuagcucccccacggaagagagaccuacagugggccccgggcaacaggauaacccgcugcucaaaaccuucagcaaugucuuuggccggcauucuggaggcuuccuguccagcccugcugacuuuucucaggagaacaaggcccccuucgaagccgugaaacgcuucagccuugaugagagaucccuggcuugucggcaagacucugauagcuccacaaauucugaccucagcgaucuguccgacagcgaagagcagcugcaggccaagaccgggcuuaagggaauuccugaacaccucaugggcaaacuggggcccaacggagagagaucugcugagcugcuccugggcaaguccaaaggcaagcaggcccccaaagggcgcccucggaccgcgccgcuuaagguuggacaaagcgugcugaaagaugucuccaaggugaagaaacucaagcagucuggcgaacccuuucugcaggacgggagcugcaucaauguugccccucaccugcauaaauguagagagugccgccuugaaagauaucggaaguucaaagagcaggaacaagacgauuccacaguggcuugucgcuuuuuccacuuuagacggcucauuuucacgcgcaagggaguccugagaguggagggcuuucugucuccccagcagagcgacccugaugccaugaaccucuggauccccuccagcucucuggcugaggggaucgaccuugaaaccuccaaguacauucuggccaaugugggagaucaguucugccaacucgucaugagcgagaaagaagccaugaugaugguugagccucaucagaagguggcuuggaaacgggcggugcgcggcgucagagagaugugugacgugugcgaaacaacccuguuuaacauccacuggguuugccggaaguguggcuucggggugugccuggauuguuaccgccuuagaaaaucucggccgagauccgagacagaagagaugggagacgaagaggucuuuagcuggcugaagugcgccaagggccagucucaugagcccgaaaaucucaugccuacccaaauuauccccgggacggcucuguauaacauuggagauauggugcacgccgcccgcggcaaaugggggaucaaggcuaacuguccuugcaucagccggcagaauaaauccguucucagacccgccgugacaaacggaaugucucagcugccgagcauuaauccuuccgcgagcuccggcaacgagaccaccuucucuggcgggggaggccccgcucccgucacaaccccugaacccgaccacgugccuaaggccgauagcacagacauccgcuccgaggaaccgcuuaaaacggauucuagcgccuccaauucuaacagcgagcugaaggcuauucggcccccuugucccgacaccgccccucccuccagcgcgcuccauuggcuggcugaccuggccacacagaaggccaaagaggaaaccaaggaggcugggucucuuagauccguucugaauaaagaaagccacucuccguuuggacucgauuccuucaacagcacagccaaggugucuccucugacccccaaacucuucaauucccugcuucugggcccuacggcuagcaacaauaagaccgagggguccagccuccgcgaccugcugcauucuggacccggcaaacuuccucaaacaccccuggauaccggcaucccguuuccucccgucuucagcacauccucugccggggugaagagcaaggcgucccuccccaacuuucuggaccacauuaucgccucuguggucgaaaauaaaaagaccagcgaugcuuccaaacgggccugcaaccucacagacacccagaaggagguuaaagagauggugaugggacugaaugugcuugauccucacacgucucauagcuggcugugugacggcagacugcucugccugcacgauccguccaacaagaacaauuggaagauuuuccgcgaauguuggaaacaggggcagcccguccuugugagcggaguucauaagaaacugaagucugagcucuggaaaccugaagcuuuuucccaagaguucggcgaccaggauguggaccuggucaacugccggaauugcgccaucaucagcgacgugaagguuagagauuuuugggacggguucgagauuaucuguaagcggcuccgcucugaagauggacagcccauggugcugaaacuuaaggacuggccucccggcgaggauuuuagagacaugaugccuacacgguucgaagaucugauggagaaccugccgcuccccgaauacaccaaacgcgacggcagacugaaucuugccucccggcugccuagcuauuuugucagacccgaucucgggccuaagauguacaacgcuuauggacugauuaccgcggaggaccgccgggugggcacaaccaaucuccaccuggaugucuccgacgccgugaacguuaugguguacgucgggauccccauuggagagggcgcucaugaugaagaggugcuuaaaacgaucgacgaaggggacgccgaugagguuacaaagcagagaauccacgacggaaaggaaaaaccgggcgcccuguggcacauuuaugcugccaaggaugcggagaaaauccgcgagcugcuccggaaggugggcgaagagcaagggcaggaaaauccucccgaccaugaucccauucacgaccagucuugguaccuggaucagacccuuagaaaacgccuguacgaggaauauggaguccaaggcugggcuaucgugcaguuccucggggacgccguguucauuccugccggagcuccccaucagguucacaaccuguacagcugcaucaaggucgccgaggauuuuguguccccugagcaugugaagcacuguuuccggcucacacaagaauuuagacaccugagcaauacccauacaaaccacgaggacaaacuucaggucaagaauaucauuuaucaugcggugaaagaugccguuggcacccugaaggcucacgaaucuaaacuggcccgcuccuga

SEQ ID NO: 71094 - RNA, 3291 nt, Artificial Sequence
  derived and/or modified sequence opt5 from KDM4B__Homo_sapiens__NP_055830
augggcagcgaggaccacggggcccagaaccccuccugcaagaucaugaccuucagaccuacaauggaagaguuuaaagauuucaauaaguacguggcuuauauugaaucucaaggagcccaucgggcgggccuggcuaaaaucauuccgcccaaggaguggaaaccucgccagacguacgacgauaucgacgaugucguuauucccgccccuauccaacagguggugaccgggcagagcggacucuuuacacaguauaacauccagaagaaggccaugaccgucggcgaauacagacggcuggcuaauuccgagaaauauuguacaccccgccaccaggacuucgaugaccuugagagaaaguacuggaaaaaccugaccuuugugucuccuauuuauggggccgauaucagcggaucccucuacgacgaugacguugcucaauggaauauuggcucucugcggacaauccuugauaugguggaacgcgagugcggcaccauuaucgaaggggucaacacgccguaccuguauuucggaauguggaagaccacauuugccuggcauaccgaggacauggaccucuacagcauuaauuaucugcacuucggcgagcccaaauccugguacgcgaucccucccgaacaugggaagagacuggagcggcucgccaucggauuuuucccuggcagcucucaggggugugaugcuuuucugcgccacaagaugacacuuauuucccccaucauucugaaaaaguauggaaucccguucagcagaauuacccaggaagccggcgaguuuaugaucacguucccuuacggcuaucacgcuggguucaaccauggauuuaauugcgccgaaucuacaaacuucgcgacccuccgguggaucgacuacggcaaaguggccacacaguguaccugccgcaaggauaugguuaaaauuuccauggacguguuugucagaauccugcaacccgagcgguacgagcuuuggaagcaggggaaagaucugaccgugcucgaccacacacgcccuacggcucugaccagccccgaacugucuuccuggagcgccuccagagcuucucucaaggccaagcugcuucggagaagccaucgcaaacggucccagcccaagaaaccuaagccggaggaucccaaauucccuggagaaggcacagccggggcugcgcugcucgaggaagccggaggcagcgugaaggaggaggcuggccccgaagucgacccugaggaagaggaagaggagccccaaccgcugccucacgggagagaagccgagggagccgaagaggauggccgcgggaaacuucggcccaccaaggcuaagucugagcgcaaaaagaaauccuuuggacugcucccuccccagcugccucccccgccugcccacuuccccagcgaagaggcgcuguggcuccccucuccucuggaaccgcccguucuuggcccugggcccgcugccauggaggaaagcccucugcccgccccucucaauguggugcccccggaggucccuuccgaggaacuggaggcuaagccccgcccuauuauccccaugcuuuaugugguuccgcggccuggcaaggccgcuuuuaaccaggaacaugugucuugucagcaagccuucgagcacuuugcgcagaaaggacccacauggaaggaaccugucagccccauggagcugaccggccccgaggacggggccgcuuccagcggagccggcagaauggaaacgaaagcucgcgccggggagggacaggcgccuucuacauucuccaagcucaaaauggaaauuaaaaagagccggagacauccgcugggcagacccccuacccggucuccccuguccgugguuaagcaggaggccagcuccgaugaagaggcuucuccuuuuagcggggaggaagacguguccgaccccgaugcccucagaccucugcuuucucugcaauggaagaaucgggcugccagcuuccaggccgagcgcaaauuuaacgcugcggccgcuagaaccgaaccguacugcgccaucuguacacucuucuaucccuacugccaggcccugcagaccgagaaggaggcuccuaucgccucccugggcgaaggaugucccgcgacacuuccuagcaaaucucggcaaaagacgagaccccucauuccggagaugugcuucaccuccggcggggaaaauacagagccucugcccgcuaacagcuauaucggagacgauggcaccucuccccugauugccugcgggaaauguugccuccagguccacgccuccuguuacggaauccgcccugaacuggugaacgagggcuggacaugcagccggugugcugcccaugcguggaccgcugagugcugucuuugcaaucugagagggggcgcccuccagaugacgaccgaccgcagauggauucacgucaucugugccauugcugugcccgaagcccgguuucugaacguuaucgagcgccacccuguggauaucucugcuauuccggaacagagauggaagcugaagugcgucuauugucggaaacgcaugaagaaagugagcggagccugcauccaaugcuccuacgagcauuguagcacaucuuuccacguuaccugcgcgcaugccgcuggcgugcuuauggaacccgacgauuggccuuacgucguguccauuacaugucucaagcacaaaagcgggggacacgccgugcagcugcugagagcuguuucccucggccaggucgugaucaccaagaaucggaacgggcuguauuaccgcugcagagugauuggagccgccucucaaacguguuaugaggucaauuuugacgauggcagcuacuccgacaaccuuuaucccgagucuaucacaagccgggauugcgugcagcuggggccucccuccgaaggcgagcucguugaacugcgcuggaccgacggaaaucuguacaaggcuaaauucaucucuagcgugacaucccauauuuaucaggucgaguuugaagauggcagccagcuuaccgugaagagaggggacaucuucacccucgaggaggaacugccgaaacggguuagaucucgccugucccucagcacaggagcgccucaagagcccgccuuuucuggcgaagaggcuaaggccgccaaacggccuagaguggggacgccccuggcuaccgaggacuccggacgcagccaggauuacgucgccuucguggaaucucuucugcagguucagggccggccuggcgcgcccuuuuga

SEQ ID NO: 71095 - RNA, 2442 nt, Artificial Sequence
  derived and/or modified sequence opt5 from KDM4C__Homo_sapiens__NP_001140167
auggagguggccgaagucgagagcccccugaacccuuccugcaagaucaugaccuucagaccgucuauggaagaguuucgggaguucaauaaauaccucgcuuauauggagagcaagggcgcccaccgcgcggggcuggcuaaaguuauucccccuaaggaguggaaacccagacaguguuacgacgauaucgacaaccuucugauuccugcccccauccaacagauggugacaggacaguccggccucuuuacgcaguauaauauucaaaagaaggccaugaccgugaaagaguuccggcagcuggcuaacucugggaaguacugcacaccucgcuaucuugauuacgaagaccuggaaagaaaauauuggaagaaucucaccuuugucgccccgaucuacggagcugauaucaacggcagcauuuacgacgaggggguggaugaguggaauaucgcccggcugaacacaguucuggacguggucgaagaggaauguggaauuuccaucgagggcgugaauacccccuaucucuacuucggcauguggaaaacaaccuuugcguggcauacggaagauauggaccuguauucuauuaacuaccuucacuucggggagccuaagagcugguaugccauucccccugagcauggaaagcgccuggaaagacucgcucagggcuuuuuccccuccagcucucaggggugcgaugccuuucugcggcacaaaaugacccuuaucuccccgagcguucugaagaaauacggaaucccuuucgacaagaucacacaagaggcuggcgaauuuaugauuaccuuccccuauggguaccaugccggauucaaucacggcuuuaacugugcggagucuacaaauuucgccaccgugcgcuggaucgauuacggcaaagucgcuaagcucugcacguguagaaaagacauggugaagauuuccauggacaucuuugugcggaaguuccagccugaucgcuaucagcuguggaaacaggggaaggacauuuacacaaucgaucacaccaaacccacacccgccagcaccccugaagucaaggcuuggcugcaaagacggcgcaaaguuagaaaggccucucgguccuuucagugcgccagaagcaccuccaagcgcccgaaagcugacgaggaggaagaggugucugaugaaguggacggagcggagguccccaacccugauagcgugacagacgaucucaagguuuccgaaaaauccgaggccgcugugaagcugcggaauacggaggccucuuccgaagaggaaagcucugccagcagaaugcaggucgagcaaaaccuuuccgaccauaucaaacugucuggcaacagcugucucuccaccagcgugacagaggauauuaagaccgaagacgacaaggcuuaugccuaccgcucuguucccuccaucagcucugaggcggaugacuccauuccucugagcuccggguaugaaaaacccgagaagucugauccgagcgaacuuuccuggccuaaaucucccgagagcugcuccagcguggcugagucuaauggaguccugacagaaggcgaggaauccgacguggagagccacgggaacggacucgaaccuggcgagauccccgccgucccuucuggcgagcggaauagcuucaaggugcccagcauugccgaaggggagaacaaaaccucuaagagcuggagacauccgcugucccgcccucccgcucggagccccaugacgcugguuaagcagcaggccccuucugaugaagaacucccggaagugcuguccaucgaggaggaagucgaggaaacagagagcugggcuaaaccccuuauccaccuguggcagaccaaguccccuaauuuugccgcggagcaagaauacaacgccaccguggcuagaaugaaaccccacugugccauuugcacacuccugaugccuuaucauaagcccgacucuagcaaugaggaaaacgaugcucgcugggagaccaaacuugacgaaguugugacauccgagggaaagacgaaaccucugauccccgagaugugcuucauuuacucugaagagaauaucgaauacagcccgccuaacgccuuucucgaggaagauggcaccucccugcugauuucuugugcgaagugcuguguccgggugcacgccagcugcuaugggauccccucccaugagauuugugacggauggcucugcgcuagauguaagcgcaaugccuggacagcugagugcugucugugcaaccuucggggcggggcccugaaacagaccaagaauaacaaaugggcccacgugaugugugcuguugcggucccugaagugagauucacaaaugugcccgagcggacccagaucgaugucggccgcaucccgcuccagagacugaagcugggacggcuuggcauuuga

SEQ ID NO: 71096 - RNA, 5073 nt, Artificial Sequence
  derived and/or modified sequence opt5 from KDM5A__Homo_sapiens__NP_001036068
auggccggcguggggcccggaggcuacgcugccgaguucgucccuccgcccgaaugcccuguuuuugagcccagcugggaagaguucaccgacccucuguccuuuaucgggcgcauucggccccuggcggaaaagacaggaaucuguaagauuagaccuccgaaggauuggcagcccccuuucgcuugcgaggugaaaucuuuuagauucacgccccgggugcaaagacugaacgagcuugaagccaugaccagaguccggcuggacuuucucgaucagcuggccaaguucugggagcuucagggcagcacacugaaaaucccugugguugaacgcaagauucucgaccuguaugcucuguccaagaucguggccucuaaagggggauuugagauggucaccaaggagaaaaaguggagcaaagugggcuccagacucggcuaccugcccgggaagggaacaggcucucuucucaagagccacuaugaacggauccucuacccguaugagcuguuccaguccgggguuagccuuaugggagugcaaaugccuaaucuggaucucaaagaaaaggucgagcccgaagugcugucuaccgacacacagaccuccccugagcccggcacgcgcaugaacauucugcccaaaagaacccggcgcgugaagacacagagcgagucuggggaugucuccagaaauaccgaacucaaaaagcugcagaucuuuggagcuggcccuaaaguugugggccuugccauggggacaaaggacaaggaggaugaagugacccggcgcagaaaagucacgaaccggagcgacgccuucaauaugcaaaugagacagcgcaagggaacacugucugugaacuuuguugaucucuacguguguauguucugcggccgggggaauaacgaggacaaacugcuucugugugauggaugcgacgacuccuaucacaccuucugucucauuccgccccugccugauguccccaagggcgacuggagaugcccuaaauguguggccgaagagugcagcaagccccgcgaggcuuuuggguucgaacaggccguucgggaguacacacugcaguccuuuggagaaauggcugauaauuucaagucugacuacuuuaacaugccggugcacauggucccuaccgagcucguggaaaaagaguucuggagacuggucagcuccaucgaggaagaugugauuguugaguauggcgccgacaucagcucuaaggauuuuggcuccggguuccccgugaaagacggacgccggaagauucuuccugaagaggaggaauacgcgcugagcggcuggaaucucaacaauaugcccguccuggagcaaucugugcuugcccauaucaacguugauaucagcgggaugaaagugccuuggcuguaugucggaauguguuuuuccucuuucugcuggcacauugaagaccauuggagcuacuccaucaauuaucuccacuggggcgagcccaagaccugguacggggugccgagccacgcugccgaacagcuggaggaggugaugagagaacuggcuccugagcucuuugaaucucagcccgaucugcuucaucaacugguuacaauuaugaaccccaacguccucauggagcacggcgugccuguguaucgcacgaaucagugcgccggagaguucgucgugaccuuuccgcgggccuaccauuccggcuucaaccagggguacaauuucgcugaggcgguuaacuuuuguacagccgacuggcugcccaucggaagacagugcgugaaucacuaucgccggcugagacggcacugugucuucagccaugaggaacuuauuuuuaagauggcugccgacccugagugccucgaugugggccuggccgcuaugguuuguaaagaacugacccucaugacagaggaagagacccgccugagagagucugugguccaaaugggggugcuuauguccgaagaggaaguuuucgagcuggugcccgacgaugagcggcagugcagcgccuguagaacgacaugcuuucucuccgcgcugaccuguucuugcaacccugaacgccuggucugucuuuaccaccccaccgaccucugcccuugccccaugcagaagaaaugucugcgguauagauacccgcuggaggaucucccuagccugcuuuauggagugaaggugcgcgcucaguccuacgacacaugggucucuagaguuaccgaagcccugagcgccaauuucaaccauaaaaaggaucucaucgagcugcgggugaugcuggaagacgcugaggaucgcaaguaucccgagaaugaccuuuuuagaaaacuccgggaugccgugaaggaagcugagacaugcgccuccgucgcgcaacugcugcucagcaaaaagcagaaacaccgccagucuccugacuccggcagaacgcggaccaagcugacaguggaagaacuuaaagccuucguucagcaacuguuuagccuccccugugugaucucucaggcucgccaggucaagaaccugcuggaugacguggaagaguuccaugagagagcccaggaagcuaugauggacgagaccccggauuccagcaaacuucaaaugcucauugacauggggucuagccuguacguugaacugccugagcucccccggcugaaacaggaacuucagcaagcccgcuggcuggaugaggugagacucacacuguccgacccucagcaggucacccuggaugugaugaagaaacuuaucgacagcggcguuggacuggcgccccaccacgccguggagaaggcuauggccgaacuccaggagcugcucacggucucugaacggugggaggagaaagcuaaggugugccugcaagccagaccccgccauuccguggccagccuugaauccauugucaaugaggcuaagaacaucccugcguuucugccgaauguucucucucugaaagaagcccugcagaaggcucgggaguggaccgccaaaguggaagccauucagagcggcuccaacuacgcuuaucuugagcagcuggagucucucagcgccaaggggagacccaucccugugcgccuggaagcgcucccccaagucgagucccagguggcugccgcccgggcuuggagagaacgcacaggacggaccuuccugaagaaaaauucuagccacacacuucugcagguucucuccccuagaaccgauaucggcguguacgggagcggcaaaaaccgccggaaaaaggucaaagagcugauugaaaaggagaaagagaaggaccuggaucuugaaccccugucugaccucgaggaaggacuggaggaaacgagagauacagccauggugguugcgguguuuaaggagcgggagcagaaagaaaucgaggcuaugcauucccuccgcgccgccaaccuggcuaagaugaccauggucgacagaauugaagaggugaaauucuguaucugccggaagacagccagcggguucaugcuucaaugugagcugugcaaagauugguuucacaauucuugugucccucugccgaaguccagcucucagaaaaagggcuccagcuggcaggcuaaggaagugaaauuccucugcccccuguguaugcgcuccagacggccuagacuugagaccauucugagccuccugguuucucuccaaaagcugcccgugcgccuuccugaaggagaggcccugcagugccugaccgaacgggcgaugagcuggcaggacagagcccgccaggcucucgccacagacgagcuguccucugcucuugccaaacugagcguccucucccaacggaugguggagcaggccgcuagagaaaagacggagaaaaucauuucugcggaacugcagaaggccgcugccaaccccgaucuccagggccaucugcccagcuuucaacaguccgccuucaaucgcguugugucuagcgucuccagcucuccucggcagaccauggacuaugaugacgaggaaacagauuccgacgaggauaucagagagaccuacggguaugacaugaaggauacagcuagcgugaaaucuuccagcucccuugaacccaaccuguuuugcgacgaggaaauccccauuaagucugaggaagugguuacccacauguggacggccccuagcuucugugcggagcacgcuuacuccagcgccucuaaauccugcagccagggaucuagcacaccccgcaagcaaccuagaaaauccccgcuggucccccggucucucgagccucccgugcuggaacuuagcccuggcgccaaggcucagcuggaggaacucaugauggugggggaucugcucgaggucucccuggacgagacccagcauaucuggcgcauucuucaggccacccaucccccgucugaagacagauuucugcauaucauggaggaugacagcauggaagagaagccucugaaagugaagggaaaagauuccagcgaaaagaaacggaagcgcaagcucgagaaaguugagcaacuguucggcgaagggaagcagaaaucuaaggagcuuaaaaagauggacaagccccgcaagaagaaacugaagcucggcgcggauaaauccaaggaacugaauaaacuggcuaagaagcucgccaaagaggaggaacggaagaaaaagaaagagaaggccgcugccgcuaagguggaacuugucaaagagagcacagaaaagaaaagagagaagaaagugcuggacauuccuuccaaguaugauuggucuggagccgaagagagcgacgaugagaacgcgguuugugccgcucagaauugccaacgccccuguaaggacaaaguggauuggguccagugcgacggcgggugugaugaaugguuucaccaggugugcguuggaguguccccugagauggccgaaaacgaggacuacaucuguaucaauugcgcuaagaaacagggccccgucucuccggggccugcgccgcccccuagcuucauuauguccuacaagcugccgauggaggaccucaaagaaaccagcuga

SEQ ID NO: 71097 - RNA, 4635 nt, Artificial Sequence
  derived and/or modified sequence opt5 from KDM5B__Homo_sapiens__NP_006609
auggaggccgcuaccacacugcaccccggcccuagaccggcccucccccuugggggaccuggcccccuuggggaguuccugccucccccugagugcccgguguuugaacccagcugggaggaguucgcggacccuuuugcuuucauccauaagauucggcccaucgccgaacagacgggaauuuguaaaguccgcccucccccggauuggcaaccucccuuugccugcgacguugauaagcuccacuucaccccuagaauccagcggcugaacgagcuugaagcucagacacgcgugaaacugaauuuucucgaccagauugccaaguacugggagcugcaaggcuccacccugaaaaucccccauguggaaagaaagauccucgaucuguuccagcuuaacaagcuggucgcugaggaagggggauuugccgugguuuguaaagaccggaaguggacaaaaauugcgaccaagaugggcuucgcccccggcaaagcuguggggucucacauccgcggacauuaugaacggauucucaauccuuacaaccuguuucuuagcggcgauucccugagaugccuccagaagccgaaucugacaaccgacacgaaggauaaagaguauaagccccacgacaucccucagcgccaaucuguccagcccagcgaaaccuguccucccgccagacgggcuaaacgcaugagagccgaggcgaugaacauuaagaucgaaccggaggagacaaccgaagcccggacacacaaucugcgcagacggauggggugcccuacccccaaaugugagaacgaaaaggagaugaaauccucuauuaagcaggaaccuaucgagagaaaggauuacaucguggagaaugaaaaagagaagcccaaaagccgcuccaagaaagcuacgaacgccguugaccucuaugugugccugcuuuguggaagcggcaaugaugaagaccggcugcuccugugcgacgggugugaugacucuuaccauacauucugccuuauuccuccccugcacgaugucccgaagggagacuggagaugcccuaagugucucgcucaggagugcuccaaaccccaagaagccuuuggcuucgagcaggccgcucgcgauuauacccugcggacauucggcgagauggcggacgccuuuaagagcgauuacuucaacaugcccgugcauauggugccuaccgaacuggucgagaaagaauuuuggagacucguuucuaccaucgaggaggacgugacaguggaauacggggcugauauugccuccaaggaguucggaagcggcuuuccgguccgcgacgggaaaaucaagcugucucccgaagaggaagaguaucuugauuccggauggaaucugaacaauaugccugugauggagcagagcguucucgcccacauuacggcugacaucuguggcaugaagcugcccuggcuuuacguggggaugugcuucuccucuuuuuguuggcacaucgaagaccauuggagcuauuccauuaacuaccugcacuggggagagccuaaaaccugguauggcguccccggcuacgccgcggaacaacucgagaacgugaugaagaaacuggcuccugaacuguucguuagccagcccgaucuccugcaucagcuugugacaaucaugaauccgaacacccugaugacacacgaggucccuguguaucggaccaaucagugcgccggggaguuugucauuacguuccccagagccuaccauucuggauuuaaccaaggcuucaauuuugcugaagccgugaacuucuguacaguugacuggcucccucuggggcgccagugcguggagcacuaccggcugcuucacagauauugugucuucucccaugaugaaaugaucugcaagauggcuagcaaagccgacgugcucgauguuguggucgcgucuaccgugcagaaggacauggccauuaugaucgaggaugaaaaggcucugcgcgagaccgugcggaaacugggaguuaucgacagcgagagaauggauuuugaacuccugcccgacgaugagcggcagugugucaagugcaaaacaaccugcuucauguccgccauuucuuguagcugcaagccgggccuucuggugugucuccaccaugugaaagaacugugcuccuguccucccuacaaguauaaacugcgcuacagauauacacuugacgaucucuacccuaugaugaaugcucugaagcugcgggccgagagcuauaacgagugggcgcucaaugucaacgaagcccuggaggcuaagaucaauaaaaagaaaucucuuguguccuuuaaggcccugauugaagagagcgaaaugaaaaaguuccccgacaacgaccuccugagacaucugcgccuuguuacgcaagaugcugagaagugcgccucuguggcccagcagcuccugaaugggaaacggcagaccagauaccgcuccggcggaggcaagagccaaaaccagcugacagucaaugagcucagacaguuugugacccagcuguacgcucugcccuguguucugucccaaacaccucuccugaaagaccugcuuaaccggguggaagauuuccagcagcacucucaaaagcuccugagcgaggaaaccccguccgcggccgagcugcaggaccuccuggaugucucuuuugaguucgacguggaacuuccccagcuggcugagaugcgcaucagacucgaacaggcccgguggcuggaggaaguucaacaggccugccuggauccuagcucccuuacgcuggacgauaugcgcagacucauugaccugggggugggacucgcucccuauagcgccgucgagaaagcgauggcucggcugcaggaacuucugaccgugucugagcacugggaugacaaggccaagucccuccugaaagcccgcccuagacacagccugaacucucuugcuacagccgugaaggagaucgaagagauucccgcguaccugccuaauggcgcugcccucaaagauuccguccagcgggcccgcgacuggcugcaagacguugaagggcuccaggcuggaggcagagugccggugcuggauacccuuaucgagcuggucacacgggggagaagcauccccgugcaucucaacucucugccucgccuggagacccuuguugccgaagugcaggcuuggaaggagugugccgucaauacguuucugacagaaaacagccccuauucccuccuggaggugcucugcccucggugugacauuggccugcuuggacugaaaagaaagcagcgcaagcugaaagaaccccucccgaauggcaagaaaaagagcaccaaacuggagucucuuuccgaucuggagcgggcgcucacagaaagcaaggagaccgccuccgcuauggccacccugggggaagcuagacuccgcgagauggaagcccugcaaucucuucggcuggccaacgagggaaaacugcucagcccucugcaggacguugauaucaagauuugccuuugccagaaggcucccgcggcccccaugauccaaugugagcugugcagagacgcuuuccacacauccuguguggccgucccuucuauuagccagggccuccgcaucuggcugugcccccauugucggagauccgaaaaaccuccgcucgagaagauccugccccuucuggccucucugcagcggauucgcgugagacucccugaaggggaugcucugcgguacaugaucgagcgcacgguuaauuggcagcacagagcccaacagcuucugagcuccggaaaccucaaauuugugcaggaccgggucggcagcgggcugcucuauucuagauggcaggcguccgcuggccaagugagcgauaccaauaaggugucucagcccccuggaacaaccuccuucagccugcccgacgauugggacaaccgcacaucuuaccuucacuccccguuuagcaccggccgguccugcauuccucugcauggggucagccccgaaguuaaugagcugcucauggaggcccagcugcuucaggugucucugccugaaauccaagagcucuaucagacgcugcuggccaaacccagcccugcucagcagacagacagauccucucccgugcgcccgagcuccgaaaagaacgauuguugccggggaaagagagacggcauuaauucucucgagcgcaaacuuaagcggagacuggagcgcgaagggcugagcuccgagagaugggaacgggucaaaaagaugcgcaccccuaaaaagaagaaaaucaagcucucucaccccaaagauaugaacaauuucaagcuggagagagaacggagcuacgagcuugugcgcuccgccgagacccauagccugcccucugacacauccuacagcgaacaagaggauucugaagacgaggaugcgaucuguccugcuguuuccugccuccagccggaaggagacgagguggauuggguccagugugacggcagcugcaaccaaugguuccaccaggugugcguuggggugucccccgagauggccgaaaaagaggauuauauuugugucagaugcaccgugaaggacgccccuucucggaaguga

SEQ ID NO: 71098 - RNA, 4140 nt, Artificial Sequence
  derived and/or modified sequence opt5 from KDM5C__Homo_sapiens__NP_001140174
auggagcccggcagcgacgauuuccugccuccgcccgaaugcccuguguucgagcccuccugggccgaguucagagacccucucggguacaucgcuaagauucggcccaucgccgaaaaaucuggaauuuguaagauccgcccuccggcgauugucguugaagagggcggguaugaggcuaucugcaaagauagacggugggcccgcguggcccagagacugaacuaucccccuggaaagaauaucggcagccuucugcggucccacuacgaacgcauuguguaccccuaugagauguaccaaucuggggcuaaccucguccaguguaauaccagaccuuuugacaacgaagagaaagauaaggaguauaagccccauagcaucccgcugcggcaguccgugcagccuucuaaauucaauagcuacggacgcagagccaagcggcuucaacccgacccugaacccacagaggaagauauugagaaaaaccccgaacugaagaaacuccagaucuacggcgcuggcccuaagaugauggggcugggacugauggccaaggacaaaacgcuccgcaagaaagauaaggagggcccggagugucccccuaccguuguggucaaagaggaacuugggggagacgugaagguugaauccacaagccccaaaaccuuucuggagucuaaggaggaacugucccacagcccugagcccugcacaaagaugaccaugagacuccggcgcaaucauucuaacgcgcaguucauugaauccuaugugugcagaauguguagccggggcgaugaggacgauaaacugcuucugugcgacgggugugacgauaauuaccacaucuuuugccuccugccgccucugcccgaaauuccuaagggagucuggagaugucccaaaugcgugauggccgagugcaagcgcccucccgaggcuuucggcuuugaacaggccacacgggaguauacccuccaaucuuucggcgaaauggcugacuccuuuaaagccgauuacuucaacaugccggugcauauggucccuacggagcugguugaaaaggaguuuuggagacuugugaauagcaucgaggaagacgugaccgucgaguauggggcggauauccacuccaaggaguucggaucuggcuuccccgugagcgacuccaaacgccaccugacacccgaagaagaggaguacgccaccagcggguggaaccucaauguuaugccugugcuggaacagucuguccuuugucauauuaacgcugauaucuccggaaugaaggugccguggcuguauguuggcaugguguuuagcgccuucugcuggcacauugaggaccauuggucuuacagcaucaauuaccuccacuggggagaacccaaaacaugguauggggucccuucccuggcugccgagcaccuggaagaggugaugaagaaacucacccccgagcuguuugauucucagccugaccuucugcaucagcucgucacgcugaugaaccccaacacacuuaugagccacggcgugccuguugugcggaccaaucaaugugccggcgaguucgucauuacauuucccagagcuuaccauuccggguucaaccagggauauaauuuugcggaagccgugaacuucugcaccgcugauuggcugccggccggccgccaguguaucgaacacuaccggagacuccgccgguauugcguuuuuagccaugaggaacugaucuguaagauggccgcuugcccugagaagcuggaccucaaucuggccgcggcugugcacaaagagauguucauuaugguccaagaagagagacgccuucggaaggcccugcucgaaaaagggaucaccgaggccgagagagaggcuuuugaacugcugcccgacgaugaacggcaguguauuaagugcaaaacaacguguuuccuuucugcccucgcuugcuacgacugcccugauggacuggugugucugucccacaucaacgaccucugcaaguguucuagcucccgccaguaucugagauaccgguacacccuugaugagcugcccgccaugcuccauaagcugaaagugagagcggagagcuuugacacaugggccaauaagguucgcgucgcucuggaaguggaggauggccggaaaagaucccuugaggaacuccgcgcccuggaaucugaggcuagagaacggcgcuucccgaacagcgagcugcuccagcaacugaagaauugccuuuccgaggccgaagcgugugugucuagagcccuggggcucgucagcggccaggaggcuggaccucaccggguggccggccugcagaugacccugacagaacuucgcgcuuuccucgaccagaugaacaaucugcccugcgccaugcaucaaauuggggauguuaaaggagugcuggagcaggucgaagccuaucaggcugaggcgagagaggcccucgcuucccugccuagcucucccggccuucugcagucccuccuggaacgggggcgccaacugggaguggagguucccgaagcccagcagcuucagagacaaguggagcaggcccgguggcucgacgaggucaagcgcacccuggcuccuagcgccagacggggcacgcuggcggugaugagagggcuccugguugcuggcgccucuguggccccgucccccgcugucgauaaagcccaggcggaacuucaagagcugcucacaaucgcugaacgcugggaggaaaaggcccaccugugucuggaggcccggcagaagcacccucccgcuacccuugaggccaucauuagagaagcugagaacaucccugugcaucugcccaauauucaggcccucaaagaagcgcuggccaaggcucgcgccuggaucgcugacguggaugagauucagaacggagaccacuacccuugccucgacgaucuggaaggccuugucgccguugggcgggaccugccggugggacucgaggagcugagacaacuggaacuucaggugcugaccgcccauagcuggcgcgagaaggcuucuaaaacauuucucaaaaagaauagcuguuauacccugcucgaaguccugugccccugugcggaugccggcuccgacagcacaaagcggucuagauggauggagaaagaacuugggcuguacaaguccgauacggagcuccugggacugagcgcucaggaccuucgcgauccuggcuccgugaucguugccuucaaagagggggaacagaaggagaaagaaggcauucugcaacuccggagaaccaacucugccaagcccagcccucuggcuuccucuagcacagccuccucuaccacaagcaucugcgugugcggacagguccucgcgggcgcuggggcccugcagugugaccuuugccaggauugguuucacggacgguguguguccguuccccgccugcugagcucuccgagaccuaaccccaccuccagcccccuccuggccuggugggagugggacacgaaguuccuuugcccucuguguaugcggucucgcagaccccggcucgagaccauccuggcucuccugguggcccuucaaagacugccuguccgccugccggaaggcgaggcgcuccagugccugacagaacgggcuauuuccuggcaggggagagcccgccaagcccuugcuagcgaggaugugaccgcccugcucggacggcuggcugaacucagacagcgccugcaggccgagccccggccugaggaacccccuaauuaucccgcggccccggcuucugacccucuuagagagggcuccgggaaagauaugcccaagguucagggccugcuggaaaacggagacagcgugacauccccugagaaagucgcccccgaagagggcagcgaccucgagcugcuuucuagccugcucccucaacugaccgggcccgugcucgaacugccggaggcuacgcgcgccccucuugaggaacugaugauggaaggagaucugcucgaggugacacuggacgagaaucauuccauccccgaaucucuugauuuuuguauucugacccccagauacugcagcgaccucuccucuuggggcccugccccgggggucuuucccccuugguga

SEQ ID NO: 71099 - RNA, 4713 nt, Artificial Sequence
  derived and/or modified sequence opt5 from KDM5D__Homo_sapiens__NP_001140177
auggagcccggcugcgacgaauuucugccuccgcccgaguguccuguguuugaacccagcugggccgaguuccaggauccucucggguacaucgcuaagauuagacccaucgccgaaaaauccggaauuugcaagauccggccuccggcggacuggcaacccccuuuugcugucgagguugauaacuuccgcuuuacccccagagugcagcggcugaaugagcuugaagcccagacacgcgugaaacugaacuaucucgaccagauugccaaguucugggagauccaaggcucuagccugaaaaucccuaaugucgaaagaaagauucuugaucuguacucccucucuaagaucgugauugaggaagggggauaugaagcuaucuguaaagaccggcgcugggccagaguugcucagcggcugcacuaucccccgggcaagaacauugggagccugcuccgcucccauuacgagagaaucauuuacccuuaugaaauguuucagucuggagccaaucacgugcagugcaacacgcaucccuucgauaaugaggucaaagacaaggaauacaaaccucacagcaucccccugcggcaauccgugcagcccagcaaguuuucuuccuacagccgcagagcgaagcggcuucagccugauccggagcccaccgaggaagacaucgagaaacauccugaacugaagaaacuccagauuuauggccccggcccuaagaugauggggcugggacuuauggccaaagauaaggacaaaacaguucacaagaaggugaccugucccccgacagucaccgugaaagaugagcaaucuggcgggggaaacguguccagcacacugcucaagcagcaccugucucuggaaccuugcaccaaaacgaccaugcagcuccgcaagaaucauuccagcgcucaauucaucgacuccuacauuugucaggucugcucuagaggcgacgaggaugacaaacugcucuuuugugaugggugcgacgauaacuaucacaucuucugucugcuucccccucugcccgagauuccucggggaaucuggagaugccccaagugcauccuugccgaauguaagcagccgccugaggcuuuuggcuucgaacaggccacacaagaguacagccugcaguccuucggcgaaauggcggacagcuuuaaaucugauuauuucaauaugcccguucauauggugcccaccgagcucguggagaaggaauuuuggcgccuggucuccagcauugaggaagacgugacaguugaguacggggccgauauccacucuaaagaguucggaagcggcuuuccuguguccaacucuaagcagaaucugagcccggaagagaaacggcagucccucaccguccugacgagacuuauuagcucuuucugggcucaagccgugcugcccccuuggcccccuaagguucucgggcugcaggaauaugcuacauccggauggaaccuuaaugugaugcccguccuggaccagagcgugcucugccacaucaacgccgauauuucuggcaugaaggucccuuggcuguacguggggaugguuuucuccgccuucuguuggcauaucgaggaccacuggagcuacuccaucaacuaucugcauuggggagaacccaaaaccugguacggcgugccgucucucgcugcggagcaccuggaggaagucaugaagaugcuuacaccugagcuguuugacagccagcccgaucuccugcaucaacuggugacccuuaugaauccuaacacccucaugucccacggcguucccgugguccgcacaaaucagugcgccggggaguucgugauuacguuuccgcgggcuuaucacucuggauucaaccagggcuacaauuuugccgaggccgugaacuucuguaccgcugacuggcugccugccgggagacagugcaucgaacauuaucgccggcugagacgcuacuguguuuucagccacgaggagcucauuugcaaaauggcggcuuuucccgaaacacuggaucuuaaucuggccgucgccgugcauaaggagauguucaucauggugcaagaggaacggagacuccgcaaagcucugcuggaaaagggagucaccgaggccgagcgggaggcuuuugaacuucucccugacgaugaaagacaguguauuaagugcaaaacaaccuguuuccuguccgcccuggcgugcuaugacugccccgauggccucgugugucugagccacaucaacgaccuuugcaaguguucuuccagccggcaguaccugcgcuacagauauacgcucgaugagcugcccacaaugcugcacaaacuuaagauucgggccgagucuuuugacaccugggcuaauaaaguuagaguggcccucgaagucgaggaugggcgcaagcgguccuucgaggaacugagagcucuggaaagcgaggcccgcgagagacgguuuccuaacucugaacuccugcaacgccuuaaaaauugccugagcgagguggaagcguguaucgcccagguucucggccugguguccggacaggucgcuagaauggacaccccgcagcugacacuuaccgagcuccgggugcugcuggaacaaaugggcagccuccccugcgccaugcaucagaucggggauguuaaggacgugcuggagcaggucgaggcuuaccaggccgaagcccgcgaggcucuugcgacacugccuucuucccccggacuccugagaagccugcuugaacggggccaacagcuggggguggaggugccugaagcccaccagcuccagcaacaggucgagcaggcucaauggcuggacgagguuaagcaggcccucgcccccuccgcucaucgcggaucucuggugauuaugcagggccuucuggugaugggggccaaaaucgcgagcuccccuucugucgauaaggcuagagccgaacuccaggagcugcugacgauugccgaacggugggaggagaaagcucacuucugucuugaagcccgccaaaagcauccgcccgcgacccuggaggcuaucauuagagaaacagagaacaucccugugcaccuccccaauauccaggcccugaaagaagcccucaccaaggcucaggccuggauugcugacguugaugagauccagaacggcgaccacuauccuugccuggaugaccuugagggacugguggccgucggccgggaucuccccguggggcuggaggaacugagacaacuugaacugcagguucucacagcgcauagcuggcgcgagaaggccuccaaaaccuuucugaagaaaaauucuuguuacacgcuccuggaagugcuuugcccgugugcugacgccggaagcgauuccaccaagcggagcagauggauggagaaagcucugggccuguaucagugcgacacagagcuccuggggcuuucugcccaggaucugcgcgacccuggauccgucauuguggccuucaaggaaggcgagcaaaaggaaaaagaggggauccuccagcugcggagaaccaacagcgcuaagcccucuccccucgcgccuucccugauggccagcucucccacauccauuugcguuuguggccaggugccugcuggagucggcgugcuucagugcgaucugugucaagacugguuucacgggcagugcgugagcgucccgcaucugcucaccucccccaaaccuagccugacgucuagcccccuucuggccuggugggaaugggacacaaaguuccucuguccucugugcaugcgcucccggagaccccgccucgagaccauccuggcccuucugguugcucugcagcggcucccggugagacugccugagggagaagcccuucaaugucugacagagcgggcgaucggcuggcaggaucgcgcuagaaaagcccucgccucugaagacgugaccgcucugcuccggcagcuggccgagcuucgccagcaacugcaggcgaagcccagaccugaggaagcuagcgucuacaccuccgccacagccugcgaucccauucgggaggggucuggaaacaauaucagcaaggugcagggccugcucgaaaacggggacuccguuacgucuccugagaauauggcucccggcaaaggaagcgaucuggaacuucuguccagccuccugccgcagcugaccggcccugugcucgagcuucccgaggccauuagagcuccccuggaggaacugaugauggaaggggaccuccuggaggucacacuugaugaaaaccacucuaucuggcaacugcuccaggccggacagccuccggaccuggaucgcauucggacccugcucgagcuugagaaguuugaacaucagggcuccagaacacgcagccgggcgcuggagagacgccggagacgccaaaaaguggaccaggggagaaauguugaaaaccuggugcagcaagagcuccagucuaagcgggcccgcuccagcggaaucaugucccaggucggcagagaagaggagcacuaucaggaaaaagcugaucgggagaauauguuccugacccccucuacggaccacagcccuuuccuuaagggcaaccaaaauucccugcagcauaaagacagcgggucuuccgccgcuugucccagccucaugccucugcugcagcucucuuacagcgaugaacagcaacuuuga

SEQ ID NO: 71100 - RNA, 4362 nt, Artificial Sequence
  derived and/or modified sequence opt5 from KDM6A__Homo_sapiens__NP_001278344
augaaaagcugcggcgugucccuggccaccgcugccgcggcugccgccgcuuucggggacgaggaaaagaagauggccgcuggaaaagccucuggcgagagcgaagaggcgucccccucucucacagccgaagagagagaggcucugggaggacuugauagccggcuguuuggcuucguccgcuuucacgaagacggggccagaacgaaggcucuccugggaaaagccguucgguguuacgagucccuuauccugaaggcggaaggcaagguggagucugauuucuuuugccagcucggccauuucaaccugcugcucgaggacuauccuaaagcccugagcgcuuaccaacgcuauuacucccuucagagcgauuauuggaagaaugccgcuuuucuguacgggcucggacugguguauuuccacuacaacgccuuucagugggccauuaaggcuuuccaggaaguccuuuacguggacccgucuuuuuguagagcgaaggagauccaucugcggcucggccugauguucaaaguuaauaccgauuaugaauccagccugaagcacuuucaacucgcccugguggacugcaaccccuguacacuuucuaaugcugagauucaguuccauaucgcccaccuguacgaaacccagcgcaaguaucacuccgccaaagaggcuuacgagcagcuccugcaaacagaaaaccuuagcgcccaggucaaggcgaccgugcugcagcagcucggguggaugcaucacacaguugaucugcugggagacaaagcuaccaaggagucuuaugccauucaauaccuccagaaaucccuggaagccgauccuaauagcggccaguccugguauuuccuugggagaugcuacucuagcaucggaaaggugcaagacgcuuuuaucuccuaccggcagagcauugauaaaucugaggccuccgcugacacgugguguagcaucggcguccuguaucagcagcaaaaccagcccauggacgcccuccaggcguacauuugcgccgugcagcuggaucauggccacgcugccgcuuggauggaccuugggacccuguaugaaucuuguaaucaaccucaggaugccaucaagugcuaccucaacgcgacacgcagcaaguccuguucuaauaccagcgcccuggcugccagaauuaaauaucugcaggcucagcucugcaaccugccccaaggaucccuucagaauaagacaaaacugcucccuagcaucgaggaggccuggucucugccgauucccgccgaacugaccucccggcagggcgcuaugaacacggcgcagcaagccugcaagccucaccaucccaauacagagccugugcuugggcucagccagacccccaucucucagcaaucccugccgcugcacaugaucccuagcucccaggucgacgaucucucuagccccgcuaaacgcaagagaacauccucuccuaccaagaacaccagcgacaacugguccggaggccaugccguuagccacccgcccgugcagcagcaagcccauucuuggugucugacaccucagaaacuucagcaccuggaacagcuccgggcuaaucgcaacaaucugaacccggcccaaaagcugaugcuugagcagcucgaaucccaguucgugcugaugcagcaacaccagaugagacccacgggggucgcucaggugcggagcaccgggauuccuaauggccccacagcggauucuucccugccuaccaacagcguuucuggccaacagccccagcucgcccugacaagagugccgagcgucucccagccuggggugcgccccgccugcccuggacaaccccuugcuaauggcccuuuuagcgccgggcauguucccuguucuaccucccggacgcugggaagcacagacaccauccucauuggcaacaaucacaucaccggguccggcucuaacggaaaugugccguaccugcagagaaacgcgcugacacuuccucauaaucgcaccaaccucacaagcuccgcugaggagcccuggaaaaaucagcugucuaacagcacgcagggccugcacaaggggcaauccucucacagcgccggacccaacggcgaacggccucucuccagcaccgggccgucucagcaucugcaggccgcuggauccggcauucagaaucaaaacgggcaccccacacuuccuagcaauucugucacccagggcgccgcucugaaccaucucuccagccacacagccaccucuggaggccagcaggggaucacgcugaccaaagaguccaagcccagcggaaauauccugacagugccugaaaccuccagacauacaggcgagacccccaacagcacggcgucugucgaggggcuuccuaaucacgugcaccaaaugacagccgaugcuguuugcagccccucccauggagacucuaagagcccgggccuccuguccucugauaacccucagcugagcgcccuccugauggggaaagcuaauaacaaugugggcaccggaacaugugacaaggucaacaauauucaccccgccgugcauaccaaaaccgacaacuccguugccucuagcccuuccagcgcuaucucuacagcgacgcccucccccaagagcaccgaacagacaaccacaaauucugugaccucccuuaacagcccucacuccggccugcauacgauuaacggggagggaauggaagagucucaaagccccaugaaaacagaucuccugcuggucaaucacaagccuagcccccagaucauucccuccaugucuguguccaucuauccuagcucugccgaagugcuuaaggcuugccgcaaccugggcaaaaaugggcucagcaacuccucuauccugcucgacaaguguccgcccccucggcccccuagcucccccuacccuccgcugcccaaagauaaacuuaauccucccaccccuucuauuuaccuggagaacaaaagagacgccuucuuucccccgcuccaccaguucugcaccaauccuaacaaucccguuacagucauccgcggacuggccggcgcucugaaacuugaucuggggcucuuuagcaccaagacacugguggaggccaacaaugaacauaugguggagguccggacgcagcuccugcaacccgcggacgaaaacugggauccuaccggcacaaagaagauuuggcacugugaguccaauagaagccauaccacaaucgcuaaauaugcccaguaccaggccucuuccuuccaggaaagccuucgcgaggagaacgaaaagcggucccaccacaaagaccauucugauagcgaguccaccucuagcgacaauuccggaagacggcgcaagggccccuuuaaaacgauuaaguucgggaccaacaucgaucugagcgacgauaagaaauggaagcuccaacugcacgaacugacaaaacuuccugcuuuugugagaguugugucugccggaaaccugcucucccaugucggccacaccauucuggggaugaauacagugcagcucuauaugaagguuccgggaagccggacccccggccaucaggagaacaauaacuucugcucugugaauaucaacaucggcccuggggacugugaaugguuugucgugcccgagggauacuggggcguucugaaugacuucugcgagaaaaacaaucuuaacuuccugaugggguccugguggccuaaucuggaagaucucuaugaggcgaacgugcccgucuacagauuuauucagcgcccgggagaccugguguggaucaaugcuggcacagugcacuggguccaagccauuggguggugcaacaauaucgccuggaacguuggaccucuuaccgcuugucaguauaagcuggccguggaacgguacgaguggaauaagcuccagagcgugaaaucuauuguccccauggugcaccugagcuggaacauggcuagaaacaucaagguuuccgauccuaaacucuucgagaugaucaaguacugccugcuucgcacgcugaaacaaugucagacacugagagaagcccucauugcggccggcaaggagaucauuuggcauggccggaccaaggaggaacccgcucacuauugcucuaucugugaaguggaggucuuugaccugcuuuucgugaccaaugagagcaacucccgcaaaacauacauuguucauugccaggauugugccagaaagaccagcgggaaucuggaaaacuuugugguccucgagcaguauaaaauggaagaccugaugcaaguguacgaucaguucacgcucgcuccuccccugccguccgccucuagcuga

SEQ ID NO: 71101 - RNA, 5049 nt, Artificial Sequence
  derived and/or modified sequence opt5 from KDM6B__Homo_sapiens__NP_001073893
augcaccgcgccguggaucccccuggcgcucgggccgcgcgcgaggcuuucgcccucgggggacugagcugcgccggcgcuugguccucuuguccuccccauccucccccuagaagcgccuggcuccccgggggccggugcuccgcuucuaucggccagccuccgcuucccgccccucugcccccuagccacggguccucuagcggacaucccuccaagcccuacuaugccccuggcgcccccaccccucgcccccuccacggcaaacuggaaagccuucauggguguguccaagcucugcucagagagcccgcccaaccuggacugugggaacagcugggccagcucuacgagucugaacacgacuccgaggaggcuacacggugcuaucacagcgcccugcgcuacgggggaucuuuugcggaacuuggccccagaauugggcggcugcaacaggcccagcucuggaacuuccauacgggauccugucagcaccgcgcuaagguucugcccccucuugagcaaguguggaaucugcuccaucuggaacacaaaagaaacuauggcgccaagcggggcgggcccccugugaaacgcgcugccgagcccccggucgugcagccuguucccccugccgcucugagcggacccucuggcgaggaagggcucuccccuggaggcaagagacggcgcgggugcaauagcgagcagaccggacugcccccgggccuuccucugccgcccccuccgcugcccccucccccucccccucccccgccucccccucccccgcugccuggccuugcgacaucucccccuuuucagcugaccaagcccgggcucuggagcacacugcacggagacgccuggggccccgaaagaaaagggagcgcuccuccggagcggcaagaacagagacauucccugccccacccuuaccccuauccugcccccgccuacaccgcucauccuccgggacaccgccucgugcccgccgcgccucccggcccugggccccggccgccuggcgcugagagccauggaugucugcccgccacaagacccccuggcucugaucuucgcgagucccggguccagagaagccgcauggacucuagcgugucccccgccgcuaccacggccugcguuccuuacgcuccgucucggcccccugggcugcccggaaccacaaccagcuccagcucuagcuccucuuccaacacaggccucagagggguggaaccuaaucccggaaucccgggcgccgaucacuaucaaaccccugcgcuggaggucagccaccaugggcgccuuggccccuccgcccacucuagccggaagccuuuccugggagcucccgccgcuacgccucaucucucccugcccccgggcccuucuuccccgcccccuccgcccuguccuagacugcucagacccccucccccuccggccuggcugaaagggcccgcgugccgggccgcuagagaagacggagagauucuugaagaacucuuuuucggcacagaggggccuccccggccugcgcccccuccccucccccaccgcgaaggauuucugggaccucccgcuuccagauucagcguggggacccaggauucucacacacccccuaccccgcccaccccuacaacguccagcucuaacuccaauagcggcucucauagcuccagccccgccggacccgugucuuuucccccgccucccuaccuggcccgguccaucgacccucuucccagaccucccagcccggcucagaacccucaggauccgccccucgucccucugacccuggcgcucccgcccgccccucccuccucuugucaccaaaauacaagcggcuccuuccgccggccugagucucccagaccucgcguuagcuuucccaagaccccggaaguggggccuggacccccucccggcccgcuguccaaagcuccucagcccgugcccccuggggucggagagcuucccgccagaggcccucggcuguucgacuuuccgcccacaccucucgaagaucaguucgaggagcccgccgaguucaagauucugccugacgggcuggcuaacaucaugaagaugcuugaugagucuauccgcaaagaagaggagcagcaacagcaugaagccggcguggcgccccagccuccgcucaaggagcccuuugcuagccugcaguccccuuuccccaccgacacggccccuacaaccaccgcccccgcuguugccgugacaaccacaacgaccacaaccacaaccacgaccgcgacacaagaagaggagaagaagccgccucccgcucugcccccucccccuccgcucgccaaauuucccccucccagccagccucagcccccgccucccccucccccgucuccugccucccugcuuaagagccuggcuucuguccucgagggacagaaauauugcuacagaggcaccggggccgcuguguccacacggcccggaccccugccuaccacgcaauauagccccggcccuccgucuggggccacagcgcugcccccuaccuccgccgcucccagcgcccagggauccccucagcccagcgcuucuagcuccucucaauucagcacauccggcggcccuugggcccgcgagagacgggccggggaagaacccguucccggaccuaugacccccacccagccucccccgccucuuucucugccgcccgcucgcagcgaauccgaggugcuggaagagauuucuagagcgugcgagacacuggucgaacgggugggccgcagcgccacggacccugcugaucccgucgacaccgccgagccugccgauuccgggacagaaagacuccugccgcccgcucaggccaaggaggaagcgggaggcguggcugccguuagcgggucuuguaagcggagacagaaagagcaccaaaaggagcaucgccggcacagacgcgccugcaaagacuccgugggacggagaccucgcgaaggccgggcuaaggccaaagcgaagguccccaaggagaaaagcagacgcgugcuuggcaaucuggaucuccagucugaagagauccaggggcgggagaaguccagaccugaccugggaggcgcuagcaaagccaagcccccgaccgccccugcucccccuuccgcccccgcuccuucugcccagcccacaccgcccagcgcguccguuccugggaaaaaggcccgggaagaggcucccggaccuccgggcgugagccgcgccgauaugcugaaacuuagaucucucuccgaagggcccccuaaagagcugaagauucggcugaucaaagucgaaagcggagacaaggagaccuuuauugcuucugagguggaagaacgcagacuccggauggccgaucugacgaucagccacugugccgcugacgugguuagagcgucccgcaacgccaaagucaagggcaaguuccgggaaucuuaccuuagccccgcucaauccgugaaaccuaagauuaauacagaggaaaaacugcccagagagaagcucaacccucccaccccgucuaucuaucuggagagcaaacgcgaugccuuuuccccugugcugcuucaguucugcaccgacccccggaauccuaucacagucauuagaggccuggccgggagccuccgccugaaccucggacuguuuucuaccaagacacuuguggaggcuuccggcgagcauacgguugaagugcggacccagguccagcaacccagcgacgagaacugggaucugacagggaccagacagaucuggccgugugaauccucucgcagccacacaaccauugccaaauacgcgcaguaccaggcuuccucuuuccaggagagccuccaggaggaaaaggaguccgaagacgaggagagcgaggaaccugauucuacgaccggaacaccgcccuccagcgccccugaccccaagaaucaucacaucauuaaauuuggcaccaacaucgaucugucugacgccaagagauggaaaccucagcugcaagaacuucugaagcucccggcuuucaugcgggugacauccaccgggaauaugcugagccauguuggacacacaauccucggcaugaacaccgugcagcuguauaugaaaguccccggcucucgcacgccugggcaccaggagaauaacaauuuuugcagcgugaacauuaauaucggacccggcgauugugaaugguucgccguucaugagcacuacugggagacaauuuccgcguucugcgacagacaugggguggauuaucuuaccggaucuugguggccuauccuggacgaucucuacgccagcaacauucccgucuaucgguuugugcagcgcccgggcgaccugguguggaucaaugcugggaccguccacuggguucaagccacaggaugguguaacaauaucgcuuggaacgugggcccucugaccgccuaccaguaucagcuugcucuggaaagauacgaguggaaugaagugaagaacgucaaguccauugugcccaugauccacguuagcuggaacguggcccggacggucaaaauuuccgauccugaccucuucaagaugaucaaauuuugccugcuccagucuaugaagcauugucaagugcagagagagagccugguucgcgcgggcaaaaagauugccuaccaggggcgggugaaggacgaacccgcuuauuacugcaaugagugcgaugucgagguguucaacauccuuuuuguuacauccgaaaauggaucuagaaacaccuaucuggugcacugugagggcugcgcccgccggagaagcgcugggcugcagggagucguggugcucgaacaauaccggacagaggaacuggcccaggccuaugacgcuuucacccuuguccgcgcgagacgggcccgcggccagagacggcgcgcucuggggcaagccgccggaacaggcuuuggcuccccugcugcccccuucccggagcccccucccgcguuuucuccucaggcccccgcuagcaccuccagauga

SEQ ID NO: 71102 - RNA, 4071 nt, Artificial Sequence
  derived and/or modified sequence opt5 from KDR__Homo_sapiens__NP_002244
augcagagcaaggugcugcucgccgucgcucuguggcuuugcguugagaccagagccgcguccgugggccugcccucugugagccucgaccugccucggcuuuccauccaaaaagauauucugacaaucaaggcuaacacgacccuccagauuacaugucgcgggcagagagaccuggauuggcuguggccgaauaaccagucuggaagcgaacaacgggucgaggugaccgaaugcuccgacggccucuucuguaaaacacugaccauccccaagguuauugggaaugauacaggagccuacaaaugcuuuuaucgcgagaccgaccuugccucugugaucuacgucuaugugcaggauuacagaagcccuuucaucgcuuccguuagcgaccagcacggcguggucuauauuacggaaaacaagaauaagaccguggugauccccugucuggggucuauuuccaaccucaaugucagccugugcgcccgguacccugagaaacgcuuuguucccgauggaaacagaaucucuugggacuccaagaaaggcuucacaauuccuagcuauaugaucucuuacgcuggcaugguguuuugugaggccaagauuaaugaugaauccuaccagagcaucauguauaucguggucgugguuggguaccggauuuaugacgugguccuuuccccgucucauggaaucgagcugagcgugggcgaaaaacucguucugaacugcaccgcgcgcacagagcugaauguggggauugauuucaacugggaguaccccuccagcaagcaccaacauaagaaacucgucaauagagaccugaagacccagucuggauccgaaaugaaaaaguuucuuagcacgcugacaaucgacggcgugacccggucugaucaggggcucuauacaugugccgcuagcuccggacugaugaccaaaaagaacucuaccuucguccgcgugcacgagaaaccuuuuguugccuucggcagcggcauggaaucccuuguggaggcuacagucggggaaagagugcggauucccgccaaguaccugggauauccucccccggagaucaagugguacaaaaauggcaucccucucgagagcaaccauacgauuaaggcggggcacguucugaccaucauggaagugucugagcgcgacacaggaaacuacaccgucauucugacaaaucccaucuccaaagaaaagcagagccacguggugucucucguugucuaugugccuccccaaauuggcgagaaaucccugaucagccccguggauuccuaccaguaugggaccacgcagacacuuaccugcaccgucuacgccaucccuccgccccaucacauucauugguauuggcaacuggaagaggagugugcuaacgaaccuucucaggccgugagcguuacaaaucccuacccuugcgaggaauggagauccguggaggacuuucagggaggcaacaagaucgaagucaauaagaaccaguucgcucucauugagggcaaaaauaagaccgugucuacacugguuauccaagccgccaacgugagcgcucuuuauaaaugcgaggcggucaauaagguggggcggggagaaagaguuauuuccuuucacgugacgcgcggccccgagaucacccugcagccggauaugcagccuacagaacaggagagcgucucucucugguguaccgccgaccgguccacauucgagaaccugaccugguacaaacuggggccccaaccucuccccauucacgugggagaacugccuacgcccgugugcaagaaucuugauacccuguggaagcucaacgcuacaauguucagcaauucuaccaacgacauccugaucauggagcugaaaaaugccucccuucaggaucagggcgacuacgucugucucgcccaggauagaaagacaaagaagcgccauugcguugugcggcaacugaccgugcuggaaagagucgcuccgacgauuacagggaaccucgagaaccagaccacaagcaucggcgaaucuauugaggugagcuguaccgccuccggaaauccuccuccccagaucaugugguuuaaagacaacgagacccugguugaagacagcggcauugugcuuaaggaugggaaucgcaaccugacaauccggagaguccgcaaggaggacgaaggacucuauacgugccaggcguguucugugcugggcugcgcuaaaguugaggccuucuuuaucauugaaggggcccaagagaagaccaaucuggagaucauuauccuugugggaacagcugucauugccauguucuuuuggcuccugcuggugaucauccuccggaccguuaaaagagcuaacggcggggaacugaagacaggcuaccuuuccauugugauggaucccgacgagcugccgcucgaugaacacugugagcgccugcccuaugacgccagcaaaugggaauuuccucgggauagacugaaacuuggaaaaccccucggccgcggggcguuuggacaggucaucgaggccgacgcuuucggcauugauaagaccgccacgugccggacaguggcugugaagaugcugaaagagggggccacccauuccgaacacagagcgcugaugucugagcucaagauccugauucauaucggacaccaccuuaaugucguuaaccugcucggcgccuguaccaaaccugggggcccccugauggugaucguggaauuuugcaaguucggaaaucugagcacauaccuucgguccaaaagaaacgaguuugucccuuauaagaccaagggcgcucgcuuccggcaggggaaagacuacgugggagccauucccguugaucucaagagacgccuggacucuaucacaagcucccaaucuagcgcuuccagcggcuuuguggaggaaaaaucucuguccgaugucgaggaagaggaagccccggaggaccucuauaaggacuuccugacgcuugagcaucugauuugcuacagcuuccagguggccaaagggauggaauuucucgcuucuagaaaguguauccaccgggaucuggcggcccgcaauauucugcuuuccgagaagaacguugugaaaaucugcgacuucggacuggcuagagauauuuacaaggacccugauuauguccggaaaggcgacgcccgccucccccugaaguggauggccccugaaaccaucuuugauagaguguacacaauccagagcgacgucuggucuuucggggugcuccugugggagauuuucucccuuggcgcuagccccuauccgggaguuaaaaucgaugaagaguucugucggcgccugaaggagggcaccagaaugcgggccccugacuacacaacccccgaaauguaucagacgaugcucgauugcuggcauggggagccuucccaacgccccaccuuuagcgaacugguggagcaccugggaaaucuucugcaggcgaacgcucagcaggacggcaaggauuacauuguccuccccaucucugaaacacugagcauggaggaggacuccgggcucucucugccuaccagcccgguguccuguauggaagaggaagagguuugcgaccccaaauuccacuaugauaauacagccggaauuucucaauaccuucagaacagcaagagaaaaucccggccugugucugucaagaccuuugaggacaucccccuggaggaaccugaagugaaagugauccccgaugacaaccagacagauagcggcaugguucucgccuccgaggaacugaagacccuggaggacagaacgaaacuuagcccuucuuucggcgggauggucccguccaagagccgcgagucuguggcuuccgaaggaagcaaucagacauccggcuaccaaucuggguaucauagcgaugacaccgauaccacaguguacuccagcgaggaagccgagcugcucaagcugauugaaaucggaguccagaccggcucuacggcgcagauucuccaacccgacuccgggacaacccugagcucuccucccguguga

SEQ ID NO: 71103 - RNA, 999 nt, Artificial Sequence
  derived and/or modified sequence opt5 from KDSR__Homo_sapiens__NP_002026
augcugcuccuggccgcugccuuccuuguggcguuuguccugcuccuguacaugguuagcccccuuaucuccccuaagccgcuggcucuccccggagcccacgugguggucaccgggggaucuagcggcauugggaaaugcaucgccauugaguguuauaagcagggagcuuucaucacacugguggccagaaacgaagacaaacugcuccaagcuaagaaagagauugaaaugcauuccaucaaugauaagcagguugugcugugcaucucugucgacgugagccaggauuacaaccagguugagaaugugauuaagcaagcccaggaaaaacuuggcccugucgacaugcuggugaacugugcggggauggccguguccggaaaguuugaggaucucgaggucucuacguucgaacggcugaugagcaucaauuaucuuggcuccguuuaccccagccgcgcugugauuaccacaaugaaagagagacgggugggccgcaucgucuuugugucuucccaggccgggcagcugggacucuucggcuuuaccgcuuauagcgccucuaaguucgcgauuagagggcuggccgaagcucugcaaauggagguuaaaccuuacaacguguauaucacagucgccuaucccccugacaccgauacaccgggauuugcugaggaaaaucggaccaagccccucgagacgcgccugauuuccgaaaccacaagcgugugcaagccugagcagguugccaaacagaucgugaaggacgccauccagggcaacuucaauucuucccuugggagcgauggauacaugcuguccgcucucaccuguggcauggcgcccgucacaucuauuaccgaaggccugcaacagguggucacgauggggcuuuuuagaacaaucgcccuguucuaccucggcagcuuugacuccauugugcggcgcugcaugaugcagagagagaaaagcgagaacgcugauaagaccgccuga

SEQ ID NO: 71104 - RNA, 1875 nt, Artificial Sequence
  derived and/or modified sequence opt5 from KEAP1__Homo_sapiens__NP_036421
augcagcccgacccuagaccgagcggcgccggggcuugcugucgguuccugccccuccaaucccagugcccugagggagccggcgaugcggugauguacgcuucuaccgaauguaaggccgaggucacacccagccagcacgggaaccgcacguuuuccuauacccuggaagaccauacaaaacaggccuucggaaucaugaaugagcuuagacugucucaacagcucugcgauguuacccuucaggugaaguaccaggacgcuccugccgcucaauuuauggcccacaaagugguccuggcgagcuccucucccguguucaaggccauguuuacaaacggccugcgggaacaggggauggagguugugagcauugagggaauccauccuaaagucauggaacgccucauugaguucgcuuauaccgccuccaucagcaugggcgaaaagugugugcugcacguuaugaauggcgcugugauguaccagauugauucugucgugagagccugcuccgacuuucuggugcagcaacucgauccgagcaacgcgaucgggaucgccaauuucgcugagcagauuggaugugucgagcugcaucagcgggcccgcgaauauaucuacaugcacuuuggcgagguugcuaagcaagaagaguucuuuaaccuuucucacugccagcuggugacacucauuuccagagacgaucugaaugugcggugugaaagcgaggucuuccaugccugcaucaacugggugaaauaugacugugagcagcgcagauuuuacguucaggcccuucugcgggcugugcgcugccacucucucacccccaauuuccugcaaaugcagcugcagaagugcgaaauucuccaguccgauagcagauguaaagacuaccuggucaagaucuucgaggaacuuacgcugcauaaaccuacccaagugaugcccugccgggcgccuaagguugggcgccucauuuauacagccggaggcuacuuuagacagucccugucuuaucuugaggcuuacaaccccagcgaugggaccuggcugcggcucgccgaccuccaggugccgagauccggacuggccggcugugucgugggcgggcugcuguaugcugucggaggccgcaauaacagcccugacgggaauacagauucuuccgcccuugacugcuacaaccccaugaccaaucaguggagcccuugugcgcccaugucugugccccggaacagaaucggaguuggcgugaucgaugggcacauuuaugcugucggaggcagccacggcugcauccaucacaacuccguggaacgcuacgagccugagcgggacgaauggcaucugguugccccgaugcucacgagacgcauuggggugggagucgccgugcugaaucggcuucuguacgcugugggcggguucgauggaacaaacagacucaauucugccgaguguuauuaccccgaacgcaacgaguggcggaugaucaccgcuaugaauacaauuagaagcggcgccgggguuugcguccugcacaacuguaucuaugcggccggcggauacgacggccaagaucagcucaauuccguggaacgcuaugacguggagaccgagaccuggacauuugucgcuccuaugaagcaucggagaagcgcccuggggaucacggugcaccagggacggauuuacguucugggcggguaugauggacacaccuuccuugacucuguggaaugcuacgaucccgacacagacaccugguccgaggucacacgcaugaccagcggcagaucuggggugggcguugcugugacgauggaaccuugucggaaacagaucgaucaacagaacugcacaugcuga

SEQ ID NO: 71105 - RNA, 2199 nt, Artificial Sequence
  derived and/or modified sequence opt5 from KEL__Homo_sapiens__NP_000411
auggagggcggggaccagagcgaagaggaacccagagagcggucccaagccggaggcauggggacccuguggucucaggaaagcacaccugaggagcgccucccgguggaaggauccagacccugggcugucgcccggcgcguucugacggcgauccuuauucugggccuccugcuuugcuucucugugcugcucuuuuacaacuuccagaauugugggccuagacccugcgagaccagcgugugucuggaucugcgggaccacuaucucgcuuccggaaacacaucugucgccccuugcaccgacuuuuucagcuuugccuguggccgcgcuaaggaaacaaauaacuccuuccaggagcuggccaccaaaaauaagaacagacuucggcgcauccuggaggugcaaaauagcuggcaucccggcucuggggaagagaaggcuuuucaguucuacaacuccugcauggauacacucgccauugaagcggccggaaccggcccucugagacagguuaucgaggaacuugggggauggcggauuagcggcaaauggacgucucugaauuuuaaccgcacccucagacugcugaugucccaguaugggcacuucccguuuuuccgggcuuaccucggaccccauccugccagcccccacacaccugugauccaaaucgaucagcccgaguuugacgucccgcugaaacaggaucaggagcaaaagauuuaugcucagaucuuccgcgaauaccuuaccuaucugaaucagcucggcacacugcuuggcggggacccuucuaaggugcaagagcauuccagccuguccauuucuaucaccagcagacucuuccaguuucugcggccccuggaacagagacgcgcccagggaaaacucuuccaaaugguuacgauugaucagcugaaggagauggcgccugccaucgacuggcuuuccugucugcaggcuacauuuacccccaugagccucucucccucccagagccuggugguccacgauguggaauaccuuaaaaacaugucucaacugguggaggagaugcuccugaagcagcgggacuuccugcagagccacaugauucucggccuggucguuacacuuuccccugcccuggauucucaguuucaagaagcuagacgcaaacucagccagaagcugcgggagcugaccgaacagccgcccaugccugccagaccccgcuggaugaagugcguggaggaaaccgggacauucuuugagccuacgcuugccgcucucuucgugcgggaggcguuuggacccuccaccagaagcgccgcuaugaaacuguucacagccauccgcgacgcccugaucacccggcucagaaaucugccguggaugaacgaagagacacagaauauggcucaagacaaggucgcccagcuucagguggaaaugggcgcgucugagugggcucugaaaccugagcucgcccgccaagaauacaacgauauucagcugggguccagcuuucugcagucuguucuuuccugugugcggagccucagagcccggaucguccaguccuuccugcaaccccauccucagcaccgcuggaaggugucucccugggacguuaacgcuuauuacagcguguccgaucaugucguggucuuuccugccggacugcuccagcccccguucuuccacccuggcuaucccagagcugugaauuuuggcgccgcggggucuauuauggcccacgagcugcuucauaucuucuaccagcugcuccugcccggaggcugccuggcuugugacaaccacgcccuucaagaagcucaucucugccugaaacggcacuaugccgcguuuccucugccgagcagaaccuccuucaaugauagccucacguuucuggagaacgccgcugacguugggggacuugccauugcucugcaggccuacucuaagcgccuccugcggcaucacggcgaaacagugcugcccucccuugaucucagcccucagcagaucuucuuuagaucuuaugcccaagucaugugccgcaaacccuccccucaggacagccacgauacccauucucccccucaccugagagugcaugggccccugagcuccaccccggcuuucgcgcgguacuuucgcugugccagaggcgcucuccugaauccuagcucucggugccagcuuugguga

SEQ ID NO: 71106 - RNA, 1059 nt, Artificial Sequence
  derived and/or modified sequence opt5 from KERA__Homo_sapiens__XP_011536083
auggccggcaccaucugcuucauuaugugggugcuguuuaucacagacacggucuggagcagauccguucgccagguguacgaggugcacgauucugacgauuggaccauucaugacuucgaaugucccauggagugcuuuuguccuccgagcuuccccacagcucucuauugcgaaaaccgggggcugaaggagaucccugccauucccuccagaaucugguaccuuuaucugcaaaauaaccucaucgaaaccauuccugagaaacccuuugagaaugcgacacagcugcgguggaucaaccuuaauaagaacaaaauuaccaauuacggaaucgaaaagggcgcucugucucagcucaaaaagcugcuguuccucuuucuggaggauaacgaacuugaggaggucccuagcccgcugccccgcucccucgaacagcugcaacuugccagaaauaaggugucucggauuccucaggggacauucagcaaccuggagaaucucacccugcuggaccuccagaacaauaaacugguugauaacgccuuucagcgcgacacguucaagggacuuaaaaaucugaugcaacucaacauggcuaagaacgcccugagaaauaugcccccucggcuucccgcuaacaccaugcagcuguuucucgauaauaacuccaucgaaggcauuccggagaauuauuucaacgugaucccuaaagucgccuuucugcgccugaaucacaacaagcucagcgacgaagggcugcccucuagaggauucgauguguccagcauccuugaccugcagcucucucauaaucagcugacaaagguuccucggauuuccgcgcaccuucaacaucugcaccucgaucacaacaaaaucaagagcgugaaugucucugugauuugucccucccccagcaugcugccugccgagcgcgacuccuucucuuacggcccgcaucugagauaucuccggcuggacggcaacgagaucaaacccccuauucccauggcucuuaugaccugcuuucgccugcuccaggccgugaucaucuga

SEQ ID NO: 71107 - RNA, 654 nt, Artificial Sequence
  derived and/or modified sequence opt5 from KHDC3L__Homo_sapiens__NP_001017361
auggacgcccccagacgguucccuacccuggugcagcucaugcaaccgaaggcuaugcccgucgagguucugggccaccuuccuaaacgcuuuagcugguuccauuccgaauuucugaagaaccccaaaguggugagacucgaggucuggcugguggaaaagaucuucgggcggggaggcgagcgcauuccucacguucaggggaugucucagauccuuauucaugugaauagacuggaucccaacggagaagccgagauccucgucuuuggccggccuagcuaccaggaggacacaauuaaaaugaucaugaaucuggcggauuaucaccgccaacugcaggcuaagggguccggaaaggcccucgcccaggacguggcuacgcagaaagccgaaacccaaagaucuagcaucgagguucgggaagcuggcacacagcgcuccguggaggucagagaggccggcacccagcggucuguggaagugcaggaggucgggacacaaggaagcccgguugaagugcaggaggcgggcacccagcaaucccugcaggccgcuaacaagagcgggacacagcgcucucccgaagccgcuuccaaagccgugacccagagauuccgggaggaugcgcgcgacccugucacgagacuuuga

SEQ ID NO: 71108 - RNA, 1050 nt, Artificial Sequence
  derived and/or modified sequence opt5 from KHDRBS2__Homo_sapiens__NP_689901
auggaggaagagaaguaccugcccgaacucauggccgagaaagacagccuggauccuuccuucgugcacgcuucuagacuucuggccgaagagaucgagaaguuucagggcagcgacgggaaaaaggaagaugaggagaaaaaguaucucgacgucaucuccaacaagaauaucaaacugucugagcggguucuuauuccggugaagcaauaccccaaauucaacuuugugggaaagcugcucggcccucgcgggaauagccugaaaagacugcaggaggaaaccggagcgaagauguccauccucggcaaggggucuaugcgggauaaagcuaaggaggaagaacugcgcaaaagcggagaagccaaguaugcccaucuuuccgacgagcugcacguccucauugagguguucgcucccccuggcgaagccuacagcagaaugucucaugcucuggaggaaaucaaaaaguuucuuguucccgauuauaacgacgagauccggcaggaacagcugcgcgagcucuccuaccugaauggcagcgaggauucugggagaggacggggcauucgcgggagaggaauccggauugccccuacagcgccgucccgcggcagagggggagccauucccccucccccucccccgggccggggcgugcugacgccucgcgggagcaccgucacaagaggagcucuccccgugccucccguugcccggggcgugcccaccccuagagcucgcggggccccgacaguccccggauaucgggcgccucccccucccgcccacgaggcuuacgaagaauacggcuaugacgauggguacggaggcgaguaugacgaucaaaccuacgaaacauaugacaacucuuacgccacccagacgcaguccgugccggaguauuacgacuacggccauggggugagcgaggaugcuuaugacuccuacgccccugaagagugggccaccacaagaucuagccugaaagcucccccucagcgcuccgcgcggggaggcuauagagaacaccccuacgggcgcuauuga

SEQ ID NO: 71109 - RNA, 1041 nt, Artificial Sequence
  derived and/or modified sequence opt5 from KHDRBS3__Homo_sapiens__NP_006549
auggaggaaaaguaccugcccgagcucauggccgaaaaagacagccuggauccuuccuucacccacgcucuuagacuggugaaccaggagaucgaaaaguuucaaaaaggcgaggggaaggacgaggaaaaauauauugaugucguuaucaauaagaacaugaagcucggacagaaagugcugauuccggugaagcaguuccccaaauuuaauuucgucggcaaacuucuggggccucggggaaacucucucaagcgccugcaggaggaaacacugacgaagaugagcauccucggcaagggguccaugagagacaaagccaaggaggaggaacugcggaaaucuggagaggcgaaguacuuucaucuuaaugaugaccugcacgugcucauugaaguuuucgcucccccugccgaggccuaugcucgcaugggccaugcccuggaagagaucaaaaaguuucuuauccccgauuacaacgacgagauuagacaagcucagcugcaggaacucaccuaucugaauggcgggagcgagaacgccgaugugccugucgugcggggaaaaccgacacugcgcaccagaggcguucccgcgccugccaucacacgggggcgcggaggcgugaccgcuagacccgucggggugguggucccucggggaacacccaccccgcgcggcguucucuccacgagaggcccugugucucgggggcgcggacugcuuacccccagagcccggggcgugccucccacaggguacagacccccuccgcccccucccacccaggaaacauauggagaguacgacuacgaugacggcuaugggaccgcuuacgaugaacaaagcuaugacuccuacgacaauagcuauucuacgccugcccaguccggagcggauuacuaugacuacggccacggccugagcgaggagacauacgauucuuaugggcaggaagaguggaccaacucccgccauaaggcccccagcgcucggacagccaagggagucuacagagaccagccguauggccgcuacuga

SEQ ID NO: 71110 - RNA, 897 nt, Artificial Sequence
  derived and/or modified sequence opt5 from KHK__Homo_sapiens__NP_000212
auggaggaaaagcagauccugugcgugggccucgucguucuggacgugauuagccuuguggauaaauaccccaaggaggacuccgaaaucagaugucugucucaacgguggcagcgcgggggaaacgccagcaauuccugcaccguccucucucugcuuggcgcuccuugugccuucauggggagcauggcgccgggacacguggcugauuuuguucuggacgaucucagacgguauuccguggaccugcgcuacacagucuuccagacgaccggcucugugcccauugccacaguuaucauuaacgaggccagcggguccagaaccauccuguauuacgaucggagccucccugacgugucugcuacagauuuugaaaaagucgaccugacccaguucaaguggauccauauugagggacgcaaugccuccgagcaagugaaaaugcuucagagaaucgaugcucacaacacacggcagcccccugaacagaagauucgcgugagcgucgagguugaaaagcccagagaggagcuguuucaacucuucggcuauggcgacgugguguuugucucuaaagauguggccaagcaucugggguuccaguccgcggaagaggcccuucggggacuguacggccgcguuagaaaaggggcugugcucgucugcgccugggcugaagagggagccgacgcgcugggcccugacgggaagcugcuccacagcgaugccuuuccgcccccucgggugguugacacccugggagcuggcgauacguucaaugccucugugaucuuuucccuuagccagggccgcuccguccaggaagcucugagauucgggugucaaguggccggcaaaaagugcggacuccagggguuugacggaauugucuga

SEQ ID NO: 71111 - RNA, 2136 nt, Artificial Sequence
  derived and/or modified sequence opt5 from KHSRP__Homo_sapiens__NP_003676
augagcgacuacuccaccggcgggcccccuccgggacccccucccccugccggcgggggaggcggggcuggaggcgccggcgggggacccccuccggggcccccuggcgcgggagauagaggcgggggaggccccggcgggggaggcccugggggaggcucugcugggggacccagccagccgccuggcggcgggggacccggcauccggaaggacgccuucgccgaugcugugcaacgcgccagacagauugcugccaaaaucgggggagacgcggccacaacggucaacaauuccaccccugauuuuggcuucgggggccagaagcggcagcuggaggacggagaucaacccgaaucuaaaaagcucgcuagccagggcgacuccauuucuagccagcuggggcccauccacccuccgccccgcacauccaugaccgaggaauauagaguuccugauggaauggugggccuuauuaucgggcggggaggcgagcagaucaacaaaauucaacaggacagcgggugcaaggugcagaucucucccgauuccggcggacugccugaacgcagcgucucucucacaggcgcccccgaguccgugcagaaggcuaaaaugaugcuggacgauauuguuagcagagggcggggaggcccgccugggcaauuucaugacaaugccaacggaggccagaaugggaccgugcaggagaucaugauucccgcgggcaaggccggacuugucaucggcaaagggggagaaacaauuaagcaacugcaggagcgcgcuggcgugaaaaugauccucauccaggacgggucucagaacaccaauguugauaagccucugagaauuaucggagaccccuacaaggugcaacaggccugugaaauggucauggauauucugcgggagcgcgaccagggcggguucggcgauagaaacgaguauggaucccggaucggcgggggaauugacgugccugugccccgccacagcgucggcguugugaucgggagauccggagaaaugaucaaaaagauucagaaugaugcuggcgugcggauccaauuuaaacaggacgauggcacggggccggagaagauugcccauaucaugggaccucccgacagaugcgaacacgccgcucgcauuaucaacgaucuccugcagucucuucggagcgggcccccuggcccgcccggaggcccugggaugcccccuggaggcagaggccgcgggcggggacagggcaauugggggcccccuggaggcgagaugaccuucuccauccccacacauaaaugugggcuggucauuggaagaggcggcgaaaacgugaaggcgaucaaucaacagaccggggccuuuguugagauuagccgccagcucccgccuaacggagaccccaauuucaaacuguuuaucauucggggcucuccucagcaaaucgaccacgcuaagcagcuuauugaggaaaagaucgaggggccccugugcccggugggaccuggccccgggggaccuggccccgccggccccauggggccuuucaacccgggacccuuuaaccagggcccucccggggccccuccccacgcuggaggcccuccgccccaucaauacccuccccagggguggggaaauacauauccucaguggcagcccccggccccucacgaucccuccaaagcggcugccgccgcugccgaccccaacgcugccugggcggccuacuauagccauuacuaccaacagccucccggcccugucccgggccccgcuccugcccccgcugccccucccgcgcagggggaaccgccucagcccccucccaccggacaaucugauuauacgaaggccugggaggaauacuauaaaaagaucggccagcagccucagcaacccggggcuccgccucagcaggacuacacaaaagccugggaggaguauuacaagaagcaagcucagguggccaccggaggcgggcccggagcucccccuggcagccagccggauuauuccgccgcgugggccgaauacuacagacagcaagcugccuauuacggccagacacccgggccuggaggcccccagccucccccuacccagcaagggcagcagcaggcccaauga

SEQ ID NO: 71112 - RNA, 1947 nt, Artificial Sequence
  derived and/or modified sequence opt5 from KIAA0020__Homo_sapiens__NP_055693
auggaggugaagggcaaaaagcaguucaccgggaaaagcacaaagacggcccaagaaaagaacagauuucacaaaaauuccgacucuggaagcuccaagaccuuccccacacggaaagucgcuaaggagggcgggccuaaaguuaccucucgcaacuuugaaaagagcaucacaaaacugggaaagaagggcgugaaacaguucaagaauaaacagcagggggauaaguccccgaaaaacaaguuucaacccgccaauaaauucaacaagaagagaaaauuucagccugacggacggucugaugagagcgcggcuaagaaacccaagugggacgauuucaaaaagaagaaaaaggaacucaaacagucccgccagcugagcgacaagaccaauuacgauauuguggucagagccaaacaaaugugggagauccuucggcgcaaggacugcgauaaggagaaaagagugaagcugaugucugaccuccagaaacugauucagggcaagaucaaaacaauugccuuugcucaugauuccacccggguuauccaguguuauauccaauacggcaacgaagaacagcgcaagcaggccuucgaagaacuuagagacgaucugguggagcucagcaaggcuaaauauucucggaauauugucaagaaauuucugauguacggguccaagccucaaaucgccgaaauuauccgcagcuucaaaggacacgugagaaagaugcugcggcaugcggaggccucugcuauuguugaauaugccuacaacgacaaagcuauccucgagcagcgcaauaugcugacggaggagcuuuauggcaacaccuuucagcuguacaaguccgccgaccacagaacacucgauaaggugcuggagguccagcccgaaaaacuugagcugauuauggacgaaaugaagcaaauccucaccccuauggcgcagaaagaggccgugaucaagcauagccuggugcacaaagucuuccuggauuucuuuacauacgcuccgcccaagcuccgguccgaaaugauugaggccaucagagaggcuguuguguaucuggcccacacccaugacggggcccgcguggcuaugcacugccuuuggcauggaacgccuaaggaucggaaagucauugugaagacaaugaaaaccuacguugaaaagguggcgaauggccaguauucucaccugguccuccuggccgcuuucgacuguaucgaugacacaaaacuugugaagcagauuaucaucagcgagauuaucuccagccugcccucuauuguuaacgauaaguacgggagaaaagugcuccuguaucugcucuccccucgcgaccccgcccacaccguccgggaaaucauugaggugcugcaaaagggagauggcaaugcccauagcaaaaaggacaccgaagucagacgccgggagcuucuggagucuaucagcccggcucuccuguccuaccuucaggaacacgcccaggaggugguucuggacaaaucugcgugcgugcucgucagcgauauccugggcuccgcuacaggggacgugcagccuacgaugaacgccauugccagccuggcugccaccggacuccaucccggcgggaaggauggagaacugcacaucgcugagcauccugccggccaccuuguucugaaguggcucauugagcaagacaaaaagaugaaagaaaacgggagagagggauguuuugcgaagacacugguggaacacgucggcaugaaaaaucugaagucuugggccuccgugaaccgcggcgcuaucauucuuagcucucuccugcaguccugcgaucuggagguggccaauaaaguuaaggcugcccucaagagccugauccccacccuugagaaaacaaaguccaccucuaaagggauugagauccugcucgagaagcugagcacguga

SEQ ID NO: 71113 - RNA, 300 nt, Artificial Sequence
  derived and/or modified sequence opt5 from KIAA0040__Homo_sapiens__NP_055471
auggagagaaucagcgccuucuuuuccucuauuugggacaccauccugacaaagcaccaggaaggcauuuacaacacgaucugccucggggugcugcuuggacugccccuccuggucauuaucacccuucuguucaucuguugccauuguugcuggagcccuccgggcaaacgggggcaacagcccgagaagaauaaaaagaaaaagaagaaaaagaaaaagaaagaugaagaggaccucuggauuuccgcucagccuaagcugcugcagauggaaaagcgccccucucucccuguuuga

SEQ ID NO: 71114 - RNA, 6708 nt, Artificial Sequence
  derived and/or modified sequence opt5 from KIAA0100__Homo_sapiens__NP_055495
augccccuguucuuuagcgcccugcuggugcuucugcucguggcucuguccgcccuuuuccugggaagauggcucguugugcggcuggccaccaaguggugccagcgcaaacugcaagcugaacucaagaucgggucuuuuagauucuuuuggauucagaacgugagccugaaauuccagcagcaccaacagacaguggaaaucgacaaucuuuggauuuccucuaagcugcucagccacgaucugccucacuacguggcccuuuguuuuggagaaguucggauccgcacggaccugcagaaaguguccgaucucucugccccguucagccaguccgcuggagucgaccaaaaggaacugagcuuuucucccucccugcucaagauuuucugccagcuguuuagcauccauguggaugccaucaacauuaugguucuuaaaguggacaccucugagucccuguggcacauccagauuagcagaucucgguuccuccuggauuccgacgggaagcgccuuaucugugaagucagccugugcaaaauuaauuccaaggugcucaaaucuggacagcuggaggauaccugucugguggagcucagccuggcucuugaccugugccucaaggucggcaucuccagcagacaucugaccgccauuacaguugauguguggacccuucacgcggaacugcacgaggggcucuuucaaucucagcugcugugucagggaccuucccucgccagcaagcccgugccuugcucugaagucacagagaaccugguggagcccacccuuccuggccuguuccuccugcaacagcugccggaccagguuaaagugaagauggaaaauacgagcgucgugcuuuccaugaacucucagaaacggcaucucaccuggacacugaagcugcuccaauuccuguaucaccgcgaugaggaccagcuuccccugcggagcuuuaccgcuaauuccgacauggcccagaugagcacagaacuccugcuggaggauggccuucuccugucucagucccggcaacgcaucguuugucugaacagccucaaggcuucugugcaggucaccacgaucgaccuguccgccagccuugugcugaauacaugcauuauccauuacagacaccaggaguucucccacuggcuccaucugcuggcgcuugagacccaggggucuagcuccccuguccucaagcaacggaaaaagcgcacauuuccccagauucuggccccuaucauuuucucuaccagcaucuccaacgugaauaucagcauucagcugggagauacacccccguuugcucucggcuucaacucuaucucccuggacuaucagcaccuuagaccucaaagcauucaucagagagggguucugacaguggaucaccucuguuggagagucggaucugacucccauauccagcgcgcgccccacccucccaauaugcacguguggggcgaggcucugguucuggauagcuuuacgcuucaagggucuuacaaccagccccucggacugagcuccacccagagcgacacacuguuccucgauugcaccauucggggccuccagguggaagccucugacacaugcgcccaaugucuuuccagaauccugagccucaugggcccucaguccgggaagucugcugucagccgccauuccucuuuuggagagagcgugucccugcuguggaaaguggaucuuaagguugaagacaugaaucuguucacccucucugcgcuggucggcgccagcgaggugcggcucgacacgcugacaauccuuggguccgcugaaaccagcaccgugggcauucagggccugguccucgcccuggugaaaucuguuacagagaagaugcagccgugcuguaaagcccccgauaucccuacccccgugcugucccuuagcaugcugucuauuacauaucacuccagcaucagaucucucgagguccaaugcggggcuggacugacgcuccugugguccccucccgaccauauguaccuuuaucagcacgugcuggccacccuccagugucgcgaucugcugcgggcgacaguuuuuccggaaaccgugccuagccuugcucuggagacauccggcaccacgagcgaacucgagggcagagcccccgaaccucugcccccuaagcgccuccugaaccuuacccuggaggucucuacagccaagcugaccgcuuucguggccgaggacaaauuuauuacacucgcugccgaaagcguuucccugucucggcacgggggaagccuucaggcguacugccccgagcuggccgcuggcuucgaugggaacuccaucuucaauuuuaaggaaguggagguccaacuccugccggagcucgaagagaugauucugcauagaaacccuuuccccgcccuucagacccugcgcaaucggguguggcugcucucuuuuggaagcguguccgucgaguuccccuaccaguaugacuuuucuagaacgcuggaugaggcuguuggcgugcaaaaauggcuuaaggggcugcaccagggcacacgggccugggcgagcccuuccccggugccccucccucccgaccugcuccugaaagucgaacauuucagcuggguguuucuugaugacguuuucgaggugaagcugcacgauaacuacgagcugaugaaggacgaaucuaaagaguccgccaagcgccuccagcugcuugaugcuaaagucgccgcucugagaaagcagcauggagaacuccugccugcccggaaaaucgaggaacucuaugccagccuggagagaaagaauaucgagauuuacauccaacgcucucggagacuuuauggcaacacccccaugcgcagagcucugcugacauggucccucgcggggcuggaacuuguggcccuggcugacgccagcuuucacggaccugagcacguuguggaacagguccaggagcucgaccccggcuccccguucccucccgaagggcuggaucuggugauucaguggugucggaugcucaagugcaauguuaaaucuuuucuugugcgcaucagagacuacccucgguaucuguucgagauucgcgauuggagacugaugggacggcucgucggcaccgagcaaagcgggcagcccuguucccgcagacggcagauccugcaucuuggccugccguggggaaacguggccguggaacgcaauaugccuccccucaaguuuuaccacgacuuccauagcgagaucuuccaguacaccgucguuuggggcccuugcugggaucccgcuuggacacugauugggcaauguguggaccugcucacgaaacccucugccgauccuuccccgccccuuccuuggugggacaagagcagacugcuguuucacggagauuggcauauggacaucgaacaggcgaaccuccaccagcuggcuaccgaggaucccuauaauacaaccgagaacaugcacugggaauggucucaucuuagcuuccacuggaaaccuggccaguuuguguucaagggggaccuggauauuaauguccggacagccuccaaauacgacgacugcugcuuucuccaucugcccgaucuguguaugacccucgaccuucaauggcugugccacggaaacccucacgaucaucacucugugacgcugagagccccggaguuccuccccgaaguuccucugggccagcuucaugacagcuaucgcgcuuuucgguccgagaaucugaaccucucuaucaagauggaucugacaagacacagcgggaccauuucccagccccgcauccugcucuacagcucuacccuucgguggaugcaaaacuucugggccacauggaccuccgugacaagaccuaucugucgcggcaagcuguuuaauaaccugaaacccagcaagaaaaagcucggacagcauuauaaacagcuguccuacacggcgcuuuucccgcagcugcaaguccacuauugggcuucuuuugcccagcagcggggcauucagaucgaaugcagccaagggcacguguucaccagaggaacacagcgccucauuccucaggccggcaccguuaugcggagacugaucuccgacuggucugugacacagauggucagcgaucugucccaagugaccguccaucucauggcuagccccacggaggagaaugccgaccacugucuugauccccuggugaccaagacacaucugcucucucuguccagccuuaccuaccagcggcacucuaaccgcacagcugaagaggaacuguccgccagagacggggauccuaccuuccacacacaucagcuccaccugguugaccugcggauuagcuggaccacgacaaaucgcgacaucgcguuuggacucuacgauggcuauaagaaagccgcugugcuuaagagaaaccugucuaccgaggcccugaaagggcucaagaucgacccccaaaugccugcuaaaaagccgaagcggggcguccccaccagcgccuccgccccucccagagugaauacaccuucuuucagcggacagcccgauaaaggcuccagcgggggagcuuacaugcugcagaaacuuauugaagagaccgaccgcuuuguuguguucacggaggaagaguccggcaugucugaucagcugugcgggaucgcggccugucaaacagacgauauuuauaaccggaauugccucaucgaacuggucaacugucagauggugcugagaggagcugagaccgaaggcugcgugauuguuagcgccgccaaagcucagcuccuucagugucaacaucacccggccugguacggcgacacacugaagcagaaaaccuccuggacaugccugcucgaugggaugcaguauuuugcgaccacggagucuagcccuaccgagcaggacggacgccaacuguggcuugaagucaagaauaucgaggaacaucggcagagaucccuggauucugugcaggagcucauggagagcggccaggcugucgggggaauggucacaaccacaaccgacuggaaccaacccgccgaagcccagcaggcucaacaggugcagcgcauuaucucccggugcaauuguagaauguacuauaucagcuacucucacgauauugacccugagcuggccacgcagaucaagcccccugaaguucuggagaaccaagaaaaagaggaccuccuuaagaaacaggagggcgcgguggauacauucacccugauucaccaugaacuggagaucuccacaaaucccgcucaguacgccaugauucucgacaucgucaacaaccugcuucugcacguggaaccgaagcgcaaagagcauagcgaaaagaaacagagaguucgguuucaacucgagaucucuuccaauccugaggaacagcgcagcucuauucugcaucugcaggaggccgugagacagcacgucgcucaaauccggcagcucgaaaagcagauguauuccauuaugaaaagccuucaagaugacuccaagaacgagaaucugcuggaucucaaccagaagcugcagcuucagcugaaucaagaaaaagccaaccuccagcuggagagcgaggaacugaauauccucauucgcugcuucaaggacuuucagcugcagagagcuaacaaaauggagcuucggaagcaacaggaagaugugucuguugugagacgcaccgaguucuacuuugcccaggcgcgguggagacugaccgaggaagacgggcagcucggaaucgccgagcuggaacuucaacgcuuccuguauagcaaggucaauaaauccgaugacacagcugagcaucuccuggaacugggcugguuuacgaugaacaaucuccugcccaacgccguguacaaggugguccuucggccccagucuagcugucaguccggcagacaacuggcucuccggcuguucucuaaaguucgcccuccggucgggggaaucagcgugaaggagcacuucgaggucaaugugguuccccuuaccauucagcugacacaucaguuuuuccacagaaugaugggcuuuuucuuuccugggcgguccguggaagaugacgaggucggagaugaagaggacaaaucuaagcucgugaccacaggcauccccguugugaagccucgccagcugauugccaccgacgaugccgucccccuggggccuggaaaaggcguggcucaaggccucacgagaagcuccgggguccggcgcagcuucagaaagucuccggaacaucccguggacgauaucgacaaaaugaaggagcgggcggccaugaacaauuccuuuauuuauaucaaaauuccucagguuccccugugcgugagcuacaagggagagaagaacucuguggauuggggcgaccuuaaccugguccucccuugucuggaauaucacaauaacacauggaccuggcuugauuucgcuauggccguuaaacgcgacuccagaaaggcccugguggcucaggugaucaaagagaagcuccggcugaaaagcgccaccggguccgaagucagaggaaagcuggagacaaagucugaucucaauaugcagcaacaggaagaggaggaaaaagcgcgccugcuuaucggccugagcgugggggacaagaaccccggcaaaaaguccauuuuuggccggagaaaauga

SEQ ID NO: 71115 - RNA, 198 nt, Artificial Sequence
  derived and/or modified sequence opt5 from KIAA0101__Homo_sapiens__NP_001025160
auggugagaaccaaggccgacagcguccccggcacauaccggaaaguuguggcugcccgcgcgccuagaaaggugcugggguccucuacgagcgcuaccaacuccacaucugucagcucccggaaagagcacgugcucugcaaucugaucacccagaugaugaagaaaaaccgcacauucucuuuuauuuucgaauga

SEQ ID NO: 71116 - RNA, 3480 nt, Artificial Sequence
  derived and/or modified sequence opt5 from KIAA0196__Homo_sapiens__NP_055661
augcuggacuuccucgccgaaaacaaucugugcggccaggcuauccuuagaauugugagcugugggaacgccaucauugcggaacugcuccggcuguccgaguuuauccccgcugucuuccgccuuaaggauagagccgaccaacagaaauacggagauauuaucuuugacuucucuuauuuuaagggcccugaacugugggagagcaaacucgaugccaagccggaacugcaggaccuggaugaggaguuccgggaaaauaacaucgagauuguuacccgcuuuuaccucgcuuuccaguccgugcacaaauauaucguggaccugaauagauaccuugaugaccugaacgaaggggucuauauucaacagacacucgagacggugcugcuuaaugaggauggaaagcagcugcucugcgaagcccuguaccuguauggcguuaugcuccuggugaucgaccagaagauugagggggaaguccgggagcgcaugcuugugucuuacuacagauauagcgcugcccgguccucugcggauagcaacauggacgacaucuguaaacugcuccgcuccaccggauacagcucucaacccggcgccaagagaccuuccaauuaucccgaaagcuacuuucagcggguuccuauuaacgagucuuucaucuccauggugaucggccgccugagaagcgaugacauuuauaaucaggucucugcuuacccccuuccugagcaucgguccacagcccuggcuaaccaggccgcgaugcucuaugugauccuguacuuugaaccgagcauucugcacacccaucaagccaaaaugcgcgagaucguggauaaguacuuccccgacaauugggucauuuccaucuauauggggaucacaguuaaccucguggaugcuugggaaccuuacaaagccgcuaagaccgcccugaauaacacacuugaccugucuaacgugagagagcaggccagccgguaugcuaccgucuccgaaagagugcacgcgcagguucaacaguuucucaaggagggauaccugcgcgaggaaauggugcuugauaauauucccaaacugcucaacugccugcgggacuguaaugucgccaucagauggcugaugcuccauacggcugauagcgccugcgacccuaacaauaagcgccugcggcagauuaaagaucagauccuuaccgacucuagauauaacccccgcauucuguuccaacuccugcuggacacagcccaguucgaguuuauccuuaaggaaauguucaaacagaugcucuccgagaagcagaccaaaugggaacacuacaagaaggagggcagcgagcggaugacagaacuggcugauguguuuucugggguuaaaccgcugaccagaguggagaagaaugaaaaccuccaagccugguuccgcgagaucagcaaacagauucugucccuuaauuaugacgauucuacggcggcuggacggaagacaguccagcugauccaggcccucgaggaagugcaagaguuucaccagcuggaaagcaaccugcaggucugucaguuccuugccgacaccagaaaauuucuccaucaaaugauucgcacaaucaauauuaaggaggaagugcugaucaccaugcagauuguuggcgaucuguccuucgcuuggcagcucaucgacagcuuuaccucuaucaugcaagaguccauucgggugaacccuagcauggucacaaagcugagagccacguuccuuaaacuggcuucugcccucgaucugccccugcuucggaucaaucaggcgaacuccccugaccuccugagcgugucccaguacuacucuggggagcugguuagcuaugugcgcaagguccuccagauuauccccgaauccauguuuaccucucugcuuaaaauuaucaagcugcaaacacacgauaucauugaggugcccaccagacucgacaaagauaagcugcgggacuacgcccagcugggaccuagauaugaaguggcuaaacuuacacaugccaucagcauuuucaccgagggcauccucaugaugaaaacgacacugguuggcauuaucaaggucgauccgaaacagcugcucgaagacgggauccgcaaggagcuggugaaacggguggcuuuugcccuucacagaggacugauuuucaauccccgcgcgaagccuuccgagcucaugcccaagcugaaagaacugggcgccaccauggacggguuccacagauccuuugaguacauccaggauuaugucaacauuuacggacuuaagaucuggcaagaagaggugucucggauuaucaacuauaauguugaacaggagugcaacaauuuccugcgcaccaaaauccaggacuggcaguccauguaccaaagcacacauauuccuauccccaaguuuaccccgguggaugagucugucacauucauuggcagacucugucgggaaauccugcgcauuacggacccuaaaaugaccugccacaucgaucagcucaacacaugguacgacaugaagacccaucaggaggugacauccagcagacuguuuucugaaauucaaaccacgcuugggaccuucggacugaauggccucgaucggcugcuguguuuuaugaucguuaaagagcuucagaacuuccugagcauguuucagaagaucauucuccgcgacagaacagugcaggauacccugaagacacucaugaaugcugucagcccccugaaaagcaucguggccaacucuaauaagauuuauuucuccgcuaucgccaaaacccaaaagauuuggacggccuaccuugaggcuaucaugaaaguuggccagaugcagauccugcggcagcaaauugcgaacgaacucaauuauagcugccgcuuugacuccaagcaccuggccgcugcccuggagaaccuuaauaaggcccugcucgcugauaucgaagcccauuaccaggacccuucucugcccuauccuaaagaggauaacacacuccuguacgaaauuaccgcguaucuugaggcugccgggauccacaauccccugaacaagauuuacaucacaaccaaaagacugccguacuucccuaucgugaacuuucucuuccugauugcccagcuucccaagcugcaguauaauaaaaaccucggaauggucugccggaagcccaccgacccuguggacuggccgccccuggugcucggccugcuuacacugcugaagcaauuccacagcagauacacggagcaguuucucgcucugaucgggcaguucauuuguuccaccgucgaacagugcacaucucaaaagaucccugagauucccgccgauguugugggagcgcuucuguuucucgaagacuaugugcgcuacaccaagcugccucggagagucgcugaggcccaugugcccaauuucaucuuugaugaguuccgcacaguucucuga

SEQ ID NO: 71117 - RNA, 2784 nt, Artificial Sequence
  derived and/or modified sequence opt5 from KIAA0226__Homo_sapiens__NP_001139114
augcagagcauccuguaccacggccucauuagagaccaagccugccggcgccagaccgauuauuggcaguucgugaaggacaucagauggcugagcccccauucugcccuucacgucgagaaauuuauuagcguucaugaaaacgaucaguccucugccgacggggcgagcgagcgggcuguggccgaacuguggcuccaacacucccugcaguaccauugucuuucugcccagcugcgcccucuccugggagauagacaguauauccggaaguucuacacagacgcugccuuucugcucagcgaugcucacgugacggccaugcugcaaugccuugaggcggucgaacagaauaacccgcgccugcucgcccagauugacgcuuccauguucgccagaaaacacgagagcccccugcuugugaccaagucucagucccugacagcucucccuagcucuaccuauacacccccuaauuccuacgcccaacauagcuauuuuggcucuuucuccagccugcaccaguccguucccaacaaugggucugagcggcgcagcaccuccuuuccucugagcggaccgcccagaaaaccucaggaaucucggggccaugugucccccgcggaggaucaaacaauccaggccccucccgucagcgugucugcucucgcccgcgacagcccgcugaccccuaacgaaauguccucuagcacgcuuaccucccccaucgaggcuagcuggguuucuucccagaaugauagcccuggggacgccucugagggacccgaauaccuggccauuggcaaccucgaucccagaggccggacagcuuccugucagagccacuccucuaaugcggagagcuccucuagcaaccuguucuccagcagcuccagccaaaagccugacucugccgcuuccagccuuggggaccaggaaggaggcggggagucucagcugagcuccgugcuccgcagaagcucuuuuuccgaaggacagacccugacagucaccagcggcgccaagaaaucccacauccggucucauagcgauacguccauugccucuagaggggcuccgggaggcccccgcaauaucacaauuaucguggaggacccuauugccgagagcugcaacgauaaggcgaaacugcggggcccccucccuuacuccgggcaaucuagcgaaguguccacccccagcucucuguauauggaguacgaaggaggcagauaucuuuguuccggggagggaauguuccgccggccgagcgaaggccagucucugaucuccuaccucagcgagcaggacuuugggucuugcgcugaucuggagaaggaaaaugcccacuucuccaucagcgagucccuuauugccgcuaucgaacugaugaaauguaacaugaugagccagugccucgaggaagaggaggucgaagaggaagacucugauagagagauucaagagcugaagcagaagauccgccugcggagacagcagauucgcaccaaaaaucuccugccuauguaucaagaagccgagcauggauccuuucggguuacauccucuagcucccaguucucuagcagagacuccgcucagcuuucugauagcggcuccgccgacgaaguggaugaguucgaaauccaagacgcggacauccgccggaacaccgccucuucuuccaagagcuuugugucuucccagagcuucucccacuguuuucugcauucuacaagcgcugaggccgucgcuaugggccuccugaaacaguucgaggggaugcagcugcccgccgcguccgaacuugaguggcucgugccugaacacgaugcuccccaaaagcugcugccuauucccgacagccucccgaucucuccugaugacggacagcacgcugauauuuacaaacugagaauccggguucgcggcaaccuugagugggccccucccagaccccagauuaucuuuaaugugcauccggcucccacgcggaagaucgccgucgccaaacagaacuauagaugcgcuggguguggcauucgcaccgacccugauuacaucaagcggcugagauacugcgaauaucucggaaaguacuucugccaauguugccacgagaaugcgcagauggccauucccucccgcgugcugagaaaaugggacuuuagcaaguauuacguuucuaacuucagcaaagaucugcuuaucaagauuuggaaugacccucucuuuaacgugcaggauaucaauuccgcucuguaucggaaagucaagcugcucaaccaggugcgccugcuuagaguccaacugugucauaugaagaauauguucaaaacaugccggcucgccaaggagcugcuggacucuuuugauaccgugcccgggcaccuuacagaagaccuccaccuguacagccugaacgaccucaccgccacgcgcaaaggcgagcugggaccuagacuugcugaacugacacgggccggcgcgacccauguugagcgcuguaugcucugccaggcuaagggguucauuugugaauuuugccagaaugaggaugacaucaucuuccccuucgagcugcacaaauguagaaccugcgaagaguguaaggccugcuaucauaaggccugcuuuaaauccggaucuuguccgcggugcgaacgccugcaagcuagacgggaggcccuugcgagacagagccucgaguccuaccugagcgauuacgaagaggaaccugcugaggcccuggcccucgaagcugccgugcuggaggcuacauga

SEQ ID NO: 71118 - RNA, 1908 nt, Artificial Sequence
  derived and/or modified sequence opt5 from KIAA0226L__Homo_sapiens__NP_001273691
auggugagccaguccaccgucagacaagacucucccguugagccuugggaaggcaucagcgaucacuccgggauuaucgacggaucuccgcggcugcucaacacagaucaucccccuugccagcuggacauucgccuuaugagacacaaggccguguggaucaauccccaggaugugcagcaacagccucaggaccugcagagccaaguccccgcugccggcaacuccgggacgcauuucgugaccgaugcggcuucuccuagcggaccgucccccagcugucucggcgacucucuggccgagacaacccuuuccgaagauacaaccgacagcguugggucugccuccccucacggaagcucugagaaauccagcuccuuuucucugagcuccacagaagugcauaugguccggcccggcuacagccaccgcgugucucucccuaccucccccggcauucuggcuacgagcccguauccugagaccgauucugccuucuuugagcccagccaccugacauccgcugccgacgaaggggcgguucaggugucuagacggaccaucagcuccaauagcuucucuccugaggucuuugugcuccccguggaugucgaaaaggagaacgcccauuucuacguugcugacaugaucauuuccgccauggagaaaaugaagugcaauauccugagccagcagcaaacagaaucuugguccaaagaggugagcggacuucugggcuccgaccagcccgauucugaaaugaccuuugacacgaacauuaagcaggagagcggguccucuacaagcuccuauagcggauacgaaggcugugcugugcuccaagucucuccugugaccgagacacgcaccuaucacgauguuaaggagaucugcaaaugugacguggaugaauuugucauucuggagcuuggggacuuuaaugauaucaccgaaacaugcuccuguagcuguucuuccagcaagucugugacguacgagccggacuucaacagcgccgaacugcucgcgaaagagcuguauagaguuuuucagaagugcuggauucuguccguggucaauagccagcucgccggaucucuguccgcugccggcagcaucguggucaacgaggaaugcgugcggaaagauuucgaguccucuaugaauguugugcaggaaaucaaguuuaagagccgcauuagaggcaccgaggacugggcucccccucgguuccaaaucauuuucaacauccaucccccucuuaaacgcgaucuggucguggccgcccagaauuucuucugugcugggugcggaacacccguugaaccgaaguuugugaaaagacuccgguacugcgaguaccugggcaaguauuucugugacugcugucacuccuacgcggagucuugcauuccugcccgcauccuuaugaugugggacuuuaaaaaguauuacgucagcaacuucuccaaacagcugcucgauucuaucuggcaccagcccauuuuuaaucugcugagcaucgggcaaucccucuaugcuaaggccaaggaacuggacagagugaaagagauucaggaacagcuuuuccauaucaagaaacugcucaagaccugucgguuugccaacagcugcgugaaagagagagcucuguucguuaacuuugcccgcauucggcuuucuuccagccacuucagacagcaacaugucgaggaugugcagcgcgcgggacuggcuuuuacaaauucugccuccagcccucccucugccccuggcgugcgggggucccagagaggagaaaacuucuggaaggucuggccccuccagcaacacgacgcuccggaguacugugaaaaggauugcagcaccugucugaugaucacgccuaucugcguguauuacugguga

SEQ ID NO: 71119 - RNA, 4188 nt, Artificial Sequence
  derived and/or modified sequence opt5 from KIAA0232__Homo_sapiens__NP_001094060
auguaccccaucugcaccguggucguugacggccugccuagcgaguccucuagcuccucuuauccggggcccgugagcguguccgaaaugucucuccugcacgcccuuggaccuguccagacauggcugggccaagagcucgaaaagugugggauugaugcuaugaucuacacgagauaugugcugagccuucugcuccaugacuccuacgauuaugaccugcaggagcaggaaaacgauauuuuccugggaugggagaaaggcgccuacaagaaauggggaaagagcaaaaagaagugcucugaccucacccuggaggaaaugaaaaagcaggcggcuguucaaugucuucgguccgccagcgaugagucuuccgggaucgaaacacugguggaggagcucugcagccgccugaaagaccuucagucuaagcaggaagagaaaauucacaagaagcuggaaggcucccccagcccugaggccgaacucuccccucccgcuaaagaucaggucgagauguauuacgaggccuuuccgccccugucugaaaagccugugugucugcaagagaucaugaccguuuggaauaaaagcaaggugugcuccuacuccucuuccagcucuagcuccacagcucccccugccucuaccgacacaagcucccccaaagauuguaacagcgaaucugaggucaccaaggaaagauccagcgaggugccgacgaccgugcaugagaaaacacagucuaaguccaagaaugaaaaagagaacaaguucagcaauggcaccaucgaagagaaaccugcgcucuauaagaaacagauucggcacaagcccgaagggaagauccgcccuagauccuggucuagcggauccucugaggccggcagcuccagcucugggaaccagggagagcugaaagcuagcaugaaguacgucaaaguucggcauaaggcccgcgaaauuagaaauaaaaagggccggaacgggcaaagccgccuuucucugaagcacggagagaaagcugaaagaaauauccacacaggcuccagcucuagcuccagcucuggcuccgugaagcagcucugcaaacgggggaagcgcccccugaaagagauuggaagaaaggaccccggcagcaccgaggggaaggaucuuuauauggaaaaccggaaagacacggaguacaaggaggaaccucugugguauacagaaccgaucgccgaguacuuugugccccucucccgcaaaucuaagcuggagaccacauauagaaaucggcaggacaccagcgaucugaccuccgaagcggucgaggaacucucugagagcgugcauggacuguguauuuccaacaauaaccuucacaaaacauaccuggccgcuggcacguucaucgacgggcauuuuguugaaaugccugccgugaucaaugaggauauugaccucaccggaacaucucugugcagccuucccgaggauaacaaguaccuggacgauauccaccucuccgaacugacccacuucuaugaggucgacauugaucaaagcaugcuggacccuggcgcuucugaaacaaugcagggcgaguccagaauccucaacaugauucgccagaaaagcaaggaaaauaccgauuuugaggccgaguguugcaucgugcuggacgggauggaacuucagggagagcgggccaucuggacggacucuacauccagcguuggcgcugaagggcuguuccuccaagaucugggaaaccuggcgcaguuuugggagugcuguucuuccagcuccggcgacgccgauggggagagcuucggcggagacucucccgugagacuuagcccgauucucgauuccaccguccucaauucucaucugcuggcuggcaaccaggaacuguuuagcgacaucaaugagggguccggaauuaacucuugcuucagcguguuugaaguccaguguuccaauucugugcuuccuuucagcuucgagacccugaaccucggcaaugaaaacacagauuccagcgccaauaugcuggggaagacccaaucucgccugcuuaucuggacgaaaaacuccgccuuugaggagaaugaacacugcagcaaccucucuacacggaccuguucccccuggagccauuccgaggaaacaagaucugacaaugagacccugaacauucaguucgaagagagcacacaguuuaacgcugaggauaucaauuacguugugccucgcgucuccagcaacuauguggacgaggaacugcucgauuuccugcaggacgaaaccugccaacaaaauucucggacgcuuggagagauccccacccugguuuuuaagaaaacauccaagcucgaaagcguguguggcauucagcuggagcagaaaaccgagaacaagaauuucgaaacaacccaggucugcaacgagucuccucacggggauggcuacagcuccggagugaucaaggacauuuggacgaaaauggccgacacaaauucuguggcgaccguugaaaucgagagaacagaugcugagcuguuuagcgccgacgucaacaauuauuguugcugucuugaugccgaagcugagcucgaaacccugcaggagcccgacaaggccgugcgccgguccgaauaccaucugugggagggccagaaagagucucucgaaaagagagcuuucgccagcuccgagcugagcaacguggaugggggagacuauaccacaccgucuaaaccuugggaugucgcgcaagacaaggaaaauacguuuauucuuggcgggguguacggagagcugaagaccuucaacuccgauggcgaaugggccguugugccucccagccacacaaaagggucccuccugcagugcgcugccucugacgucgugaccaucgcuggcacagauguuuuuaugacccccggaaauagcuucgccccgggccaccgccagcuguggaagcccuuuguguccuucgagcagaacgaccaaccuaaaucuggggagaauggacuuaacaagggcuucagcuuuauuuuccaugaagaucuccugggggcgugcggaaacuuucaggucgaggaccccggccuggaauacuccuucagcucuuuugaccucuccaauccuuucagccaggugcugcacguugaguguucuuuugaacccgaggggaucgccuccuucagcccuucuuuuaaacccaagagcauccuuugcuccgauucugacagcgagguguuccauccgcggauuuguggcgucgauagaacgcaguaucgggcuauccgcauuuccccuagaacacacuuucggcccaucagcgccuccgaacugucuccuggaggcgggagcgaguccgaguucgaaucugagaaggacgaagcuaacauucccaucccgagccaaguggauaucuuugaggacccucaggccgaucucaaaccccuggaagaggacgccgaaaaggagggacacuacuauggcaaauccgagcuggaaucugggaaguuccuuccuagacugaaaaagagcggaauggagaaauccgcucagaccagccucgauucucaggaagaguccaccggcauucugagcgugggcaagcaaaaucagugccucgaauguucuaugaacgagucccuggagaucgaccuugaaagcucugaggcgaauugcaagauuauggcccagugugaagaggaaaucaacaauuucugcggguguaaagcuggaugccaauuucccgccuacgaggauaaccccgucuccagcggccagcuggaggaguucccuguucucaauacagacauucaggggaugaaccgcucccaggaaaagcaaaccuggugggaaaaagcccuguauagcccgcuguuucccgcuucugagugugaggaaugcuacacaaaugccaagggagagagcggccuugaagaguauccugacgcgaaagaaacgcccuccaacgaggagcggcugcucgauuucaauagagugucuagcguguacgaagcucgcugcaccggggagagagacuccggagccaagucugauggcuuucggggcaagauguguagcuccgccucuagcacauccgaagagaccgggagcgaaggaggcggggagugggucggaccuucugaggaggaacuguucucccgcacacaucucuga

SEQ ID NO: 71120 - RNA, 3192 nt, Artificial Sequence
  derived and/or modified sequence opt5 from KIAA0319__Homo_sapiens__NP_001161846
augaccagacugggcuggcccagcccuugcugugcccggaagcagugcuccgaggggcgcacauacucuaacgcugugaucagcccgaaucucgaaacgaccagaauuaugcgggucucccacacauuccccguuguggacuguaccgccgcgugcugugaucugucuagcugcgaccuugcuuggugguuugagggacgcuguuaucugguguccugcccucauaaagaaaacugugagcccaagaaaaugggcccuaucagaucuuaccucacauucguccugcggcccgugcaacgcccugcccagcuucuggauuauggggacaugaugcucaauagaggaagcccguccggcauuuggggagauagccccgaagacauccggaaggaucugaccuuucuggggaaagacuggggccucgaggagaugucugaauacuccgaugacuaucgcgagcuggaaaaggaucuucugcagccuagcggcaagcaggagcccagagggucugccgaguacacagacuggggacuccugccuggcuccgaaggggcuuucaacagcucuguuggagauucccccgccgugccggcugagacccaacaggacccugaacuucacuaucugaaugagagcgccuccacgcccgcgccuaaacuccccgaacggucuguccugcugccccucccuaccacaccgagcuccggcgaggugcuggagaaggaaaaagccagccagcuucaggagcaaucuuccaacagcucugggaaggaaguucugaugcccagccauucccucccucccgcuucucuggagcuuagcuccgugaccgucgaaaaauccccugugcugacagugacccccggaucuacggagcacuccauuccgacaccucccaccagcgccgcuccuucugaguccacacccagcgaacucccuaucucccccaccaccgccccgcgcacagucaaggagcugacgguuucugcgggcgacaaucugaucauuacccucccugauaacgaaguggagcugaaggccuuuguggcucccgcucccccugucgaaacaaccuacaauuacgaguggaaccuuaucagccauccgacagacuaucagggcgagauuaaacaggggcacaagcagacccugaaucucucccaacugucugugggacuuuacguuuucaaagugacggucagcuccgaaaacgcuuuuggcgagggguucgugaauguuacagugaagcccgccagacgggucaaccugccucccguggccgucgugagcccucagcuccaggaacugacccugccccucaccucugcucugaucgauggaucccaaagcacagacgauaccgagauuguuucuuaucacugggaggaaaucaauggcccuuuuauugaggagaaaacauccguggacagccccguccuucgccugucuaaccucgauccggggaacuacagcuucagacugacggugaccgacuccgauggagcgacaaauagcaccacagccgcucugaucguuaacaaugccguggacuauccucccgucgccaacgcuggcccuaaucauaccaucacgcuuccccagaacucuauuacccucaauggcaaccaguccagcgaugaccaccagaucgugcuguacgaauggucccuggggccgggaucugaaggcaagcaugugguuaugcaagggguccagacaccuuaucuccaccugagcgccaugcaggagggagacuacaccuuucagcuuaaagugacagauuccucucggcaacagagcaccgcgguggucacggugauuguucagcccgagaauaacagaccucccguggcugucgccggccccgacaaggaacugaucuucccuguggaguccgccacacucgaugggucuagcuccagcgacgaucacggcauuguguuuuaccauugggaacacguucgcggaccgucugcugucgagauggaaaauaucgacaaggccaucgcuaccgugacaggccugcagguugggaccuaucauuuccggcugaccgugaaagaucaacagggacuuuccagcacaucuacgcucaccgucgccgugaagaaagagaacaauagcccucccagagcgcgcgccggcgggcggcacgugcugguccugcccaacaauagcauuacacucgacggaucuagauccaccgaugaccagcgcaucguuagcuaccuguggauucgggauggccaguccccugcugccggggacgugaucgauggcagcgaccauucuguggcccuucaacugacaaaccucgucgagggaguguauaccuuccaccugagaguuacggacagccagggcgccuccgauacagacaccgcgaccguggaaguccagcccgauccucgcaagucugggcugguggagcuuacacuccaaguuggagugggccagcugaccgaacagcggaaagacacacuggucagacagcucgccgugcugcuuaacguucuggauagcgacauuaaggugcaaaagauccgcgcucacuccgaucucucuacggucaucguguuuuacgugcagagccggccgcccuucaaaguccugaaggccgcugagguugccagaaaucugcauaugcggcuuuccaaagaaaaggccgacuuucuccuguucaaagugcugcgcguggauaccgcugggugccuccugaaguguucuggacacggccauugcgacccucuuacaaagagaugcauuuguagccaccuguggauggagaaccucauccagcgguauauuugggauggggaguccaauugcgaauggagcaucuuuuacgucaccgugcuggcguucacacugauuguucuuaccggcggauuuacguggcuguguaucugcuguugcaaaagacagaagcgcaccaaaauucggaagaaaacaaaguauaccauccucgacaacauggaugagcaagaaagaauggagcugcgccccaaguacggcaucaaacacagaucuacagagcauaauuccagccucauggugucugaauccgaguucgacagcgaccaggauaccaucuuuucccgggaaaagauggagcgcgggaacccuaaagucucuaugaauggaagcauuagaaacggcgccuccuucagcuacuguucuaaggaccgguga

SEQ ID NO: 71121 - RNA, 2547 nt, Artificial Sequence
  derived and/or modified sequence opt5 from KIAA0319L__Homo_sapiens__XP_011540484
auggagaagagacugggcgugaaacccaacccugccagcuggauccucuccggguacuauuggcagaccucugcuaaguggcugcggagccuuuaccuguucuauacaugcuuuuguuucuccguccucuggcugucuacggacgccagcgaaucccgcugccaacagggaaaaacccaguuuggcguugggcuuagaucuggaggcgagaaucaccuguggcuccuggaagggacaccgagccugcaguccuguugggcggcuugcugucaagauagcgccugccauguguucugguggcucgagggaauguguauucaggccgacugcucucggccccaguccugucgcgcuuuuagaacccacagcucuaacuccaugcugguguuccuuaagaaauuucagacagccgaugaccugggcuuccucccugaagaugacgucccccaucugcuuggccugggguggaauugggcuagcuggcggcaaucuccuccccgcgccgcgcucagaccugccguguccagcuccgaucagcagucucugauccggaagcugcagaagcgcggaagcccguccgacguugugacccccauugucacacaacacagcaaagugaacgauucuaaugagcucggcgggcugaccacguccggaagcgcugagguucauaaggccaucaccauuucuagcccucuuacaaccgaccugacagcugaacucuccggcgggcccaaaaacgugucuguccagccugagaucagcgaaggacuggccaccacgcccuccacacagcaagugaaaagcucugagaaaacccagaucgcggugccgcagccugucgcccccuccuacagcuaugcuacaccuacaccccaggccucuuuucaauccaccagcgcucccuacccuguuauuaaggagcuugugguguccgccggcgaaucuguccagaucacccugccgaagaaugaggugcagcucaacgccuauguucugcaggaacccccuaaaggcgagacguacaccuacgauuggcaacugauuacacaccccagagacuauagcggggaaauggagggaaagcacucccagauccucaaacugucuaaacuuaccccuggccuguacgaguucaaagugauugucgaagggcagaaugcucauggagagggcuaugugaacguuacagugaagcccgaaccgcggaaaaaucgcccucccaucgcgauugucagcccucaguuucaagagaucucccuccccaccacgagcacagugaucgaugggucucaguccaccgacgacgauaagauuguccaguaccacugggaagaacugaagggaccucuuagagaggaaaagaucagcgaggacaccgccauucugaagcucucuaaacuggugcccggcaacuauacauucucccugaccguuguggauagcgacggcgcuacaaauucuacgaccgccaaccucacagucaauaaggccguggauuacccgccuguugcuaacgccgggcccaaccaggugaucacccugccccaaaauagcauuacacuuuuuggaaaccaguccaccgacgaucauggcaucacgagcuaugaauggucucuguccccuagcuccaaagggaaggucguggagaugcagggagugcggaccccgacacuccaacugucugcgaugcaggaaggcgacuacaccuaccagcugacaguuaccgauacgaucgggcagcaagcuacagcccaggucaccgugauugugcagcccgagaauaacaagccuccccaggccgacgcuggcccugauaaagagcuuacacuccccgucgacagcaccacccuggacggauccaagucuagcgaugaccaaaagaucauuuccuaucugugggaaaagacacagggcccugauggggugcagcucgagaaugccaacucuagcguugcuacggugaccggacugcaggucggcacauacguguucacccuuacaguuaaagacgaacgcaaucugcaaucccagagcucugugaacgucaucgugaaggaggagauuaauaagcccccgaucgccaaaaucaccgggaacguugugauuacgcucccuacauccaccgcggaacuggauggaagcaagucuuccgacgauaaaggcaucgucagcuaucuguggaccagagacgaggggucucccgccgcuggcgaagugcuuaaucacuccgaucaccauccuauucucuuccugagcaaccugguggagggaacauacaccuuucaccucaaggucacagacgccaaaggcgaauccgauacggaccggaccacaguugaggugaagcccgauccgagaaagaauaaccugguggagaucauucuugacaucaaugucagccagcugaccgaacgccucaaagggauguucauucggcaaaucggagugcugcugggcguucuugacucugauaucauugugcagaagauccagccuuauacagagcagagaaaaauuagcuccgucgaggcuucucucaaguga

SEQ ID NO: 71122 - RNA, 3213 nt, Artificial Sequence
  derived and/or modified sequence opt5 from KIAA0355__Homo_sapiens__NP_055501
auguacugcuguagcgcccaggacuccaagauggauuauaaaagacgguuccugcucggcgggucuaagcaaaaagugcagcagcaccagcaauaccccaugccugagcugggacgcgcucuuagcgccccgcuggcguccaccgcuacaacggcuccccucggcucucugaccgccgccgggagcugccaucacgccaugccucauacaacccccaucgcugacauucagcagggaaucuccaaguaucuugaugcccugaacgucuuuuguagagcgucuacauuccucaccgaccuguuuagcacaguuuuccgcaauucccacuacagcaaagccgcuacccagcugaaggaugugcaagaacaugugauggaggccgcuucucggcucacguccgccauuaagccugaaaucgcgaaaaugcugauggagcuuagcgccggcgcugccaacuuuaccgaccagaaggaguucucucugcaggauauugaaguccucgggagaugcuuucugacagugguucaggugcacuuccaauuucuuacccacgcucugcagaaaguccagcccguggcccauuccuguuucgccgagguuaucgugccugaaaagaaaaauagcggaucuggcggcgggcucuccggaaugggccacacaccggaggucgaagaggcugugcggagcuggcgcggggcggccgaggcuaccuccagacugcgggaacgcggaugcgacggcugucuggccgggaucgaggugcaacagcucuuuugcucucagagcgccgcuauucccgaacaucagcugaaggagcuuaacaucaagauugauuccgcccugcaagcguauaaaaucgcucucgaaagccugggacacugugaguacgccaugaaggccggcuuccaccuuaauccuaaagcuauugaggccucucugcagggcugcuguuccgaagcugaggcccagcagacggggagacggcaaacacccccucagcccaugcagugcgaacucccgaccgucccuguucagaucggaagccauuuucugaagggcgugucuuucaacgagagcgcggccgacaaucugaaacucaagacacacaccaugcugcaacuuaugaaagaagcugggugcuauaacggaauuaccucccgcgaugacuuccccgugacagagguccugaaucagguguguccuucuacguggagaggcgccugcaagaccgcuguucagcuccuguuugggcaggccggacuuguggucguggauacagcgcaaaucgagaacaaggaagccuacgcuccccagaucagccuggagggcucccggauuguugugcagguccccagcaccuggugucucaaagaagacccugccacaaugucucugcugcaacgcucccucgacccggagaagacccugggccuuguggauguccuguacacggcugugcucgaccugaauagauggcgggccgggagagaacaggcccugcccugcauccagauucagcuucaacgcgagaucugugauuucggaaaccaggcugaccucccuagcggcaaugggaacaaaucuuccggaggccugcagaagacauuuagcaaacugaccucccgguucaccaagaaggcgucuugcacaagcuccucuagcuccaccaauuauagcauucagaacacacccucuaaaaacaucuuuaucgccggguguuccgaggaaaaggcuaaaaugccuggcaauauugauacgagacuccaaagcauccugaacauuggaaauuucccccgcaccacagacccgucucaguccgcccagaacagcucuaauaccguugccaacggcuuucuuauggagcggagagaaaauuuccugcauggggaugacggaaaggaugagaaaggcaugaaccucccuacagaccaggagaugcaagaagugaucgauuuucugagcggguucaauaugggacagucccaccagggcagcccccuggucacccgccauaacucugcugccacggcgauggugaccgagcaaaaggcuggggccaugcagccucagcagcccucccuuccuguucccccgccuccccgggcuccccaagccggcgcccacacaccucucaccccgcagcccggacuggcgccucagcagcaaagccccaagcagcagcagccucaagugcaguacuaucagcaucugcuccagcccauuggcccucaacagcccccgccucagcccagagcuccugggaaauggguccacggauccucucaacagcccgcccaggccgugggcgcugggcugagcccgcuuggacaguggccuggcaucuccgaccugucuagcgaccucuacucccuggggcuggugucuagcuauauggauaauguuauguccgaaguccuuggccaaaagccccagggaccucgcaacaauacauggcccaaccgggaccagagcgauggcguguuugggaugcucggagagauccugcccuucgacccugccgugggcucugauccggaauuugcuagauacgucgccggggugucccaggcgaugcaacagaaacgccaggcccagcacggacggagacccggcaauccucgggggaacuggcccccuauggacgaugcucaucgcaccuggcccuucccugaguucuuuacggagggcgacggacugcacggcggguggagcggagcccaaggcgauucugcuuccagcucugacgaaacauccagcgccaacggggauucccucuucagcauguuuucuggaccggaccugguugccgcugugaagcagagacggaaacacagcuccggcgagcaggauaccucuacacuucccagcccuccccugcucaccaccgucgaagacgugaaucaagacaacaagacaaagacguggccucccaaagcgccguggcagcauccuucuccccugcccuccacccugccuagccccuccgccccucuuuaugcuguuacaucuccgggcagccaguggaaugauaccaugcagaugcuccaaucccccgugugggccgccacaaacgacugcagcgcugccgcguucucuuacguccagaccccuccccagccucccccgccucccgcucacaaggccgccccuaaaggguuuaaggcuuuccccggaaaaggcgagagacgcccugccuaccugccccaguauuga

SEQ ID NO: 71123 - RNA, 1704 nt, Artificial Sequence
  derived and/or modified sequence opt5 from KIAA0391__Homo_sapiens__NP_001243607
augaccuucuaccuguuuggcauccgcagcuuccccaagcucuggaaauccccuuaucuggggcuuggaccgggccacucuuacgugagccuguuucucgccgaccggugcgggauucgcaaccagcaaagacuguucucccuuaagacaaugucuccccagaauacgaaagcuaccaaccugaucgccaaggcgcgguaucuccgcaaagaugagggaagcaauaagcaggucuacuccguuccucacuuuuuccuggcuggcgccgccaaggaaagaucucagaugaacagccaaacagaggaccaugcucuggcccccgugcggaauaccauucagcucccuacacagccccugaacuccgaagagugggauaaacuuaaggaagaccugaaagagaauaccgggaagaccagcuuugagucuuggaucauuucccagauggcuggaugucauagcucuaucgauguggccaaaucccuccuggcgugggucgccgcuaagaacaauggcaucgugagcuaugaccuucugguuaaguaccucuaucugugcguguuccacaugcaaacaucugaagucauugauguguuugagaucaugaaagcccgcuacaagacgcuggaaccuagaggcuacucccuccugauucgggggcuuauccauagcgaccgcuggagagaggcucugcuccugcuugaggauauuaaaaagguuaucaccccguccaaaaagaacuauaaugacuguauucagggagcccugcuccaccaggaugugaacacagcguggaaucuguaccaggaacugcucggccacgacaucguccccaugcuggagacccuuaaagccuucuuugauuucgggaaggacaucaaggacgauaacuauucuaauaaacugcucgacauucugagcuaccuucggaacaaccaacuguauccuggagaauccuuugcucauagcaucaagacaugguucgagucuggccagugcuccggguguggaaaaaccauugaaagcauccagcucucucccgaggaguacgaaugccugaagggcaaaauuaugcgcgaugugaucgacggcggggaucaauauagaaagacgacaccucaggagcugaagcgguucgaaaauuuuaucaaaagcagacccccguucgacguggucauugauggacucaacguugccaagauguuuccuaaagugagagagucccagcugcuucugaauguggucucucagcucgcuaagcggaaccugagacugcuugugcucggccgcaaacacaugcugcggagaagcucccaauggagccgcgacgaaauggaggagguucagaagcaggccucuuguuucuuugccgaugacaucuccgaagaugaccccuuccugcucuacgcuacccugcauagcgggaaucacugccgguuuauuacaagagaccuuaugcgcgaucacaaggcgugucugccugacgccaaaacccagagacucuucuuuaaguggcaacagggacaucagcuggcuaucgugaaccgguuccccggcucuaaacugaccuuucagcgcauucuuuccuacgauacagucgugcaaacgaccggggacagcuggcacauccccuaugaugaggaccucguugaacggugcuccugugaggugccuacaaaguggcugugccugcaucagaaaaccuga

SEQ ID NO: 71124 - RNA, 4935 nt, Artificial Sequence
  derived and/or modified sequence opt5 from KIAA0586__Homo_sapiens__NP_001231118
auguucuggugcggcaccuguuuugugacaaacaauaugaaggggagcgaggucucccuggaaaagaagaaaaagaucaaaaugcccguuaagagacuccgggagguggugucucagaaccacggagaccaucugguccuucugaaggaugaacucccuugcgugccgcccgcccugagcgcuaauaaacgccuuccuguuggcacggggaccucccugaacggaacaucuagaggcagcuccgaccucaccucugcccggaauuguuaccaaccccugcuggagaacccuauggugagcgaauccgauuucagcaaggacgucgcggugcagguucucccccuggauaaaauugaggagaauaacaagcagaaagcuaaugacaucuuuauuucucaguauacaauggggcaaaaggaugcccuucgcaccgugcugaagcagaacgucucccucugccugacaggauggagcgaccacucuggcgugaucaccacgcauuguucccuuuaccugcucagacugaugcggagcucucaccugucccucccuagcuccugggauuaucgcgcccagucuaugccgguguucaaagaagucaagguucaucugcuugaggacgcuggcauugaaaaagaugccgugacccaggagacaagaaucagccccuccgggaucgacagcgcuaccacaguggccgcggccaccgcugccgcuauugccacggcggccccucugaucaagguccaaucugaucucgaggcuaaaguuaauuccgugacagaacugcuuagcaagcugcaggagaccgacaaacaccuccagcgggugacagaacagcaaaccucuauucagcgcaagcaggagaagcugcacugccaugaccacgaaaaacaaaugaacgucuuuauggagcagcauaucagacaccuggagaagcuccagcagcaacagauugauauccagacccacuucauuagcgccgcucugaaaacauccucuuuucagcccgugagcaugccuuccagccgggccguugaaaaguacucugugaaacccgagcauccgaaucuuggauccuguaacccuagccuguauaauacguucgccucuaagcaagcuccccucaaggaagucgaggacaccuccuuugauaaacaaaagagcccucuggaaacacccgcgccccgcagauucgccccugugccggucucccgggacgaugagcuuucuaaacgcgagaaccugcucgaagagaaggaaaacauggaggugagcugccacagaggcaauguucggcugcuggaacagauccucaacaauaacgacucccugaccagaaaaucugagagcuccaauacaaccagccuuacgcgcucuaagaucggguggacacccgagaagaccaaccgguuuccuuccugugaggaacuggaaaccacaaaagugaccaugcaaaagagcgaugacguccuccaugaucugggacagaaagagaaggagacaaauucuauggugcagcccaaagaaucccugagcaugcuuaagcucccugaccugccccagaacucuguuaagcugcagacgaccaauacaaccagaagcgugcucaaagaugcugagaagauucugcgcggcguccaaaacaauaaaaaggugcuugaagagaaccuggaagccaucauucgggccaaagacggggcugccauguacucccucaucaaugcgcugagcacaaacagagagaugucugagaagauucgcauccggaaaaccguggacgaauggaucaagacgauuuccgcugagauccaggaugaacugagcagaaccgacuaugagcagaagcgcuucgaucagaaaaaucagcggacaaagaaaggacagaacaugaccaaggacauuagaacaaacacccaggauaaaacgguuaauaaguccgucaucccgcgcaagcacucucaaaaacagauugaggaacauuuucggaaccuuccuaugagaggcaugcccgccagcucccuccagaaggagcggaaagaaggccugcugaaggccacaaccgugauccaggacgaggauuacaugcuccaaguguacgggaaaccugucuaucagggacaccgcucuacacugaagaagggccccuaccuuagauucaauagcccuucccccaaaucucggccgcagagaccuaaggugaucgaacgcguuaaagggaccaaggugaaaagcauucggacccagacagacuucuaugcuacgaagcccaagaaaauggauuccaagaugaaacacagcguccccgugcugccucauggagaccaacaguaccucuuuucuccguccagagagaugcccaccuucagcggcacacuggaagggcaccugaucccuauggccauucuucucggacagacccaaucuaacuccgauacaaugcccccugcuggcguuaucgugagcaagccccauccugucaccgugacgacaucuauucccccguccagccgcaaaguugagaccggcgugaagaaaccuaauaucgccauugucgagaugaaguccgaaaagaaagaucccccucagcugaccguccaggugcugcccagcguggacaucgacucuaucagcaacuccucugcggacguucucagcccgcuguccucuccuaaggaggccagccuucccccugugcagacauggauuaaaacccccgaaaucaugaagguggaugaggaggaagucaaauuucccgggacaaauuucgacgagauuaucgaugugauucaagaagaggaaaagugcgacgagaucccugauuccgagccgauccuggaauuuaacagaucuguuaaggcugacagcacgaaauauaauggacccccuuuucccccuguggccuccaccuuccagcccacagcugauauucucgacaaggucaucgagcggaaagaaacccuggagaacagccugauucaguggguggaacaggagaucaugucucgcauuaucuccggccuuuucccuguucaacagcagaucgccccgagcauuucuguguccgucagcgagacauccgaaccccucaccucugauaucguggaggggacgagcuccggagcgcugcagcuguuuguugacgccggcgugccugucaauagcaacgugauuaagcacuucgugaaugaagcucucgccgagaccaucgcugucaugcugggggauagagaagccaaaaagcaaggccccguugccacaggagugucuggcgacgcuuccaccaacgagacauaccuuccugcgcggguguguacaccccugccgaccccucagcccacgcccccuugcagccccucuagcccugccaaggagugcguccucgugaaaaccccggauuccucucccugugacagcgaccacgauauggcuuuuccuguuaaggaaauuugcgccgagaaaggggacgauaugcccgccaucaugcuggugaauacaccuaccgucacccccacaaccacgccgccucccgcugccgcgguguucacaccuacccuguccgacaucucuauugauaaacuuaaaguuagcucccccgaacugccuaagcccuggggagacggcgaucucccgcuggaggaggaaaacccuaacagcccccaggaggaacuccauccccgcgcuaucgugaugucugucgccaaggacgaggaaccugaguccauggauuuuccggcccagcccccucccccugagcccgugccuuucaugccguuccccgcugggacaaaagccccuagccccucccaaaugccuggaucugacagcuccacccuggaaucuacacuuagcgucaccgugacggagaccgaaacacuggauaagcccauuuccgagggcgaaauccucuuuagcugugggcagaaacuggcgccgaagauucuggaggacaucggccuuuaucugaccaaucucaacgacucucuguccagcacacuccacgaugcuguugagauggaagacgauccucccucugagggacaggugauuagaaugucccauaaaaaguuccacgccgacgccauccugagcuuugcuaagcaaaaucaggaaucugccgucagccagcaggcuguguaccauuccgaggaucuugaaaacucuguuggcgagcugagcgaggggcaacggccccagcucaccgccgcggccgaaaauauccugaugggacacucccuguacaugcagccucccgugacgaacacacagagccuugaccaacagugcgauccuaaaccgcugucccgccaguucgacaccgucucuggcagcauuuaugaggauuccugugcuucucacgggcccaugagccucggagaacuggagcucgagccuaauuccaagcuggugcuucccacaacccugcugaccgcccaggaaaacgacgugaaucucccuguugcugccgaggauuuuucucaauaccagcugaaacagaaccaagacgucaaacagguggaacauaagcccagccaguccuaucuuagagugcggaauaagagcgauaucgccccgucucagcaacaggucuccccuggcgacauggaccgcacacagauugagcugaaccccuaccucacgugcguguucagcgggcugggcguucacgugaaaaaggucucuuguaucggaaagcucggccuguggagauuugugauucagaucaucuccagcccucggugggaaucuuccgcuacccuuagauucacagaugcgcccugccaagacguuagcgaugccgcuguguccgagccucgcgggcugcugagcgucucugagagccagcauaaugccggaggccacgggguguuuggaggccgguaucuccugaacgggaaaagacagcccgcccagugucuuugccauugguucuga

SEQ ID NO: 71125 - RNA, 3828 nt, Artificial Sequence
  derived and/or modified sequence opt5 from KIAA0825__Homo_sapiens__NP_001139150
auggacugggaugacgaguacagccacaacuccuucgaucugcauugccuccugaauagcuuucccggcgaccuugaguucgaacagaucuuuagcgauauugacgaaaagaucgagcaaaacgccgcuuccauuaaacacuguaucaaggaaauucagucugagaucaauaaacagugcccuggggugcagcugcaaaccacaacggauuguuucgaguggcucaccaacuauaauuacagcacauccgaaucuagcuuuaucucccauggagaccugauuaaguucuuuaaaacccuucaggaucugcucaagaacgagcagaaucaggaagagaugacacuggaccugcucugggaucugagcugccacucuuccgucagcuucccgucuacccuuuccggcaccagcuuucauuuccugucuagaacaucccuccacagcguugaggacaacuccucuauggaugucaagagcaugugggacgacauccggcugcaccuucgcagauuucugguguccaaacuccaaagccauaaugaaauuaacaauucucagcagaagauccugcugaaaaagcagugucuccaacagcugcuuuuccuguaucccgaguccgaagugauuaucaaauaccagaacauucaaaauaagcuccuggccaaccuucuguggaauugcuuuccuagcuauaaccgggauucuaaccucgacgugaucgcgcacggguaccagagcacgaugcugaagcuguauuccguuaucaaagaggauuucaauacccucugugaaauucuggcucccucuagcauggugaaguucaucaaagagacauaccuugacaccgucacagaggaaauggccaaguuucuggagaacuucugcgaacuccaguuucgcgagaaugccgugagaguugugaaaaccuccaagucuucuuccaaacaucggggagcuguccacgcccuggugacgacagaauguccucagaagggccgcaacuucagccuuccccuggauaagguggaguuucucucucaacugauuaaauccuucaugaagcuggagaaagggguccaggaacucuuugacgagauccugcuuagccugaagauuaccagagauacauccggaauccucgaaaaaucugaccgggagguugugauggaaaagccucgcgcuaaugagaccaacaucccgagcgagcagucccugcccggcaaggaagccacccugcuugauuucggcuggagaucugcguuuaaagaggugagccucccuauggcccacugcgucgugacagcuauugaaggguucuccacgaagauccugcagcaagagcagaaugagcggagcucugccguuuccuacgcuaugaaccuggugaauguccaacagguguggcaggacagccauauguuucccgaagaggaacagccuaaaaagauuggaaaauucuguucugauaucauggagaagcucgacaccaugcugccccuugcccuggcgugccgcgacgauuccuuucaggaaauuagagccaaccucguugaggcuugcuguaagguggccacagcuguccugcagcggcugcaagagcgcgccaaagaagugccgagcaaggccccucuuaaaaaucuccacaccuaucugucuacagcugucuacguguuccagcauuucaagagauaugacaaccugaugaaagagaugaccaagaagcccaucuuucucguucuggugcagcgguaccaagaguucaucaauacgcuucaguuucaggucacaaacuauugcgugagaguuugugcgaccagcauucugcaggaugccgaaucccaccauugggacgauuacaaggcuuucuaugaaggcgagcgcugcagcuuuucuauccaaauguggcacuacuucuguuggucccuccacuacgaccuguggaccauucugccucccaaacuugcccaggagauccucguggaaguccuggagaaaagccugucccuccuggccucucgguaugcuagagcccaucccagccgcaagcggacaccucagcuuagacuggaugugaccacaauucucaucugcacggaaaauaugcugugguccguguguaccucuguucagaaacugcuuaacccgcaccaacauacagacgauaagauuuuuaaaauccacacccacugcaacaaucucuucacaacccuggucauccugacgagcccccucaccgagcuguacaagacauuucagcaugggcuugacgaauccgcgucugauagccugaaguccuucuuuaaacagccucucuauugggugagcuguauuucucacuucuaccccucccugcugcgcaccccuagcgcuggaggccuuaaggccgaggggcagcugaaacuccugcucucucaaccccggugcaacuggaaucugcuucuggagacacuccugcaucacgacggacugcuucugagaauccuccugaaguccagcaaacaggugucugauaccgaaaacaaucucaaccagggcccgucccugauggaggccauuuuuaagauccuuuaucauuguagcuucuccccucaaacguucgcuaaugucuuugugagcuacauggaagaggagcagcugugggacuuccucuauaacauucccguuucuacaugcguggaauacgagcuggaagucauccgcugccugcggcuugcccugaccgacgcuaucaaggauacagugcagcagauuguuagcgugauguccucuagacgcaauugugagaccaaccucaauaaacacaucgucccugacugccugcucgaaagcaugcccaaggaguggaacuacuccccuaaagagaccaaucggaaggaaucuuguaagagcuuuacaagacugacggcccaagcgguguccauuguuaucucuaaacuucccaccgugauugccugccugccgccucccgucaaguauuucuuuuuccugagcgagcggaaaauguccaagaaauuuguggaacucaagaaagcuggccugcuuguguggaaccugaucgucaucauuugucgcaucuucgaggaugggaauacaguugaacuccugaccggagccagccucgacagauggucuaaggagaagcugggccuuauuugcaugugucugaaauccaucaugggggaucagacaagcauucacaaccagaugauccagaaggugauccaaucuauugagcagcagaaacccaacuggaucgaacggcagcugcucaaggcuagaaaacuguccaccgagugcgccuuuaugacgauugaaaagagcacagcgcuucaagagggagacguggcccuggaacucaccgagcagaaaaucaauaccaugguccuggaucucugucauaagccuggcgggcgcgaguaccugcggcagauuuaucacaucaugcagcuuaacgaagaguaccugaaggaacaacuguucuccaugaacucuagcgaggagaaaccgcuccccauuagaccucugaagacaacccuucgcuccaucgaagaccagcccagcgcuuuuaauccuuuccauguguauaaagccuucucugagaauaugcuggaucagguuuccaucacaaaguggaacuggaauugggcuaaacuccugcccaacuaccucagacuggacaagaugacguuuagcgugcuucugaagaaucggugggaaaugaaaaaggaugagacccuggaagaggaggaaaaagccauucucgagcaccugaagcaaaucugcacaccucagaacucuagcgccuccgacaauauugaggaacaguga

SEQ ID NO: 71126 - RNA, 1845 nt, Artificial Sequence
  derived and/or modified sequence opt5 from KIAA0907__Homo_sapiens__NP_055764
augagcgccggcuccgcuacccaccccggggccggaggcagacggucuaagugggaccagccugcgccggcuccccuccuguuccugccucccgccgccccugggggagaggugacaagcuccggcgggucucccggaggcacgaccgcugccccuagcggcgcucuugaugccgcggccgcugucgccgcuaaaaucaacgccaugcugauggcgaaggggaaacucaagccgacacaaaaugccuccgaaaaacugcaggcucccggaaagggccuuaccucuaacaagagcaaagacgaucugguuguggccgagguggaaauuaaugacgucccucucacaugccgcaaccugcugaccagagggcagacacaggaugagaucucccggcucagcggagcugccgugucuacccgcggcagauuuaugacgaccgaagagaaggccaaaguugggcccggagaccggccucuguaccuucaugugcaaggccagacacgcgagcuggucgauagagcugugaaucggauuaaggaaaucauuaccaacggcguugugaaagcggccacagggaccucccccacguucaauggagcuacagucaccguguaucaccagccggccccuaucgcccagcucagccccgcugugucucaaaagccucccuuucaguccggcaugcauuacguccaggacaagcuguucguugggcuugagcacgccgugcccacauuuaacgugaaagaaaaggucgagggaccuggcuguagcuaucugcagcauauccaaauugagaccggggcgaaaguguuccuccgcggaaagggcucuggcugcaucgaaccggcuuccgggagagaggccuuugaacccauguacauuuauaucagccacccuaaacccgagggacuggccgcugccaagaaacugugugaaaaucuccugcagaccguucacgcugaguacucccgguucgugaaccagauuaauacagccgucccucuucccggcuauacgcaaccgucugcgaucagcuccgugccuccccagccucccuacuacccuagcaacggguaucagucuggauaccccguugugccgccuccccagcaacccguccagccuccguauggcgugcccuccauugucccucccgccgugagccuggcuccugggguucuccccgcccugccuaccggcgugcccccggucccuacacaguaccccaucacccaggugcaaccucccgcuucuacaggacagagcccgaugggcgggccuuuuauccccgccgcgccuguuaagaccgcccuucccgcuggaccccagccucagccgcaaccccagccuccccugccuucccagccccaggcccaaaagcgcagauucacggaggaacucccugaugagcgggaaucuggccugcugggguaucagcauggaccgauucacaugacaaaucucggcaccggguuuagcucccagaacgagaucgaaggcgcuggaagcaaacccgccucuuccagcggcaaggagcgcgagagagaccggcaacugaugccucccccugccuuccccgugaccgggauuaaaacagaaucugaugagagaaauggauccggcacccuuacagggagccaugacuacccggcuaagaaaaugaagacgaccgaaaagggauuuggccuggucgcguaugccgcugauuccucugacgaggaagaggagcacgggggccacaaaaacgccagcuccuucccucagggauggucucucggcuaccaguaccccagcucccagccccgcgccaagcaacagaugccuuucuggauggcucccuga

SEQ ID NO: 71127 - RNA, 4833 nt, Artificial Sequence
  derived and/or modified sequence opt5 from KIAA0922__Homo_sapiens__NP_001124479
auggccggccugagacggccccagccugggugcuacugucgcaccgcugccgcggugaaccuccugcuuggagucuuccaaguucugcucccgugcuguagacccggcggggcucagggacaggccaucgagccucugcccaaugugguggaacuuuggcaggccgaggaaggcgagcugcuccugccuacacaaggggacagcgaagagggacuggaggaacccucccaggagcagucuuuuagcgauaaacucuucuccggcaaaggccugcacuuucagccuucuguccuugacuucgggauucaauuucugggacauccgguggcuaagauccuccacgccuauaaccccagccgggauuccgaaguuguggucaauucuguguucgcugccgcgggccauuuucacguuccucccgugccuugccgcgucauucccgccauggggaaaacgagcuucagaaucauuuuucugccgaccgaggagggauccaucgaaagcucucuuuucaucaacacauccagcuacggcgugcugucuuaucauguguccgggauuggaacccggcgcaucagcacagagggcucugcuaagcagcucccuaaugccuacuuucugcugcccaaaguccaguccauucagcucagccaaaugcaggcugaaaccacaaacaccucccugcuucagguucaacuggaguguucucuccacaauaaggugugccagcagcugaagggcuguuaucuugaaagcgacgaugugcugagacuccagauguccaucauggucacgauggagaacuucagcaaagaguuugaagagaauacccaacaucugcuggaccaccucucuauuguguacguugccacagaugaauccgagaccagcgacgauucugcggugaacauguauauccugcacagcggaaauucccuuauuuggauccaggacauccggcauuucucucagcgcgaugcccugagccuccaguucgaaccuguccugcuucccacauccaccacgaacuuuacaaagauugcuagcuuuaccugcaaagccgcuacaucuugugacuccgggaucauugaggaugugaagaaaaccacccacacacccacgcugaaggccugccucuucagcucuguugcccaaggcuacuucagaauggacuccagcgcuacccaguuucacaucgagacacaugaaaauaccuccgggcuguggucuauuugguaccggaaccacuucgaccgcagcgugguccugaaugauguguuucucuccaaggagacaaaacauaugcugaagauccuuaacuucaccggaccucuguuucucccgcccggcuguuggaacaucuucucucugaaacuggcggucaaggacauugccaucaaucuuuuuacgaacguguuccucacaaccaauauuggggcuaucuuugccauuccucugcagaucuauagcgcccccaccaaagaaggaucccugggcuucgagguuaucgcucacugcggcaugcauuacuucaugggaaagagcaaagccgggaacccuaauuggaacggcucucucucccuggaucagagcacauggaauguggacucugaacuugcgaacaagcuguaugagagauggaagaaauacaagaauggggaugucugcaaacggaacgugcucggaaccacacgcuuugcucaccugaagaaauccaaggagagcgaaucuuucguguuuuuccugcccagacuuauugccgagccgggccucaugcugaauuuuagcgccacggcucugcgguccagaaugaucaaguauuucguuguccaaaacccuagcucuuggcccgugucccuccagcugcuuccucugagccucuaccccaaaccugaagcccuggugcaucugcuucaccgcugguuugggaccgacaugcagaugauuaauuucacaaccggcgaguuucagcucacagaggcuugucccuaucugggaacccacuccgaagagucucgguucggcauccugcaucuccaucugcaaccgcuugaaaugaagagaguuggggucguguuuacgccugccgauuacggaaaagugaccagccugauucucauccgcaacaaucugacagucauugacaugaucggcguggagggguucggagcgcgggaacugcuuaagguuggcgggagacuccccggcgccggaggcucccugcgcuuuaaagugcccgagucuacccugauggauugccggagacagcucaaggacagcaagcagauccuguccauuacaaagaacuucaaggucgagaacaucgggccucuuccgauuaccgugucuagccugaaaaucaauggauacaacugucaaggcuauggguucgaaguucucgauugccaccaguuuucccuggaccccaauacgagccgcgacauuucuaucguguucacaccugauuuuaccuccagcugggucauccgggaccugucucuugugacagcugccgaucuggaguucagauuuacccucaacguuacccugccccaccaccuccugccucuuugugcugacgugguccccggaccuuccugggaagagagcuucuggcgccugacaguguuuuucgugucucucucccugcugggcgucauucuuaucgccuuucagcaggcgcaauacauucugauggaguucaugaagacgcggcagagacagaaugccagcuccagcucucagcaaaacaaugggcccauggauguuaucagcccgcauuccuauaaaucuaacugcaagaauuuucucgacaccuacggcccuagcgauaagggacggggcaaaaacugucugcccgugaauacaccucagucccgcauucagaacgcugccaagagaucucccgcuaccuaugggcacagccagaaaaagcauaaaugcuccguguacuauucuaagcacaaaacaagcaccgccgccgcuuccagcacgucuacaaccaccgaagagaagcaaacauccccgcucggaagcucucugccugcggccaaggaagacaucuguaccgaugcuaugcgggagaauuggaucucccuuagauacgccagcggcauuaacgucaaucugcagaaaaaccucacacugcccaagaaccugcuuaauaaagaagagaacacgcugaagaauaccaucguguucuccaacccuucuagcgaaugcuccaugaaagaggggauucagacauguauguuccccaaggagaccgacaucaagacaagcgaaaauaccgccgaguuuaaagaacgcgagcucugcccccugaagacgucuaaaaagcucccugagaaccaucugccgcggaauagcccccaauaccaccagccugaucuucccgaaauuagccggaaaaacaauggaaacaaucagcagguuccugugaagaacgaggucgaccacugcgaaaaucugaagaaaguggauaccaagcccucuagcgagaaaaagauccauaaaacaucccgcgaagacauguucucugagaagcaagacaucccuuuuguugagcaggaagauccguauagaaagaaaaagcugcaggagaaacgggaaggcaaccuccagaaucugaacuggagcaagucccgcaccugucgcaaaaacaagaaaagagggguggcucccgucucuagaccucccgagcaaagcgaccuuaagcuggugugcuccgauuucgaaagaagcgagcucucuuccgacauuaauguucggagcugguguauccaggaguccacacgcgaagugugcaaggccgaugcggagauugcuucuagccugccugccgcccagagagaagcugagggcuacuaucagaaacccgaaaagaaaugugucgacaaguuuugcuccgauucuagcuccgacuguggauccucuuccggcagcgugcgggccucucgcggguccuggggaagcuggucuagcaccuccucuagcgauggcgacaaaaagccgaugguggaugcgcaacacuuccucccugcuggggacuccgucagccagaacgauuuucccuccgaggcccccaucucucugaaucuuagccauaacauuugcaauccuaugacaguuaacucccugccccaguacgccgagccuucuuguccgagccugcccgcuggaccuaccggcguggaagaggacaagggccucuauucccccggggaccuguggccuacgcccccggugugcgucacaucuagccuuaauuguacccuggaaaacggagugccuugcguuauccaggaguccgcccccgugcacaauagcuucauugauuggucugcuaccugcgagggccaauuuuccagcgccuacuguccucucgaacugaacgacuauaaugcguuccccgaggaaaacaugaauuacgccaacggguuuccuugccccgcugauguccagacagacuucaucgaucacaauucucaguccaccuggaacacgccgccuaauaugcccgccgcuuggggacaugccagcuuuaucucuuccccucccuaccucacaagcaccagaucccugagcccgaugucuggccuuuucgggagcauuugggcuccccaauccgacguguaugagaacuguugcccuaucaaccccacaaccgaacacucuacacauauggagaaucaggccguuguguguaaagaguacuauccuggauucaaccccuuucgggcguacaugaaucuggauauuuggaccacgaccgccaacagaaaugcuaacuucccucugagccgcgacuccucuuauugcggcaaugucuga

SEQ ID NO: 71128 - RNA, 2751 nt, Artificial Sequence
  derived and/or modified sequence opt5 from KIAA1024__Homo_sapiens__NP_056021
auggaaaccagccaggaaacaucccuguuccucgugaagauccuggaggaacuugacucuaaacaaaacacggucagcuaccaggaucugugcaagucccucugugccagauuugaccugucucagcuugcuaaacugcggagcguucucuucuauaccgccugccuggaucccaauuuuccugcgacacuguucaaggacaaaaugaaguguaccgugaacaaucagcaauccaagaaaauuaugguggcugccgauaucgucacaauuuuuaaccucauccagaugaauggcggggccgcuaaggagaaacugccgaccggacgccagaaggugagaaagaaggaagccucuuucgagagcugccgguccgacacagagauuuguaacgcugccgaaugcgagccccuuaauugugaacugagcgagcgcucuuuuuccagaggcuacccuauccggcagagcucuaagugccgcaaaauggauuguaaggacugcccccaauucguuccugcguccgagcccaacuuucuccugggggugagcaaagaagucaagaauagagccgcuucucuugaucggcugcaggcccucgcuccuuauuccgugaccagcccgcagcccugugagaugcagcgcacguacuucccuaugaacaucgaaaaugaguccauuucugaccaagauagccugcccaucaaccaguccauuaaagaaaccuuuaucagcaaugaggagccuuucguugugcagucuugcguccaaaagagaaacauuuuuaaagaagacuuccacaaucugauggccgugucccccagccucgugggaccgaucucuaaggcggagaacgaacaucgggagccucagagccgcaaggaaccccacaaaccucccuucuuuaaccauuccuucgagaugcccuauaauucucaguaccugaacccugucuauagcccgguucccgauaagagacgggccaaacacgagucccuugacgaccugcaggcuagcacauacuuuggcccuacccccgugauggggacacaagaagcccgcagaugccucggaaagccuaauaaacagacccccuggccggcuaagucuuggucccugaacacggaggaagugccugauuucgagcggagcuuuuucaauagaaaccccucugaagagaaacuucauuacccuaaugccuccagccagacacccaacuuuccugcccccgagcgccggccgaccuaucuggucccuaaagaccagcaacccauucuccccaucgcuuacgcggccaagcagaauggccugaaauccaaggaaaucucuagcccuguggaucuggagaaacacgaaccgguuaagaaguucaaagacaaguccauuaacuguacaucuggccagcucagcuccgauaccagcucuguggggacccagacagagcacguccuggagcccaaaaagugcagagaccuuuguacguccggacaaggcaaauauagcgaucgccauaccaugaagcacucugacgaugacuccgaaaucgugagcgaugacauuucugacaucuuucgguuccuggaugacaugagcauuuccgggagcacaggaguuauccagucuuccugcuacaauagcaccggcucccucucucagcugcauaagagcgauugugacuccucuccugagcacaaccuuacaaaaaucgcuaauggggugcccaacagcaagggagauaaaggcaauagaccugaaaacacccaccauuccgaggaggagcugaagacgucugucugcaaacucgugcugcgcauuggcgagaucgaacggaagcuggagagccucuccggggucagagacgaaauuagccaggugcugggaaaacuuaacaagcuggaucaaaagaugcagcagcccgagaaaguuucugugcaaaucgaccucaauucccugacaagcgaaggcccuucugaugacuccgccagcccccgcauguuucacgcccauucugggucccacggaccgaagcuggagaacaauccugauugguguugcagcgacgcuuccggcagcaacucugagagccuucgggucaaagcccucaagaaaucccuguucaccagacccucuagccgcucccugaccgaagaaaauucugcgacagaaagcaagauugcuuccaucucuaacagcccucgggauuggagaaccaucacauauacgaaucggguggggcucaacgaggaagagauuaaggacaccggacccggcgacaauaaagauuggcaucgcaaguccaaagaggccgacagacaguacgauaucccgccucagcaccggcugcccaagcagccuaaagacggcuuucuuguugaacaaguguucagcccccaccccuauccugccucucugaaggcucauaugaaguccaacccgcucuacacagauaugagacugaccgagcuggccgaagucaaacgcgggcagcccagcuggacaauugaggaguacgcucggaaugccggagacaagggcaaacuuaccgcgcucgaucugcagacgcaggaaucucugaacccuaauaaccucgaguauuggauggaagacaucuacacccccggguaugauucccugcuuaagagaaaagaggccgaguuccgcagagcuaagguguguaagauugccgcucugaucgccgcggccgcuugcacagugauucucguuaucgucgugccuaucuguaccaugaaaagcuga

SEQ ID NO: 71129 - RNA, 3522 nt, Artificial Sequence
  derived and/or modified sequence opt5 from KIAA1033__Homo_sapiens__NP_056090
auggccguggagacccugagccccgacugggaguucgauagagucgacgauggcucccagaagauccacgcugagguucaacucaaaaacuacgggaaguuucuggaagaguauacaucucagcuucggcgcauugaagacgcccuggaugacagcaucggagaugugugggacuucaaucucgauccuauugcgcugaaacuucugccguacgagcaguccucucuccuggagcugaucaagacggaaaacaaagugcucaauaaggucauuaccguguaugcugcccugugcugugagaucaagaaacuuaaguacgaagccgagacaaaauuuuauaacggccuccucuucuacggggagggagcuaccgacgccagcaugguugaaggcgauugccagauccaaauggggagauuuauuuccuuccugcaggagcuuucuuguuuugugacacggugcuaugaagucgugaugaauguugugcaucagcuggcugcccucuacaucagcaacaagauugcgcccaaaaucauugagaccacaggaguccacuuccagaccauguacgaacaucugggcgagcugcucacggugcugcuuacccuggacgagaucauugauaaucacaucacacucaaggaccauuggaccauguauaagcgccugcuuaaauccgugcaccacaacccuagcaaguuuggcauccaagaagagaaacugaagcccuucgaaaaauuucuccugaagcuggaggggcagcuccuggacggaaugauuuuccaggccuguaucgaacagcaauuugauucucuuaauggcggggucuccguuagcaaaaacucuacauucgcugaggaguucgcccauuccauuagaagcaucuuugcuaauguggaagccaagcugggagagccuucugaaauugaccagcgggauaaguacgugggcaucugcgggcuguucguccugcacuuucagaucuuccgcaccauugacaaaaaguuuuauaaaucccuucuggauaucuguaagaaagugcccgcgauuacgcucacagccaacaucauuugguucccugacaauuuucugauccaaaagaucccggcugccgcuaagcugcucgauagaaaaagccugcaggccauuaagauccaucgggacaccuuccuucagcagaaagcccaaucccugacaaaggauguucagucuuacuauguguuugucagcuccuggaugaugaaaauggagagcauucucucuaaggaacagcgcauggacaaguucgcugaggaucugaccaacagaugcaauguguuuauccagggauuccuguacgcguauuccauuagcaccaucauuaaaacaacgaugaaccuuuacaugucuaugcaaaagcccaugaccaaaacaagcguuaaggcccucugucggcugguggagcugcucaaagcuaucgaacacauguuuuaccgcagauccauggucguggccgacucugucagccacaucacccagcaucugcagcaccaggcccuucauuccauuagcguggcuaagaagcggguuaucucugacaaaaaguauuccgagcaacgccuggaugugcucagcgcccugguccuggcggaaaacacacuuaauggcccuucuaccaaacagagacggcucauugugucccuggcucugagcguuggcacgcagaugaagacauucaaagacgaggaacucuucccccuucagguggucaugaagaaacuugaucugaucuccgaacucagagagcgcgugcaaacccagugcgacuguugcuuucuguacuggcaccgggccguguucccuauuuaucuggaugacguuuacgaaaacgccgucgaugcugccagacuucauuauauguuuucugcucuccgcgacugcgugcccgccaugaugcacgcgcggcaccuggagagcuacgaaauccugcucgauuguuaugacaaggagaucauggagauucugaaugaacaucuucuggauaagcucugcaaagagaucgaaaaggaccugagacuguccgugcacacccaucuuaaacucgaugaccgcaacccguucaaggucgggaugaaagaccuggcccuguuuuucucucucaauccuauucgguuuuucaacagauuuaucgauauucgcgcuuacgugacacacuaccuggacaagaccuucuauaaucuuacaacgguugcccugcacgauugggcuaccuacagcgagaugcggaaccucgccacacagagauauggacuggugaugaccgaagcgcaucugcccucccaaacacuugagcagggccuggacguccucgagaucaugcgcaauauccacauuuuugugagccgguaccuguauaaccucaauaaccagaucuucauugaaagaaccucuaauaacaagcaucugaauacgaucaacauucggcacaucgccaacuccauccgcacccaugggacaggaauuaugaauaccacaguuaacuuuaccuaccaguuccuuaaaaagaaauucuauaucuuuagccaauucauguacgaugagcacauuaagucuagacugaucaaagacauucgguuuuucagagaaaucaaggaucagaaugaccacaaguacccuuuugaucgcgcugagaaauucaaccggggcauuagaaagcucggggugacgcccgaaggacaguccuaucuggaccaguuucgccaacugaucagccagaucggcaaugccaugggcuacgucagaaugauucggucugggggacuucauuguagcuccaacgcuauccgcuucgugcccgaucuggaggacauuguuaauuuugaggaacucgugaaagaggaaggccuggccgaggagacacucaaggccgcuagacaccuggauagcguccuuucugaccauacccggaacuccgcggaagggacagaguauuucaaaaugcugguggacguguuugccccugaguuccgcagaccgaagaauauccaccuccggaacuucuacauuaucguucccccucugacccugaauuuugucgaacauagcaucuccugcaaggaaaaacuuaacaagaaaaauaagauuggagcugccuucaccgaugacggcuuugccauggggguggcuuauauccugaaacuccuggaucaguaccgcgaguucgacucucuccacugguuucagagcgugagagagaaguaucugaaagaaauucgggccgucgcgaagcaacagaacgugcaguccgcuucucaagaugagaagcugcugcagacaaugaaucugacgcagaaacgccucgacguuuaccugcaggaguucgaacuucuguacuuuagccucuccucugccagaaucuucuuucgggccgauaagaccgcugccgaagagaaccaagagaaaaaggaaaaagaggaagagacaaagaccagcaacggcgaccuguccgauagcacagugucugcggaccccgucgugaaguga

SEQ ID NO: 71130 - RNA, 15018 nt, Artificial Sequence
  derived and/or modified sequence opt5 from KIAA1109__Homo_sapiens__XP_005263344
auggaccagcgcaagaacgaaagcaucgugcccuccauuacccaacuggaagauuuccucacagaacacaauucuaacguuguuuggcugcuuguggccacgauccugagcugcggcuggauuaucuaccucaccuauuacaauucccggaacguggggcugauucuuacacugguccucaaucgccuguauaaacauggauacauccacaucggcucuuuuagcuucuccgugcugucugggaagguuauggugagagaaauuuauuacaucaccgaggacaugagcauucggauccaggauggauuuauuaucuuccgcugguggaaaauguauaacccuaagcagaaacagcaugaccccaaggcugaaacaagacucuacauuaccgucaaugauuuugaguuccacguguacaaccgguccgaccuguauggccgccuucaagagcuguuugggcucgaacccacaaucaucccucccaagaaagaugacgauaagaccagagagauuggacggacgcgcacccagagcaaaaucgaaagaguuaaggugaaaacagagucucaggacccuaccuccagcuggcggucucugauucccgucaucaaggugaauguguccacaggccgccuugccuucggcaaccauuaccagccucaaacccuguguauuaauuuugaugacgcguuccucacguauacaaccaagccucccagcucucaccuggaucaguuuaugcacaucgucaaagggaagcuggagaacguuagagugaugcucgugcccagcccccgguacgucggacugcagaaugacgaaccuccccgccuuaugggcgagggguucgugguuaugcagagcaacgacguggauaucuauuacuauauggacgaaccgggacuggucccugaggaaacagaggagaauauugaaggcgagauguccucugaagauugcaaacuccaagaccugcccccuuguugggggcuugauaucgugugcggaaagggcaccgacuuuaacuacggccccugggcugauagacagcgggacugucuguggaaauucuucuuucccccugauuaccagguucucaaggugagcgagauugcccaaccggggagaccccgccagauccuggccuucgaacugcggaugaacauuaucgcugacgccaccaucgaucuccuguuuaccaagaacagagagacgaacgcuguccaugugaaugucggagccggcuccuaucuugagauuaacaucccuaugaccguggaagagaauggguacacacccgcgauuaagggacagcugcuccacguugacgccaccacaagcaugcaguaucgcacccugcuugaagcugagaugcuggccuuccauaucaacgcuucuuacccucggauuuggaauaugccccaaacguggcagugcgaacucgagguguauaaggccacauaccacuuuaucuucgcgcagaaaaacuuuuucaccgaccugauucaggauugguccagcgacucuccgccugauaucuuuagcuucguccccuauaccuggaauuuuaagaucauguuccaccaauuugagaugauuugggccgcuaaccagcauaauuggaucgacuguuccacaaaacagcaggaaaacguguaccuggccgcuugcggcgagacccucaauauugauuucucucugccuuucacagacuuuguucccgccacguguaacaccaaguucagccuuagaggggaagauguggaccugcaccucuuucugccugauugccaucccuccaaauacagccuguucaugcuugucaagaauugucacccgaacaagaugauccaugacacaggcaucccugccgagugccaaucuggccagaaaaccgugaagcccaaauggcgcaacgugacacaggagaaguccggcuggguugaaugcuggaccguccccagcgugaugcucacgaucgauuauaccuggcacccuaucuacccgcagaaagcugacgagcaacugaagcagucucuguccgaaauggaggaaacaaugcucagcgugcugcggcccucccagaagaccucugauagagucgugagcuccccuucuacaagcuccagacccccuauugaccccagcgagcuuccucccgacaaacugcacguugagauggaacucucuccggauucccaaaucacccuguaugggccucugcuuaaugcguuucucuguauuaaggagaacuacuucggagaagacgauauguauauggacuuugaggaagugaucagcucucccguccugucccugagcacgucuagcuccagcggcuggacagccguggggauggagaaugauaaaaaggagaacgaaggaucugcuaaauccauucauccucucgcccugcggcccugggacaucaccguucuugugaaucuguacaagguccacggcagacucccggugcaugggacaaccgauggcccugagugccccaccgccuuccuggaacgccuguguuuugagaugaagaaaggauuccgggaaacaaugcuucagcucauccugagcccucugaacguuuuuguguccgacaauuaucagcagagaccgcccgucgaugaggugcuccgggagggccacauuaaccugucugggcuucaacugcgcgcucacgccauguucagcgcggaaggacucccucugggcuccgacucucuggaguacgcuuggcuuaucgaugugcaggccgggagccucacggccaaggucaccgcuccgcagcuggccugccugcucgaauggggacagacauuuguuuuccaugugguguguagagaguacgagcuggaacggcccaaauccgucauuaucugccaacacggcauugacagacgcuucugugagucuaaacuuagcugcaucccugggcccuguccuaccuccgaugaccugaaauauacaaugauccggcucgcuguggacggcgccgauauuuacaucguugaacauggaugcgcgaccaauauuaagaugggcgccaucagaguggcuaacuguaaucugcacaaccagagcgucggggagggaauuucugccgcuauccaggacuuucaggugcgccaauauauugaacagcugaauaacugcagaaucggccuucagcccgccguucugcggcgcgcguacuggcucgaggccggguccgcuaaucugggacucaucacgguggauauugcccuggcugccgaccaucacagcaaacacgaggcccaaagacauuuccuugaaacacacgaugcucggaccaagcgccugugguuucucuggccugacgauauccugaagaacaaaagaugccggaacaaguguggcugccucgggggaugucgcuucuuuggaggcaccgucacagggcuugacuucuuuaaacuggaggaacucaccccgucuuccagcucugcguucuccagcacauccgccgagagcgauauguauuacggacagucucugcuccagcccggcgaauggauuaucacgaaggagauuccuaaaaucaucgacgggaaugugaacggaaugaagagaaaggagugggaaaauaaaagcguuggcauugagguggaacggaagacccagcaucugucccuucaagucccccugcgcucucacagcuccucuagcuccucugaggaaaacagcuccagcucugcugcccagccucuccuggccggggagaaagagucccccagcucuguggcugaugaccaucuggugcagaaggaauuucuucacggcacaaaaagagacgauggacaggccuccaucccgaccgagauuagcggcaauuccccugucucucccaacacacaagacaagagcguugggcagagcccccugcggagcccucucaagagacaggcgucugugugcuccacccgccugggaagcacgaaaucucucaccgcugccuucuauggcgauaagcagcccgugacagucggggugcaauuuagcuccgacguuucucggagcgaugaaaaugugcuggacuccccuaaacagagacgcucuuucggcuccuucccguacacccccuccgccgauagcaacucuuuucaccaguaccgguccauggacagcuccaugucuauggcugauagcgaggccuauuucuccgcggcugaggaauuugagccuaucucuagcgacgaaggccccggcacauacccugggagaaagaaaaagaagaaacagacccaacagauugauuauucccgcggaagcaucuaccauucugucgagggcccccuuacagggcacggagaauccauccaggacagccggacccugccguucaagacgcauccuucucaagccuccuuugugagcgcccugggcggggaggaugacguuauugagcaccucuauaucguggaaggagagaaaacagucgaaucugagcagauuacaccccaacagccugugaugaauuguuaccaaaccuaucugacacaguuccaggucaucaacuggagcgugaagcaccccaccaauaaaagaacguccaagucuagccuucaucgcccucuggaccucgauacacccaccuccgaagagagcuccucuagcuuugagcagcuguccguuccgacauucaaagugauuaagcaaggccucaccgcuaacucucugcuugaccggggcaugcagcugagcggguccacaucuaauaccccuuacacgccccuggaaaagaaacucgccgauaacaccgacgaugagacacugaccgaagaguggacacuugaccagcccgucagccagaccagaacgacagcuaucguggaaguuaagggaaccguggauauuguccugacaccucucguggccgaggcgcuggaccgguacaucgaggccauggugcacugcgcuuccacccgccauccggccgcuaucguugaugaccuccacgccaaaguccugagagaagccgugcaaaauagcaagaccacauuuucugagaaccuuuccagcaaacaggauauucggggcacgaagaccgaacagucuacaaucgggaccacaaaccaaggacaggcucagaccaaucugacgaugaagcaggacaacgugacaauuaaaggccugcaaaccaaugucuccauccccaaggugaaccucugucugcuucaggcgagcguugaggagucuccuaccacagcccccucccgcagcgugacccaugucucccugguggcucucugcuucgauagaauugccacacagguucggaugaauagagggguggucgaagagacgagcaacaaugccgaaccuggacgcaccucuaacuuugaccgguaugugcacgcuacaaaaaugcagccccaaagcuccggcucucugagaagcaaugccggcgcggagaaggggaaagaaaucgcugccaagcucaacauccaccgcguucauggacagcugcggggccuugacaccacagauauugggaccugugccaucacggcuauuccuuucgagaaguccaaagugcuguuuacccuggaggaacucgacgaguucacauucgucgaugaaaccgaccagcaggccgugccggaugugacaagaaucggacccucucaagagaaguggggcuggauuauguuugaaugcgggcuggagaaucuuaccaucaaaggaggccgccagagcggcgcgguccuguacaacuccuucgggaucaugggaaaggcuucugacacagagcggggcgggguucucacgagcaauaacuccagcgauucuccuaccggauccggcuauaauacagacgugagcgaugacaaccugcccugugauagaaccucuccuuccagcgaccugaaugggaacuccgugucugacgaacaggaugagggagucgaaagcgacgaucucaaaaaggaccuuccccugaugccgccuccgcccgauuccugcagcaugaagcugaccauuaaagagaucugguuuucuuucgccgccccuacaaacgugcgcucccacacgcaugcuuuuagcagacagcucaaucugcuuucuaccgccacacccgcuguuggcgccuggcuggugccuauugaccaacucaagagcucccugaacaaacuggaaaccgagggcacacuccggaucugcgcggucaugggguguauuaugaccgaggcccuugaaaauaagucugugcacuucccgcugcgcagcaaauacaacagacugacgaagguugcucgguuucuccaggagaaucccuccugccugcuuuguaacauccugcaccauuaucuccaccaggccaauuacucuauuaucgaugacgcuacaaugagcgauggacugccugcccuggugacccucaagaaaggccuugucgcccuggcucgccaauggaugaaguucaucguggucacccccgcguuuaaaggggugucccugcauagaccugcccagccccucaagccgcagauugcuauggaccacgaacaugaggauggacugggccuugacaacgggggaggccugcagagcgauacaucugccgacggcgccgaguucgaauuugacgcugccaccguuuccgagcacacaaugcuccuggaagggaccgcgaaucggccucccccuggaagcuccggccccgugacgggggcugagaucaugagaaaacugucuaagacacacacccauagcgauuccgcccucaaaauuaagggaauccacccuuaucauucucuuagcuacacauccggcgacaccgccacggauagccccgugcacgucgggcgcgcuggaaugccgguuaaggacucuccucggaaagaaucccugcugagcuaccucaccggcucuuuccccucccugcacaaccuucuggagggcacaccccaaagaagcucugccgcggugaaguccagcucucucacccgcacagggaauaccguggccacagauaugcugagcgagcauccucugcucuccgaaccgagcuccgucucuuuuuauaacuggaugagcaaugcugugggaaaccggggcuccguucuucaggagucucccgugaccaaaagcgggcacaauucccugccuacgggagucgcccccaaccugccuacaauucccucugcuagcgacuucaacaccgugcucuccagcgaucagaauacccuggacggcacacauucucagcacuccaccagccaagaugacgucgccgggguggaagaggcuaaccagggcuucccugccguucagcuugcggaugcccagguggucuuuaagccccugcucucucauacaggaauccaaucccaggacacgaugccguucugcuacagaauguauuuuggcgaacaccugagcuucucugggacccuggacugucuccgggcugauaucguggacuccgauacagccaaagagcgcaagggaaagagagcucggcgccagggccacguuaaucuuccuccccuggaguuuaaaccugcccugaugcucgggaccuucagcauuucugccguggucauggaaaaguccgugugcacaccccaaaacagcaccagcgcucuguccuuucaugaccuuucuaaaagauacuauaauacguuccacuguaacuuuaccaucagcugccaguccauuucucagcauguggauauggcgcugguucggcucauccaccaguucagcacaaugauugacgauaucaaggccacccaaacagacaucaaacugucccgcuacaccgcuggaucugccagcccgacgccuacauuuaagaccagaaagcaucgggauuuccgcuccagcgacuuuucuagauccagccggggcucucugaaugggggcaacagagucaauaacgccaaaaauaagcgcacaaacaaugagaacaauaaaaaggaaucccggaacaaaaacagccucggaagauccgagcgccggaccucuaaggugagcagaaagggcuccaaagauguggucgaccacaugaccauucacauggaugacucugacagcaucacaguuuccgaacagagcgagcccucugcugaguguuggcagaauauguauaaacuucugaacuucuacucccugauuagcgaucccacggggauccucgaaaaaucuagcgagaccuucggaccugccggcgugcgcucccccacagaaccuaccugcaagguggucuuugagaaugagcaggacaacucuagccugacaaaaacccaacggaagagaucccuugugacgagcgaaccgcagcauguuacacugauuguguucgggaucggaauggucaaucgcacccaccucgaggcggauauuggcgggcugaccauggaaucugagcugaaacggauccauggcuccuuuacacucaaggaaaagaugaaagacgugcuucaccagaagaugaccgagacaugugccacggcucacaucggaggcguuaacauugugcugcuggaggggaucacccccaauauucagcucgaagauuucccuacaagccccaccuccacagccaaacaagaguuucugaccgucgugaagugcucuaucgcuaaaagccaggcccuuuacuccgcgcagagaggacugaagacgaacaaugccgcuguguucaaggucggcgccauuucuaucaacaucccucaacaucccgcuacccuccacagcaugaugguucgcuccucucaucagcugagcaaacagauuuccgaccugauccggcagccuagcacagccccgcaacccgugaaggaagauauugcuaccccucuccccucugagaaaacaccuaccuccgugaaucagacacccgucgaaaccaacgaguuuccgcagcuuccugaggggcuggaaaagaaacccaucgugcugaaguucagcgccaugcucgacggaauugcgaucggcgccgcucugcuucccucucugaaggccgaguauaaaaugggcagaaugcgcucccacgggaugacgggagcucagacaagauuuaccuucgaacucccuaaucaucggcugcgcuuuaccagcaagguuucugccacagauaugagcacgauucccccuuccgccagccugaaccucccgcccgugaccauguccggcaaauacauuauggaggaacacgacucuuauagcgaucaagucugguccaucgacgagcugccuucuaagcagggguacuaucuucagggaaauuaccugagaugcguggcggagguuggcagcuucgaacacaaccucacaaccgaucugcuuaaccaucugguguuuguccagaaaguguucaugaaggagguuaaugaagugauucaaaaggucuccgggggagagcagcccaucccucucuggaacgagcacgacggcacagcugacggcgauaaacccaagauucugcuguauucucucaaucugcaguucaaagggauccaggugaccgccacaaccccgagcaugcgggcugucagauuugaaacgggacuuauugagcuggaacucuccaaccggcugcaaaccaaggccagcccuggaucuuccagcuaccuuaaacuguucgggaagugucagguggaccucaaucuggcccugggacagaucguuaaacaucaaguguacgaggaagcuggcucugauuuucaccaggucgccuauuucaagacacgcaucgggcucagaaacgcgcugcgggaggagauuuccggaagcucugaccgcgaagccgugcuuaucacccugaauagacccauuguguacgcucagccuguugccuuugaucgggcugugcuguucuggcugaacuauaaggccgcguacgacaauuggaacgagcagcgcauggcccuucacaaagauauccauauggcuacaaaggaagucguggacaugcugcccggcauucaacagaccuccgcccaggcuuuuggcacgcuguuccugcagcugacaguuaaugaucucgggaucugccugccgaucaccaacacagcccaaagcaaucacaccggagaccuugauacgggcucugcucuggugcucaccauugaguccacacugaucaccgccuguagcuccgaaagccuugucucuaaagggcauuuuaagaacuucugcauuagauuugcggacggauucgagacaagcugggacgauuggaaaccugagauccacggcgaccuggugaugaaugccugugucgugcccgaugggaccuaugaaguuugcucccggacaaccggacaggcugccgcugagucuagcuccgccggcacguggacacucaacgugcuguggaagauguguggcauugacguccauauggaucccaacaucgggaagcgccugaaugcccucggaaacacccugaccacacuuaccggcgaagaggacaucgaugacauugcggaucucaauucugugaacaucgcugaccucagcgaugaagacgagguugauacaauguccccuacgauucacaccgaggccacagacuacagacggcaggccgcuagcgccucucagcccggggaacugcgcggaagaaaaaucaugaagcggauuguggacauccgcgagcuuaaugaacaagcuaaagucaucgaugaccugaagaaacucggcgccuccgaggggaccauuaaccaggagauccagagauaucaacagcuggaaagcguggcggugaaugauauucggagagacguucgcaagaagcugcggagaucuuccaugcgcgccgcuagccucaaagauaaguggggacugucuuacaaaccuuccuacagccgguccaagucuaucagcgccuccggcagaccgccccuuaaacgcauggagcgggcuagcucuagagucggcgaaacagaggaacugccugagauucgcguggacgccgcgucccccgggccucgggugaccuuuaacauccaggauacguuccccgaggaaaccgagcucgaccugcuuagcgucacaauugaaggaccuucucacuauagcuccaauucugagggcagcugcuccguguucagcucuccgaagacccccgggggauuuuccccuggcauccccuuccagacagaagaggggagacgcgaugacagccugucuuccaccagcgaggauuccgaaaaggacgagaaagaugaagaccaugagcgggaaagauuuuacaucuaucggaagccuucucacacgagccgcaagaaggccacaggauucgcugccguucaucaacucuuuaccgagcgcuggcccacaaccccggugaaccggucccugucuggcaccgcuacagagagaaauauugacuucgaacuggauauccgcgucgagauugacagcggcaaaugugugcuccacccuacgacccugcuucaggaacaugaugacaucucccugagacggagcuacgauagaucuuccagaagccucgaccaggauucucccuccaagaagaaaaaguuucagacaaacuaugccagcaccacacaccugaugaccgggaaaaagguucccucuucccuucaaacgaaaccuagcgaccuggagacaaccguguucuacauucccggagucgaugugaagcuccacuauaauagcaaaacccugaagacagaguccccuaacgcuucucggggcagcucccugccgcgcacccuuucuaaggaaagcaaacuguacgggaugaaggacuccgccacaucucccccuucucccccucuccccuccacgguucaguccaaaaccaauacacugcucccgccucagcccccucccaucccugcggccaagggaaaaggcagcgggggagugaagaccgcuaagcuguacgccugggucgcccuucagucccugcccgaggaaauggugaucagcccgugccugcucgauuuucuggagaaagcucuugaaacaauucccaucaccccuguggagagaaacuauacggccgucucuucccaagacgaggacaugggccauuucgaaauucccgauccuauggaggaaagcaccacaucucugguuuccagcucuaccuccgcguacagcuccuuuccgguggacguggucguguauguucgggugcagcccagccagaucaaguucucuugucucccugucagccgcguggagugcaugcugaaacuccccucccuggaucuggucuuuucuagcaacagaggcgaacuugagacacuggggaccacauacccugcugagacccucucccccggaggcaaugccacgcagucugggacaaagaccagcgccuccaaaaccggcauuccuggcucuagcgggcugggcagcccccuuggacggagccgccacucuuccagccaaucugaccugacauccagcuccucuagcuccagcggccucucuuucacggcuugcauguccgauuucagccuguauguguuucauccguacggggccggaaagcagaagaccgcugucucuggccucacaccuggguccggaggccuggggaacguggacgaagaacccaccagcgucacaggcagaaaagauucucugagcaucaaucuugaguucgugaagguuucccugucucggauccgcagaagcggaggcgccuccuuuuucgagagccagucuguguccaaaagcgcguccaagauggacaccacacucauuaacaucucugccgucugugauauugggagcgcuuccuuuaaauaugacaugcggagacugucugaaauccuugccuucccucgcgcuugguaccggagaagcauugcccgccggcuguuucucggagaucaaaccaucaaucugcccacguccggcccggggaccccugacagcauugagggagugucucagcaccugucccccgagagcucuagaaaggcguacugcaagacaugggaacagcccucccagagcgccucuuucacccacaugccucaaucccccaacguuuuuaaugagcauaugacaaacagcaccaugucuccuggcacgguggggcagagccucaaauccccggcuagcauccgcucccggucugucagcgauuccucugugcccagacgcgacagccuguccaagacaucuaccccuuucaauaaaagcaacaaggccgcuucccagcagggcacacccugggaaacccuugugguuuuugccaucaaucugaaacaacucaacguccagaugaauaugagcaacgugaugggaaauaccacauggacgaccucuggccugaagucccaggggcggcuuagcgugggaucuaacagagaccgggagauuuccaugagcgucggccuggggcgcucucagcucgauuccaaaggaggcgugguugggggcacaaucgacgugaacgcccuggagauggucgcucacauuagcgaacauccuaaucaacagcccucccacaagauccagauuaccaugggaagcacagaggcgagaguggauuauaugggaucuuccauccugauggggaucuucagcaacgccgaccucaagcugcaagaugaauggaaaguuaaucuuuacaacacccuggacucuagcauuacggauaaguccgagaucuucgugcauggagaccucaaaugggauauuuuucaggucaugaucucucggagcacaaccccggaccugauuaagaucggcaugaaacuucaggaguucuuuacccagcaauucgauacauccaagcgcgcucugucuaccugggggccugugcccuaucucccucccaagacaaugacgagcaaucuggagaaauccagccaggagcagcugcucgacgccgcccaccacagacauuggccuggagugcugaagguugucucuggcugucacaucucccuuuuucagauuccccugccggaagauggcaugcaauucgggggaagcaugucucuccauggcaaccacaugacccuggcuugcuuucacgggcccaauuuccgguccaaaagcugggcccuuuuucaucuggaggaaccuaacaucgcguucuggacagaggcucagaagauuugggaagacggauccucugaccacagcaccuacaucgugcagacacucgauuuucaucugggccacaauaccauggugacgaaacccuguggggcccuggaguccccuauggccaccauuacaaagaucaccagacgccggcaugagaaucccccucacggagucgcuagcguuaaggaaugguucaauuaugugacagccaccagaaacgaggaacucaaucugcuucgcaacguggacgcuaauaacacagagaacucuacgaccgucaaaaauuccagccugcucucuggcuuucggggcggguccagcuacaaccacgaaacagagaccauuuucgcccugccgagaaugcagcuugauuucaagucuauccaugugcaagagccccaggaaccuagccugcaggacgcgucccucaaacccaagguugagugcucuguggucaccgaauuuacagaucacaucugugugacgauggacgccgagcugauuauguuccugcaugaucucguuagcgcuuaucugaaagagaaggaaaaggccaucuuuccuccccgcauucuuuccaccagaccgggacagaaauccccuaucauuauccacgacgauaauucuuccgacaaggaucgggaggacagcaucacauacaccacaguggacuggcgcgauuucaugugcaacaccuggcaccuggaacccacgcucagacugauuuccuggacaggccggaaaaucgacccugucgggguggauuacauucuucagaagcugggauuucaucacgcucgcaccaccauccccaaauggcuccagagaggcgugauggacccgcuggauaagguccugucuguucucauuaaaaagcuggggacagcccuucaggacgagaaggagaaaaagggaaaagauaaggaggagcauuga

SEQ ID NO: 71131 - RNA, 1368 nt, Artificial Sequence
  derived and/or modified sequence opt5 from KIAA1147__Homo_sapiens__NP_001073861
augguggagcagggcgacgccgcuccccugcucagaugggccgaagggccugcggucagccugccgcaagcuccccagccucaggccggaggcugggggcggggaggcgggggaggcgcccgccccgcugccgagccucccagacggcgcgaaccugaggaaccggcugcccccgagguucuucugcagccuggcagacucgagcugggggauguggaagaggaccaaguggucgcgguguucguugugaccuuugauccccgguccggaaacauggucgaauggugccuuccucaggacaucgaucuggagggcguggaguucaagucuauggccagcgggucccacaaaauucagucugacuuuaucuacuuccgcaagggacccuuuuucggccucgcuuguuuugccaauaugccgguugaaagcgagcuggaaagaggggcucggaugaaauccgugggcauucugucuccuagcuauacacuccuguaccgcuauaugcauuuccuugagaaccaggucagacaccaacuggaaaugcccggacauuacucccaccucgccgcguuuuaugaggauaagaaaggcgugcugcaugccgggccuggacggggcagcucucuuccucccguguacuggcugcccuccauccaccgcuauauguacccggagaugaagauuacgcaccccgcugggugcaugagccaguucaucaaguuuuucggagaacagauccucauucuguggaaauuugcccugcucagaaagcggauccugauuuucucuccucccccugucggcguuguguguuaccgcguguauugcuguugcugucuugcuaaugucucccugcccgggaucggaggcaccauuccggagagcaaaccuuucuuuuacgugaacguugccgacaucgaaucucucgagguggaagucuccuauguggccugcacaaccgagaagauuuucgaggagaaaagagaacuguacgauguuuauguggacaaucagaacgucaagacacaucacgaucaucuucaaccccugcucaagaucaauagcgcugaccgggaaaaauacagacgccugaacgagcagcggcagaugcugcucuauucccaagaaguggaggaggauuacaauccuugugaagaggaccuguuuguccuuuucuuucuggaacagaacaauagaaucuuccagacccuccuggaggugucugcgagccaggacaagacacuuaccgccgagcacgcucgcggcauggggcuggauccccaaggagaccgguccuuucuccuggaucugcucgaagccuacggcauugacguuaugcuggugaucgauaacccuugcugucccuga

SEQ ID NO: 71132 - RNA, 2145 nt, Artificial Sequence
  derived and/or modified sequence opt5 from KIAA1161__Homo_sapiens__NP_065753
augcugcagaacccccaagaaaagagccaggccuacccuagacggcgcagaccgggcugcuaugcuuaccggcagaaucccgaagccaucgcggcugccgccauguauaccuuccucccugacaacuuuucccccgcuaaaccuaagcccucuaaagaucugaagccucuucuggggagcgccgugcucggacugcuucugguccucgcugccguuguggcgugguguuacuauuccgugucucugcgcaaagccgagagacugcgggcugaacuccuggaccuuaaggccggcggguucagcauucgcaaucagaagggagagcaagucuuuagacuggcuuuccgguccggcgcccucgaucuggacucuugcagccgcgauggggcgcuucugggauguucccucacagccgacggccugccgcugcacuuuuucauccagacggugagacccaaagauaccguuaugugcuaccgggugcgcugggaagaggcugccccuggcagagcugucgagcaugccauguuucucggggacgccgcugcgcacugguauggaggcgccgaaaugcggacacagcauuggcccauucgccuggaugggcagcaagagccucagcccuucgugaccagcgacguuuacucuuccgaugcugccuuuggaggcauccuugaaagauacuggcugagcucucgggccgcugccauuaaggugaacgacuccgucccguuccaccucggguggaauagcacagagagaucucugcgccuucaggcgcgguaucaugauaccccuuacaaacccccugcuggacgggccgccgcucccgagcuguccuaucgcgugugugugggcagcgacgucacauccauccacaaguacaugguucggagauauuuuaacaaacccucucgcgugccugccccggaggcuuuccgggaccccaucuggagcaccugggcccucuacggcagagcgguggaucaggacaagguccugcgcuuugcccaacagauucggcugcaccauuucaauuccagccaccucgagaucgaugacauguauacgccugcuuacggggauuucgacuuugaugaagugaaguuccccaacgccucugacauguuuagacgccugcgggaugcuggauucagaguuacccuuugggugcauccuuuugucaauuacaacuccagccgguucggcgaggggguggaacgcgagcuguuuguuagagagcccacaggacggcucccggcccuggugagaugguggaauggcauuggggcgguccuugacuucacccacccuaaagcccgcgauugguuucagggacaccugagaagacuccgcucuagauauagcguggcuuccuucaaguuugacgccggcgaagucucuuaccugccccgggacuucagcacauaucgcccucugcccgauccuuccguguggagcagacgguacaccgagauggcucuccccuuuuucucucuggccgaaguucgcgugggcuaucaaucccagaacaucagcugcuucuuuagacuugucgaccgggauucuguguggggguacgaccugggacuccgcucccugauuccggccguucugacggugagcaugcuuggcuauccuuucauccuccccgauauggucgggggaaaugcugugccccagagaacagcgggcggggacgugccugagcgggaacuguacauucgcuggcuggagguugccgcuuuuaugccggccaugcaguucuccauucccccuuggagauacgaugccgaggucguggcuaucgcccaaaaauuugcggcucuccgggccucucugguggcuccccuucugcucgaacuggccggcgaggucaccgacacaggagauccuaucgugagaccccugugguggaucgccccuggcgacgaaaccgcgcaucgcauugauagccaguuccuuaucggggacacccuccugguugcucccgugcuggagccgggaaagcaggaacgggaugucuaucucccugccggcaaauggagauccuacaagggggagcuguuugacaaaacacccgugcuucugacggacuauccuguugaucucgacgagauugccuacuucaccugggcuucuuga

SEQ ID NO: 71133 - RNA, 3702 nt, Artificial Sequence
  derived and/or modified sequence opt5 from KIAA1211__Homo_sapiens__NP_065773
augggcaccagagccuucagccacgacuccaucuuuauucccgaugggggagcugagucugaacagacagugcaagccaugagccaggacaacauccugggcaaggucaaaacgcuccagcagcaacuggggaagaauauuaaauucggacagcgguccccuaacgcgaucccgaugaauaaggcuaacucuggcgaggccagccuugaagaggaucuguuucucaccucccccauggaaauuguuacacagcaggacaucgugcugucugaugccgagaauaaaagcuccgacaccccuagcucucuuuccccucugaaccuccccggggcuggaagcgagauggaagagaagguggcccccgucaagccuucucgcccgaaaagacauuucuccagcgcuggcacaaucgaaucugugaaucuggaugccauuccccuggcgaucgcccggcucgacaacuccgcugccaagcacaaacuggcuguuaagccuaaaaagcaacgcgugagcaagaaacauagacggcuugcccaggauccccagcacgagcagggcgggcuggagucccgcccuugccucgaccaaaauggacaucccggcgaagauaagccgaccuggcacgaggaagaaccuaacccccuggacucugaagaggagagacggcgccaggaagauuacuggagagagcuugaagcgaaauguaagcggcagaaagccgaggcugccgaaaagcgcagacuggaggagcaacggcuccaggcucuggaacgcagacugugggaggaaaaucggagacaggagcuccuggaagaggagggggaaggacaggagccuccccuugaagccgagcgcgcuccccgggaggaacaacagagaagccuggaggccccuggcugggaagacgcggagcgccgggaaagagaggagcgcgaacggcucgaggccgaagaggaaagacgccggcugcaggcucaggcccaagccgaggagagacgccggcuugaagaggacgcuagacuggaagaacggcgcagacaggaagaggaggaagggcggugcgccgaggaacucaaaagacaggaggaggaagaggcggaaggaugggaggaacuggagcagcaagaggcugaaguccagggcccgcccgaggcccuggaagagacaggcgaagggcgccggggagccgaggaggaagaucucggcgaggaagaggaagaggggcaggcucaccuggaggacuggagaggacagcuuuccgaacugcucaacgauuuugaggaacgccuggaggaccaagagagacuuaagccugaaggccagcgggagcauagcgaggagcccgggauuugugaggagcagaauccugaggccgaacgcagacgggagcaacagggacgcucuggcgauuuccagggcgcugacagacccgggccggaagagaagcgggaagagggagauaccgagccucugcucaaacaggaaggccccguggaggccgcgcaaccucccguugaacgcaaggaggccgcugcccuggaacaggggagaaaaguggaggagcugcgguggcaggaagucgacgagcgccagacgaugccuagacccuauaccuuucaaguguccagcggaggcaagcagauccucuucccgaaagugaaccugucuccugucacacccgcuaaggauaccgggcuuacagccgcgccccaggaaccuaaggccccgaaagcuagccccguucagcacgcccugccuuccucucucagcgugccccauaccgcuauucuggugacgggcgcccaacugugcggaccugccgucaaucuuucccagaucaaggacacagcuuguaaaagccuccugggccuggaggagaagaaacacgcggaagcccccgcuggggagaacccuccccggggaccgggcgaugccagagccgggucuggaaaggcuaagccucgccaggaaucccccagcucugccuccgcgcucgcugagugggccagcauucgguccagaauccugaaaaacgccgaaucugacccucgcagcuccgagcgggaccaacuuagacccggcgaugagucuaccccgcgcgggcggugcgacagcagaggcaaucagcgcaagacaccucccgugaacgcuaaauuuuccaucaugccugccuggcagaaguucagcgauggaggcaccgaaaccucuaaacaguccacagaggcggaaagcauucggaagagacccaugcuggggcccucugaggaaacggcuccucaaccgcccccugccggaguucgggagcucggcaaggggcccgagaaauccgaaaugcaccgcgagccugccgacaccacagaaggauguaaguuugcuaaagaucugcccagcuuccuggugccuucucuuccguaucccccucagaaggucguggcccauaccgaguuuacaaccagcuccgacagcgaaacggcuaauggcaucgccaaacccgauccuguuaugcccgggggcgaggagaaggcgucuccguucggaauuaaacucagacggacaaacuacucccugcgcuucaauugcgaccagcaggccgaacaaaagaagaaaaagagacacagcuccaccggcgauucugcugacgccgggccucccgcugccggaagcgcccggggcgagaaagaaauggaggggguggcucugaagcauggacccucccucccucaggagagaaaacaggcgcccucuacccgccgggauagcgccgaaccuuccucuagcagauccgucccgguggcucaccccggcccucccccugccagcucucagacacccgccccggagcaugacaaggcugccaacaagaugccucuggcgcaaaaacccgcucuugccccuaagcccaccucccagacaccucccgccagcccgcugucuaaacucucccgcccuuaccuggucgaacugcuuagccggagagcugggcgccccgaucccgagccuucugaaccguccaaggaggaccaggagagcuccgaccggagacccccuucucccccuggccccgaggaacgcaaaggacagaagagagaugaagaggaagaggccacggagcggaagccugcgagcccgccccucccugcuacccaacaggaaaaacccagccagacaccugaggccggccgcaaggaaaaacccaugcugcaauccagacacucucuggacgggagcaagcucaccgagaaaguggaaacagcccagccgcuguggaucacccuugcucugcagaagcagaagggauuucgggagcaacaggccacgcgcgaggaaagaaaacaggcucgggaggccaagcaggcggaaaaacucuccaaggagaauguuucugugagcguccaaccuggcuccucuagcguguccagagccgggagccugcacaaaucuaccgcucugcccgaggaaaagcgccccgagacagccguuucccggcuugaaagacgcgagcagcucaaaaaggcuaacacccugccuacaagcgugaccgucgaaauuucugauuccgcucccccugccccgcuggugaaggaggugacgaaacgguucagcacacccgacgccgcgccuguuuccaccgagcccgccuggcucgcucuggccaagagaaaagccaaggcuuggucugauuguccucagaucaucaaauga

SEQ ID NO: 71134 - RNA, 2973 nt, Artificial Sequence
  derived and/or modified sequence opt5 from KIAA1211L__Homo_sapiens__XP_005263981
augagagagcuggaagcccacagcacccuccggcgcauggcugccuucuaccagugcaucagacccgacccuuccgagcuggauaugauuucuacacgggugauggacaucaaacuucgcgaagcggcugagggccugggggaagauagcacgggcaaaaagaaauccaaguuuaaaaccuucaagaaguuuuucggcaaaaagaaaagaaaggagucuccgagcuccacagggucuagcaccuggaaacaaucccagacacggaacgaggucauugccaucgaaagcggacccguuggcuaugacucugaggaugaacucgaggagucccgcgggacccugggaagcagagcccuuucucaugacuccauuuuuaucccugaaagcggccaggaugcuacacggcccgugcgcguguucucucaggagaaugucugugacagaaucaaggcccugcaacucaagauucagugcaacgugaaaaugggcccucccccuccgcccgggggacugccugcuaagcggggcgaagaugccgggauguccagcgaggacgauggacugccccgcuccccucccgaaaugucucuccugcacgacguuggcccggggaccacgaucaaagugagcgucguguccccugaucauguuagcgacucuaccguguccgcgagaauuagcgacaauucucuugcccccgucgcugauuuuagcuacccugccgaguccucuagcugucuggacaacuccgcugccaagcacaaacuccaggugaagccccggaaucagcgcagcucuaaaaugagacggcuguccagcagagcgcaaucugagucccuuagcgaucugacaugcacccccgaagaggaagagaacgaagagaagccucuccuggagguguccccggaggaacgccccucuagcggacagcaggacgucgccccugaucggggccccgaaccuggacccccggcuccucugcccccucccgggggagccagagcucgccgggccagacuccagcauuccucugcccugacagcuagcguugaggaaggcggggugccuggagaggaccccuccagccgcccggcgaccccugagcuugccgaacccgagucugcucccacgcugcggguggaaccuccguccccucccgaggggcccccuaaucccggcccugauggaggcaagcaagacggcgaggcucccccggccgggccuugugcccccgccacagauaaagcggaagaggucgugugcgcuccugaagacguugccagccccuucccgaccgccaucccugagggagauacaacacccccugaaaccgaccccgcugccaccucugaggcucccuccgccagagacggcccugagcgcagcgugccgaaggaagcggagcccacgccucccguccucccugaugaagagaaagggcccccuggaccggcccccgaaccugagcgggaggcugaaaccgagcccgaaagaggcgccgggacagagccugaacgcauuggcaccgagcccucuacagcuccggccccuagcccucccgcgcccaaguccugucugaaacaccggcccgccgcugccagcgagggaccugcugccucuccgccccuugccgcugcggaauccccucccguggagccuggccccgggagccuggacgccgaagcugccgccccggagagaccuaaggcugagcgggccgaagcgcccccugcuggagccgagcgcgccgcucccgaaagaaaggccgagcggggcggggcggaacucagaggagcuaaaaaguuuuccguuucuagcugccgcgcccggccuagacccggcgugucccgcccgcuggagagagccucugggcggcugccucucgcucgcagcggccccgucuggagauccgaggccgcucuggaugaccuucagggacugcccgaaccucagcacgccaaaccgggcccccggaagcucgcggagcgcgggccucaagauucuggagacagagccgcuagccccgccggcccucggaaaagcccccaggaagcugccgccgcuccugggacccgcgagccgugucccgcggcccaggaaccugcucccuccgaggauagaaacccuuuccccgugaagcugcggucuacgucccuuagccugaaguaucgcgacggagccucucaggaggucaaaggcgugaagagauacuccgccgaaguucggcucgagagaagccugacagugcugccgaaagaagagaagugcccucucgggaccgcucccgcccugcgcggcacccgggcgcccucugaucaaggaaaaggcaaggcuagaccucccgaaccucuuuccagcaagccgccccugccucgcaaaccccuccugcaguccuuuacacugccucaucagcccgccccgccugacgccgggcccggagagcgggagccuagaaaggaaccccgcaccgcugagaaacggccucuuagacgcggcgccgaaaagagccugcccccggcggcuacagggccuggagccgauggccagcccgcucccccuuggaucacggucacccggcaaaagagacgggggacacucgaccagccgcccaaucaggaggauaagccuggcgcccgcacccugaaaucugagcccggaaagcaggccaaggugccugaaagaggccaagagcccguuaaacaggcugacuucgugcggagcaaguccuuucucauuacaccugucaaacccgccguggaccgcaagcagggggcgaaacugaacuucaaggaaggacuucagagaggcaucucucugagccaccaaaaucucgcccaguccgcugugaugauggagaaggaacugcaucagcugaaacgggccucuuaugcuagcaccgaucaaccguccuggauggagcuugccagaaagaaaucucaggccuggagcgacaugccucagaucauuaaguga

SEQ ID NO: 71135 - RNA, 3795 nt, Artificial Sequence
  derived and/or modified sequence opt5 from KIAA1217__Homo_sapiens__NP_001091970
augcagaccagcgagauggacagaaagcgggaagccuuccuggagcaccucaaacaaaaguacccccaucacgcuuccgccaucaugggccaucaggaacgccugagagaucagacacggucuccuaaacuuagccacuccccgcagcccccuucucugggggaccccguggagcaucucagcgaaacguccgcggauucucuggaggcuaugagcgagggagacgccccuacccccuuuucccgcggcagcagaacacgggccucucuuccugucguucgcuccaccaaccaaacaaaggaaagaagccugggggugcucuaucugcaguacggagaugagaccaaacagcugcggaugccgaaugaaauuacaucugcugacaccauccgcgcccucuucguguccgcuuuuccccagcaacugacgaugaagaugcuugagagcccuucugucgccauuuauaucaaggaugaguccagaaacguguacuaugaacugaaugacguucggaacauucaggaucgcagccuccugaaaguguacaauaaggaccccgcgcacgccuucaaccacaccccuaaaacaaugaauggcgauaugagaaugcagcgggagcuugucuaugcucgcggggacggacccggcgccccgagaccuggcuccaccgcucaucccccucacgccauccccaacucucccccuagcacaccggugccccauuccaugccucccagcccuucucggauccccuacgggggaaccagauccaugguugugccgggcaaugcgacgauuccucgcgaucggaucagcucucugcccgucagcagaccuauuucccccucuccuagcgccauccucgaacgccgggacgugaagcccgacgaggauauguccgggaaaaacauugcuauguacagaaaugaaggauuuuaugccgacccguaccuguaucacgagggccgcaugagcaucgcuucuucccacgggggacauccucuggaugugcccgaccacauuaucgccuaccaucggacagccaucagaagcgcuucugcguauugcaaccccuccaugcaggccgagaugcacauggaacaaagccucuaccgccagaagucccggaaguauccugauucucaucugccgacccuuggcagcaaaacacccccugcuucuccccacagagucuccgaccugcgcaugauugauaugcacgcccauuacaaugcccacggcccuccccauaccaugcagccugaccgggcuagccccuccagacaagccuucaagaaagagccggggacccucguuuacaucgaaaagccucggagcgcggcuggacugucuucccuuguggaucuggggcccccucucauggagaaacagguguuugccuauagcacagccacgauucccaaggaccgcgaaaccagagagcggaugcaggcuauggagaaacagaucgccucucugacaggccugguccaauccgcucucuucaagggaccgauuaccagcuacucuaaggaugccagcuccgagaaaaugaugaagacaaccgcgaacagaaaucacacggacagcgccggcacaccucacgugucugggggaaaaaugcuguccgcucuugaaagcaccguucccccuucccagcccccucccgugggcaccucugccauccauaugagccugcucgaaaugcgccgguccgucgcugagcugagacuucagcugcagcaaaugcgccagcuccagcugcagaaccaagaacugcucagagccaugaugaagaaagcggagcuggagaucucuggcaaggugauggaaacaaugaagcggcuugaggacccgguucagcgccagagagugcuggucgaacaggagcggcaaaaauaucuccacgaggaagagaagauugugaaaaagcugugugaacuggaggauuuugucgaagaccuuaaaaaggauagcaccgccgcuucccgccucgugacacugaaggacguugaggauggggccuuccugcucagacaggugggagaggcugucgccacgcugaaaggcgaauuucccacccuucagaacaagaugcgggccauccugcgcauugagguggaagcuguuagauuccucaaagaggaaccucauaagcuggacucucugcuuaaacgggugcgcagcaugacagauguccucaccaugcugagacggcacgugacagacgggcugcucaagggaaccgaugcggcccaagcugcccaguacauggccauggagaaggcuacggccgcggaggugcugaaaucccaggaagaggcugcccauaccagcggccagcccuuucacucuacaggggccccuggcgacgcuaaguccgaaguugucccccuuagcggaaugauggugagacacgcccaaucuuccccuguggucauccagccgagccagcauucuguggcgcugcucaaucccgcucagaaccugccucacguugccuccagccccgccgugccucaagaggcuaccuccacacugcagaugagccaggcuccccagucuccgcaaauuccuaugaauggcagcgccaugcagucccuuuucaucgaagagauccauucugucagcgccaaaaaccgcgcgguguccauugagaaggccgagaaaaagugggaagaaaaacggcagaaucucgaucacuauaacgggaaggaguucgagaagcugcuggaagaggcucaagccaauaucaugaaaucuauucccaaccucgaaaugcccccugcuaccggaccccugccuagaggcgacgccccgguugauaagguggagcuuagcgaagacucccccaauucugagcaggaccuggagaaacucgggggaaagagcccucccccucccccgccucccccucgccgguccuaccugcccggcagcgggcugacgacaaccagaucuggcgaugucguguauacaggacgcaaagaaaacaucaccgccaaggcuuccagcgaggacgcgggcccuucuccccagacccgggccacaaaguacccggcugaggaaccugccuccgccuggacgcccagcccucccccgguuaccacauccucuagcaaagaugaagaggaggaagaggaagagggggacaagauuauggcugaacuucagggauccagcggcgcgccccaaaccucuagaaugccugugcccauguccgccaaaaaucgcccugggacacucgauaagcccggaaaacagagcaagcugcaggacccucggcaguacagacaagcuaacggcucugccaagaaaagcgggggcgauuuuaagccgaccucccccucucugccugccagcaaaauccccgcucucuccccuucuagcggaaaguccagcucucugcccuccagcuccggcgacucuagcaaucuuccgaacccucccgccacgaaacccuccauugcgucuaauccucugagcccccagacagggccuccggcucauuccgccagccucauccccucugucuccaacggaagccugaaguuccagucucugacccacaccggcaaggggcaccaucuuuccuuuagcccucagucucaaaacggacgggcucccccuccccugagcuucuccucuagcccgccuucccccgccagcuccgugucucucaaucagggcgccaaagggacacgcaccauccacacaccuagccugacguccuauaaggcucagaacggcucuagcuccaaagccacccccucuacagcgaaggagaccagcuga

SEQ ID NO: 71136 - RNA, 1866 nt, Artificial Sequence
  derived and/or modified sequence opt5 from KIAA1279__Homo_sapiens__NP_056449
auggccaacgugcccugggcugaggucugcgaaaaguuccaggccgcgcuggcucucagcagaguugagcugcacaaaaauccugaaaaggagccguacaaauccaaguauucugcccgggcccuucuggaagaggugaaagcucuccugggccccgccccugaggacgaagaugagcgccccgaagcugaggacgggccuggagccggcgaucaugcgcuugggcugcccgccgagguggucgaaccugagggaccgguggcucaaagagccguucggcucgcugugaucgaauuucaccugggcgucaaccauauugacaccgaggaacugagcgccggggaggagcaccucgugaagugucugcgccuucugagacgguaccgccucucccaugauugcaucucucuguguauucaggcgcagaauaaccuuggaauccuguggagcgaaagagaggaaauugagacagcccaggcuuaucucgaauccucugaggcccuguacaaucaauauaugaaggagguuggcagcccuccccuggaccccacggaacgguuccucccugaggaagagaaacugaccgaacaggagcgcuccaagagauuugagaaaguguacacacacaaccuuuauuaccuggcucaggucuaccagcaccucgaaauguucgagaaggccgcccauuauugccacagcacccugaaacggcaacuugaacauaaugcuuaccaccccaucgagugggcgaucaacgccgcuacacugucucaguuuuauauuaauaagcucuguuucauggaggcccgccacugccuguccgccgcuaacgugaucuuuggccagaccgggaagauuagcgccacagaagauaccccggaggcggaaggagaggugccugaacuguaccaucagagaaaaggcgagaucgcucgguguuggauuaaguauugccucacgcugaugcaaaaugcccagcuuucuaugcaggacaacaucggggagcuggaucucgacaaacaauccgaacugcgcgcccuuagaaagaaagagcuggaugaagaggaaagcauucggaagaaagcuguccaguucggaaccggcgagcucugugacgccaucucugcuguugaggaaaagguguccuaccugagaccccuggauuuugaggaagcccgcgaacucuuccugcuugggcagcacuauguguuugaggcgaaggaguucuuucagaucgacggauacgucacagaccauauugaggugguucaagaucacagcgcccuguucaaagugcucgcuuucuuugaaaccgacauggagcggagaugcaagaugcauaaacgccggaucgccaugcuggaaccucugacagucgaucuuaauccccaguacuaucuccuggugaacagacagauucaguucgagaucgcucacgccuacuaugacaugauggaucugaagguugcgauugccgaccgccuccgggaucccgacucccacaucgugaaaaagaucaauaaccugaacaagucugcucuuaaauacuaucaacuguuucucgauagccugagagacccuaauaaggucuucccggagcauauuggcgaagaugugcugcgccccgccaugcuugcuaaauuucgggucgccagacucuacggcaagaucauuaccgccgacccuaaaaaggagcuggaaaaccuggcuacgucccucgagcacuauaaguucaucguggacuacugugaaaaacaucccgaggcggcccaggagauugaaguugagcuggaacuuagcaaggagauggugucucugcucccuacaaaaauggaacgcuuucggaccaagauggcucugacauga

SEQ ID NO: 71137 - RNA, 3015 nt, Artificial Sequence
  derived and/or modified sequence opt5 from KIAA1324__Homo_sapiens__XP_011540127
auggccgagcccggccacagccaucaccuguccgcuagagugcgggggcgcaccgaaagacggaucccucgccucuggagacugcuucugugggccggaacagcguuccaggucacgcaaggcaccgggccggagcuccaugcuugcaaggaaucugaguaccacuaugaauacacagccugugacagcaccggaucccgguggcgcguugccgugccccauacaccuggccugugcaccucucuucccgauccuauuaaagggacagaguguagcuuuuccugcaacgcuggagaguuccuggacaugaaggaucagucuuguaaacccugcgccgaaggcagauauagccucggcaccgggauccgguuugacgagugggaugaacugccucacggauucgcuucccugagcgccaauauggagcucgacgauucugcggccgaguccacgggcaacuguaccagcucuaagugggugccgcgcggggacuacauugcuuccaauacagaugaaugcaccgccacacugauguaugcugucaaccuuaaacagagcggaaccgugaauuuugaguacuauuaccccgacucuuccaucauuuucgaauuuuucguucagaacgaucaaugucagccuaaugccgacgauagcagauggaugaagacgacagagaagggcugggaauuucacuccguggagcugaaccgggggaauaacguccucuacuggcgcaccacagcguucucuguguggaccaaaguucccaagccugugcuggucagaaauaucgccaucaccggaguggcuuauacaagcgagugcuuucccuguaaaccgggcacguacgccgacaagcagggcuccagcuucugcaaacuuugcccugcuaacucuuauuccaauaagggggaaaccagcugucaucagugcgaccccgauaaguacucugagaaaggaagcuccucuuguaacgugcggccugccugcacagacaaggauuauuuuuacacccacacagccugugacgcuaauggcgaaacccaacugauguauaaaugggcgaagcccaaaauuugcagcgaggaucucgaaggggccgucaagcugcccgcuuccggaguuaaaacgcauuguccuccgugcaaccccggcuucuucaagacaaacaauagcaccugucagccuugccccuacgggucuuacuccaacggaagcgacuguacccgcugcccugccggcacagagcccgccgugggcuuugaguauaagugguggaauacccugccgacaaacauggaaacgaccgugcucucugggaucaauuucgaguacaaaggaaugacaggcugggaagucgcuggggaucacauuuauaccgccgcgggagcuuccgacaacgauuuuaugauccugacacuugugguuccuggcuucagacccccucagagcgugauggccgacaccgagaauaaggaagucgcccggauuacguuuguguucgagacccugugcuccguuaacugugagcucuacuuuauggugggggucaauucuagaacaaacacccccguggaaacauggaaaggcagcaagggaaaacaguccuauaccuacaucauugaggaaaauacgacaaccucuuucacaugggcuuuucaacgcaccaccuuccacgaggccagccggaaguauacaaacgaugucgcuaagaucuacuccaucaaugugacgaacguuaugaauggcguggccagcuacugcagaccuugugcgcuggaggccucugacgucggguccagcugcaccucuugucccgcuggauauuacauugaccgcgauuccggcacaugccauagcuguccgaccaacacaauccuuaaagcccaccagccuuauggggugcaggcuugcguucccuguggacccggcaccaagaacaauaaaauucauucucugugcuacaacgacuguacguuuagccggaauacaccuaccagaaccuucaacuauaauuuuuccgcccucgcgaacacagugacccuggccgggggcccgagcuucacaucuaagggacugaaauacuuccaccauuuuacgcucucccugugcggcaaucaagggcgcaagaugagcgucugcaccgauaacgugacagaccuucggauccccgaaggagaguccggcuucucuaagagcauuaccgcuuaugugugucaggccguuaucaucccucccgaagucacaggguacaaagcuggaguguccucucagccugugagccuggccgauagacucauuggcgucaccacggacaugacccuggaugggaucacaucccccgccgagcuuuuucaccuggaaucucucggcauuccugacgugaucuucuuuuaccgcagcaaugauguuacccaguccugcagcucuggacgguccacaaccauuagagugcgcuguagcccccaaaagacagucccgggcucucugcugcucccugggaccugcuccgacggaacgugugauggcugcaacuuccacuuucugugggagagcgcugcggccuguccccuuugcucuguggcugacuaucaugccaucguuuccagcuguguggccgggauccagaaaacaaccuacgucuggcgggagccuaagcugugcuccggaggcauuagccuccccgaacagagagugaccaucuguaaaacaauugauuucuggcugaagguugggaucucugcuggaaccugcacggccauucugcuuacagugcugaccugcuauuuuuggaagaaaaaucagaagcucgaguacaaauauagcaagcuggucaugaacgcgacacucaaagacugugaccugccggcugccgauuccugcgccaucauggaaggcgaggacguggaagaugaccuuauuuucaccucuaagaaaagccuguuuggcaagaucaaguccuucacaucuaaacaaccugcucccgugaccaucagccucuccgaggauucuuga

SEQ ID NO: 71138 - RNA, 3090 nt, Artificial Sequence
  derived and/or modified sequence opt5 from KIAA1324L__Homo_sapiens__NP_001136221
augcuguucagagcccggggccccgugcgcgggagaggauggggccggccugcugaggccccgcgcagagggcggagcccucccuggucccccgcguggaucugcuguugggcucucgccggaugccaggccgcuugggccggcgaccugccuucuagcuccucucgcccccuuccuccgugucaagaaaaggauuaccacuuugaguauaccgaaugcgacagcuccgggucuagauggcgggucgcuauucccaacagcgccguugauuguuccggacugccugaccccgugcgcggcaaagagugcacauucagcugugcgucuggcgaauaccucgagaugaagaaucaggugugcuccaaauguggggagggaacguauagccugggcucugggaucaaguuugaugaaugggacgagcuuccugccggauucuccaacauugcuaccuuuauggauacagucgugggccccagcgacucuagaccggaugggugcaauaacuccagcuggaucccucggggaaauuacauugaauccaaccgcgacgauuguaccguuucucugaucuaugccgugcaucucaaaaagagcggcuacgucuucuuugaguaucaguacguggacaauaacaucuucuuugaguucuuuauucagaaugaucaaugccaggaaauggacacaaccacagacaaguggguuaaacugaccgauaacggcgagugggggucccacagcgugaugcugaagucuggaacgaauauccucuacuggagaaccacaggcauucugaugggguccaaagcugucaagcccgugcuugugaaaaacaucaccauugaaggagucgccuauacaagcgagugcuucccuuguaagcccggcaccuuuucuaauaagcccgggagcuucaacugccagguuuguccucggaauacguacuccgaaaaaggagcgaaggagugcauccgcuguaaagacgauucucaguucagcgaggaaggcuccagcgagugcacagaaagaccgcccuguaccacaaaggacuauuuucaaauucauaccccuugcgaugaggaaggcaaaacccagaucauguacaaguggaucgagcccaaaauuugucgggaggaccugacagaugccaucagacucccucccucuggggaaaagaaggacugcccgccuuguaaccccggauucuauaacaauggcuccagcucuugccacccuugucccccugggacguuuuccgauggaaccaaagagugccgccccugcccggcuggcacagaaccugcccugggguucgaguacaagugguggaacgugcuucccggcaauaugaaaaccagcuguuuuaacgugggaaauuccaagugcgacggcaugaacgggugggaagucgcuggagaucauauucagucuggcgccgggggaagcgacaaugacuaucugauccucaaccugcacauucccggcuucaaaccuccgacauccaugaccggggccacgggcucugagcugggacggaucacauuuguguucgagacccucuguagcgcugauugcguucuguacuuuaugguggacaucaauagaaaguccaccaacgucguggaaagcuggggcgggacaaaggagaaacaggcguacacccacauuaucuucaagaaugccacauuuacguucaccugggcuuuucaacgcacaaaccagggacaggauaaucggagauucauuaacgacaugguuaaaaucuauucuauuaccgccacaaaugccguggauggcgucgcuuccagcugucgcgccugcgcgcuugggucugaacaauccggaagcucuugugugcccugcccucccggccauuacaucgagaaggagaccaaccaguguaaagaaugcccucccgacacguaucugagcauccaccaggucuacgggaaggaggcuugcauuccuuguggccccggauccaagaacaaucaggaucauagcgugugcuauucugacuguuucuuuuaccacgaaaaagagaaccaaucccuccacuaugauuucagcaaucuguccucuguuggcagccuuaugaacgggccguccuuuaccucuaagggaacaaaauacuuccacuuuuucaauaucagccugugcggccaugaagggaagaaaauggcccucuguaccaacaauauuacagacuuuaccgugaaggagaucgucgccggauccgaugacuacacgaaccuggugggcgcuuucguuugccagucuacaauuaucccuagcgaguccaagggguuucgggccgcucugagcucucaguccauuauccucgccgauaccuucaucggcgugacagucgaaaccacccugaaaaauauuaacaucaaggaggacauguuucccgugccuacaagccagauucccgacgugcauuucuuuuauaaaucuuccacggcgaccacaagcuguaucaauggaagaucuaccgccguuaagaugcgcugcaacccgacaaaauccggcgcuggggucauuagcgugccuuccaagugucccgccggaaccugcgauggcuguacguucuacuuccuuugggaaagcgcugaggccugcccucugugcacagaacacgacuuucaugagaucgagggggcguguaaacggggauuccaagaaacccucuauguguggaaugagcccaaguggugcaucaagggcauuucucugcccgaaaagaaacuugccaccugugagacagucgauuuuuggcugaaagugggcgcugggguuggagccuucaccgcugugcuccuggucgcccugacaugcuacuuuuggaagaaaaaccagaagcucgaauauaaguacagcaaacuggugaugacgaccaauuccaaggagugugagcuuccugccgcugacucuugcgcgaucauggaaggcgaggauaacgaagaggagguuguguauagcaacaaacagucccugcucgggaagcugaaaucucuggccacaaaggaaaaggaggaccacuucgaaagcguccagcuuaaaaccuccagaucuccgaauauuuga

SEQ ID NO: 71139 - RNA, 3354 nt, Artificial Sequence
  derived and/or modified sequence opt5 from KIAA1377__Homo_sapiens__NP_065853
augcuggccggcagacccgggacccggagcgcugugggagagcucggcacagaauccucugacaaccuggaucgcgccccucuugggccgagagagagcggaggccaccaucggcccggguccuaccuggacaugaagauccaccucgagaaaaaucuggaggaagaacgccagauucuucugcaacagcagaagaucugcagaaaccgggcgcgcaaauauuucgucgagucuaauagacggaagaaggcuuuugaagagaaacgcaaggaacaggaggagaaagaacaucaaauuagagagcagauccuccagcagcggaagcaaaaauucgaagagguuacggaaaaguuucagcgcgcccacgugccucugagccagagacggaaagccgugucccgcaagcccgucccuccccuggaggaggcucucaagcagauucaagaaucuaaccugaaaagcgaggugaaucuuccuuucuccagacggccgaccaucaacuggagagccaucgauagcgcucugcccucugcccucuccaagaaugaccauaaacaccagaagcagcugcuuagcaaaauuaacugugaaaaggagaugaaugaaaacaugcgcgcgacacuggccaccucuaaaaauguuuuucaacucaagcuggaggagacacagaagcugcucgaagaucagcaccuguccaaccuucagaaauucugcgacgaggugaaucaaaucaccaacagcgaaacacugucuuccauugauagccucgaggcuaccgaacaugaggagaucuaccugacgcuuaauaaggaacacuccaccucuauucagcggaacacaaucagccugaaaccugccaacaugcaguccaccaaucucagcuguuuugacgaggauaagcuggcuuucucuaaaacacagcauauuaacaauuggcugaccaaccucgacgccuccaauacgcaaaacgucacagcguuuagcgauauccugucuaagagcaaugugcuucccuccugggaauauuucaacucuaaggagcagaauccuagcccccugaacggaaccguugagagagccacaaauaccgcuaacaauuccgugccguuugucagcucuccucccauguucgugcucgacaaaaagugcgagaaaaccuccgagacaagcacgaugcgcaccacagauucuaccuccggcgccuuuaagcgggaaagaccucuggugacagagagccccaccuucaaauucuccaagucucagagcacguccgacucucuuacacaggaagucgcuaccuuucccgaccaagagaaguacagcgagcugaaccaggaaaauggcaccacauccaucccuaccagcuguguuccgguggccacaccccucgugcugccuucuaacauucaguccgcccgccccagcgcuaaaaacucuauccacauuaaggagaucgaugcgguccagugcuccgacaaacuggaugaacucaaggacgggaaagaggaagagauuaaguauuucaauuguaacaaggaggaacugccucuuuuuagcgauucuuuccaagacgccuacaucccccacaauccggauagcaaagacgagaagcagaaacuggcugaaacguccagccucucuaacgugaccuccaauuaugauuuuguuggacagcauaagaaaaugaaguacaacauccacgagcggaauggcgugagauuccugaaaagcauucugaagaaggaauccaaauacgagcauggguaucuuaaggcccucaucauuaaccaaucuuuuaaauucggaaaucagaaggccgcugccauccgcgacagcauugagcugacaaaagaaaagggcgcggagaucccuaagaccaucaaaaagcugcggugguuugaugaaacauccaacauugagaauaacgcugaaaauucucacagccucaaaaacaagaccgggacgacccagcagcauucccaacaguuccacauccagucuggagccggcagcaauauuaucuccgucagcacaugcgccgugaacucugcugacaccaaaaaguccagagaagacagcauuucugagaacguuacaacccugggcggguccggagccgaucacaugccccuuaauuguuuuaucccuagcggcuacaacuucgcuaagcaugccuggcccgcgucuaaaaaggaagaguccaaaauuccugugcacgacgauagcaagacgaaacaggggaagccccaacgcggacgggccaagaucaucagaaaaccgggcuccgcuaagguccagagcggguuuauuugcacaaaucggaaaggagccgugauccagccucagucugcuagcaaggucaacauuuucacccaagcccagggcaaacugaucauucccugucccccuccgcaguccacaucuaauauccgcagcggcaagaacauccaagugucccagugccagcccguuaccccugaaaauccccagaacauuaucacccauaauucuuucaacagcaaacacgugcucccuacagagcacucccugaaucaauggaaccaggagucuagcagcccccuguccaaugcgugcucugaccuugucacggugauuccuucccuccccagcuauuguucuuccgaaugccagaccuuugccaagaucaaccauagcaaugggacacaggcuguugccagacaagaugcuacccuguacuguacacagcgguccccggugugcgaggaaucuuauccuagcgucacccugagaacggccgaggaagaguccgugccccucuggaagcgcggaccuaacgugcugcaccagaacaaacgggccacaggcagcaccguuaugagacgcaagagaauugcugagaccaaacggcgcaauauccuugaacagaagagacaaaaccccgggucugucggacagaaauacuccgagcagaucaauaacuucggccagagcgugcugcucucuagcuccgaaccgaagcaaacaacccgggggacaucuuauauugaggaagugagcgacuccacgucugaguuucugauggcggagaaucuggucaaggccagcgugccugaagaugagauccuuaccguucucaacuccaaacagauucaaaagagcaaucugccccugaacaaaacacagcaguucaauaucuguacccucucugcugaggaacagaagauucuggagucccuuaacgaccugagcgaacgccuccauuacauccaggaguccaucugcaaaaauccuucuauuaagaacacacugcaaaucauuccccugcuugaaaagagagaggaucggaccagcuccugucgcgacaaaagauga

SEQ ID NO: 71140 - RNA, 1572 nt, Artificial Sequence
  derived and/or modified sequence opt5 from KIAA1456__Homo_sapiens__XP_005273641
augaagauccaguucaaaaaggagugccaaaacagaaaaggccuguguuuucuccagcggcugacccaggaaguguaccacgagaaggaccgcacaauuagcuuccauuccuauaaauuuucuuucacgcuucacaucgaaaaggucaugagaagcaauugccauucccuggagguugaaaccgccgugauucacaaggauaaacggauggaccaugaggcugcccagcucgagaagcaacacgugcacaacgucuacgaaucuacagcgcccuauuuuagcgaucugcaguccaaggcuuggccucgcgugagacaguuccuucaggagcaaaaaccggggucucugaucgccgacauuggauguggcaccgggaaauaccucaagguuaauagccaggugcauacagucggaugcgauuauuguggcccccugguggaaaucgcccggaaccgcgggugcgaggcuaugguuugugacaaucugaaccucccuuuuagagaugagggauucgacgccaucauuuccaucggcgugauucaccauuuuagcaccaagcagcggcgcaucagagcuauuaaagaaauggcccggguccuggugcccggcgggcagcuuaugaucuacgugugggcgauggagcaaaagaaucgccacuucgaaaaacaggauguccugguuccuuggaacagagcccucugcucucagcuguuuuccgagagcucucaauccggacggaagcgccaguguggcuaucccgaaagagggcacccuuaccauccgcccugcagcgaguguucuugcuccgugugcuucaaagagcaguguggaagcaagcggucccacucugugggcuacgaaccugcuauggccagaacaugcuuugcuaauauuagcaaagagggggaagaggaauauggauucuacuccacccuuggcaagagcuuccgcucuugguuuuucucccggagccuggacgagucuacgcucagaaagcagaucgagcgcguccggccccugaaaaacaccgaagugugggccagcuccacaguuaccgugcaaccuucuagacauagcucccuggauuuugaccaccaggagcccuucagcacaaagggccagucucucgaugaagaggucuuuguggaauccagcucugggaaacaucuggaguggcuucgcgcgccgggaacccugaagcaccucaauggcgaccaccagggggagaugcggagaaacggaggcgggaauuuccuggacuccacgaacacaggaguuaauuguguggaugccggcaacaucgaagacgauaacccuagcgcuuccaaaauucuucgccggaucucugccgucgacagcaccgauuuuaaucccgacgauacaauguccguggaggacccucaaaccgauguccuggacucuaccgcuuucaugagauauuaccauguguuucgcgaaggcgagcucugcagccugcugaaggagaacguuuccgaacuccggauucugagcucugggaaugaucacggaaacugguguaucauugccgagaagaaaagaggcugcgacuga

SEQ ID NO: 71141 - RNA, 4080 nt, Artificial Sequence
  derived and/or modified sequence opt5 from KIAA1462__Homo_sapiens__XP_011517910
auguacagcguggaggaccugcucaucucccacggcuauaagcugucuagagaucccccugccagccgggaagacaacccgaaagggcgccaggcugccagaaccggaacacgggcgggccaagggcuucagaauggacaugaggauggccccgcugcccuggcccaccgcaagacguccgcugggaaaggacaugucucugacagcgaauccagacggucuaccccucgcggccacggcgagccccagagcacauccgccagcagaaccucugaagcuggguucugcaaccagccucccuccgccuggagcucucauccuccgacaggaaaugaucaagcguaccggcgcagaggccggcaggaggcccgcucccagaagcccagagagcacgaaaaccucgaggcucgggggauggcccaggcucacagccugccuguucaugugcgcgaaggacccugggaggugggcgggagaucugagcacgucaugaaaaagccugugugggaagaggaacuucggauguccggacccgccaaguggcaaaauguuagccuggaguccuggaaccagccgagaaaacucggccgccagaugucugacggcgauggggaacggcuguuucaggaccuguauccuuucauucaaggagagcaugugcucaauagccagaacaagggcaaauccagaagccugccccgcguccuuucuccugagucccugagcuguaccgaaauccccauuccccucaaugagcggcacucuccuaagaugccgcccuacccucccacaugcgcgccuaaccuggauagcaccagaaauuccgaaaaaucuggguguagcgcccccuuuccgcgcccuaaguucggacggccccuuaagccucccuccuauagcucucaccagcaauccagaggcggggcugacagcucugauucccaggacagccagcagauggaugccuacgugccucgccaugagcugugccucuccgaccccggacuggaaccgccuguuuaugugcccccucccucuuaccggagcccgccccaaaacaucccuaaucccuaccuggaggacacggucccuauuaacguguguggcggccacucccagcagcagucucccaccgagaaagcuggggccagcggacaaccucccuccggcccgccugggacaggaaaugaauauggcgugagccccagacucccucaggggcugcccgcccauccgcgcccugucaccgcuuacgauggcuuuguucaguauauccccuucgacgauccucggcuuagacacuuuaagcuggcgcagccccaaggauucugcgaggacaucaaacucgaugacaagucuuacaacuccagccccgugacagcccaggaaccugcucauggcgggaugcagccggauggagccauuuggaacccccagucucugaucccucccuccggcgacgagcgggggcuugugcuggccgauagcucuccucgcuggcucuggggacaacccccuggcgacggggaaaauagcggccugccgaaccagagagaucggugugucgcuagaggacaguggcccgacgugcgcggcucccaacacgggcacaccggacggcagguuagcucuccuuauucccagggcgagagcacgugcgagacacagaccaaacugaagaaauuucaaacagggaccagaaccaagaaguccucuaaaaagaaaaugaaugaaacaauuuucugucucgugagcauccccgucaaguccgagucucaucugccugaccgcgauauggacaacaaugaucuuaaacccagcgccgaccagaagaacggauccgauaagucuccggcgcugcaggaacagagccuccuguccaugagcucuacggaccuugagcugcaagcucucaccggcuccaugggcgggagaacagaguuucagaaacaggaucugggagaaccugaggaagaccggcagaccaaugaucugagcuucauucaccucacaaagcaucgcgagcugaaacacucuggcuccuggcccgggcacagauaccgggaccaacagacccagacgagcuuuucugaagaaccccaauccagccagcuucugccuggagccaagcucggcgggcccucccgcgccgcucugagcccuaaaugcucugauccggccgcuagcgaggcccagacacauaccgcguuccccaccggagaccacaagcagagaccuuccgcccggaaccugaagggccaucgcucucuuagccccuccucuaauagcgcuuucuccagaacaucucucagcguggaucaagccccuacccccaaagcugggcggucccagccguguguugacgugcacggccugggagcccauccuggccccaagcgcgaagucgugaaaggggagccuacaggacccugcaacagcaagcagcuguuuggccaguuccuccugaaaccugucucuagacggcccugggaccuuaucucccaacuggagagcuuuaauaaggagcuccaggaagaggaggaaucuuccagcuccucuagcuccuccucuuccagcucugaggaaagcgaggcggaaccgcagcaggagaacagagcccacugccgccaagaggaugugggguuccggggaaauuccccugaaaugagaguugagccccagccccgcaugugggugccugaaucuccggucugucggagcggcagaggcgaguccaagucugagagcugguccgaggaacugcagcccgggcacccucgcgcuuggcccccuagccccggacgguuuagaguggaagagggcgggggagccccuuucugcucugcugacggcuccacgagcgccgaaaaacgccaucuggagguuuccaacgggauggaugagcuugccggaucuccguuucccgugacccggaugagcuccagaucuagcgacgcuaagccucuccccgcguccuauccugccgaaccccgggagccgcaggaaagcccuaaaauuacaucugcuuucuccagcgucaagcccucugaggccgugccccgcaaauuugauuccggcggcgaaagaggggccggacugccucugagccucucuaauaagaaccggggccugagcgcucccgaccuucgcuccguggggcugaccccuggacaagagcagggcgccucugagcucgaagggagccugggagaggcguccacaaucgaaaucccgcccggcgagagccugcaggcuagagccgcccggauucuuggcaucgaaguugcugucgagucccuccugccugggauuagacgcgccggacaaaaccagcccgcggagccugaugcuucugccuguacccccgaaagcccgcaggaggaacugcucucccggccugcccccgcugacgugccuagagugucuacggaugccuucuacggccgccggaaaugcggguggaccaagagcccccuguuugucggagacagagauuccgcucgccgggccccucaggcguucgagcacucugacguggauggcguugugacaagcaccgaccccgucccggagccugaacccagcccccuugagagcaaguuuuucgaacaaaaagacguggagacaaagccuccguucagaucuacccuguuucauuucguugaacgcacgcccuccguggccgggagcgagaaaagacuccggucuccuuccaaggucaucgagagccugcaggaaaaacuggcuucucccccucgcagagccgaucccgaccggcuuaugcgcaugaaggagguguccagcguuuccagaaugcgggugcucagcuuuagaaaugcugauucucaggaagacgccgaggaacugaaggccacaacccgcggacaggcuggccugccuggcgggcucgucagccccggauccggcgaucgggcgcaaagacuggggcacucucuuagcguguccaaagacucuauuagccgcgaggagaaggaacauccggccgcucagaaagagaaguccauggaucaggacuucugguguccugauucuuacgaccccagccggguggaaagagucuga

SEQ ID NO: 71142 - RNA, 3651 nt, Artificial Sequence
  derived and/or modified sequence opt5 from KIAA1468__Homo_sapiens__NP_065905
auggccgcuauggcccccggcgggagcggauccggcgggggagugaacccuuuccugucugacagcgaugaggacgaugacgaagucgcggcuaccgaggaaagacgggccguucuccgccugggcgccggguccggacuugauccgggcucugcuggcagccugucuccccaggacccuguggcccucggguccagcgcuagacccggacugccuggcgaggccuccgcggccgcuguggcccuugggggaacaggcgaaacgcccgcucggcugagcaucgaugccauugcggcccaacuccugcgcgaccaguaccugcucaccgcucuggagcuucacacagagcugcucgaaucugggagagagcugccucggcuucgcgauuauuuuuccaauccgggaaacuucgaaagacagagcggcacacccccuggcaugggggcccccggagucccuggcgcugccggggugggaggcgccgggggacgggagcccucuaccgcuuccggcggcgggcagcugaaucgcgcgggaagcaucucuacccucgacucccuggauuuugccagauacagcgacgauggcaaccgggagacagacgaaaagguugcugugcuggaguucgaacuccgcaaagccaaggagaccauucaagcccugagagcuaaucuuacgaaagccgcggaacaugaggucccgcugcaggagcggaagaacuauaaauccucuccugaaauccaggagcccauuaagccucucgaaaagcgcgcucugaauuuucuugugaacgaguuccugcucaaaaauaacuacaagcugaccagcaucacauuuuccgacgaaaaugaugaccaggauuucgagcugugggacgauguugggcucaacauccccaaacccccugaccugcuucaacuguauagagauuuuggaaaucaccaggugaccggcaaggaccucgucgauguggccagcgggguggaggaagacgagcuggaagcccuuacaccgauuaucucuaaccugcccccuacccucgagacgccccagccugcugaaaauuccaugcugguccagaaacuggaggauaagauuagccuccugaacucugagaaguggagccuuauggaacaaauccggagacugaaauccgagauggacuuccucaagaacgaacauuuugccauucccgcuguuugcgacucugugcagccgccucuggaucagcugccccacaaagacagcgaggauuccggccaacauccugacgugaauagcucugauaagggcaaaaacacagacauccaccuuuccauuagcgaugaggccgacucuaccauccccaaggaaaauuccccuaacagcuucccccgccgggagagagaaggaaugccgccuuccucucucagcuccaaaaagacaguccacuuugauaagcccaaucgcaaacugucucccgcguuccaucaggcccugcucagcuucugucggauguccgcugacagcagacugggguacgaggugucucgcaucgccgauuccgaaaagagcguuaugcuuaugcugggacggugccucccucacauugugccgaacguccugcuggcuaaaagagaggagcuuaucccccucauucuguguaccgccugccugcauccugaacccaaggagcgcgaccagcuccugcacauccuuuuuaaucugauuaaacggccugaugacgaacagagacaaaugauccucaccggcuguguggcguucgcccgccacguugggcccacacggguggaggcugaacugcugccucagugcugggagcagaucaaccauaaguaucccgagagacggcuucucgucgccgaaucuuguggagcucuggccccguaccugccuaaggagauucgcuccagccucgugcugucuaugcuucagcaaaugcugauggaagacaaagccgaucucgucagagaggcugugaucaagagccugggcauuaucaugggguacauugacgaucccgacaaauaucaccagggcuuugaacugcuucucuccgcgcugggagauccuagcgagcggguugugucugccacgcaucaggucuuccugcccgcuuacgccgccuggaccacagagcucggcaaucugcagucccaccuuauccugacccuccugaacaagaucgaaaaacugcuuagagagggggaacauggacuggacgagcacaagcuccacauguaucugagcgcucuccaaucccugauuccgucucuuuuugcccuggugcuccagaaugcgccuuucagcuccaaggcuaaacugcauggcgagguuccccagaucgaagugacacgcuuuccucggcccaugucuccccugcaggaugucagcaccauuaucggguccagagagcaacuugccgugcugcuccagcuguacgacuaucagcucgaacaagagggaacgacaggcugggaaucucugcuuugggugguuaaccagcugcucccucagcugauugagaucgucgggaagauuaaugugaccagcaccgccugcgugcacgaguucucccgcuuuuucuggagacugugucggacauuuggcaaaaucuucaccaacacaaaggucaaaccgcaguuucaagaaauccuucgccugagcgaggaaaauauugauucuuccgcuggaaacggcgugcucacgaaggccaccguucccaucuacgcgacaggggugcugaccugcuauauucaggaggaagacagaaagcuccuggucggauuccuugaggaugugaugacacugcugagccucucucaugcuccucuggacucccuuaaagccagcuucguugagcugggcgccaaccccgcuuaccacgaacuccugcucaccgugcugugguacggggucgugcacacgucugcccuuguucgguguaccgcugcccgcauguuugagcugacacugagaggaauguccgaagcgcucguggauaagcgggucgccccugcucuggugacccuuagcuccgaccccgaguucagcgugcgcaucgccacaauuccugcuuuuggcaccaucauggaaacggucauccagagagagcugcucgagcggguuaaaaugcagcuggccucuuuccucgaagacccgcaauaucaggaucagcauagccugcacacagagauuaucaagaccuuugggcgcgugggccccaaugccgaaccuagauuccgggacgaguuugugauuccccaucuucacaaacuggcucuggucaacaaucuccagaucguggauuccaagagacuggacauugcgacacaucuuuucgaggccuacucugcucugagcugcugcuuuaucuccgaagaucucaugguuaaccacuuccugccuggacuccgcugucugcggaccgacauggagcaccuuucucccgaacaugaggugauccugagcuccaugauuaaagaaugcgagcaaaaggucgagaauaagaccgugcaggaaccgcagggcucuaugagcaucgccgccucccugguuagcgaggauacaaaaacgaaguuucucaacaaaauggggcaacugaccacaucuggagcuaugcuugccaauguguuccagagaaagaaauga

SEQ ID NO: 71143 - RNA, 2718 nt, Artificial Sequence
  derived and/or modified sequence opt5 from KIAA1524__Homo_sapiens__NP_065941
auggacagcaccgccugccugaagucccuccugcuuacagugucucaguacaaagcugucaagagcgaggccaacgcgacgcaacugcucagacaccuggaaguuaucuccggccagaaacuuacccggcuguucacaucuaaucagauucucaccagcgagugucuguccugccugguggaacuccuggaggaucccaacaucucugcuagccuuauucuguccaucauugggcuccugagccagcuugccguggacaucgaaacacgcgauugucugcaaaauaccuauaaccucaauucuguccuggccggagugguuugcagauccagccauacagacucuguguuucugcaguguauccagcuccugcagaaacuuaccuacaacgucaaaauuuucuauuccggcgcuaauaucgaugagcugauuacguuucucaucgaccacauucaaagcucugaggaugaacugaagaugccuugccuugggcugcucgccaaccugugucggcauaaucuguccgugcagacccacaucaagacacucagcaacguuaaauccuucuaccgcacccugauuacacuucuggcucauucuagccucaccguggucguguuugcccuguccauccuuagcucucugacgcucaaugaggaagugggagagaagcuguuccacgcgagaaacauccaccagacauuucagcugauuuucaauauccucauuaacggcgacgggacccugacacggaaauauuccgucgaucuucugauggaccuccugaagaauccgaaaaucgccgauuaccugacccgcuaugagcauuuuagcucuugccuucaccaaguucucggacugcugaacggcaaggaccccgauagcuccucuaaggugcucgaacugcuucuggcuuucuguagcgugacccagcucagacauaugcugacacagaugauguuugagcaauccccucccggcagcgccacgcuggggucucacaccaaaugccuugaaccuacagucgcucuccugcgguggcugucccagccccucgacggaagcgagaacuguucugugcuggcccuugaacuguucaaggagauuuuugaggacguuaucgaugcggccaauugcuccagcgcugaccgcuucgugacccuccugcugccuacaauccuugaucagcuccaguucaccgaacaaaaccuggacgaggcccugacgagaaagaagugcgaacggauugcuaaagccaucgagguccuccugacacuuuguggcgaugacacccugaagaugcacauugccaaaauccucaccacagugaagugcaccacacugauugaacagcaguuuacguacgggaagaucgaucugggauucggcaccaaaguugcugacuccgagcuuuguaagcucgcggccgaugugauccugaaaacacuggaccucauuaauaagcugaaaccgcuuguccccgggauggaggugucuuuuuacaagauccugcaggauccucgccucauuacaccccuggcuuucgcccugaccagcgacaacagagaacaaguccaguccggacuucggauccugcucgaggccgcuccucugcccgacuuuccggcccucgugcugggcgaaucuauugcggcuaauaacgccuaucgccagcaggagaccgaacauaucccuagaaagaugcccuggcaaagcuccaaucacagcuucccuacgucuauuaaaugccuuacaccccaucugaaggauggcguucccgggcucaacaucgaggagcugaucgaaaaacugcaguccggaaugguggucaaggaccagauuugugaugugcggaucagcgacauuauggauguuuacgagaugaaacuuucuacccuggccuccaaggaaagcagacuccaggaccugcucgagaccaaggcucuggcccuugcucaagccgaucgccugaucgcgcagcaccggugccagagaacacaagccgagaccgaagcucgcacgcucgccucuaugcugcgggagguggaacgcaaaaaugaggaacugagcguccuucugaaggcucaacagguggaguccgagagagcccagagcgacauugaacaucucuuucagcacaaccggaaacuggagucuguggcggaggaacacgaaauccucacaaaguccuauauggagcugcuucagagaaaugagagcaccgagaaaaagaacaaggaucugcagaucacaugugacucccugaauaaacagauugaaaccguuaagaaacucaacgaaucucugaaggagcaaaaugagaaaagcaucgcccagcuuauugaaaaggaggaacagcgcaaagagguccagaaccaacugguggaucgggaacauaagcucgcuaaccugcaccagaagaccaaagugcaggaggagaagaucaaaacacuccaaaaggaaagagaggacaaagaagagacgauugauauccugcgcaaggaacuuucccggaccgagcagaucagaaaggagcugucuauuaaagccagcucccuggaaguccagaaggcucagcucgagggccggcuggaagagaaagaaucucuugugaagcugcaacaggaggagcucaauaaacauagccacaugaucgccaugauucacucccugagcgggggaaagaucaacccugaaacaguuaaucucucuauuuga

SEQ ID NO: 71144 - RNA, 5853 nt, Artificial Sequence
  derived and/or modified sequence opt5 from KIAA1549__Homo_sapiens__NP_001158137
augcccggcgcccggcggcgcagaagaggggcugccauggagggaaagccucgcgcgggcguggcucuggccccggggcccagcggaagacggccuuccgcccgcugcgcuagacggcgcagacccggccuccugcuuccugggcuguggcuccugcuucuggcccggcccgcuucuugugccccugacgaacucagcccggagcagcacaaccugucccuguacucuauggaacucguccugaaaaagagcaccggacauuccgcggcccaaguugcucuuaccgagacggcccccggcucucagcacagcuccccucugcaugugaccgcucccccuagcgccaccaccuucgauacagcguuuuucaaucagggcaagcagaccaagucuacagccgaccccuccaucuuuguggcuaccuaugucagcgugacgucuaaagaaguugccgugaacgaugacgagauggauaauuuccucccggacacccacuggacaaccccucgcauggucucccccauccaauacaucacagugagcccucccgggcugcccagagaggcucuugaaccuaugcugaccccgucucuccccaugguuucccugcaggaugaggaagugacgagcggauggcagaacacaacccggcagccugccgccuaugcugaguccgcgucucauuuucacacauuccgcagcgccuuuagaaccuccgagggcauuguccccaccccugggcggaaucuggugcucuaccccacagacgcuuauagccaccugucuuccagaacgcuuccggaaaucguggccagccugaccgagggagucgaaacaacccucuuccugucuagccgcucccuuaugccucaaccccugggcgaugggauuacaaucccucuccccucucugggagagguuagccagccucccgaagaggugugggccaccuccgcugaccgguacacggaugugacaaccguccugagccagucucucgaggaaaccaucuccccgagaacauauccuaccgugacagccagccaugcggcucuggccuuuucucgcacgcacagcccgcuucugagcacaccccucgccuucgcuuccucugccagcccuacagacguuuccucuaacccguuucugcccagcgauuccagcaagaccucugagcuucauuccaauagcgcucugccuggccccguggacaacacacacauucucucuccugucuccagcuuccggcccuacaccuggugcgccgcguguacggugccuucuccccagcaaguucuggccaccagccugauggaaaaggacgugggcuccggggauggagcugagacacucugcaugaccguccuggaagagagcucuaucucccuuaugagcuccguggucgccgacuuuucugaguucgaagaggauccccaaguguucaauacacuguuuccuagcagacccauuguuccucucuccucucgcagcauggaaaucuccgagaccucugugggcauuagcgcugaagucgacauguccagcgugacgacaacccagguucccccggcccacgggcggcugucugugccugcgucccuggaucccacagccggaagccuuucugucgcugagacccaagugaccccuuccagcgugacaacggccuucuuuucuguuaucaccuccauucuccuggacagcuccuucagcgucaucgcuaacaaaaauacacccucucuggccgugagagaucccagcguguuuaccccuuacucccucgucccgucuguggagagcucccuguucucugaccaggaacgcagcuccuuuucugagcauaagccccggggcgcccuugauuucgcuagcuccuuuuucagcacaccuccccuggaacucucuggguccaucagcucuccuuccgaggcgcccgccagccugucccugaugccuucugaccuuagcccguuuaccucccagagcuucucuccccucguugagacguuuacacuguucgauuccagcgaccugcagucuagccaacucucccugccuucuagcaccaaccuugaguucucccagcugcagcccucuagcgagcucccucugaauaccauuaugcugcuucccuccagaagcgaagugucuccgugguccagcuuuccuuccgacucucucgaguucgucgaagcuagcacagugucccugaccgauucugaggcccacuuuacaagcgccuucaucgagacgaccuccuaucuggaaagcucucucauuucccaugagagcgcuguuacagcccuggugccgcccggaucugaauccuuugacauccuuaccgcgggcauucaggcuacaagcccucugaccacgguccacaccacacccauccucaccgagucuagccuguucuccacacugaccccuccggaugaccaaaucucugcccuugauggccaugugagcguucucgccuccuuuagcaaagcuauucccacagggaccgugcugaucacggacgccuaccugccuuccggaucuagcuucgucuccgaagcgacacccuuuccucuccccaccgagcugaccguggugggcccgucucuuacaccuaccgaggucccccugaacacgagcacagaaguuuccaccacaucuaccggggcugccacaggaggcccucucgauagcacccugaugggggacgccgcuucccagucucccccugaguccuccgccgcucccccgcugccuagccuucgccccgugacggccuucacccuggaagcgacaguggauacccccacacucgccaccgcuaagccuccguaugucugugacauuacggugcccgaugccuaccugaucacaaccguucucgcucggagagccgugcaggaguauauuaucacagccaucaaagaaguccugcggauucacuuuaaucgcgcuguggagcuuaagguuuacgagcuguucaccgacuuuaccuuccucgugacaucuggcccuuucgucuauacggcgaucuccgugauuaacguucugaucaacagcaagcuggugagagaucagacaccccuuauucugucugucaaaccuuccuuucucgugcccgaaagccgguuccaagugcagacaguccugcaguuuguuccuccguccguggacaccggauucugcaauuuuacacagagaaucgagaagggccucaugaccgcccuguucgaagugcgcaaacaccaucaagggacguacaaccuuacaguccagauucugaauaucaccaucagcucuagccgggugacccccagacgcggaccuguuaacauuaucuuugcugugaaguccacacagggcuuccucaaugggucugaggucagcgagcugcugagaaaccuuuccgugguugaauuuucuuucuaccugggauaucccgugcuccaaauugccgagccuuuucaguacccccagcugaaucucagccagcugcuuaaauccucuuggguccggaccgugcugcugggcgucauggaaaagcaacuccagaacgagguguuccaggccgaaauggagcgcaaacuggcucagcuucugagcgagguuuccacaagacggcgcauguggagacgggccacgguggcggcugggaauagcgucgugcaaguugugaacgucucucgccucgaaggcgacgauaauccggugcagcugaucuauuucguggaggaccaggauggagaaagacucuccgccguuaagagcucugaccugauuaacaagauggaucuucagcgggccgcuaucauccugggcuaccgcauucaaggggucaucgcccagccuguggacagagugaaacggcccucccccgagagccaguccaauaaccugugggucauugugggaguugugaucccuguccucgugguuauggugauugucgugauccuguauuggaaacuuuguagaaccgauaaacuggacuuucaacccgauacaguugcgaauauccagcagcgccagaagcuccaaauuccuucugugaaaggcuucgacuuugcuaagcagcaccuggggcagcauaacaaggaugacauccucauuauccacgaaccggcgccccugccuggaccccuuaaagaucacaccacaccuagcgagaacggcgacguccccucccccaagagcaaaauuccuucuaagaaugugcggcauagagggcgcgugucccccagcgacgccgauucuaccgucagcgaggaauccucugagcgggacgcuggcgauaaaacgccuggagccguuaacgacggcagaagccaccgcgcuccccaguccgggccuccccugccgucuagcggaaaugaacaacauuccagcgccucuaucuucgagcacguggaucggaucuccagaccucccgaagcgagccgccgggugcccuccaagauucagcugaucgccaugcagccuauuccggcucccccuguccagagacccucuccugccgaccggguggcugagagcaacaagaucaauaaagagauucaaaccgcccuccgccauaaguccgaaaucgagcaccacagaaacaaaauucggcugcgcgccaagagacggggccauuacgaauuucccguuguggaugaccuuucuagcggggauacaaaagagagacaccgcgucuaucggagagcucagaugcagaucgacaagauccuggauccuaccgcguccgugcccagcguuuucauugagccgcgcaagucuucccggaucaaaagaagcccuaagccccgccggaaacaucaggugaauggaugcccugccgacgcugaaaaggacagacucauuacaaccgauucugacggcacauaccgcagacccccggggguccacaacuccgccuacaucggcuguccuagcgaucccgaccugcccgccgaugugcaaacgccuucuuccgucgagcucggacgguaucccgcucugccuuuuccggccagccaguacauucccccucagcccucuaucgaagaggcgcgccaaaccaugcauagccuucuggacgaugcuuucgcccugguggccccuuccagccagcccgcuuccacagccggcguugggccuggagugccgcccggccucccugccaauucuacccccagccaggaagagagacgggccacccaguggggguccuuuuauucuccugcucaaacagccaacaaucccugcagccgcuacgaggacuauggaaugacgccgccuaccggcccccugcccagaccuggcuucgggcccggacuucugcaguccacagaacucgugccuccggauccccagcagccucaggcuucugccgaggcucccuuugccgcgcggggcaucuacagcgaagagaugccuuccgucgccagaccccgcccgguugggggaaccacaggcagccagauucagcaccugacccagguggggaucgcuucucggauuggagcccaaccuguggaaauucccccuuccagaggcagccaguauggcgggcccggauggccgucuuacggcgaggacgaggcugggcgccgggaagccacgcacaugcugggacaucaggaguacuccagcucuccucucuuccaaguccccagaacauccggccgggaacccagcgccccuucugggaaccuuccccaccgcggacugcagggcccuggccugggguauccgaccuccagcaccgaggaucuccagcccggacauagcuccgcuucucugauuaaagcgaucagagaagaacuucugcggcucagccagaagcaauccacagugcagaauuuucacucuuga

SEQ ID NO: 71145 - RNA, 5244 nt, Artificial Sequence
  derived and/or modified sequence opt5 from KIAA1551__Homo_sapiens__XP_005253462
augaacuggaaugaaaagcccaaaagcgccacccugccuccccuguaccccaagucccagccucccuuccugcaccaaucucuuaucaaccagauuacaacgaccagccaguccucuuuuagcuauccuggauccaaucaggaggcuugcauguaccccgggaacucuaauccuaucagccaaccgcugcucaacauucagaauuauccccagcagaucuccgugagcgacaugcauaacggaacagugguugccucucacaccuccguggagagaauuacauacgcgaaugugaacggcccuaaacaacugacccauaaucuucagaugagcucuggggucacacagaacguguggcucaauucccccaugcggaacccuguucacagccauaucggagcuaccgugucucaccagacggauuucggcgccaauguccccaacaugccggcccuccaaucccagcugaucaccagcgacacauauuccaugcagaugcaaaugauuccuucuaacagcacccgccugcccguggcuuaccaggggaaucagggacucaaccaguccuuuagcgaacaacagguugauuggacacagcaguguaucucuaagggccugaccuauccugacuacagaccgcccccuaaacuuuaccgguauuccccgcaguccuuccugcccgauucuacgauucagaagcagaauuuuaucccucacacaagccuccaggugaagaacucccaacugcuuaauucuguccugacccuccccagccgccagacauccgccgugccuagccagcaguacgcuacccaaaccgacaaaagacccccgccucccccuuauaacugccgguacggcucucagccccugcaguccacacaacauauuacgaagcaccugagcauggaggugccucagucucgcgaaaugcucuccagcgagaucagaaccuccuuccagcagcaauggcagaaucccaacgagaaugucucuacaauugggaacuuuaccaaucugaaaguuaacacaaauagcaagcagccguucaacuccccuauccggucuagcguggauggagugcagacccuugcccaaacgaaugaagagaaaaucauggacuccuguaaccccacaagcaaccagguccuggauaccucuguggcgaaggaaaagcucguucgcgacauuaaaacccugguggagaucaagcagaaauuuuccgagcuugccagaaagauuaaaaucaauaaggaucugcucauggcugccggcugcauuaaaaugacaaacaccagcuauucugaacccgcucaaaauuccaagcugagccugaagcaaacagccaaaauccagucugggccucagaucacgccggucaugcccgagaacgcggaacggcaaaccccuacagugguugagagcgccgaaaccaauaagacacaguguaugcucaacuccgacauucaggaggugaauugccgcagauucaaccaggucgauagcgugcugcccaauccugucuacucugagaaacggcccaugccugacuccagccaugacgugaagguucuuaccuccaaaacgucugcuguggaaaugacccaagccguccugaacacacagcucagcuccgagaaugugaccaagguugaacagaacucucccgcugugugugagacaaucagcgucccgaaguccaugucuaccgaagaguauaaaagcaagauucagaaugagaacaugcugcuucuggcccuccugucccaagcccgcaaaacgcagaagacagugcugaaagaugcuaaucagaccauccaggacagcaagccugauucuugcgaaaugaaccccaacacacaaaugaccggaaaucagcucaaccugaagaauauggagaccccuuccacaagcaacgugucuggcagaguucuugacaauuccuuuuguagcgggcaggaaucuuccacgaaaggaaugcccgccaagagcgauuccagcugcucuauggagguccuggcgaccugucucagccuguggaaaaagcagccguccgacacagcuaaagaaaaggagugcgauaagcugcggaccaacacaaccgccgugggcauuucuaaaccugccaauauccacgucaagagccccugcuccgucgugggcaacucuaauagccaaaacaaaaucuccaauccuucucagcagacggcucuuagcaugguuaugcacaacuacgaguccagcgggauuaauaucacaaagggaaccgaacuccaaauugccguggucucuccccuggugcuguccgagguuaaaacccucagcgugaagggcaucacacccgcgguccugccugaaaccguguacccgguuauuaaagaggggucuguguguucccuucagaaccagcuggcugagaaugccaaggccacagcugcccucaaggucgacgugagcggacccguggcuuccacggccaccucuacaaaaaucuucccucugacccagaaggaaaaacaaaacgagagcacaaacggcaauuccgaagucacccccaacguuaaucaggggaagcauaacaaacuggagagcgcgauucacucuccuaugaaugaucagcagaucucccaagaaagcagaaacucuacgguggugagcuccgacacccuucagaucgauaauauuugcucucucgucgagggagacacaagcuauaacucccagaucgccaagaucuuuucuagccugccccugaagaugguggagccucagaaaccgucccuccccaaucaacagggcaucggcagccgcgaaccugagaagcagcuggacaacaccacagaaaauaaagauuucggguuccaaaaggacaaacccguucaguguaccgaugugucucauaagauuugcgaccaguccaagagcgagccuccccuugaauccucuuuuaacaaucuggagacaaaccgggucauccucgagaaaagcucccuggaacacgcuaccgagaagucuacggccaaugauacauguagcuccgcugccauccaggaagacauuuacccgcaagagaucgaugcgagcucuaacuauaccccucaggaccccgccagaaaugaaauucauuccgauaaagcucccgugcuguaccuucacgaccagcucagcgagcugcugaaggaguucccuuauggaaucgaagccguuaacacccgcgagggcucuguggggcagcaaacaaccuaccagacguccgaagaucagacagcugacaaaaccagcucugauagcaaggaccccgccgaccagauucaaaucacaauccucuccucugagcagaugaaggagauuuuuccugaacaggaugaccagccguaugucguggauaaacuggccgagccccaaaaggaagaaccuaucaccgaaguugugagccagugcgaccuucaggcucccgcggccggacaaucccgggauagcgucauucuggacuccgagaaagaugacauccacuguugcgcucucggcuggcugucuaugguguacgagggggugccucagugucagugcaacagcauuaaaaauuccucuagcgaagaggaaaaacagaaggagcaauguagcccccuggauacaaacucuugcaaacagggcgaaagaaccagcgaccgcgaugucacgguugugcaguucaagucccuugugaauaacccgaagaccccucccgacggaaaaagccauuuuccugagcuccaggaugacucucggaaggacacacccaaaaccaagcacaaaucccugccuagaacagagcaagaacuggucgccggccaguucagcucuaagugcgauaagcucaauccccugcagaaccauaaacgcaagaaacuucgguuucacgaggugaccuuccacuccagcaauaagaugacggccucuuacgaacaggcuucccaagagacaagacagaaaaagcauguuacccagaacagccgcccgcugaagacaaaaaccgccuuucucccuaauaaggacguguauaaaaagcacuccagccuggggcaaucucugagccccgagaagauuaaacuuaagcugaaauccgucucuuucaagcagaaacggaagcucgaucagggaaacgugcuggacauggagguuaaaaagaagaaacaugauaagcaggagcaaaaaggcagcgugggggcgaccuuuaagcucggagacucccugucuaaucccaacgaaagagcuaucgucaaagagaagauggugagcaauacaaaauccgucgauacgaaggccucuagcuccaaguucagccggauucuuaccccuaaagaauaccugcagcgccagaagcacaaagaggcccucucuaacaaggcuuccaaaaagaucugugugaagaauguuccgugcgacagcgagcauaugagacccucuaaacuggccgugcaggucgaauccuguggcaagagcaacgagaaacacuccucuggggugcaaacaagcaaggaaucccugaacggccuuaccagccacggcaagaaucugaagauucaucacucucaggaguccaagacauauaacauccuccggaauguuaaagaaaaggugggcgggaaacagccugauaagauuuggaucgacaaaaccaagcuggauaagcucacgaacauuagcaaugaggcgcaguuuucucaaaugcccccucaggucaaagaccagaagaaacuguaccuuaacagagugggauucaagugcacagagcgcgaaagcaucucccugaccaaacucgagucuagcccccggaagcugcauaaagacaagagacaagaaaauaagcacaaaaccuuccugccugugaagggcaacacagagaaauccaauaugcuugaauuuaagcuguguccggauauccuccugaaaaacaccaauucuguugaggagcgcaaggacgucaagccccauccuagaaaagaacaggcuccccuccaggugagcgggauuaaguccacaaaagaggauuggcugaaguucguggccacgaaaaagcggacccagaaggacagccaagaacgcgauaacgucaauucuagacuuuccaaacggagcuuuuccgccgacggauucgagaugcugcagaacccugugaaggauucuaaagaaauguuucagacauauaagcagauguaccuggagaaacgcagcagaucccucggcucuagccccguuaaguga

SEQ ID NO: 71146 - RNA, 1896 nt, Artificial Sequence
  derived and/or modified sequence opt5 from KIAA1598__Homo_sapiens__NP_001120683
augaacagcuccgacgaggaaaagcagcugcaacucaucaccucucugaaagagcaggccauuggcgaauacgaggaucuuagagcugaaaaucagaagacaaaagagaagugcgacaaaauccggcaggagcgcgaugaagccgugaagaagcuggaggaguuccagaaaauuagccacauggucaucgaggagguuaacuuuaugcaaaaucaucucgaaauugagaagacguguagagaauccgcggaggcucuggccaccaaacuuaacaaggaaaauaaaacacugaagcggaucucuaugcucuauauggccaagcuggggcccgacgugaucaccgaggagauuaacaucgaugacgaagauagcacaaccgacacagauggagcugccgagaccugcguguccguccagugucagaaacaaauuaaggaacugcgcgaccagaucgugucuguucaggaggagaaaaagauucucgcuaucgaacuggagaaucuuaaaagcaagcugguggaagucauugaggaagugaacaaaguuaagcaggagaagacggugcucaauuccgaaguccuggagcaaagaaaagugcuugagaagugcaaccgggugagcaugcuggccgucgaagaguacgaagagaugcagguuaaucucgagcuggaaaaagaucugcgcaagaaagcggagucuuucgcccaggaaauguuuaucgagcaaaacaagcucaagagacagucccaucugcuucugcagagcucuaucccugaccagcaacuccugaaagcucuugaugaaaaugccaagcugacccagcagcucgaggaggaacggauucagcaccaacagaaagugaaggagcuggaagaacagcuggaaaacgagacacuccacaaagagauccauaaucugaagcagcaacuugaacugcucgaggaagacaagaaagagcuggaacuuaaguaucagaacuccgaggagaaagcucgcaaccugaagcacagcguggacgaacuccagaaaagagucaaucagucugagaacuccgugccgcccccucccccucccccuccgccccugccucccccucccccgaauccuauucggagccugauguccaugauccgcaagagaucucaccccagcggcuccggggccaagaaagaaaaggcgacccaaccugagacaaccgaggaaguuacggaucucaaacggcaggccguggaggaaaugauggaccgcauuaagaaaggaguccaucugagacccgugaaccagacagcucggcccaagaccaaaccugagagcucuaagggcugugaauccgccguugaugagcuuaaggggauccugggaacacucaauaaaagcaccucuagcagaucccugaagucucuggacccggagaacagcgaaaccgagcuugaacgcauccuccggagacgcaaagugacagcugaggccgauuccagcucucccacgggcauucuggccaccuccgaaagcaagucuaugccuguccugggcuccgugagcuccgucacaaaaaccgcucucaauaagaagacacuggaggcggaguucaacucucccagcccucccaccccggaaccuggggagggaccccggaaacuugaaggcugcacguccucuaaggugacauuucaaccucccagcuccaucgggugucgcaaaaaguacauugacggagagaaacaggccgaaccuguugugguccuggaucccgugagcacccacgagccgcagaccaaggaccagguugcugagaaggauccuacacaacauaaagaagacgagggcgaaauccagcccgagaauaaggaggauucuauugaaaacgugagagagaccgacuccagcaauugcuga

SEQ ID NO: 71147 - RNA, 1485 nt, Artificial Sequence
  derived and/or modified sequence opt5 from KIAA1715__Homo_sapiens__NP_001291937
augggcagaagcuggcccgggcugucccucugucaguggcggcugcuuccugcccuggaggcuggaugggccguggcggcugaaaccggcgggggaggccgcccggggagagccgcccccgcuucuuguagcugcgaguuccucuggacaaucgacgauauuuaccacugugcccaauuucugcagaucaaggacggauggauuaucuucuccauggaaggcaaaacgaagccuucuaccgucgagguucuugaaagcauugauaaagagauccaggcucuggaggaauuucgggagaagaaccagcgccuccaaaaacugugggugggcagacugauccucuauuccucugugcuguaccuuuucacaugccugauugucuaucucugguaccugcccgacgaauuuaccgcccggcuugcgaugacacugccuuucuuugccuucccccucaucauuuggagcauccgcaccgugauuaucuuuuucuuuuccaagagaacagagcggaauaacgaggcucuggaugaccugaagucucagcgcaaaaagauucucgaagagguuauggaaaaagagaccuauaagacggccaaacugauccuugaaagauucgauccugacucuaagaaggcuaaagagugugagccgcccuccgccggggcggccgugaccgcucggccuggacaggaaauccgccagagaacagccgcucaacggaaucugagccccaccccugccucucccaaccagggcccgccuccccaggucccugugucccccgggcccccuaaggauagcucugccccgggagggcccccugagcgcacaguuacccccgcucucuccagcaaugugcugccuagacaucuuggcucccccgcgacgucugucccgggaaugggccugcacccucccggcccuccccucgcccggccuauucugcccagagaacgcggggcucuggaccggaucguggaguaccucgugggagauggcccgcagaacagauaugcccugauuugccaacaguguuuuagccauaaugggauggcccuuaaagaagaguucgaguacaucgcuuuccgcugcgccuacugcuuuuuccugaacccugcgcggaagacaagaccccaggcuccccgccucccugaauuuuccuucgagaaacggcaagucguugaaggaagcagcuccgugggcccgcugcccagcgggucugugcuuagcuccgacaaucaguuuaacgaggaaucucuggagcacgauguccucgacgacaauaccgagcagacagaugacaagauuccugccaccgaacagaccaaccaagugaucgagaaagccagcgauuccgaggaacccgaggaaaagcaggagacagaaaaugaggaagcuagcguuaucgagacgaacucuaccgugccuggagccgacuccauucccgauccugagcugagcggcgaaucucugacagcugaguga

SEQ ID NO: 71148 - RNA, 3111 nt, Artificial Sequence
  derived and/or modified sequence opt5 from KIAA1804__Homo_sapiens__NP_115811
auggcccugagaggcgcugccggggcgaccgacacacccgugagcuccgcuggaggcgccccugggggaucugccagcuccucuagcacguccucuggcgggagcgcuuccgccggagcuggccucugggccgcgcuguacgauuaugaggcccggggcgaagacgagcuuagccugcgcagagggcagcucgucgaaguucugucucaagaugcugccguguccggagacgagggcuggugggcuggacaggugcagcggcgccuugggaucuucccggccaacuacgucgcgcccugcagaccugccgcuagccccgccccucccccuucucggccguccagccccgugcacguugcuuuugaacgccuggagcucaaggagcugauuggcgccgggggauucggccagguguauagagccaccuggcaaggccaggaagucgcugugaaagcggcccggcaggauccugagcaggacgcugccgccgcugccgaaucuguucgcagagaggcgcggcuguuugcuaugcuccgccaucccaauaucauugagcugagaggggugugucuucaacagccucaccugugccucguccuggaguucgcccggggaggcgcccuuaaccgcgcucuggccgcugccaaugcggcccccgauccgagagcuccugggccccggagagcccgccggaucccuccccaugugcucgugaacugggcuguccagauugccagaggaaugcuguaccugcacgaggaagcguuuguucccauccuccaucgcgaccugaaguccagcaauauccuucugcucgagaaaauugaacacgaugacaucuguaacaagacacugaaaauuaccgauuucggccuugcccgggaguggcacagaacaaccaagauguccacagcugggaccuaugccuggauggcuccugaggugaucaagucuagccuguuuuccaaaggaagcgacauuuggucuuacggcgugcuccugugggaacugcucacgggcgaggucccguaucgcgggaucgauggacuggccguggccuacggcguugcugugaauaaacuuacccugcccauuccuuccacaugccccgaaccuuucgcgaaacucaugaaggaguguuggcagcaagacccccauauccggccgagcuuugcccugauccuugaacagcugaccgcuauugagggggccgucaugacagagaugccucaggaaucuuuccacagcaugcaagacgauuggaaacucgagauccagcagauguuugacgaacugagaaccaaggagaaggaacugcgcucccgggaggaggaacucacgagagccgcucugcagcaaaaaucucaggaggaacuucugaagcgccgggagcagcagcucgccgagagagaaauugaugugcuggagcgggaacugaacauccuuauuuuccaacucaaucaggagaaacccaagguuaaaaagcgcaaaggaaaguuuaagagaagccggcugaaacugaaggacggccauagaaucucccucccuagcgauuuccagcacaaaaucacagugcaggcgucucccaaccuggacaagcgccggucccuuaauagcagcuccagcuccccucccucuagcccgaccaugaugccuagacugcgcgcuauucaacucacauccgaugaaucuaacaaaaccugggggagaaauaccgucuuccggcaggaggaguuugaagacgugaagcgcaacuucaagaaaaagggcugcacauggggacccaauagcauccagaugaaagauagaacggacuguaaggagcggauucgcccccuguccgauggcaacagcccuuggucuaccauccugauuaaaaaccagaagacaaugccgcuugccucccucuuugucgaccaacccgggagcugcgaagaaccuaagcugucucccgacggacuggaacacagaaaaccuaagcagaucaaacuccccucccaggccuacaucgaucugccucuuggcaaggacgcucaacgggagaaucccgccgaggcggaaagcugggaggaagcugccucugccaacgcugccaccgugagcauugagaugacaccgaccaauucccugagccgcucuccucagagaaagaagacggaauccgcucucuauggguguacaguucugcuggccagcguggcgcuuggacucgaucugcgggagcugcauaaggcccaggcugccgaggaaccccucccuaaagaggaaaagaaaaagcgcgagggcaucuuccagagagcuuccaaaucucggagaagcgccucucccccgaccucccugccuucuaccugcggggaggccuccucucccccuagccuuccccuguccagcgcucucggcauucugucuacacccuccuuuagcaccaagugucugcuucaaauggacucugaagauccucucgucgacuccgcgccggugacaugcgauagcgagaugcugacgcccgacuucugcccuaccgcccccggaucuggccgcgaaccugcucugaugccccggcucgauacagacuguuccguuagcagaaaccugccuuccagcuuucuucagcagaccugcgggaaugugccguacugugccucuagcaaacaccgccccucccaucaccggagaacaaugucugauggaaacccuacccccacgggcgccaccaucauuagcgcuacaggggccuccgcgcugccucucugccccucuccggcuccucauagccaucugccccgcgaggucucccccaagaagcacucuaccgugcacaucgugccucagcggagacccgccagccugcgcucccggagcgaccuuccucaagccuauccgcagacagcuguuucucagcuggcccagaccgcgugugucgugggaagacccggcccucaccccacgcaauuccucgcugccaaagaacggacaaagucccaugugccuagccugcucgaugccgacgucgaggggcagucucgcgacuacaccgugccccugugcagaaugcgguccaaaacaagccgcccguccauuuaugagcuugaaaaggaguuucugucuuga

SEQ ID NO: 71149 - RNA, 2124 nt, Artificial Sequence
  derived and/or modified sequence opt5 from KIAA1841__Homo_sapiens__XP_005264663
augagcagaggcuacuccgagaacaauaacuuccugaauaacaauaaccagauggugcucgacaugauccuguauccccuuauugggaucccucaaaccauuaauugggaaacaaucgcccggcuggucccgggacucacgcccaaggagugcgcuaaacgcuuugaugaacugaagucuagcggcuccucuccuguugacaaccaguacaauagccuuauggccgcgggggagucccccguggaaacccuggcuacauauauuaaaucuagccuccuggauauccacggagaguuccaggagaccccugugggccaugacgccgucuccaagacagggagacacagcaucgccucuacccggaacuguuccagcgaaucugagaauugcacaacccauaacggaggcgaaaugacggaggaguccgaaggccccaauauggugauucacguuugugaugaggcuaaaaaccugaaggaagacuuuaccugcccucgcgaucuccugaucagcgagaugaaguacuucgccgaauaucuuucuauggacgcucagagaugggaggagguggauauuuccguccauugugacgugcacaucuuuaauuggcugauuaaauacaucaagcggaacacaaaagaaaacaaggauugcgagaugccgacccucgaacccgggaauguuauuagcauccugaucuccucugaguuccuuaaaauggacagccugguggaacaauguauucaguauugccacaagaacaugaaugccaucgucgcgacaccuuguaacaugaauugcauuaacgccaaucuccugacccgcaucgcugaucuguuuucccauaacgagguggacgaccucaaggauaaaaaggacaaauucaagagcaaacuguuuuguaagaaaauugagagacuuuucgaucccgaauaccugaauccugacucucgguccaacgccgcuacgcucuaccgcugcugccuguguaagaaacuucugacaaaggagaccgaaagacggauccccugcaucccgggaaagauuaauguggaucgcagaggcaacaucgucuauauucacauccgggacaaaacaugggauguucaugaguaccucaauagccuguuugaggaacugaagucuuggcgcgacguguauuggagacucugggggaccauuaacuggcugaccuguagccggugcuaccaggccuuccuuuguaucgaguuuucccacugccaguaucacucugaaacaguggucuacccuacggcggccagcucccugaauaccgugggaacaggcaucuaucccuguugcaaccaaaaaguucucagauucgauccuacccagcugacaaagggguguaaggugcgcgaccauauggucacccuucgggaucagggagagggcggcgaccugcccagcugccccacggcuagaaugcucgacgaucugcacaaauaccgcgacgugauuguugugccuuucucuaaggauacagucuccgacgugggggucggacugugugaugaaaaaggcaucgagugcgacgugcuccuggagccgaacacccccugggggccuaagaccggagaacuuaaugccuuucugagccucaaaaacuggacacugcagcugaagcaacagucucuuuucuccgaggaagaggaauacaccacaggcagcgagguuacggaggaugaagugggggacgaggaagaggucuccaagaaacagcggaagaaagaaaagcccaaaaaguuuaccagacaaccuaagaaacaggugucuagccccugcgcucagcgcaaggagaaagcccucgagaaguccgccucucgggauguuagcccguucgugauguccaugcagaaaaauaagugggacgcuacaagaagccugcgcuuuaaccaagaugcgcagcgggaagacgaucagagacgcaugaccgagauuacaggacaucugaucaaaaugcggcucggcgaccuggacagagucaagucuaaggaagccaaagagaccgauaaacuucggccucgcgacggcacgguguccaagagcaauagaaagucugggcuguccagcgugcuccugaugaccguucugcuuuguuga

SEQ ID NO: 71150 - RNA, 1557 nt, Artificial Sequence
  derived and/or modified sequence opt5 from KIAA1919__Homo_sapiens__NP_699200
augcugugcgccagcuuccucggccuggggcuuuccguggcuaucgucggacccaccuuucaggaccuggccacaaacguuaauagaaacauuucuagccucuccuucaucuuugugggccgggcgcugggguaccuuucuggaagcgugauuggcggguuccuggucgaugugaugaauuauuuucuccugcugggaaucuccaugucugcuacgaccguuggccucuaccuggugccuuucuguaagacagccauucuucugaccgucaugaugagcaucuuuggcguguccaucgggauucucgacacaggaggcaacguucugauccuugccauuuggggagauaaaggggcuccgcacaugcaagcccugcacuucagcuuugcucucggcgccuuccuggcgccccugcucgccaagcuggcucuugggccuaccgccucugcugagaaucacacagaauccgacuuucaucccgcccugaaccagagcucugaugcggacuccgaggcccucuucggagugccuaaugauaaaaaccugcuuugggcuuaugccgucaucggcaccuacauguuucuggugagcgugauuuucuucugccucuuucugaaaaauucuuccaagcaggaaaaggcucgcgccagcgccgagacguucagacgggcuaaguaucacaacgcgcugcucugucugcuuuuucuguucuuuuucuuuuacgucggcgccgaaguuaccuauggguccuacguguucucuuuugcuacaacccaugccggaaugaaagagagcgaggccgcuggccucaauuccaucuucugggggacauuugccgcgugccgcggacuggcuauuuucuuugccaccugucuucagcccggcacgaugaucgugcugagcaacaucgggucucucacauccagccuguuccugguccucuucgacaagaauccuauuugccuguggaucgccaccucuguguacggagcuagcauggccacaaccuuuccguccggcguuucuuggauugaacaauauaccacaauccacggcaaaagcgcugccuucuuugugauuggggcgucccuuggagagauggccauccccgcugucaucggcauucugcaggggaaguacccugaucuccccgugguucuguauacgagccugggagccucuaucgcuaccggcauucuuuucccugugcucuacaaacuggccacaagcccccuggacagacagcggaaggaagaucgcaaguccgaggaccagaaagcgcuccugucuuccagcgggcuuaacgaguaugaagaggaaaaugaggaagaggaugccgagaaguggaacgaaauggacuuugagaugaucgaaaccaacgacacaaugagacacuccauuaucgagaccucucggagcucccugacggaaccgacagcugaggucuacaaucaauauccuucuaacgcccucguguucgagagcucccccuuuaauaccggcagcgcucaugucaaacaucugccugaaacccgcacaaagggaaccaacguguga

SEQ ID NO: 71151 - RNA, 4551 nt, Artificial Sequence
  derived and/or modified sequence opt5 from KIAA2022__Homo_sapiens__NP_001008537
auggacaaccagcaagauaaggccaucguggcuagcgccaauggcgagaacacccugauuaauggggucaaagaaaacgacuccgaggaucaggacguugcgaugaagucuuucgcugcccucgaagccgcugcccccauccagccuacaccgguggcucagaaagagacgcugauguaccccagaggacuucugccucuccccagcaagaaaccuugcaugcaaucucccccuuccccgcugggccuuauugaagcccccgagcacgcggccaauagcgcuuccgugaacgccaucucucugaccagcgggauugcuaagggacucaauacauggucccugccuaacgagugugaaaaggcccccuuugcgaucauggagccugccggcaugagcgcucugaauggggauugccucaugcagcccucucggaccugucugggaugcuucauggaauccaaagacgccgucgauccggagccuggcaucagccuuaaggugggcgaccugaaccgcgauuaugagacaugugcuguuucugacauugggauccagugcauuaaugccggagaaaacaugaaauacggcgagcagcuccuguccgaucaacuucugggguuuccccuccauaagagcagagccggagaccggcgcgaaaccgagaaaccugauaucgaccuggaagaccccgcucagaagucuuauuacgaggcgcugcuccuggauaaguguaauacagaggaagcccuucuggcuaacuccaaucaggacuggggcuauuucgagaccuuuauuagcgaauccaaaaucgagcuccuggaucuuugcucuaagaacgaacugagcgugaaccucuucuccgaggaggacgucgauaauuacauguuugacgaugacgaaagcacgcuggggucugauguguguucccugaaaauuagauaugagagcuuccaggacaacguucgggauaagaccacacuccugaugcaagaagacgcccaguuuaauuucuuucccucuguguucaccacaugcccuaaacgcgagagcaaguccggagcccuuaaacagucuagcgacuuuucccaauucaaggucccggaugugagcaucaucuggggcgaagaggacaagaaccuggauaaaaagaaaggcaaggaggaagggcaggaggacaaaggaguggaaaagaaggauggcaaagacaauggggagaagcccgcucucaacaaaccuuguucuggaaccgaggucgaacagcugaagaaucccaaacagggccaccuugccaacucccuggagacgagcgggucuuucuccgaugacagcuccuuuauugaaaucucuuacgaugcgaugggagagauuaaggacugcagcagauacauggcucgggauacaaauuccggcucuagcuccagccaacagaacuauggccuccgcgccaagagaaaaguucgguacucugaagacuaucuguacgauguggacucccuggagggggagaaggugaaugaacgcaaagaguggcucccugucggaagcaaggaagaggacgaugacgaauggugccccaaaaagagacggaaggugacccgcaaagagccgccuguuaucauuaaguauaucaucauuaacagauucaaaggcgagaagaauaugcuggugaaacuugggaaggucgaugccucugaaacaaccgugaaccuguccgagaaucagcucaacaaauacgcuaagcuggcuccccugaagggauuuuggcagaaaaagaaaaagcaacggaacaccaauacagacagcaucaaaacgccuuucucucagaagcagagcuuugaacccggcuccuucgagguuagcuuucuuccucccgccagaaagcgcaaaucuaagcucgggaaccggcaucgcauucagagaaucccguccauugaaaucagcgccuccucuaaacaaaucagccuguguaaugaucagcggcacgcguccaaccauaaggaggacggcggacugaaaggcacccucaagucugccccucugggggcucccagcugcgccaauggaucccaccuuaacgauauuacaggccccgacucugugaaggucaaagcucaggauaccgaguucaaggggccugaaagaaaagugcugaauaagaucaaauuuaagagcgaggcccgccucaaguccaaaaaggucaaagcggccggacaggaaagcaagccgauugugcaaaugucuccccugcuggagaaccaguccagcaaagcuaaucuuaagaacgagguuaucccuggcacaucuaauuccagccggcucucugaauuucacgaggccaaagcugccaaguccagcaccuuucugcccacgacauguuccagcgaaaugccucugucuagcgccaacgugaccaccaauauucccgucaucccugggggcuaucuccagacacugcuugacgcuuccgaucugucuaacaauaccagcauuuccuacuucucucaucacagccccgagcaaaacgaaggaucccucacacagacggagaagucuuuugugccgcugcagccuacccaggacugcguucugacaagcuccagcgauucugagcuucaacaguccagccauaacuucaaaauggaaucuuccaauuacagaaacguguggcccaauaaggcgaccagcggcacacaggaguucauggccgaagucucccgcgagaucgcuccuacccagucuagcgaauuuggggccucccaaguggugagcauggagaacaaucucacgcccaccacauauaacccgaucugucuuaauucuggaggcuccaacugcaauaaaguucuguacgacagcaugcaggacacccagcucccuucugaugacagcuaucagcugugucacuucaacaauggggagauuugcuuucccuuccaacagggaccugucaacauggaugacggccggcuguuuuccuucgauucuauggcuccccugagcguguccucuagcaauuacuguucccucagccugaagucuugcgaaaaagacggggaugacgauaucacagacgauuuucuggcccacuguucccccaaacuugugauucagcaaagcaucgacgagauugccccucucaaggaauccaccgaccugcuggauaucucuaacuucacgccggacaaguuuagacauagcucccucucugagaugagcccucccgauacacccucccugagcccucagaucacccgcugcgaaucuaugaagacacuuggcacccugaaaggauuccaggagggcguccccgggccucucgacuccguggagaagauuaaaugggauugcagcacccugucucggcagguucaaauggaagacggauuuacacugaauaaccaccaguuccaguuucauauguucaacgaugaggacuccgugagccuucugcagaagaauccgugucucucuacguucaacgaucccagcggccaaaucuccaccaauaacaaggucucuaaaagcagaaagaaauccagcccuuccaagucuggggcgaugaaucagagcuccucucagaaaaacacacggaaaaagagccugaagggaaauaacaagggcauugaaaaacccccugggaaaaauucccgccaggugcccaagucuaccaagaagggcaaauauauggcugccaucaacggagagaagaugcaaauuggcaucgggagaggaggcagccagacaaauaccaucuccagcacggggaaaacacucgccgagugcauucagcacggaggcccgauggcuucuaugaagaugccuucccagaaaggccugagcggggacugggcccuuggaaaggaaucuucccccggcuggagcgauaugucuauggggaccaacaccaauucccugcucgacgaugaccaacgggaguuucaggaacccagcuacauccuguccaacauugcgagcggaauggcugacguucagagauucaugauggccucuaucgagccucugugggaacccauggagcaucacggcgauccuaauauuuucuauagcccggaguccaacucucuuaaacugaagacacucaagauccuggccgggacaccccaagaaagcaaaaagaaaaucaauuccggaucucagggcgcuaccaagaaccaccgcagcauuaaaggcguguccaagucuaacgggaagacggccaucggagacccuggccgggcuaauaugcccggguacaacgaggauagcagauccaccuucuuugacaaaaaguacagcaauaugucuacacucggaaacaauggcccuacccauaaaaagcuguaucgccacaaauccagcucuaaggcccuuagagaugaaaaguguaaagggaagcauauggagcgggaacagguccacaaagacgaguccggaacagcgagcuucgagaagcugcgcgauuccgacuacaaccuccugaaagccgaaaccacguuuugggugcugcccguuuucgaggaagagaccagaauuuuucagaaggauaucuga

SEQ ID NO: 71152 - RNA, 5316 nt, Artificial Sequence
  derived and/or modified sequence opt5 from KIDINS220__Homo_sapiens__NP_065789
augagcgugcugaucucccagucugucauuaacuacguugaggaagagaauauccccgcccucaaggcucugcuugaaaaaugcaaggacguggaugagagaaacgaauguggccaaaccccucugaugauugccgcggagcaggggaaucucgagaucgugaaagaacugauuaagaacggagcuaauugcaaccuugaggaccuggauaauuggacagcccucaucagcgccuccaaagaaggccacguccauaucguggaggagcugcugaagugugggguuaaccucgaacaccgggacaugggaggcuggacggcucugaugugggccugcuauaaggggcgcaccgauguggucgagcuucugcucucucauggagcuaauccgagcgugacaggccuguacuccguuuaucccauuaucugggccgcgggcagagggcacgccgacauugugcaucuucugcuccagaacggagcuaaagucaauuguucugauaaguacggcaccacaccucuggugugggccgcucggaaagggcaccuggaaugcgugaagcaccuccuggccaugggagcggacgucgaucaggagggcgccaacagcaugaccgcucuuaucguugccgugaaagggggauauacacaauccgugaaggaaauucugaagcgcaaucccaacgucaaucucaccgacaaagauggcaacacggcucugaugaucgccagcaaggagggccauaccgagauugugcaggaccuucuggaugccgggacauacguuaacaucccugacagaucuggagacaccgugcucaucggcgcuguccgggggggacacguggaaauuguucgcgcgcugcugcagaaauaugccgauaucgacauuagaggccaggauaauaagacagcucucuacugggccguggagaaagggaacgccaccaugguccgggacauccugcaauguaaucccgauacggaaauuugcacaaaggacggagagaccccucuuaucaaagcuacaaagaugcgcaacaucgaaguggucgagcugcuccuggauaagggcgccaaaguguccgcgguugacaagaaaggcgauaccccgcuucauauugcuaucagagggcggagccgcaagcuggccgagcuccugcugagaaaucccaaagacggacggcuccuguaccgcccuaacaaggccggcgaaacccccuauaauauugauuguucucaccagaaguccauccuuacacagauuuucggggcuagacaccugagcccuacggagaccgacggagacaugcucggcuacgaucuguauucuuccgcccuggcugacauccuuagcgaacccacaaugcagccgccuaucugcguggggcucuacgcccaauggggcuccggaaaaucuuuucugcugaagaaacucgaggaugaaaugaagaccuucgcgggccagcagauugagccccuguuucaauucagcuggcuuaucgucuuucugacacuccugcugugugggggacuuggccuccuguucgccuuuaccgugcauccuaaccuggggauugcuguuucccucagcuuccuggcccuucuguauaucuuuuucauugugaucuacuuuggaggccggagagagggggaaucuuggaauugggcuuggguccucuccacgcgccuggcccggcacauuggcuaucuggagcuucuccugaaacugauguucgugaacccccccgaacucccugagcagacaaccaaggcgcugccggugagauuucuuuucaccgacuacaaucgccugagcucuguuggaggcgagacaagccucgccgaaaugaucgcuacccuguccgaugccugcgagcgggaauucggguuucuggcuacaagacuuuuccgcgucuuuaagacggaggacacccagggaaaaaagaaauggaagaaaacaugcugucuccccucuuucgugaucuuucuguucauuaucggcugcauuaucagcgggauuacccugcucgccaucuuucggguggauccuaagcaucugacagucaacgccgugcuuaucuccauugcuagcguugugggacuggcguucguccucaauuguagaaccugguggcaggugcuggacucucugcuuaacucccaacgcaagcggcugcacaaugccgcuagcaaacuccauaagcugaaaucugaaggcuuuaugaagguucucaaaugcgagguggagcugauggccagaauggccaagacgaucgauuccuucacccagaaccagacacgccuugucgugauuaucgacgggcuggaugcuugugaacaggacaaaguucuccaaaugcuggauaccgugcggguccuguuuagcaagggccccuucauugccaucuuugcguccgacccucacaucauuaucaaggcuauuaaccagaaucuuaacucugugcugagagacagcaauaucaacggacacgauuacaugcggaauauugugcaucuccccgucuuccugaacucccgcggccucucuaaugccagaaaauuccugguuacaagcgccaccaacggggacgugccgugcuccgauacgacaggaauccaggaggacgcugaucggagagugagccagaauucucuuggcgaaaugaccaagcugggguccaaaacagcccucaaccgccgggacaccuauagacgcagacaaaugcagcggaccaucacacgccagaugagcuuugaucugacgaagcugcuugucaccgaggacugguucucugauauuuccccucagacaaugagacggcugcucaauaucgugagcguuaccggacgccugcucagagcgaaccaaauuucuuuuaauugggaccggcuggcuagcuggaucaaccuuacagaacaguggcccuaccgcaccuccuggcugauucuguaucucgaggagacggaaggcaucccugaucagaugacacugaaaaccauuuacgagagaaucagcaagaauauccccaccacaaaggacguggaaccucuucuggagauugauggggacauccggaacuucgaagucuuucucucuucccgcacccccgugcugguugccagagacgugaaagucuuccucccguguacagugaaccuggauccuaagcuucgggagauuaucgccgacguuagagcugcccgcgagcaaauuagcaucggcggacuggcuuaucccccccugccucuccacgaaggcccgccccgggccccuuccggguacucucagcccccuagcgugugcuccucuacgagcuuuaauggacccuucgcgggcggggucguguccccucagccccauucuagcuauuacuccggaaugaccggcccgcagcacccuuuuuacaacagacccuucuuugccccuuaucuguacacaccccgcuauuacccgggcgggagccaacaccuuaucucucggccuuccgugaaaaccagccugcccagagaucagaauaacggacucgaggucauuaaggaagacgcugccgagggccugucuuccccuacagauagcucucgcggguccggacccgcucccggcccuguugugcuccugaauagccuuaacguggacgccgucugugagaaacugaagcagaucgaagggcuggaucaguccaugcucccgcaauauugcaccacgauuaagaaagccaauaucaacggacgggugcuggcucaguguaauauugacgagcuuaagaaagaaaugaacaugaauuucggcgauuggcaucuguuuagaagcaccguucucgagaugcgcaacgcggaaucucacgugguccccgaggacccucgguuccugagcgaguccucuagcggccccgccccucauggggaacccgcuagacgggccucccacaaugagcucccucauacagaacugucuagccagaccccguacacacuuaacuucuccuuugaggaacugaauacccugggacucgaugagggcgccccccgccacucuaaccugagcuggcagucccaaacaagacggaccccuagccuuucuucccugaacagccaggacucuuccaucgagaucagcaagcucacggacaaagugcaggcugaauaucgcgaugccuacagagaguacauugcgcaaaugucccagcuggaagggggacccggcucuacaaccaucagcgggcgguccagcccucacucuaccuauuacaugggacaguccagcucuggcggcagcauucauuccaaucuggagcaggaaaaggggaaggacucugagcccaaaccggaugacggaagaaagagcuuccucaugaaacgcggcgauguuaucgacuauuccucuagcgggguguccacaaacgaugcuagcccucuugaccccauuaccgaggaagaugagaagucugaccaauccggaagcaaacugcugcccggcaagaaauccucugaacggagcucccucuuucagacggaucugaagcuuaaggggucuggacugagauaccagaaacucccuagcgacgaggaugaguccggcacagaagagagcgacaauaccccccugcugaaggacgauaaagaccgcaaggccgaaggcaaagucgagcgggugccuaagucuccggaacacuccgccgagcccaucagaacauucauuaaggcuaaagaguaucucagcgaugcccuucuggacaagaaagauucuuccgacagcgggguccgcucuagcgaauccucuccuaaccauagccugcacaaugagguggcggaugacucccagcucgaaaaggcuaaccugaucgagcuugaagaugacagccauuccggaaaacggggcaucccccacucucugagcgggcuccaagauccuauuaucgccagaauguccauuugcucugaggacaagaagagccccuccgagugcucucugaucgccagcuccccggaagagaauuggccugcuugucagaaagccuacaaccugaaucgcacccccagcacaguuacccucaacaauaacucugcuccugccaauagagcgaaccagaauuuugaugaaauggagggaauucgggaaacgucccaggugauccuucgccccagcucuuccccuaaccccaccacaauccaaaaugagaaccugaagagcaugacccacaaaagaucucagcgguccagcuauacacgccuguccaaggacccgccugagcuccaugccgcugccagcucugaaagcaccggcuucggggaggaaagagaguccauucuguga

SEQ ID NO: 71153 - RNA, 3171 nt, Artificial Sequence
  derived and/or modified sequence opt5 from KIF11__Homo_sapiens__NP_004514
auggccagccagcccaacuccucugcuaagaaaaaggaggaaaaaggcaagaauauccaaguggucguuagaugccggccuuucaaccuggccgagcgcaaagcgagcgcucacuccauuguggaaugugacccggugagaaaggaggucucugugcggaccgggggacucgccgauaagagcucccgcaaaacauacacguuugacaugguuuucggcgccucuaccaagcagaucgauguguauagaagcgucgugugccccauucuggacgaaguuaucaugggguacaauuguacaauuuuugcuuauggacagaccggcacagggaaaaccuucacaauggagggagagcgguccccuaacgaagaguacaccugggaagaggauccccuugccggcaucaucccucgcacgcugcaucagauuuuugagaagcucaccgacaauggcacagaguucagcgugaaagucucucugcuugagaucuauaacgaagaacuguuugaucuccugaaucccuccagcgacgugucugaaagacugcaaauguucgaugacccucggaacaagcgcggggugauuaucaagggacucgaggagauuaccguccacaauaaagaugaaguuuaccagauccuggagaagggcgcugccaaaagaacaaccgcggccacgcuuaugaacgcuuauuccagccggucucauuccguguuuagcgugacaauucacaugaaggaaaccacaaucgacggggaggaacuggucaaaaucggaaagcucaaucugguggaucuugccggcuccgagaacauugggcgcucuggagcuguugacaaaagagcccgggaggcgggcaauaucaaccagagccugcucacccugggccgcgugauuaccgcccuggucgaaagaacaccgcaugugcccuaccgggaguccaagcucacgagaauccugcaggacagccuugggggacgcacccggacaucuauuaucgcuaccaucuccccugccagccugaaucucgaagagacacugucuacccuugaauacgcucacagagccaagaacauucugaacaaacccgagguuaaucaaaagcucacgaaaaaggcccugaucaaagaguauacagaagagauugaacgccugaagcgggaucucgcugcggccagagagaagaacggcguguacaucagcgaggaaaauuuccgcgucauguccgggaaacugaccgugcaggaggaacagauugucgagcuuaucgaaaagaucggagcuguggaggaggaacugaaccggguuaccgagcucuuuauggacaauaaaaacgaacuggaucagugcaagucugaccuucaaaauaaaacacaggagcuggaaaccacacagaagcaccuccaagagacgaagcugcagcuggugaaagaggaauauauuaccagcgcccucgaguccacagaagagaagcugcaugaugccgcuagcaaacuucugaacaccgucgaagagacaaccaaggacgugucuggccuccacuccaaacuggauagaaagaaggccguugaccagcauaaugcggaggcucaggauaucuucgggaaaaaccugaauagccuuuuuaacaauauggaagaacucauuaaggacggaucuuccaaacaaaaggccaugcuggaagugcacaaaacgcuguucggcaaccuccugagcuccucugucagcgcccuugauaccaucacaaccguggcucugggcucccucacaucuauuccugagaaugugagcacccacguuucccagaucuucaacaugauucugaaggagcagagccuggccgcugaaucuaaaacgguccuucaggagcucaucaacgugcugaagacagaccugcucuccagccuggaaaugauccuuucucccaccguggucuccauucugaagaucaauagccaacucaaacauauuuuuaagacaucucugaccguggccgacaaaaucgaggaucagaagaaagaacuggacggguuccuuagcauucucuguaacaaucugcacgagcugcaggagaacaccaucugcucccucguugaaagccagaagcaauguggaaaucugacagaggaucuuaagacgaucaaacagacccauucucaggaacugugcaagcucaugaaccuguggacagagcgcuuuugugcgcuggaagagaaaugcgagaauauucagaagccgcuuuccagcgugcaagaaaacauccagcagaaauccaaggacauugucaauaagaugaccuuccacucucaaaaauuuugugccgauagcgacggcuucucccaggagcuccggaacuuuaaucaggaagggacaaagcugguggaggaaucuguuaaacauagcgauaagcugaacggaaaucucgagaaaaucucccaggagaccgaacaaagaugcgagucucugaacacgcgcacaguguacuucagcgaacagugggucuccagccuuaaugagcgggagcaggaacugcacaaccuccuggaggugguuucucagugcugugaggcuuccagcucugacauuaccgagaaguccgauggcagaaaggccgcucacgaaaaacaacauaacaucuuucuggaccagaugaccaucgaugaggacaaacuuauugcccagaaucuggagcucaacgaaacaaucaagauugggcugaccaagcucaauugcuuccuggagcaggaucuuaaacuggacaucccuacaggcacgaccccucaacgcaagagcuaucucuacccuucuacacuggugcggaccgaacccagagagcaucugcuugaccagcugaaacggaagcagcccgaacuccugaugaugcucaacuguuccgagaauaacaaggaggaaacaauuccugaugucgacguggaggaagcggugcugggacaauauaccgaggaaccgcuuagccaggagcccuccgucgaugccggcguugacugcagcucuaucgggggagugcccuuuuuccagcacaaaaagagccacggcaaagauaaggagaauagagggaucaacacgcuggaacgcuccaaaguggaggaaaccacagagcaccucgucaccaagucucggcugccccugagagcucagauuaaucuuuga

SEQ ID NO: 71154 - RNA, 5313 nt, Artificial Sequence
  derived and/or modified sequence opt5 from KIF13A__Homo_sapiens__NP_001099036
augagcgacaccaaggugaaagucgccguuagagugcggcccaugaaccgcagagagcuggaacucaauacaaagugcguggucgagauggaaggcaaccagacggugcugcacccuccgcccuccaauaccaaacaaggggagcggaagccucccaaaguuuucgcuuuugauuacuguuucuggucuauggacgaaagcaacacaaccaaguaugccggacaggagguggucuuuaagugccuuggcgaggggauccuggaaaaagcguuccagggauacaaugcuuguauuuuugccuauggccagacaggguccggaaagucuuucagcaugaugggccaugccgagcaacucggccugaucccucgccuuugcugugcucuguuuaaaagaauuucccucgaacagaacgagucucagaccuucaagguggagguuagcuacauggaaaucuauaaugagaaagugcgggaucugcuggaccccaaggggucccgccagagccucaaggucagagaacacaaagugcugggaccuuacguggauggccuuucucaacuggccgucacauccuuugaggacauugaaagccucaugucugaggggaacaagucccggaccguugcugccacgaauaugaacgaggaaagcucucgcucccaugcgguguucaauaucaucauuacccagacacuguaugaucuucagagcggaaacuccggcgagaaagugucuaaggucagccugguggaccucgccggguccgaaagaguuagcaaaaccggagcugccggcgagcggcugaaggaaggcucuaauaucaacaaaucccugacaacccucgggcuggugauuagcucucuugcugaucaggccgcgggaaagggcaagagcaaauuugucccguaccgcgacuccgugcugacguggcuccugaaggauaaucuugggggaaacucucaaacaagcaugaucgccaccauuucccccgcugccgacaacuacgaggagacacugagcacccucagauaugcugaucgggccaaacgcaucguuaaucacgccguggucaacgaagacccuaaugcuaaggugauuagagagcugcgggaagaggucgaaaaacugagagagcagcucucucaggcggaggccaugaaggcucccgaacugaaggagaaacuugaagaguccgagaagcugaucaaagaacucaccgugacaugggaggaaaagcugcgcaaaacggaggaaaucgcccaagagcggcagagacagcuugagagcaugggcauuucucuggaaauguccgggaucaagguuggagacgauaagugcuaccucgugaaccugaaugccgacccugcucugaacgagcuccuggucuauuaccuuaaagaucauacccgcgugggcgccgacacaagccaggauauucaacuguucggcaucgggauucagccccagcacugugaaaucgacaucgcguccgauggagacguuacccucacaccgaaggagaaugcucggucuugcgugaacggcacccuggucuguagcacgacacagcuguggcacggggauagaauucuuuggggaaauaaccauuuuuuccgcaucaaucucccuaaacggaagagacgcgacuggcugaaagauuucgaaaaggagaccggccccccugagcacgaccuggacgccgccuccgaagcuucuagcgagcccgauuauaacuacgaauuugcccaaauggaggugauuaugaagacccucaauuccaacgaccccgugcagaauguuguccaggugcuggaaaaacaguaucuugaggagaagcggagcgcucuggaagagcaaagacucauguacgaacgcgagcuggagcagcugcggcagcagcuuucuccugauagacaaccgcaguccagcgggcccgaccggcucgccuacucuucccagacagcgcaacagaaagugacccagugggccgaagagcgcgaugaacuguucagacagagccuggcuaagcuccgggagcaacuggucaaagccaacacacuugugagagaagcuaacuuucuggccgaggagaugucuaagcucacggacuaucagguuacccugcagaucccugcggccaaucugagcgcuaaccgcaaacggggcgccauuguguccgaacccgcuauccaggucagacgcaagggaaagagcacacaaguguggaccaucgagaaacuugaaaauaagcucauugauaugagagaccuguaccaggaguggaaagaaaagguuccugaggccaaacggcuguauggcaagcgcggggaucccuucuacgaggcccaggaaaaccauaaucucaucggaguggcuaacgucuuucuggagugccuuuucugugacgugaagcugcaguaugcgguuccgauuaucucucaacagggcgaaguggccgggagacuccacgucgaggugaugcgggugacaggagcugucccugaacgcguuguggaggaugacuccagcgagaauuccucugaaagcggcucccuggagguggucgauucuagcggggaaauuauccacagagugaaaaagcugaccugccggguuaaaauuaaggaggccacgggccuuccccucaaccuguccaauuuuguguucugccaguacaccuuuugggaccaaugugagucuacagucgccgcuccugugguugaccccgaagugccuagcccccaguccaaagaugcccaguauaccgucacauucagccauugcaaggacuacgugguuaacgugaccgaggaauuucuggaguucaucucugauggagcgcucgcuaucgaagucuggggccaccgcugugccgggaauggauccagcauuugggagguggacucucugcaugccaagacgagaacacuucacgaucgguggaacgaggugacccgcagaaucgaaauguggauuuccauccuggagcucaaugaacugggcgaguacgcugccgucgaacugcaucaggcgaaagacguuaacacagggggaauuuuucaacuucggcagggccacagcagacgcgugcaggugaccgucaagccggugcagcacucugggacccugccucucaugguugaggcuauccuguccgugagcaucggcugcgucacagcccgguccacgaaacuccaaagaggacuggauagcuaucagcgcgacgaugaggacggcgaugacauggauucuuaccaggaagaggaccuuaauugugugcgggaaagauggagcgacgcccugauuaagcgccgggaguaucucgaugaacagaucaaaaagguuuccaacaagaccgagaaaacagaggacgauguggaaagagaggcucaacuggucgaacaguggguggggcugaccgaggagcgcaacgccguccuugugcccgcucccggaucuggcauuccuggggccccggcggacuggauccccccucccggaauggaaacacauauuccuguucuguuccucgaucugaaugccgacgaucucagcgcuaacgagcagcuggugggcccccacgccuccggggucaauucuauccuuccuaaggaacauggcagccaguucuuuuaccugcccaucauuaaacacuccgacgaugaggugucugcuaccgccagcugggacuccagcguucacgauucugugcaucucaaccgggucacgccgcaaaaugaaagaaucuaucugauugugaagacaaccgugcagcugucccacccugccgcuauggagcuuguucugcggaaacgcaucgcggccaacauuuacaauaagcagagcuucacccaaucucucaaaagacggaucucccugaagaacaucuuuuauagcugcggagucacauacgagauuguguccaauauccccaaggcuaccgaagagauugaagaccgcgagacacucgcccugcuugccgcuagaucugaaaacgagggcacgagcgacggggagaccuacaucgaaaaauauacacggggagugcugcaggucgagaauauucugucccucgaaagacugcgccaggccgugaccguuaaggaggcgcuuagcacaaaagcucggcauaucagacgcucucuguccaccccuaacgugcacaaugucagcucuagccggcccgaucucuccggcuucgacgaagaugacaagggguggccggagaaccagcuggauaugucugacuacagcuccucuuaucaagauguggccuguuacggaacgcucccuagagacagcccccgccggaauaaagagggcugcaccuccgaaacaccucaugcccugaccguuagccccuuuaaggcuuucucuccccagccuccgaaguuuuucaaaccccuuaugccugugaaggaggaacacaaaaagagaauugcccuggaggcgcgcccccugcucucccaggaggauagcgaagaggaagagaacgaacuggaggcuaucaacagaaaacuuaucuccucucagccuuauguccccguggaguuugccgacuucagcguuuacaaugccucccuggaaaaccgggagugguuuucuagcaagguggaucucuccaauagccgcguccuggaaaaggaggugucuagauccccuacaaccagcucuauuacauccggcuauuucagccacucugcuagcaacgccacccucuccgacaugguggucccgucuagcgauuccagcgaccaacuggcuauccagacgaaagacgccgauuccacagaacauucuacccccagccuuguucacgacuuucggccuuccucuaauaaggagcugaccgagguggaaaaagggcuggugaaggauaaaauuaucgucgugccccucaaggagaacagcgcgcuggccaagggauccccuucuagccaguccauucccgaaaaaaauagcaagucucuuugucgcacaggcuccugcagcgagcuggacgcuuguccgucuaaaaucucccagccugccagaggguucugcccccgggaaguuaccguggagcauacgacaaacauccucgaggaucacagcuucaccgaauuuaugggagucucugagggcaaggacuucgaugggcugacagacuccagcgcuggagaacucuccagcagacgcucucugcccaauaaaaccggcggcaagacagugagcgaugggcuucaucacccuucccaacugcacucuaagcuggagaacgaccagguuauuauccccgaggccgccuuuugggugcucugcugucaguga

SEQ ID NO: 71155 - RNA, 4947 nt, Artificial Sequence
  derived and/or modified sequence opt5 from KIF14__Homo_sapiens__NP_055690
augagccugcacuccacccauaacagaaauaacucuggcgacauccucgauauucccagcucccaaaauucuagcucccugaacgcccuuacacacucuagccggcugaagcuccaucugaaauccgacaugagcgagugcgaaaaugaugacccucuucugcgcucugcugggaaggugagagauaucaaccggacguacgucauuuccgccagccgcaaaaccgcggacaugccgcucacacccaauccuguuggaagacuggcucugcaacggcgcaccacaagaaacaaggagucuucccuccuggugagcgaacuugaggauaccacagaaaagaccgccgagacgcggcugacccuccagcgcagagccaagacagacucugcugagaaguggaaaaccgccgaaaucgauuccgugaagaugacacugaaugucggcggggagaccgaaaacaauggagugagcaaagagucccggacgaacguucgcauugugaauaacgcuaaaaauucuuucgucgccagcuccgugccccuugacgaggauccucagguuaucgaaaugauggcggacaaaaaguauaaggagacauuuagcgcccccucuagagcuaacgaaaacguggcccugaaauacuccagcaaucggccuccgaucgcuucucucagccagaccgaggucgugcgcuccggccaccugacaaccaagcccacccaaucuaaacuggauauuaaggugcucgggacaggaaaccuguaucauagaagcaucggcaaagaaauugccaagacguccaauaaauucggcagccuugagaagcggaccccuacaaaguguaccacagagcacaaacugaccacgaagugcucucucccccagcugaaauccccugcgcccagcauccuuaagaacagaaugucuaaucugcaggucaaacagcgcccgaaguccagcuuucucgccaacaagcaagaacgguccgcugagaauacaauucugccugaagaggaaaccguugugcagaacaccucugccgggaaagacccccugaagguggagaauagccaggucacaguggcuguuagagugcgcccuuucaccaaacgggagaagaucgaaaaagccucccaggucguguuuaugucuggaaaggagauuacaguugaacaccccgacacgaagcaaguguacaacuucaucuaugaugucagcuuuugguccuucgacgagugucauccccacuacgccagccagaccacaguguaugaaaaacucgcugcgccucugcuugagagagccuuugagggcuucaauaccugccuguuugcuuacgggcagacaggaucuggcaaguccuacaccaugaugggguucagcgaggaaccgggaaucauuccccgcuuuugugaagaucucuucucucaagucgcccggaaacagacgcaggagguguccuaucauaucgagaugagcuucuuugaaguuuacaacgagaagauucacgaccugcuugugugcaaagaugaaaauggccagagaaagcaaccucugcgcguccgggagcaccccguguauggcccuuacguugaagcccucucuaugaacaucgugagcuccuaugcugacauucagagcuggcuggagcuggggaauaagcagagagccaccgcggcuacaggaaugaacgauaaaucuucccgcagccauuccgucuucacccucgugaugacacagaccaagacggaguuuguggaaggcgaggaacacgaccaucggaucacaucuagaaucaaccugauugaucuugccgggagcgagcgguguuccaccgcccacacaaauggagaccgccugaaagaaggcguuucuaucaacaagagccuccugacccuggggaaagucauuuccgcucuuucugagcaagccaaucagagaagcguguucauccccuaccgggaguccgugcucaccuggcugcugaaggaaagccucggaggcaacucuaaaacagcuaugauugccacgaucuccccggcggccagcaauaucgaggaaacccugucuacacuuagauaugcuaaccaggcccgccugauugucaauaucgcuaaggugaacgaggauaugaaugccaagcucauucgggaacugaaagcggagaucgccaagcugaaagcugcccagagaaacucccgcaauauugacccugagagauaccggcuuugccgccaagaaaucaccagccucagaaugaagcugcaucagcaggagcgggacauggcugaaaugcagcgcguuuggaaagagaaguuugagcaagccgaaaagagaaaacugcaggagacaaaggaacuccagaaagccggcauuauguuccaaauggauaaccaucugcccaaucuugugaaccugaaugaggacccucagcucucugaaaugcugcuguacaugaucaaggaggggaccacgacagucggaaaauauaagcccaacuccagccacgauauccagcuuuccggcgugcucauugcugacgaucacuguaccaucaagaacuuugggggaaccguuagcauuaucccugugggcgaggcgaaaacauacgucaaugggaagcacauucuggaaaucaccgugcugcggcauggcgaccgcguuauccucggaggcgaucacuauuucagauuuaaccaccccguggagguccagaaagggaagcggccgucuggacgcgacacaccuauuagcgaaggccccaaagauuucgaguuugccaagaaugaacugcuuauggcucaaagaucccagcuggaggccgagaucaaggaagcccagcucaaagcuaaggaggaaaugaugcaggggauucaaaucgccaaagagauggcgcagcaggaacugucuagccagaaggcugccuacgaguccaaaauuaaggcccuggaggcugaacuucgggaggaaucucaacgcaaaaagaugcaggagaucaacaaucagaaggccaaccauaaaaucgaggaacucgagaaggcgaaacaacaccuggaacaggagauuuaugugaauaagaaaagacuggaaauggagacgcucgcuaccaagcaggcccuggaggaccauagcauccggcacgcccgcauucuugaagcucuggagacagaaaagcagaaaaucgccaaggaggugcaaauucuccagcagaacagaaauaaccgggauaaaaccuucacaguccagaccacgugguccucuaugaagcugagcaugaugauccaagaagcuaaugccaucuccagcaaacugaagaccuacuauguuuuuggaagacaugacauuucugauaaguccagcucugacacauccauccgcgugcggaaccuuaaacugggcauuagcaccuucuggucccucgagaaguucgagucuaaacuggcggccaugaaggaacucuacgagagcaauggguccaacagaggcgaagacgcuuuuugcgaucccgaggacgaaugggagccugauaucacagacgccccggugagcucucugucccgccggagaagccggucucuuaugaaaaaucgcagaauuagcggaugucugcacgauauccagguccaccccauuaagaaccuccauuccucucacagcuccggccugauggacaagucuagcaccaucuacuccaacagcgcugagucuuuccugccugggaucugcaaagaacuuauuggauccagccuggacuuuuucggccaguccuaugaugaggaacggacaaucgccgauucucucauuaauagcuuucugaagaucuacaacgggcuguucgccauuuccaaagcucaugaggagcaggacgaagagucucaagauaaucucuuuagcuccgaccgcgcgauccagagccuuaccauccagacggccugcgcuuucgaacagcuggugguucucaugaagcacuggcugucugaucugcuucccuguacaaacauugccagacuggaggacgaacuccggcaagaggugaaaaagcugggaggcuaucuccagcuguuucuucaggggugcugucuggacaucuccagcaugauuaaggaggcccagaaaaaugcuauccagauuguccagcaggccgugaaguacguuggccaacuggcggugcucaaaggaucuaagcugcauuuccuugaaaacggcaauaacaaagcugccuccguccaggaggaauuuauggaugccgugugcgacgggguuggacugggcaugaagauccuccuggauagcgggcucgagaaagcuaaggaacugcagcacgagcuuuucagacaguguaccaagaaugaggugaccaaagaaaugaagacaaacgccaugggacugauccgcucucuggagaauauuuuugcggaaagcaaaaucaaguccuuccggagacaaguccaggaggaaaacuucgaguaucaggacuuuaaacgcauggugaaucgggcuccugaguuccucaagcugaagcacugccuugaaaaagccauugagaucauuaucucugcccugaagggcugucauagcgauauuaaccuccugcagaccugcguggaauccaucagaaaucucgcuagcgacuuuuacuccgauuucucuguccccagcacguccguugggucuuaugagagccgcgugacacacaucgugcaucaagagcuggaaucccuugccaaaucucugcuguuuuguuucgagagcgaagaguccccugaccuccugaagcccugggaaaccuacaaccagaauacaaaagaggagcaccagcaaagcaagucuuccggcauugauggaagcaagaacaaaggcgucccgaagcggguguacgaacuucacgggucuuccccugcuguuagcucugaggaaugcacccccuccagaauccaguggguguga

SEQ ID NO: 71156 - RNA, 4167 nt, Artificial Sequence
  derived and/or modified sequence opt5 from KIF15__Homo_sapiens__NP_064627
auggcccccggcugcaagaccgagcugagaagcgugacaaacgggcaguccaaucaaccuucuaacgaaggagacgcuaucaaagucuucguucggauucgcccgcccgccgagagaagcggcuccgcggauggggaacagaaucucugucugucugugcuuagcuccacgucucugcggcuccacagcaacccugagcccaagaccuuuacauucgaccauguggcugaugucgacaccacacaggaauccguguuugccaccguugccaaaagcaucguggagucuugcauguccggauacaauggcacaauuuucgcuuaugggcagaccggaagcggcaagacguuuaccaugaugggcccuucugaguccgauaacuucagccacaaucugcgcggggucauccccagaucuuuugaauaccuuuucucccugauugaccgggagaaagaaaaggccggagcuggcaagagcuuucucuguaaaugcuccuucaucgagaucuauaacgagcaaauuuacgaucugcuggacucugccagcgcggggcucuaucugcgcgaacauaucaagaaaggaguguuuguugugggcgccgucgaacagguggugacauccgcugccgaggcuuaccagguccuuagcgggggauggagaaaucggcgcguugccucuaccuccaugaacagagagagcucucggagccacgcgguguucacaauuaccaucgaauccauggagaagucuaaugagauugugaacauccgcacgagccugcucaaucuggucgaucuugccggcuccgaaagacagaaagacacacaugcugagggcaugcggcugaaggaagccgggaacauuaaucgcagccucucuugucugggacaagugaucaccgcucugguugaugugggcaacgggaagcagagacacgucugcuaucgggacuccaaacucacauuucugcuuagagauagccugggaggcaacgccaagaccgccaucauugcuaaugugcacccugggucucgcuguuucggagagacccucuccacacugaacuucgcgcagcgggccaaacuuaucaagaauaaagcuguugugaacgaagacacgcagggcaaugucagccaacugcaggccgaggugaagagacucaaagagcagcuggccgaacuggcuuccggccaaaccccgcccgagucuuuucucacacgcgacaagaagaaaaccaacuacauggaauacuuccaggaggccaugcuguuuuucaagaaaagcgaacaggagaagaaaucccuuauugagaaggucacacagcuggaagaucucacccugaagaaagagaaguuuauccaaucuaauaaaaugauugugaaguuccgggaagaccagaucaucagacuugagaaacugcauaaggagagccgcgggggauuucucccugaagaacaggaucggcugcuguccgaacucagaaacgagauucagacgcugcgcgaacaaaucgagcaccauccccggguugcgaaguaugcuauggagaaucacagccuuagagaagagaaccgccggcugagacuccuggaaccugugaaacgggcccaggagauggacgcccagacaauugcuaagcuggaaaaagccuucucugagaucuccggcauggagaaaagcgauaaaaaucagcaaggguuuucucccaaggcucagaaggaaccgugccuuuucgccaacaccgagaaacucaaggcgcagcugcugcagauucaaaccgaacucaauaacuccaaacaggaguacgaagaguuuaaggagcugacacgcaaaagacagcuugaacuggagagcgaacuccaaucucugcagaaggccaaucugaaccuugagaaccuccuggaggcuaccaaagccuguaagcggcaggaagucagccagcugaauaagauccacgcugagacacucaaaaucauuacgaccccuacaaaggccuaucaacugcauuccagacccgugccuaaacuuagccccgaaaugggaucuuucggcucccuguacacccagaacagcuccauccucgacaaugauauucugaacgagcccguuccuccggaaaugaaugagcaggcguuugaggccaucucugaagaacugcgcacagugcaggaacaaaugagcgcccuucaggcuaagcucgacgaggaggagcacaaaaaccugaagcugcagcagcaugucgauaagcucgagcaccauuccacccaaaugcaggaacuguucucuagcgagcggauugacuggacgaaacagcaagaggagcuucugucccagcucaaugugcuggaaaagcagcugcaggagacccaaacaaagaacgauuuccuuaagucugaggugcacgaccucagaguuguccugcacagcgcugacaaagaacuguccagcgugaagcucgaguauucuuccuuuaagaccaaucaggaaaaagaguucaacaagcugagcgagcgccauaugcacgugcagcuucagcuggauaaucucagacuggaaaacgagaaacugcuugaaucuaaggccugccugcaagacuccuacgauaaucuccaggagaucaugaaauuugaaauugaccagcugagccggaaccuccagaauuucaagaaggagaacgagacacugaaaucugaucuuaacaaucugauggaacuccuggaggccgaaaaggagcgcaacaauaaacugucccuucaauuugaagaggacaaggagaacagcuccaaagaaauccugaagguccucgaggcugugagacaggaaaaacagaaggagaccgcgaagugugaacagcaaauggccaaaguucagaagcuggaggagagccuccuggcuacggaaaaagugaucucuagccuugagaagucccgggauucugacaaaaaggucguggccgaucugaugaaucagauucaagaacuccgcacaagcguuugcgagaagaccgagacaaucgacacccugaaacaggaacugaaggauauuaacugcaaauauaauuccgcccuuguggacagagaggaaucucggguccugaucaagaaacaggagguggauauucucgaccugaaggaaacccuccgccugagaauccuuagcgaggacaucgagcgggauaugcugugugaagaccuggcucaugccacagagcagcucaacaugcugacggaagcguccaagaaacacucugggcuucugcaaagcgcucaggaggaacucaccaagaaagaggcccugauucaggagcuccagcacaagcugaaucaaaagaaggaagagguugaacagaagaaaaacgaguacaauuucaagaugcgccagcuugaacaugugauggauuccgccgcugaggacccccagagcccuaaaacacccccucacuuucaaacccaucuggccaagcugcucgagacacaggaacaggagaucgaagauggcagagcgucuaaaaccucccuggagcaccuugucacgaagcugaacgaggaccgggaagugaagaaugcugagauucucagaaugaaagaacaacugcgcgagauggaaaaccuccggcuggagagccagcagcuuaucgagaagaauuggcugcugcagggacaacucgaugacauuaaaagacagaaggaaaacucugaucagaaccaucccgacaaucagcaacugaaaaacgagcaggaagaguccaucaaggaacgccuugccaaaagcaagaucguggaggagaugcugaagaugaaagccgaucucgaagagguccaguccgcucuguacaauaaggaaauggagugccuccggaugacagacgaaguugagagaacccagacccuggagucuaaagccuuccaagaaaaggagcagcuucgcagcaaacuggaagagauguaugaggaacgggagagaacaucccaggaaauggagaugcugcgcaaacagguggaaugucucgcugaggagaacggcaagcugguggggcaccaaaaucuucaccagaaaauucaguacgucgugcggcugaagaaagaaaacguuagacucgccgaggaaaccgagaagcugcgggcggaaaauguguuucugaaagagaagaagcgcagcgagucuuga

SEQ ID NO: 71157 - RNA, 4179 nt, Artificial Sequence
  derived and/or modified sequence opt5 from KIF16B__Homo_sapiens__NP_001186795
auggccagcgugaaggucgcuguuagagugcggcccaugaaccgcagagagaaagaccuggaagccaaguucaucauucagauggagaaauccaagaccacaaucacgaaucucaaaauuccugaaggcgggaccggagauucuggccgggagcgcacaaagaccuuuacauacgacuucagcuuuuauuccgcggauaccaagucuccggacuacgugagccaagaaauggucuucaaaacacuggggaccgaugugguuaaguccgcuuuugagggauauaacgccugcguguucgccuacggccagacggggucuggaaaaagcuauaccaugaugggcaauuccggcgacagcgggcuuauccccagaauuugugagggacuguuuucucggaucaacgaaacaacccgcugggaugaggcuuccuucagaacagaagucagcuaccucgagaucuauaaugagcgggugcgcgaccugcuuagacggaagucuuccaaaaccuuuaaccugcgcguuagagaacacccuaaggagggccccuacguggaagaucucagcaagcaucugguccagaauuacggggacguggaggaacugauggaugccggaaacauuaaucggacgacagcugccaccggcaugaacgacgugucuucccgcagccacgcgaucuucacaauuaaauuuacccaggccaaguucgauuccgagaugccuugcgagaccgucucuaaaauccaucucguugaccuggcugggagcgaaagagccgacgcuacaggagccacgggcgugcggcuuaaggagggcgggaauauuaacaaaucccuggugacccucggaaaugucaucagcgcgcuggccgaucuuucucaagacgcugccaacacacuggcuaagaaaaagcaaguguuuguucccuauagagauuccgugcucaccuggcugcugaaggacagccucggcggaaauucuaaaacaauuaugaucgccaccaucagcccugccgaugucaacuacggggaaacgcuguccacacuucgcuaugcuaaccgggcgaagaauauuaucaacaaaccgaccauuaaugaggacgccaacgugaagcugaucagagaacuccgcgcugagauugcccggcugaaaacccuucuggcccagggcaaucagaucgcucuccuggauucucccacagcccugagcauggaggaaaagcuccagcagaacgaggcgagaguucaggaacugaccaaggaguggacaaauaaauggaacgaaacgcagaauauccuuaaggagcaaacccuggcucuccgcaaagaggggauuggagugguccuggacuccgaacuuccucaccugaucggcauugaugacgaucuccugagcacaggcaucauucuguaccaucucaaggaggggcagaccuaugugggacgggacgacgccucuacagaacaggauaucguccugcacggccuugaccuggaguccgagcacuguaucuucgaaaacauugggggaaccgugacgcucaucccccugagcggcucucaaugcuccguuaauggggugcagauugucgaggccacccaucugaaccagggcgcugugauccuucucggaagaacaaauauguuccgcuuuaaccacccuaaagaagccgcuaagcugcgggagaagagaaaaagcggccugcucuccucuuucagccuguccaugaccgaucuuucuaagagccgcgaaaaucuguccgccguuaugcucuacaaccccgggcuggaguuugagcggcagcaaagagaagaacuggaaaaacuugagagcaagcggaaacucauugaagagauggaggaaaagcagaagucugacaaagcggagcuggaacgcaugcagcaggagguggaaacacaaagaaaggagaccgagaucguccagcugcagauucggaaacaggaagagucccucaagagacgcagcuuccauaucgaaaacaaacugaaggaucuucuggccgagaaagagaaguuugaagaggaacggcucagagagcaacaggaaaucgagcugcagaagaaacgccaggaggaagagacguuccugagagugcaagaagaacuucagcggcucaaggaacugaauaacaaugagaaagcugagaaguuucagauuuuccaagaacuggaccagcuccagaaagagaaggaugaacaguaugccaagcuggagcuugagaaaaagcgccuggaggagcaagaaaaagaacaggugaugcucguugcucaccuggaggagcagcugagagagaagcaggaaaugauccaacuucuccggcgcggagagguccaguggguggaagaggagaaaagagaccuggagggcauucgggagucucugcuccgcgugaaggaagccagagccgggggagaugaggacggcgaggaacuggaaaaggcgcagcuucgguuuuucgaguuuaaacgcagacagcuggucaagcucgugaaccuggagaaagaucugguucaacagaaggacauccuuaaaaaggaagugcaggaggaacaagagauucuggaaugucucaagugcgagcacgauaaagagucccggcugcucgaaaagcaugacgagagcgucacagacgugaccgaaguuccgcaggauuucgagaaaaucaagccuguggaguacagacugcaguacaaagaacgccagcuucaauaucugcuccagaaucaucugcccacacugcuugaggaaaagcagcgggcuuuugagauccuggacagagggccucucucucuggauaacacccucuaccaggucgaaaaagagauggaggaaaaggaggaacaacuggcccaguaucaggcuaaugccaaccagcuucaaaagcugcaggccaccuucgaguucacagcuaauauugcgcgccaggaagagaaagugcggaagaaagagaaggaaauccucgagagcagagaaaaacagcaacgcgaggcccuggaacgggcucuggccagacuugagcgccggcacuccgcccugcagagacacagcacgcucggcauggagauugaggaacagcggcaaaagcuggcuucucucaacuccggaagccgcgaacaguccggccugcaggccucucuugaggcggagcaggaagcucuggagaaggaccaagaaagacuggaguacgaaauccagcagcucaaacagaagauuuaugagguugauggggugcaaaaagaccaucacggaacccuggagggcaaggucgccagcuccucucuucccgugagcgccgaaaaaucccaccuggugccccucauggaugcucggaucaaugccuacaucgaggaagagguccagcgcagacugcaggaccuccaucggguuauuucugaaggguguagcacauccgcggauaccaugaaggacaacgagaagcugcacaauggaacaauccagagaaaacuuaaguaugagcugugccgcgaucugcucugugugcugaugccugaaccggacgcugccgccugcgcuaaccauccccuucugcaacaggaucucgugcagcugagccucgacuggaaaaccgagauuccugaccugguccuucccaauggcgugcaaguuucuuccaaguuucagacgacacugguggauaugaucuacuuccugcacgggaacauggaagucaacgugccuagccucgccgagguucagcugcuucuguacaccaccgugaaagucaugggcgacucuggacacgaucagugucaaucccucgugcugcucaauacacauauugcucugguuaaggaagacugcguguuuuauccccggaucagaagccgcaacaucccgccucccggcgcccaguucgaugucauuaagugccacgcgcuuucugaguuucggugugugguggucccugagaaaaagaauguuuccaccguggaacugguguuccugcagaaacucaagcccagcgucggguccagaaacagcccucccgagcaucugcaggaagccccgaaugugcaacuuuuuacaacgccucuguaccuccagggaucucagaacguugcucccgagguguggaaacugaccuucaauagccaggacgaggcccuguggcucaucucccaccuuacacgccuguga

SEQ ID NO: 71158 - RNA, 3117 nt, Artificial Sequence
  derived and/or modified sequence opt5 from KIF17__Homo_sapiens__XP_011540143
auggccagcgaggcugugaaggucguugugagaugccggcccaugaaccagcgcgaaagagagcugcggugucaaccuguggucaccguggacugcgcccgcgcgcaguguugcauccagaauccgggcgcugccgaugaacccccuaaacaguucacauuugacggggccuaccacguugaucaugugacggagcaaauuuauaacgaaaucgcuuacccccucgucgagggagugaccgagggcuauaaugggacaauuuucgccuacggacagaccggcuccgggaagucuuuuacaaugcagggacugccugaucccccuagccagagaggcaucauuccgcgggcuuucgaacacguuuuugaguccgugcaaugugccgaaaacaccaaauuccuuguccgcgcgucuuaucuggagaucuacaaugaggacgugagagaccuccugggcgccgauacaaagcagaaacuugaacugaaggagcaucccgaaaaggggguguaugucaaaggacucagcaugcacaccguucauuccguggcucagugcgagcacaucauggaaacgggcuggaagaaccggucugugggguacacccugaugaauaaagacagcucccgcagccacucuauuuuuacaaucuccauugagaugagcgccgucgaugagagaggaaaggaccaucugcgggcuggcaaacucaaccugguggaucuugccgggucugaacgccaguccaagaccggagcgacaggcgagagacugaaggaagccaccaaaaucaaucucagccugucugcucuuggcaacguuauuuccgcccugguggacgggcgguguaagcacgucccuuaccgcgauagcaaacucacgagacugcugcaagacucccucggaggcaauacaaagacccugaugguggcuugccuuucucccgccgacaacaauuaugaugagacacugagcacccuccgguacgccaacagagcuaaaaauauccgcaacaagccucggauuaacgaagaccccaaagaugcgcugcuuagagaguaucaggaggaaaucaagaagcugaaagccauccucacccagcaaauguccccgagcucucuguccgcucugcucagccgccagguuccucccgacccugugcaggucgaggaaaagcugcuuccccagcccgugauucaacaugaugucgaggccgaaaaacagcugauccgggaggaguacgaagagagacucgcccgccugaaggcugacuauaaagccgaacaggagucucgggcgagacuugaggaagauauuacagcuaugcgcaauagcuacgacgugcggcuguccacgcucgaggaaaaccugagaaaggagaccgaagccguucuccagguggggguccuguauaaggccgaggugaugucucgcgcugaguucgccagcuccgcugaauacccuccggccuuucaauacgagacaguugugaaacccaaggucuucagcaccacagauacccugccuucugacgauguguccaaaacacaggugagcucucgguuugcggaacuucccaagguugagccuuccaaaagcgaaaucucccugggaucuagcgaguccucuagccucgaggaaacguccgucagcgaggccuuccccggcccggaggagccuucuaauguggaaguguccaugcccaccgaggagagcagaucucgguauuuucuggacgaaugucuggggcaggaggcugccggacaccuucucggcgaacagaacuaccugccucaagaggagccccaggaagucccucugcagggccuccuggggcuucaggaccccuucgcugagguggaagccaagcuggcgcgccucuccagcaccguugccagaacagaugcuccgcaagccgacgugccuaagguccccgugcagguucccgcuccuaccgaucugcuggagccgucugacgcccggcccgaagccgaggcugcggaugacuucccucccagaccugagguggaucuugccagcgaagucgcucucgaggugguucgcacagccgaacccggaguguggcuggaggcccaggcuccugucgcccugguggcgcaacccgaaccgcucccugcuacggccggcgugaaacgggaguccgucgggauggagguugccgugcugaccgacgauccccuuccuguggucgaccagcaacaggugcuggcuagacuccagcugcuggaacagcagguugugggaggcgagcaggccaagaauaaagaucuuaaggaaaaacacaagcgcagaaagcgguaugcggacgagcgcagaaaacaacucgucgcugcccugcagaacagcgaugaagacucuggggacugggugcugcucaauguuuacgauuccauucaggaggaggugcgggccaagagcaaacugcuugaaaagaugcagcgcaaacugagagcugccgaggucgaaaucaaggaccuccaauccgaguuucagcuggagaaaaucgauuaucuggcuacaauucggcgccaggaaagagacucuaugcuucuccaacagcugcuggaacaggugcagccccucauccggcgcgauugcaacuacagcaaucuggaaaagauucuuagagaguccuguugggacgaagauaacggcuucuggaagaucccgcauccuguuauuaccaaaacaucucugccccaauuucagcucggacaccggaccaaucagccugccaagccccugcagcaaacgauggcgagcagaaccuggcgcacaaccgccacaggcuccugcucugugggggcuaccgucaaaacgcugcccgccacaaccagcgaccuuuccggaccugcucggagcucugcccagacaccgggcagagccucccauaucaccacccgccaccaggcuagcgcggcccauucugcuacaacgcugcccucccacccuccccggccucucaagugccccagcccugggccgucugccuccagccccuccaccagccugucuccuagacccagccucccuucuccccuggccuccggacuuuggcugggcccgcgcgggcgguggaaaagcuguugccucugguga

SEQ ID NO: 71159 - RNA, 2697 nt, Artificial Sequence
  derived and/or modified sequence opt5 from KIF18A__Homo_sapiens__NP_112494
augagcgugaccgaggaagaccugugccaccauaugaaggucguugugagagugcggcccgagaacacaaaagaaaaggccgcuggcuuccacaaagucgugcauguuguggauaagcacauccucgucuuugacccuaaacaggaggaaguguccuucuuucaugggaagaagacgaccaaucaaaacguuauuaaaaagcagaauaaagaucugaaguucguguuugacgccgucuucgaugagacaucuacccagagcgagguguuugaacacacaaccaaaccgauccuucgcuccuuccugaacggauacaauuguacagugcucgcguauggcgcuaccggggccggaaagacgcacaccaugcugggcucugccgacgagcccggggucauguaccuuacaaugcugcaucucuauaagugcauggaugaaauuaaagaggagaagaucuguagcaccgcuguuuccuaccuggaaguguauaacgagcagauuagagaccugcucgucaauucuggaccucuggccgugcgggaagauacacaaaaaggcgugguugugcacggccuuacccugcaucagcccaagagcuccgaggaaauccuccaucugcuugacaacgggaauaaaaaccgcacgcagcacccuacagauaugaaugcuaccagcucuagaucccacgccgucuuucagaucuaccugcggcaacaggacaagacagcgagcauuaaccagaaugugcgcaucgccaaaaugucucucauugaucuggcuggauccgagagagccagcaccucuggcgcuaaggggacccgguucguugagggaacaaacaucaaucgcucccugcucgcccugggcaacgugauuaacgcgcuugccgacagcaagagaaagaaucagcacauccccuaucggaacuccaagcugacgcgccuccugaaagacucucuugggggaaauugccaaaccauuaugaucgcugccgucagcccuuccagcguguuuuacgaugacacauacaacacccugaaguaugcuaauagagccaaagauaucaagucuucccucaagagcaacguccugaaugugaacaaucauauuacacaguacguuaaaaucuguaacgaacagaaggccgagauucugcuccugaaagaaaaacuuaaggcuuaugaggaacaaaaggcguucaccaaugagaacgaccaggccaagcugaugaucucuaauccgcaggagaaagaaauugagcgguuucaggaaauccucaacugccuguuccaaaaucgcgaggaaaucagacaggaguaccuuaagcuggagaugcuccugaaagaaaacgagcucaagagcuucuaucagcagcaaugucacaaacagauugaaaugaugugcuccgaggauaagguggagaaggcuacgggcaaacgggaccauagacuggccaugcugaagacacgccggucuuaccuugagaaaagacgcgaagaggaacugaagcaguuugaugaaaacaccaauuggcuccaccgggucgagaaagagaugggccugcugagccagaacgggcacauccccaaggaacuuaaaaaggaccuccauugucaccaucugcaucugcaaaauaaggaucucaaagcccagauuagacacaugauggaccuggcuugccuucaggagcagcaacaccgccagaccgaagccgugcugaacgcgcuccugccuacacugcggaagcaguauuguacccuuaaagaggcuggacucuccaaugccgccuucgaaagcgauuuuaaggagaucgagcaccugguugaacgcaaaaagguggucgugugggcugaccaaacagccgagcagcccaagcagaacgaccugccuggcauuucugugcucaugacguucccccagcuggggccgguucaaccuauccccugcugcuccagcucuggaggcaccaaucuugucaaaaucccuacagaaaagagaacccggagaaaacugaugcccagcccccucaaggggcagcauacacugaaauccccuccgucccagucugugcagcugaacgauagccuuuccaaggagcuccaacccauuguguacaccccugaagacugucgcaaggcuuuucagaaucccucuacggucacccugaugaaaccuagcuccuucacaaccagcuuucaggccaucucuuccaacauuaauagcgauaacugccugaagaugcucugugagguggcgaucccccacaaucggagaaaagagugcggacaggaagaccuggauucuacauucaccauuugugaggacaucaaguccagcaaaugcaaacuuccggaacaagagucucugccuaacgauaauaaggacauucuccagcggcuggaucccagcuccuuuagcacgaaacauucuaugccuguucccuccauggugccuagcuacauggccaugacaaccgcugccaagcgcaaaagaaagcugacauccucuaccagcaacuccucucuuaccgcugacgucaacagcggcuucgccaaacgggugagacaggauaauuccucugagaagcaccuccaagaaaacaaacccacaauggagcacaagcgcaauaucuguaagaucaacccgagcaugguucggaaauuuggcagaaauauuuccaaggggaaccugcgcuga

SEQ ID NO: 71160 - RNA, 5376 nt, Artificial Sequence
  derived and/or modified sequence opt5 from KIF1A__Homo_sapiens__NP_001230937
auggccggcgcuagcgugaaggucgccguuagagugcggcccuucaacucccgcgagaugucuagagacagcaaaugcaucauucagauguccgggucuaccacaacgaucgugaauccuaagcaaccgaaagaaacccccaagagcuuuuccuucgauuacucuuauuggagccacacauccccugaggacauuaacuacgcgagccagaaacaggucuaucgggauaucggagaagagaugcugcagcaugcuuuugaaggcuacaauguguguauuuucgccuaugggcaaaccggagccggcaagucuuacacaaugauggggaagcaggagaaagaccagcagggaaucaucccccaacucugcgaggaucuguuuucccgcauuaacgacaccacaaaugauaacaugagcuauucuguugaaguguccuacauggagaucuacugugaaagaguccgggaccuucugaauccuaagaacaaaggcaaucuccgcgugagagagcacccccugcuuggcccuuauguugaggaucugagcaagcucgcugugaccucuuacaacgacauucaggaucugauggacuccgggaauaaagcccggacggucgcugccaccaacaugaaugaaacaagcucccgcucucaugcgguguucaacaucauuuuuacccagaagagacacgaugccgagacaaauaucaccacggaaaaggugagcaaaauuucccuggucgaccucgcuggaagcgagcgggccgacucuacaggcgcuaaggggacccgccugaaagaaggagccaacaucaacaagucccuuacaacccugggcaaaguuaucagcgcgcucgccgagauggauucugggccgaauaagaacaaaaagaagaaaaagaccgacuucauucccuauagagauagcgugcugacauggcuucugcgggagaaucucggaggcaacucccgcacggcuaugguggccgcucugucuccugccgacaucaauuacgaugaaacccugagcacacucagauaugccgaccgggcuaaacagauuagaugcaacgcggucaucaaugaggaucccaacaauaagcugauucgcgaacuuaaagacgaggugacccggcugagagaucuccuguacgcccaaggccuuggggacaucacagauaccaacacgguuccuggaggccccaagcugacaaaugcucucguggggauguccccgagcucuucccugagcgcccugucuucccgcgccgcuagcgucuccucucuccaugaacggauccuguuugccccuggaagcgaggaggcgauugaaagacuuaaggagaccgaaaaaaucauugcugagcugaacgaaaccugggaggagaagcuccgccggacagaagccaucagaauggagcgcgaagcccugcuugcugagaugggcguggccaugcgggaggacgggggaacccugggcguuuucucccccaaaaagacaccucaccucgugaaucugaacgaagacccccugaugucugagugucuccuguauuacauuaaagauggcaucacgagagucgggcgcgaagacggagagcggagacaggauaucgugcuuagcggccacuuuauuaaggaagagcauugcgucuuccgguccgacagccgcgggggaucugaggcugugguuacccuggaacccugugagggcgccgauacauacgugaaugggaagaaagucaccgaaccuuccauccucagaagcggcaaccggauuaucaugggaaagucucacguguuuagauucaaccauccggagcaggcgcgccaagaacgggagagaacacccugcgccgagaccccugcugaacccguugacugggccuucgcucagcgcgagcugcuggaaaaacagggcauugauaugaagcaggagauggaacaaagacuucaggagcucgaggaccaguaucggcgcgaaagagaggaagccacguaccugcuggagcagcaacggcucgauuaugaguccaaacuggaagcgcuucagaagcagauggacagccgcuacuauccugaggugaaugaagaggaagaggagcccgaagaugagguccaguggaccgaaagagagugugaacuggcccucugggcuuuucggaaguggaaaugguaccaauucacaucucugcgcgaccugcuuugggggaacgccaucuuucucaaggaggcuaaugccauuagcguggagcugaaaaagaaagugcaguuccaguuuguucugcucaccgauacacuguauuccccgcuuccucccgaccugcucccucccgaagccgcuaaggacagagagacccggccuuucccccgcacgaucgucgcgguggaagugcaggaucaaaaaaacggagccacacacuacuggacccuggagaagcugagacagcggcuugaccucaugagagaaauguacgaucgcgcugccgaggucccgagcucugugaucgaggacugcgauaauguugugacaggcggggacccuuuuuaugaucgguuccccugguuuagacuggucggauccagcgccauuuccggcuguaacucuuacccccugcucaauaccugcaugagcgaacgcauggcugcccugaccccuuccccgacauucucuagccccgacuccgaugcgacggagccugcugaagagcagucugugggggaggaagaggaagaggaagaggaggaagaggacgaagaggaagaggaucuugaggacgauguuuuucccgaacacgcccugugcgacggccgggacccuuucuaugauagacccccucucuuuagccuggugggacgcgccuucgucuaccuguccaaccuucucuaucccgugccgcugguucaucggguggcuaucgucagcgagaagggcgaagugaaaggguuccugagaguggccguccaagcgauuucugcugacgaggaagccccugauuacggauccggcguucgccagagcgggaccgccaagaucucuuuugacgaucagcacuucgagaaauuucaguccgagagcugucccguggugggaaugucucgguccggcacaagccaagaagagcucagaauugucgaagggcagggccagggagcugacgugggcccuuccgccgaugagguuaauaacaauaccugcagcgcugugcccccggaggggcugcuucuggacucuagcgaaaaggccgcgcucgauggaccucuggacgccgcucuggaucaucuucggcugggcaacacauucaccuuucgcgucacggugcuccaggccuccucuaucagcgcugaguaugccgacaucuucugucaauuuaauuucauucacagacaugacgaagccuuuuccacagagccccugaaaaacaccgggcggggaccuccccucggcuucuaccacguucagaauaucgcuguggaagucaccaagucuuuuauugaguacaucaagagccagcccauuguguucgagguuuuugggcacuaucagcaacauccuuucccgccccugugcaaagaugugcuuuccccucugcgccccucuagacggcacuucccuagagucaugccccucagcaagccugugccggcgacaaaacuguccacccugacacgccccuguccuggccccugccauuguaaguacgaccuucugguguauuuugaaaucugcgagcucgaagccaacggagauuacaucccugcugucguugaccaccggggcgggaugcccuguaugggaacguuccugcuccaccagggcauucagagacgcaucaccgugacacugcuucaugagaccgggagccacauucgguggaaagaagugagagagcuggucgugggacgcauccggaacacaccggagaccgaugaaucucucauugacccuaauauccugucccugaacauccuuagcucuggcuauauucaucccgcccaagaugacagaacguuuuaccaguucgaggccgcuugggauuccagcaugcacaauucccugcuccugaaccgcguuacccccuauagagaaaagaucuacaugacacucucugccuacauugagauggaaaauugcacccagccugcgguggucacaaaggacuuuuguaugguguucuauagccgggaugcuaaacugcccgccucccgcagcaucagaaaccuuuuuggcucugggucccugcgggccagcgagucuaaucgcguuaccggaguguacgagcugagccucugccaugucgcugacgccggcuccccugggaugcagagacggagacgccgggugcuggauacaucugucgcguaugugagaggagaagagaaccuugcuggcuggcgcccgcggagcgacucccugauucucgaccaccaaugggaacuggagaagcucucucugcuucaggagguugaaaaaaccagacacuaccugcugcuccgggagaagcuggaaacggcccagcgccccgugccugaggcccuuagccccgcuuucuccgaagauagcgagucucauggguccagcuccgccucuagcccucuguccgcugagggaagacccucuccgcucgaagccccuaaugagcggcagcgcgaacuggcggucaaaugccucagacugcuuacacacaccuuuaaccgggaguauacccauagccacguguguguuuccgccagcgaaucuaagcuguccgagaugagcgugacacugcuccgcgaccccucuauguccccucugggcgucgcuacccuuacgcccagcucuacaugcccuagccugguggagggcagauacggggccaccgaucuccggacaccccaaccguguucccgcccugcuucucccgaacccgagcugcucccugaagccgacagcaagaaacugccgucccccgccagagcuaccgagacagauaaggaaccucagcggcuucuggugcccgacauccaggagauuagaguuagcccuaucgucuccaaaaagggauaucugcauuuccucgagccccacaccucuggcugggcgcgccgguuugugguggucagacgcccuuacgccuacauguauaauagcgauaaagacacgguggaacgguucguucugaaccuugcuaccgcccagguggaguacuccgaagaucaacaggccaugcugaagacaccgaauaccuucgcugucugcacagagcacagagggauccuccugcaggccgcgucugacaaagauaugcaugacuggcuguaugcuuuuaacccccuccuugccggaaccauucgcagcaagcugucccggagacgcucugcccagaugcggguguga

SEQ ID NO: 71161 - RNA, 3312 nt, Artificial Sequence
  derived and/or modified sequence opt5 from KIF1C__Homo_sapiens__NP_006603
auggccggcgcuagcgugaaggucgccguuagagugcggcccuucaacgcgcgcgagaccucccaggacgcuaaaugcguggucucuaugcaagggaauacaacgagcaucauuaacccuaagcaguccaaagaugccccgaagucuuuuaccuucgacuacagcuauuggucccacacaucuaccgaagauccccaguuugccagccagcaacagguguacagagacaucggagaggaaaugcugcuccaugcuuucgagggcuauaauguuuguauuuuugccuacgggcagacaggagcuggcaaauccuauaccaugauggggcggcaggaaccuggacaacagggcaucgugccccagcugugcgaggaucuuuucagccgcgucucugagaaccaguccgcccaacugagcuacucuguggaaguuuccuauauggagauuuacugugaaagagugcgggaccuccugaauccuaagagccgcggcucucuuagaguccgggagcaccccauccuggggccuuacgugcaggaucucuccaagcuggcggugacaagcuaugccgacaucgcugaucugauggacugcggaaacaaagcccgcaccgucgcugccacgaauaugaacgagaccuccucuagaagccaugcgguuuuuacaauuguguucacccagcggugucacgaucaacucacaggccuggacuccgaaaaggugagcaaaaucucucuugucgaucuggccggguccgagcgcgcugacagcucuggagccagaggcaugcggcucaaggaaggggcuaauauuaacaaaagccugaccacgcuuggaaaggugaucuccgcccuggccgacaugcagucuaagaaacgcaagagcgauuuuauuccguacagagacuccguucucacauggcugcugaaagagaaucucggcggcaacagccggaccgcuaugaucgcggcccugucucccgcugauauuaauuaugaagagacacuuuccacccugagauacgccgaccgcaccaagcagauccggugcaacgccaucauuaaugaggauccuaacgcuagacucauccgcgaacugcaggaggaaguggcccggcuuagagagcugcucauggcgcaagggcugagcgcuucugcccuggaaggacucaaaacagaggagggcuccguccgcggggcccugcccgcugugagcuccccucccgccccgguuucuccuagcucccccacgacccauaacggagaacuugagccuucuuucagccccaauacagaaucccagauuggccccgaggaagcuauggagcggcugcaggagaccgaaaagaucauugccgagcucaacgaaacaugggaggagaaacugagaaagaccgaagcgcuucgcauggagcgggaagcccugcucgcugagauggggguggccgucagagaagacggaggcacggugggcgucuuuagcccuaagaaaacaccgcaccuggugaaucugaacgaggauccccucaugucugagugucugcuuuaucacaucaaggacgggguuacccgcgugggacaggucgauauggacaucaaacugaccggccaauucauucgggaacagcauugccucuuuagauccaucccucagcccgauggggaggugguugugacacuggaaccuugugagggagcugaaaccuacgucaauggcaagcuggugacagagccccuugugcucaaaagcgggaaccggauuguuaugggcaagaaucacgucuuccgcuucaaccauccggagcaggccagacuggaacgggagagaggagugccucccccucccggcccucccucugaaccgguggacuggaauuuugcgcaaaaggagcugcucgaacagcaggggaucgacauuaaacuggagauggagaagcgccuucaggaucuggaaaaccaauaucggaaagagaaggaagaggccgaccuccugcuggagcagcagagacuuuacgcugauuccgacagcggagaugacucugauaaacgcagcugcgaagaguccuggagacucaucagcucucugcgggaacaacugccucccacgaccguccagacaaucgugaagcgcuguggccuccccuccagcgggaagagacgggccccucgcagaguuuaccagauuccgcagcggcgcagacugcaaggaaaagacccccggugggcuaccauggccgaucuuaagaugcaggccgugaaagagaucugcuaugaagucgcucuggcggacuuccgccacggcagagccgagauugaggcucucgccgcccugaagaugcgggaacugugcagaacauacgggaaaccugauggccccggagacgcuuggcgcgccguggcgcgggauguuugggacaccgugggcgaggaagaagggggaggcgcuggguccggaggcgggucugaggagggcgccagaggagccgaggucgaagaccuucgcgcucacaucgauaagcucacgggcauucugcaggaggugaagcugcagaauagcuccaaagaccgggaacuccaagcccugagagaucgcaugcuucggauggagagaguuaucccucuggcgcaggaccaugaagaugagaacgaggaagggggagaggugcccugggcuccucccgaaggcucugaggccgccgaggaagcugccccgagcgaccgcaugccuuccgcucggcccccuucucccccgcucagcuccugggagagagucagccggcugauggaagaggauccugccuuucgcagagggcggcugcgcuggcuuaagcaggaacagcucagacugcaaggacugcagggcucugggggccggggaggcgggcucagacggcccccugcgcgguucgugccuccccacgacuguaaacugagauuucccuucaaguccaauccgcagcaucgcgagagcuggcccggaaugggcucuggggaggccccuacaccccuucaaccucccgaagaggugaccccucacccggcuacccccgcccggagaccucccuccccucgccggagccaucaccccagacgcaacucucuggauggaggcggcagaucccgcggggcuggaagcgcccagccggaaccucagcacuuucagcccaaaaagcauaauuccuauccccaaccuccccagccuuacccggcccagagacccccuggcccccgcuauccucccuacacaaccccgccucggaugcgcagacagcggagcgcucccgaccucaaagagucuggggcggccgucuga

SEQ ID NO: 71162 - RNA, 2673 nt, Artificial Sequence
  derived and/or modified sequence opt5 from KIF20A__Homo_sapiens__NP_005724
augagccagggcauccuguccccucccgccgggcugcugucugacgaugacguggucguuagcccgauguucgaguccaccgcugccgaucuuggaucuguggugagaaagaaccugcucagcgacugcuccgucgugucuacaagccuggaagauaaacaacagguucccuccgaggacagcauggaaaaggugaaagucuaccuucgggugcgcccucugcuccccucugagcuggaaagacaggaggaucagggcuguguucggauugagaauguggaaacgcugguccuccaagcgccuaaggacuccuuugcucugaaaagcaacgagcgcgggaucggacaggccacccacagauucacauuuucucagauuuucggccccgaaguggggcaggccuccuuuuucaaucuuaccgugaaggagauggucaaggauguucugaaaggacaaaacuggcucaucuauacauacggcgugaccaauagcggcaagacacauaccauucaggggacgaucaaagacggaggcauccugccucggucucuugcucugauuuuuaacucccuccaggggcagcugcacccgacccccgaucugaagccucuccugagcaaugaggugaucuggcuugacuccaaacaaauucgccaggaagagaugaagaagcugucucuccugaacggaggccuucaggaagaggaacugagcacaucccucaaaagaagcgucuauaucgagucucggauugggaccuccacauccuucgauucuggaaucgccggccugagcuccauuucucaaugcaccagcuccagccagcuggacgagacgucucaucgcugggcucagcccgacacagccccucuccccgugccggcgaauaucagauuuuccaucuggauuagcuucuuugaaaucuacaacgagcugcuuuaugaucugcucgaaccucccucucagcaacggaagcgccagacccugagacuuugugaggaccagaauggcaacccuuacguuaaagaucugaauuggauucacgugcaggacgccgaagaggcuuggaagcuccugaaagucgggcggaagaaccaauccuucgccagcacacaucugaaucagaacuccucucgcagccacuccaucuuuucuauuagaauccuccaucugcagggagagggcgauaucgugcccaaaauuagcgaacuuucccugugcgaccucgcugggagcgagcgguguaaggaucagaagucuggagaaagacugaaagaggccggcaacaucaauaccucccugcacacccuugggcgcugcauugcggcccuccggcaaaaccagcagaauagaagcaagcagaaccugguucccuuccgcgacucuaaacugacacggguguuccaaggauuuuucacgggcagaggccgcuccuguaugaucgucaaugugaacccuugcgcuagcaccuaugaugaaacacuccacgucgccaaguuuucugcuauugccagccagcuggugcaugccccgcccaugcagcuuggguucccuucccugcacagcuuuaucaaagagcacucucuccaaguuucccccagccuggagaagggagcuaaggcggacaccggccuggaugacgacaucgaaaaugaggccgauauuuccauguacgggaaagaagaacuucuccagguggucgaggcuaugaagacacugcugcucaaagaacggcaggagaagcugcagcuugaaaugcaucugagagacgagaucuguaacgaaaugguggagcaaaugcagcagcgcgagcaguggugcucugaacaccucgauacccaaaaagagcugcuggaagagauguacgaagagaaacuuaauauucucaaggagagccugacguccuucuaucaggaagagauccaggaacgggacgagaaaauugaggagcuggaggcccuccugcaggaagccagacaacagucuguugcucaucagcaaagcggauccgagcuugcccugcgccggucucagagacucgcggcuagcgccuccacacagcagcugcaagaagugaaggccaaacugcagcaguguaaggcugagcuuaacagcaccaccgaggaacuccacaaauaccagaagaugcuggagccucccccgucugccaagccuuuuacaaucgaugucgacaaaaagcuggaagagggccaaaagaauauucggcuccugcgcaccgaacuucagaagcugggggagucccuccagagcgcugagagagccugcugccauucuacaggcgcgggaaaacugcggcaggcccugacgaccugugaugacauccuuaucaagcaagaucagacacuggcugaacuccagaacaauauggugcuggugaaacucgaccugagaaagaaggccgcuugcauugccgagcaguaucacaccguucuuaaacugcaaggccaggucuccgcgaagaaacgccucgggacaaaccaggaaaaucaacagcccaaccagcagccucccggaaagaaaccuuuccugcggaaccugcuucccagaaccccgacgugucaaagcucuaccgauugcuccccuuacgcccgcauccugagaagccggcgcagcccccuccucaagagcggccccuuugggaagaaauauuga

SEQ ID NO: 71163 - RNA, 5463 nt, Artificial Sequence
  derived and/or modified sequence opt5 from KIF20B__Homo_sapiens__NP_001271188
auggagagcaacuucaaucaggaaggcgugcccagaccuuccuacgucuuuucugccgacccgaucgcucggcccagcgagauuaacuucgaugggaucaagcuggaccugucccacgaauuuucucugguugccccuaauacagaggcgaacagcuucgaauccaaagauuaucuucaagugugccugcgcauuagacccuuuacacagucugagaaggagcucgaaagcgagggaugugugcauauccuggacucccagacggucgugcuuaaagaaccucagugcauucugggccggcucagcgagaagucuuccgggcaaauggcucagaaauucagcuuuucuaagguuuucggacccgccaccacacagaaggaguuuuuccagggcuguaucaugcaaccugugaaagaucugcugaaggggcagucccgccucaucuuuaccuacggacugacaaauagcggcaaaaccuauacauuccagggcaccgaagagaacauugggauccuuccgagaacgcugaauguccucuuugacucucugcaggaacggcuuuacaccaagaugaaccugaaaccccaccgcuccagagaguaucuccggcugagcuccgaacaagagaaggaggaaauugccucuaagagcgcucugcuccgccagaucaaagaggugacaguucauaaugauuccgacgauacccuguacggaagccuuacaaacucucugaauauuuccgaguucgaggaaagcaucaaggacuaugagcaggccaaccucaauauggcuaacucuauuaaauucagcgugugggucuccuuuuucgagaucuacaaugaauacaucuaugaucuguuugugccugugucuagcaaguuccagaagagaaagaugcuucggcugucccaggacgucaaaggcuacagcuuuauuaaggaucuccaguggauccagguuucugacuccaaggaggccuaucgccugcugaaacucgggauuaagcaccaaagcguggcguucaccaaacugaacaacgccucuuccagaagccauuccaucuuuacggugaagauucuucagaucgaagacucugagaugagccgggucauccgcguguccgaacugucucucugcgaucuggcuggaagcgagagaacaaugaaaacccagaaugagggcgaacggcuuagagagacagggaacauuaauaccucccugcucacccugggaaaguguaucaacguucugaagaauagcgaaaaaucuaaguuccagcaacacgugcccuuucgcgaguccaaacucacacacuacuuccagagcuuuuucaacggcaagggcaaaauuugcaugaucgucaauauuucucaguguuaucuggccuacgacgagacgcuuaacgugcugaaguuuuccgcuaucgcccagaagguuugcgugccugauacccucaauagcucucaagaaaaacuguucgggcccgucaagagcucccaggacgugagccuggauucuaacuccaauagcaaaauccuuaacgucaagcgggcgacaauuuccugggaaaauucucucgaagaccugauggaggaugaagaccugguggaggagcucgaaaacgccgaggaaacccagaauguugagacaaaacugcuugaugaagaccuggauaagacccucgaggagaacaaggcuuucaucagccaugaagagaaaagaaagcugcuggaccuuauugaagaccucaaaaagaaacugaucaacgagaagaaagaaaagcugacgcucgaguuuaagauucgcgaggaagugacacaggaguucacccaauauugggcccagcgggaagcugauuuuaaagagacccugcuucaggagagagaaauccuggaggaaaaugccgagcgccggcucgccauuuucaaggaccuggucggaaaaugugauacaagagaagaggcugcgaaggacaucugcgccaccaaaguggagacagaagagacgcacaacuacguuggcuuugaagauaucauugacucccugcaagauaauguggcugacaucaagaagcaggccgagauugcccaucuuuacaucgcuucucucccggauccucaggaagccaccgcgugucuggagcugaaauucaaccagauuaaggcugagcucgccaaaacaaagggggaacugaucaaaaccaaggaggaacuuaagaaacgcgagaaugaaagcgacucccugauccaagagcucgagacaucuaacaagaaaauuaucacccagaaucagcggauuaaggaacugaucaacauuaucgaucagaaagaggacacgaucaaugaauuucaaaaccucaagagccacauggagaauaccuucaagugcaacgauaaagccgacacauccagccuuauuaucaauaacaagcucauuugcaaugagaccgucgaagugcccaaagacucuaaguccaaaaucuguagcgagagaaagcgcgugaacgaaaacgagcugcagcaggaugaaccucccgcuaaaaagggaucuauucacguuuccagcgccaucacagaggaccagaagaaaucugaggaaguccggcccaauaucgcugagauugaagauaucagagugcugcaagagaacaaugaaggccuccgggccuuucugcuuaccauugagaacgagcugaagaaugaaaaagaggaaaaggcggagcucaacaaacagaucgugcauuuccagcaagaacugucccugagcgagaagaagaaucuuacgcuguccaaagagguccagcagauucagagcaacuaugacaucgccauugcugaacuccacgugcaaaagucuaaaaaucaggagcaggaagagaagaucaugaaacugagcaacgagaucgaaacagccacccgcuccauuacaaauaacguuucucagaucaagcucaugcauaccaagauugaugagcugagaacccuugacagcgugucccaaaucucuaauauugaucugcucaaccugcgggaccugagcaauggguccgaagaggauaaccuuccuaacacacagcuggaccuccugggaaaugauuaccucgucucuaaacaggugaaggaauauagaauccaggagccgaaccgcgagaauagcuuucacuccagcaucgaagcuauuugggaggaaugcaaagagaucguuaaggccucuuccaaaaagagccaucaaauugaagaacuggagcagcagaucgaaaaacuucaggcggaggugaaaggcuacaaggacgaaaacaaucggcugaaagagaaggaacacaaaaaccaagaugaccuccugaaggagaaggagacgcugauucagcagcuuaaagaggaacugcaagaaaagaaugucacccucgacgugcagauccagcacguuguggagggcaaaagagcccugucugagcucacacagggggucaccuguuauaaggcuaaaaucaaggaacuggagacaauucuugaaacccaaaaaguggagugcucccauagcgccaagcuggaacaggauauccuggagaaggaguccauuauccucaaacuggaacgcaaccuuaaggaguuccaggaacaccuccaagacucugugaaaaauacgaaggaucugaacgucaaagagcugaagcucaaggaagagauuacacaacugaccaauaaccuucaggacaugaaacaucugcugcagcucaaggaggaagaggaagagaccaauagacaggaaacagagaaacugaaggaggaacuuagcgcuuccagcgcccggacccaaaaccugaaagccgaucuccagcgcaaggaggaagacuacgcugaucugaaggagaaacucacagacgcgaagaaacagaucaagcaaguucagaaagaggugucugugaugagagaugaagacaagcugcuucggauuaagaucaaugagcuggagaagaagaaaaaccaguguucccaggagcuggauaugaagcaacgcacgauccagcagcucaaagaacagcugaauaaccaaaaggucgaggaggccauucagcaguaugaaagagcuugcaaagaccuuaacgugaaggagaagaucauugaagacaugcggaugacccuggaggaacaggagcaaacacagguugagcaggaucaggugcucgaagccaaacuggaggaagucgagcgccucgccaccgaacuggagaaguggaaagagaaguguaaugaccuugaaaccaaaaacaaucaaagaagcaacaaggagcacgaaaauaacaccgaugugcugggaaagcugacgaaucuccaggacgagcugcaggagucugaacaaaaauacaacgcugaucggaagaaauggcuugaggaaaagaugaugcugaucacccaggccaaagaggcggaaaauauucgcaacaaggagaugaagaaauacgcugaggacagagaacgguuuuucaagcagcagaaugagauggaaauccucacagcccaacugaccgagaaagauagcgaccugcagaaguggagagaggaacgcgaucagcucguugccgcucuugagauccagcugaaagcccugauuuccucuaacgugcaaaaggacaaugaaaucgagcagcucaagcggauuaucagcgaaacauccaaaauugagacccagaucauggauaucaagcccaaaagaauuucuagcgcggacccugauaagcugcagacagaaccccuuuccaccagcuucgagaucucucgcaacaaaauugaggacggcuccgucgugcuggacagcugcgaaguuuccacggagaaugaucaaucuacacgguuuccuaagcccgaacucgagauccaguucaccccgcugcagccuaacaaaauggcugugaagcaccccggguguaccacaccugucaccgugaagauucccaaagccagaaagcgcaaaagcaacgagauggaagaggaccuggugaagugcgaaaauaaaaagaacgccacgccucggacaaaucucaaguuucccaucuccgaugacagaaacucuagcgucaaaaaggagcaaaaaguugcuauucgcccguccagcaagaaaaccuauucucuucggucccaggccagcaucaucggagugaaucuggcuacaaagaagaaagaaggcacccugcagaaguucggggauuuucuccagcauucuccuuccauucugcaaagcaaagccaagaaaaucauugagacaaugucuagcuccaaacuuucuaacguggaggcgagcaaggaaaaugucucccagcccaaaagagccaagcggaaacuguacaccagcgagaucuccucucccauugacaucagcggccaggugauccucauggaucagaagaugaaagaauccgaccaccaaauuaucaagcgcagacugcggacgaagaccgcuaaauga

SEQ ID NO: 71164 - RNA, 4914 nt, Artificial Sequence
  derived and/or modified sequence opt5 from KIF21A__Homo_sapiens__NP_001166934
augcugggcgcccccgacgagagcuccgugagagucgcuguucggauccgcccucagcucgccaaggaaaagauugaggggugccacaucuguaccucugugacaccgggagaaccccaaguguuccugggcaaggauaaagcguuuacguucgacuacgucuuugauauugacagccagcaggagcagaucuauauucaaugcaucgaaaaacuuaucgagggguguuucgagggauacaacgcuaccguguuugccuauggccagacaggggccggaaaaaccuacacaaugggcaccggcuucgauguuaauauuguggaagaggaacuggggaucauuuccagagcugucaagcaucucuuuaagucuaucgaggagaaaaagcacauugccaucaaaaacggacugccugcucccgacuucaaggugaaugcccaguuucuugaacuguauaacgaggaaguucucgaucuguucgacacaacccgggauauugacgcgaaaagcaagaaguccaauauccgcauccaugaggauucuacgggcgggauuuacaccgugggagucacaaccagaacagugaacaccgaaagcgagaugaugcagugccugaaacucggcgcccugucccggacgacagcuagcacccaaaugaaugugcagucuucccgcagccacgccaucuuuacaauucaugucugucagaccagaguuugcccucagaucgacgcugauaacgccaccgacaauaagauuaucucugaguccgcgcaaaugaacgaguucgaaacacuuacggccaaauuucacuucguggaccuggcugggagcgaacggcucaagcgcaccggagccacaggcgagagagcuaaagaaggcaucucuauuaauugugggcugcuugcccugggaaacgugaucuccgcccucggcgauaagagcaaacgggcuacccacguccccuaucgcgacuccaagcugacaagacugcuccaggauucucugggaggaaauagccagaccauuaugaucgcgugcguguccccuagcgaccgggauuucauggagacgcuuaacacacugaaguacgccaaucgcgcuagaaacauuaaaaacaagguuauggugaaucaagaccgggccucucagcagaucaacgcccucagauccgagaucacccgccugcagauggaacuuauggaguacaaaaccggcaagcggauuaucgaugaagagggggucgaaagcauuaaugacauguuucaugagaacgcuaugcugcaaacagagaauaacaaucucagagugcgcaucaaagccaugcaggaaaccguugaugcgcugcggucuagaauuacacagcuggugagcgaccaggcuaaccacguccucgcccgcgccggagagggcaaugaagagaucuccaacaugauucauucuuauaucaaggagaucgaagaucugcgggcuaaacuucuggagagcgaagccgugaaugagaaccucagaaagaaucugacgcgcgcuaccgcccgggcgccguacuucuccggcagcucuacauuuucccccaccauucuuagcucugacaaggaaacaaucgagauuaucgaccuggccaaaaaggaucucgagaaacugaagagaaaggaaaaacgcaagaaaaaguccgucgcugggaaagaggacaacaccgauacggaccaagaaaagaaggaggaaaaaggagugagcgagcgggagaauaacgaacuggagguugaagagucccaggaagugucugaucacgaggacgaggaagaggaagaggaggaagaggaagaugacauugauggcggggagagcuccgacgaaucugauagcgaguccgacgagaaggccaacuaucaggcugaucucgccaauaucaccugugaaaucgcgauuaaacagaagcugaucgacgagcuugaaaacagccagaaaagacugcaaacacucaagaaacaguacgaggaaaagcugaugaugcugcagcacaagauucgggacacccaacuugagcgcgaucagguccuccagaaucugggaucuguggaguccuauagcgaagagaaagccaagaaaguuagaucugaauacgagaagaaacugcaagcuaugaacaaggaacuccagcggcugcaggccgcucagaaggagcaugccagacuucugaaaaaucaaucccaguaugagaagcagcucaaaaagcugcagcaagacgugauggaaaugaaaaagacaaagguccgccugaugaaacagaugaaggaggaacaggagaaagcccggcuuaccgagagcagacgcaacagagaaaucgcucagcucaagaaagaucaacggaagcgcgaccaccagcugagacugcucgaggcgcagaagcggaaucaagaaguggugcugcgcagaaaaacggaggaaguuacagcccuucggcgccaggucagaccuaugucugauaagguggcuggcaaagugacccggaagcugagcuccagcgacgcccccgcccaggauacagggucuuccgcugccgcggucgagaccgacgcuagccgcaccggcgcccagcagaaaaugcggauuccuguggccagaguucaagcucuccccacaccggccacgaacggaaauagaaagaaauaccagcgcaagggccugaccgggcggguguucaucuccaagacagcgagaaugaaauggcagcugcuugagcgccgggucaccgauaucauuaugcaaaagaugacaaucucuaacauggaagcugacaugaauagacuccugaaacagcgcgaggaacugaccaagcggagagagaaacucagcaagcgccgggaaaagauugugaaagagaacggagagggcgauaagaauguugccaacaucaaugaagagauggaaucccugacggccaacauugacuacaucaacgauucuaucagcgacugccaggcuaauauuaugcagauggaggaagccaaagaggagggggaaacacuugacgugaccgcugucaucaacgccuguacccugacagaggcgagauaucuccuggaucauuuucuguccaugggaauuaauaagggccuucaagccgcucagaaagaagcccagaucaaggugcucgaggggcggcugaagcagaccgagauuacaucugcuacgcaaaaccagcuccuguuccacaugcugaaagaaaaggccgagcuuaauccugaacuggacgcccuccugggccaugcucugcaggagaacguugaagauagcaccgacgaggaugcgccccuuaauuccccuggaagcgagggcucuacacuguccagcgaccucaugaaacugugcggggaagugaagcccaaaaacaaggcccgcagacggaccacaacccaaauggagcuccuguacgcugauucuuccgaacuugccagcgacacgucuaccggagaugccucccugcccggcccucucacaccggucgcugaggggcaggaaaucggaaugaauaccgagacaagcggcaccuccgcccgcgagaaggaacugucucccccucccgggcugccuagcaaaauuggcagcaucuccagacagucuagccuuuccgagaagaaaauccccgaaccgucuccugugacacggagaaaggcguaugagaaagcugaaaagagcaaggccaaagagcagaagcacuccgacucuggaaccagcgaggccucccugucucccccuagcuccccucccagccgcccccggaacgaacucaauguguuuaacagacugacggucucucaaggcaauacauccguucagcaggauaaagggauuaucaacccguucccugcuagcaaggggauucgcgccuuuccccuccagugcauccacauugcggagggccauaccaaagcugugcuguguguggacuccaccgacgaucuucuguucacagggucuaaggaccggaccugcaaagucuggaaucucgugacgggacaagaaaucaugagccugggcgggcaccccaacaacguuguguccgucaaguacuguaauuauacaagccugguguuuaccguuucuacauccuacaucaaggugugggauauuagagacagcgccaaaugcauccgcacccuuacaucuagcggccaggucacccugggagaugccuguuccgcuucuacgagccggaccguggccauuccuuccggcgagaaccagaucaaucagauugcucucaacccgacagggaccuuccuguaugccgcgucuggaaaugccguuagaaugugggaccucaagcgcuuucaaagcacaggcaaacugaccgggcaucuuggacccgugaugugccugacggucgaucagaucuccagcggccaggaccugaucauuacaggcucuaaggaucacuacaucaaaauguucgacgugaccgagggggcucucggaacaguguccccuacccacaacuucgaacccccucauuacgauggcauugaggcccugaccauccaaggggacaaucuuuuuagcggauccagagauaacggcauuaagaagugggaccugacacagaaagaccuccugcagcagguccccaaugcucacaaggauuggguuugugcccucgggguggugccugaccaucccguccugcuuucuggaugccggggcggcauccugaaaguguggaacauggauacguucaugccgguuggggaaaugaagggacacgacagcccuauuaaugccaucugugugaacuccacccauaucuuuacagcugcggaugaccgcaccgucagaauuuggaaagcccggaaucugcaagauggccagaucucugacacaggggaucucggagaggacauugcuagcaacuga

SEQ ID NO: 71165 - RNA, 4914 nt, Artificial Sequence
  derived and/or modified sequence opt5 from KIF21B__Homo_sapiens__NP_001239029
auggccggccagggggacugcugugugaaggucgcuguuagaauccggccccaacugagcaaagagaagauugaaggaugccacaucuguaccuccgugacaccuggcgagccccaggugcuccuggggaaagauaaggccuucacguacgacuuugucuucgaucuugacaccuggcaggaacagauuuauucuacaugcgugagcaaacugaucgagggauguuuugaaggcuacaacgcgaccguucucgcuuaugggcaaacaggagccggcaagaccuacacaaugggcaccggguucgauauggccacguccgaggaggaacagggaauuaucccccgcgcuaucgcccaucuguuuggcgggauugcugagagaaagcggcgcgcccaggaacagggaguggcgggcccugaguucaaagucucugcccaauuucuugagcuguauaaugaagagauccucgaccuguucgauagcaccagagaccccgauacacggcaccgcagauccaacauuaagauccaugaagacgcuaaugggggaauuuacaccacaggcgugaccucucggcugauccacagccaggaggaacucauucagugccugaaacagggcgcccuuucccgcacgacagcuagcacccaaaugaacguucagucuuccagaagccaugccaucuuuacaauccaccugugucagaugcggaugugcacccaaccugaucucgugaaugaggcggucaccgggcugcccgacggaacaccuccgucuuccgaguaugaaacgcuuaccgccaaguuccacuuuguggaucuggcuggcagcgagcgccucaaaagaacaggggccaccggagaacgggcuaaggagggcauuucuaucaacugugggcugcuggcccucggaaaugugauuuccgcccugggcgaccagagcaagaaagucguucaugugcccuaccgcgacuccaaacuuacaagacugcuccaggauucucugggcgggaacagccagaccaucaugauugcuugcguguccccuagcgaccgggauuucauggaaacgcuuaauacacugaaauacgcgaacagagcccgcaauaucaagaacaaagucgugguuaaucaagacaagaccucucagcagaucuccgcucuccgggccgagauugccagacugcagauggagcugauggaauauaaagcuggaaagcgcgugaucggcgaggauggggccgaaggauacagcgaccucuuucgggagaacgcgaugcugcaaaaggaaaauggcgcucuuagacugcgcgucaaagccaugcaggaggccauugaugcuaucaacaaccgggugacccagcucaugucucaggaggccaaucugcuucuggcuaaggccggggacggcaacgaagcgauuggagcccucauccaaaauuauaucagagagauugaagaacugcgcacaaaacugcucgagagcgaagcuaugaacgagucccugcggagaucucuuagccgcgccuccgcucggagccccuacucucugggcgccuccccugcggcccccgcuuucgggggaagcccggccucuuccauggaagaugcuagcgagguuaucagacgggccaagcaggaccucgaacgccugaaaaagaaggaggugagacagcggagaaaauccccugagaaggaagccuucaaaaagcgcgcuaaacugcagcaagaaaauucugaagagaccgaugaaaacgaggcggaggaagaggaagaggaacgggacgagagcggcugugaggaagaggaagggagagaggacgaggaugaagacuccggaucugaggaaagccuugucgauuccgacagcgaucccgaggaaaaggaggugaauuuucaggccgaccucgcugaucugacaugcgagauugaaaucaagcagaaacugauugacgagcucgaaaacucucaacgcagacugcagacgcuuaagcaccaguaugaggaaaaacugauccuccugcagaauaagauucgggauacccaacuggagcgcgacagaguccuucagaaccucuccacaauggagugcuacaccgaagagaaagccaauaagaucaaggccgauuaugaaaaacggcugcgcgagaugaacagagaccugcagaagcuccaggcugcccaaaaagaacaugcgcggcugcuuaagaaucagagccgcuacgagagagagcugaaaaagcuccaggcugaaguggccgagaugaaaaaggccaagguugcucugaugaaacagaugcgggaggagcaacagcgcagacggcugguggagacaaagagaaaccgcgaaaucgcccagcuuaaaaaggagcaacggagacaggaguuccagauucgcgcgcucgagucucagaaacggcaacaggaaaugguccugagacgcaagacccaggagguguccgcucugcggagacucgccaagccuaugagcgagcgcguugccggccgggcugggcugaaaccgcccaugcuugauucuggcgccgaagugagcgcuuccacgaccagcucugaggccgaauccggagcgagaagcgucuccucuaucgugcggcaguggaaucgcaagauuaaccacuuucugggcgaccacccugccccgacagugaacgggaccagacccgcucggaaaaaguuccaaaagaagggagccagccaguccuuuucuaaggcugcccgccucaaauggcagagccuggagagacggaucauugacaucguuaugcagagaaugacaaucgucaaucuggaagccgauauggagcgccuuauuaagaaacgggaggaacucuuccugcugcaagaggcucucagacgcaagcgggaaagacugcaggcggaguccccugaagaggagaaaggccuucaggaacuggccgaggaaaucgaggugcucgcugccaacauugacuacaucaaugaugggauuaccgacugucaggccacgaucgugcaacuggaggaaacaaaggaggaacuggauucuaccgacacaagcgucgugaucuccagcugcucucuugcugaggcccgccugcuccuggauaacuuucucaaggcguccauugacaaaggacugcagguugcucagaaggaagcccaaauccggcuucuggagggcagacuccgccagaccgauauggccgggagcucucagaaucaucugcugcuugacgcucugagagagaaagccgaagcgcaccccgagcuccaggcucugauuuauaacgugcaacaggaaaauggcuacgccuccaccgaugaggaaaucagcgaguucucugagggauccuuuagccaguccuucacaaugaagggcagcacgucucaugacgauuuuaaauucaagagcgaaccuaaacucuccgcccagaugaaggcugucucugccgagugucuggggcccccgcuugacauuagcaccaagaacaucacaaaaucccuggcuucucucguggaaaucaaggaggacggaguuggcuuuagcgugcgggauccuuauuaccgcgacagagucucccggaccgugucucugcccacacgcgggagcaccuucccuagacaaucccgggccacggaaacaagcccccugaccagacgcaaaucuuaugaucggggacagccuauuagauccaccgacguuggcuucacacccccgagcucuccucccacccgcccccggaaugauagaaacguguuuucccggcuuacaagcaaucagucccaggggucugcgcuggacaagagcgaugacuccgauagcucucucuccgagguccugcgcggcaucauuagcccugugggaggcgccaaaggggcuagaacggccccgcuccaaugcgugucuauggcugagggacacaccaagcccauccugugucuugacgccacagaugaacugcuguucaccggcagcaaggaccgguccugcaaaauguggaaccucgucacagggcaggagauugccgcucugaagggacauccuaauaacguugugucuaucaaauacuguagccacuccggccuuguguuuucugucagcaccuccuauauuaaggugugggacauccgcgauagcgcgaaaugcaucagaacgcugaccucuuccggccagguuauuagcggggacgccugugcugccacauccacccgggccaucacaucugcucaaggagaacaccagauuaaucagaucgcccucagccccuccggcaccaugcuguacgcggcuucugggaacgccgugcgcauuugggagcucagcagauuccagccugucggaaagcugacaggccauaucgggcccgugaugugccuuaccguuacgcaaacagccucccagcacgaucugguggucaccggaagcaaggaccauuacgugaaaauguuugagcugggcgaauguguuaccggcacaaucgggccuacccacaacuucgagcccccgcacuaugauggaauugaaugccucgcuauccagggcgacauucuguuuucugggucccgggauaauggaaucaagaaaugggaccuugaucagcaagagcugauucagcagaucccuaacgcccauaaggacugggugugcgcgcucgccuucauccccggccgcccuaugcugcucagcgcuuguagagccggggucauuaaaguguggaauguggauaacuuuacgcccaucggagaaauuaagggccacgacucuccgaucaaugcuauuugcacaaacgccaagcauaucuucaccgcuuccagcgauugucgggucaaacuguggaauuacguuccuggccuuacacccugccugccuagacgcgugcuggccauuaaggggcgggcgaccacacuccccuga

SEQ ID NO: 71166 - RNA, 1794 nt, Artificial Sequence
  derived and/or modified sequence opt5 from KIF22__Homo_sapiens__NP_001243199
auggacagcugcucccuggagaucgccaacuggagaaaucaccaggaaacccucaaguaccaauucgaugcuuuuuauggcgagcggucuacacagcaggacauuuacgccgggagcgugcagcccauccugcgccaucuucuggaaggacaaaacgcguccguccucgcuuauggcccuacgggggccggaaaaacccacacaaugcugggcucuccggagcagcccgggguuauuccuagagcccuuauggaucugcuccagcugacccgggaagagggagcugagggccgccccugggcccugagcgugacaauguccuaccucgaaaucuaucaggagaaggugcuggaccuucuggauccugcuucuggcgaccucgucauuagagaagauugucgggggaauauccugauccccggacuuagccaaaaaccuauuuccagcuucgccgacuuugagcgccauuuccugccggcgucuagaaaccggaccgugggcgccacacgccucaaucagagauccagccggucucacgcuguucugcuggugaaggucgaucagcgcgagagacucgcccccuuucggcagcgcgaagggaaacuguaccuuaucgaccuggcuggauccgaggauaacagacggaccggcaauaaggggcucagacugaaggaaagcggagccauuaacacgucucuuuucgugcugggcaaaguuguggacgcgcucaaucaaggccugccucgcguccccuaucgggauuccaagcugaccagacuccugcaggacagccuugggggauccgcccauucuauccugauugcuaacaucgccccugagcgccgguuuuaccucgacacagugagcgcucugaauuucgccgccagauccaaagaagugauuaaccgccccuuuaccaaugagagccuucagccgcacgcucugggcccugucaagcucucucaaaaagagcugcuggggcccccugaagcgaagcgggccagaggacccgaggaagaggaaaucggcucccccgagccuauggcugccccggccagcgcuucucagaagcucagcccccugcagaaacuuuccucuauggauccugccaugcuggagcgccuccugagccuggaccggcuucucgcgucccaggggagccaaggagcuccccugcugucuacaccuaagagagaacgcaugguucucaugaaaaccguggaggaaaaggaucuggagaucgaacggcuuaaaacgaagcagaaagagcuggaggccaagaugcucgcccagaaggcugaagagaaagaaaaccacugccccacaaugcugagaccgcugucccaucggaccgugacaggcgccaagccucuuaaaaaggcugucgugaugccccuccagcugauucaagagcaggccgcgagcccuaaugccgagauccacauucugaaaaacaagggccgcaagagaaaacucgaaucucuggacgcucuugagcccgaagagaaggccgaagauuguugggagcugcagaucuccccugagcuccuggcucaugggcggcagaaaauucuggaccuucucaacgaaggaagcgccagagaucugcgcucccugcaacggaucggccccaagaaagcgcagcucaucguuggguggagagagcugcacggaccguucucucagguggaagaccuugagcgcgucgaaggcauuaccgggaagcagauggagagcuuucugaaggccaauauccucggccuggcugccggacaaagaugcggcgcuuccuga

SEQ ID NO: 71167 - RNA, 2571 nt, Artificial Sequence
  derived and/or modified sequence opt5 from KIF23__Homo_sapiens__NP_004847
augaaaagcgccagagcuaaaacaccccggaagccuaccgugaaaaagggcucccagacgaaccugaaagacccggucgggguuuacugccgcgugagaccccucggauucccugaucaagaguguugcaucgaagugauuaauaacaccacaguccagcugcacacccccgagggcuaucggcuuaaucgcaacggggacuacaaggaaacacaguauucuuuuaaacagguguucggaacccauacaacccaaaaggagcuguuugauguuguggccaauccucucgucaacgaccugauccacggcaagaaugggcuucuguucacguacggagugaccggcagcggcaaaacacauaccaugacagggucccccggagaaggcgggcuccugccuagaugucuggauaugauuuuuaacucuaucggcagcuuccaggcgaagcgguauguuuuuaaauccaaugaccgcaacucuauggauauucagugcgagguggacgcucuccuggagagacagaagcgggaagccaugccgaaucccaagaccagcuccagcaaacgccaagucgauccugaguucgccgacaugaucacggugcaggaauuuuguaaggcugaggagguggaugaagacucugucuacggaguuuucguguccuauaucgagauuuacaacaauuacaucuaugaucuucuggaagaggugcccuuugacccuauuaaacccaagccgccucagagcaaacuccugagagaagacaagaaccacaauauguacgucgccgggugcacagagguggagguuaaaucuaccgaagaggcuuucgaaguguuuuggcggggacagaagaagcgcagaaucgccaacacacaucuuaaccgggaguccagccgcucucacuccgucuucaauauuaaacuggugcaagcgccccucgaugccgacggcgauaacguucugcaggaaaaggagcagaucaccauuagccaacugucccucguggaccuggcuggcucugagagaaccaaucggacaagagccgaagggaaccgccuucgggaggcuggaaauaucaaccagagccugaugacgcucagaaccuguauggauguccugcgcgaaaaucagauguauggcacaaacaaaauggugccuuaccgggacuccaaacuuacccaccuguucaagaauuauuuugauggggagggaaaggucagaaugaucgugugcguuaaccccaaggccgaagacuacgaggagaaucuccaggugaugcgcuucgcggaagucacacaagagguggaaguugcccggcccguggauaaagcuauuuguggccugaccccugggagacgcuaucggaaccagccgagaggacccgucggcaaugagccucuggugacggacgugguucuccagagcuuucccccucugcccucuugcgagauccuugauauuaacgacgaacagacacugccgcgccucaucgaggcccuggaaaagcggcauaaucuuagacaaaugaugauugacgaguucaacaaacaguccaacgcuuuuaaggcccugcuccaggaguucgauaaugccguccugagcaaagaaaaccacaugcagggcaagcugaaugagaaggaaaagaugaucucugggcaaaagcucgagaucgaacggcuggagaaaaagaacaaaacccuugaauacaagauugagauccuggagaagaccacaaccauuuacgaagaggacaaacgcaaucuccagcaggaacuggagacacagaaccaaaagcugcagagacaguuuagcgauaaacggagacuugaagcucgccuccaaggaauggugacggagaccacaaugaagugggagaaagaaugugagcggagaguggcggccaagcagcuggaaaugcagaauaaacugugggucaaggacgagaagcucaaacagcugaaggcuaucgugaccgagccuaaaacagaaaagcccgagcgcccuuccagagaacgggaucgcgagaaaguuacccaaagaucugugagccccuccccugucccccuucuguuccagccggaccagaacgccccucccauucggcuccgccauagacggagccgcucugccggcgauagauggguggaccacaagcccgcuuccaauaugcagacggaaaccguuaugcaaccucacgugccgcaugccaucacagucagcguggcgaacgagaaggcucuggccaaaugcgagaaguauaugcugacccaccaggaacuugccucugauggggagaucgaaacaaaacucauuaagggagacaucuacaaaacccggggcgggggccaguccguucaguuuacggauauugagacacugaagcaagaaagccccaauggaucccgcaagagacggucuagcaccguggcuccugcccagcccgacggcgcugaguccgaguggacagaugucgaaaccagaugcucuguggccguggagaugcgcgcggggagccagcugggaccuggcuaucaacaucacgcccagcccaaacggaagaaaccuuga

SEQ ID NO: 71168 - RNA, 4107 nt, Artificial Sequence
  derived and/or modified sequence opt5 from KIF24__Homo_sapiens__NP_919289
auggccagcuggcuguacgagugccucugugaagcugagcuggcccaguauuacucccacuucaccgcgcuuggccugcaaaagaucgacgaacucgcuaaaauuacaaugaaggauuauucuaaacugggggugcaugacaugaacgauagaaagcggcuuuuucagcugaucaaaauuaucaagauuaugcaggaggaagacaaggccgucagcauccccgagcgccaccuccagacguccucucugagaaucaaaagccaagagcugcgguccggaccucgcagacagcucaauuucgauucuccggccgacaacaaggaucggaaugcuagcaacgacggcuuugaaaugugcucccugagcgauuucucugccaaugagcagaaauccaccuaccuuaagguucuggaacauaugcuccccgacgauagccaguaucacacaaaaaccgggauucugaacgcuacagccggagacucuuacgugcaaaccgagaucuccacaagccuuuuuagcccuaauuaucuguccgcgauucucggcgauugugacauccccauuauccagcgcauuagccauguguccggguacaacuacggaaucccucacucuugcaucagacagaauaccagcgagaagcagaaccccuggacggaaauggagaagauucgggucugugugcgcaaaagaccucugggcaugcgggaaguucgcagaggcgagaucaauauuaucaccguggaagacaaggagacacugcucguccacgagaaaaaggaagccguggaucugacccaauauauucuucagcauguuuucuacuuugacgagguguucggggaggcuugcacaaaccaggaugucuauaugaaaaccacgcacccgcugauccaacauaucuuuaauggaggcaacgccacauguuucgcuuacgggcagaccggagccggcaagacauauaccaugauugggacccacgaaaaucccggacucuacgcgcuggccgcuaaagacaucuuucggcagcuugaagugucccagccucgcaagcaccuguucguguggauuagcuuuuaugagaucuacugcggccaacucuacgaucugcugaacagacggaagagacucuucgcccgcgaggacucuaaacauaugguccagauuguuggccugcaggaacuucagguggauuccguggagcugcuccuggaagucauccuuaaggggagcaaagagcggucuacaggagcuacgggcgugaacgccgacagcuccagaucucacgccguuauccaaauucagaucaaggauagcgcuaaacgcaccuucgggcggauuuccuuuaucgaccuggcgggaagcgaaagagccgcugaugcccgcgacucugaccggcagacaaagauggagggcgccgagauuaaucagucccuccuggcucugaaggaauguaucagagcccucgaucaagagcauacccacacacccuuccgccagagcaaacugacccaggugcuuaaggacucuuuuauugggaacgcgaaaacgugcaugaucgcuaauaucuccccuagccaugucgccacagaacacacccugaacacccuccgguaugccgauagagugaaggagcugaaaaagggaauuaaguguugcacauccguuaccucucgcaaucggacaagcggcaacuccucucccaaaagaauccagagcuccccgggcgcucugagcgaggacaagugcucuccuaaaaaggugaaacuuggguuccaacagucccucacggucgccgcucccggaagcacccggggcaaggugcacccucugacaucucauccucccaauauucccuuuaccuccgccccgaaggucagcgggaaacgcggaggcucuagagggagccccucccaggaaugggugauccacgcgagcccuguuaagggcacagugcggucuggacaugucgccaaaaagaaacccgaggaauccgcuccucuguguagcgagaagaacagaaugggcaauaaaaccgugcucgggugggaaucccgcgccucuggacccggcgaggggcugguucggggaaagcucagcacgaagugcaaaaaggugcaaaccguccagccggugcagaaacagcugguguccagaguugagcucucuuucggcaacgcucaccaccgcgccgaauacagccaagauucccagagagggaccccugcgcggcccgccucugaggcuuggaccaauauuccuccccaucagaaggaacgcgaggaacaccugagauuuuaucaucagcaauuccagcagccuccccugcuucagcaaaaacucaaguaccagccgcugaagcggagccugcgccaguauagaccucccgagggccaacucacaaacgagacacccccucuguuucacuccuacagcgaaaaucaugacggagcccaggucgaggaacuugaugacucugauuucuccgaggacagcuuuucucacaucuccagccagcgggcuacgaaacagcgcaacacacuggaaaauucugaggauuccuucuuucuccaccaaaccuggggccaggggccggagaaacagguggccgaaagacagcaaagccuguucuccagcccccggacaggagacaagaaggaucugaccaaaucuuggguggacagccgcgacccuaucaaccauagacgggccgcucuugaucacuccuguucucccagcaagggcccugucgacugguccagagagaacucuaccagcuccgggcccucuccucgcgauagccucgcggaaaagcccuauugcucccagguggacuucauuuaccggcaggagagaggaggcgggagcucuuuugaucugcgcaaagacgccucccagagcgagguuucuggcgaaaaugagggaaaccugccguccccugaagaggauggcuucacaaucagccucucccauguggcuguccccgggucuccugaccaacgggauacggugaccacaccccugagagaaguuagcgccgacggaccgauucaggugaccuccacagucaagaauggccacgccgugccuggggaggauccccgcggacagcuuggcacccaugcugaguacgccagcgggcugaugucuccucucacgaugucccugcuggaaaaccccgacaaugagggcucucccccuucugaacagcuuguucaagauggagcgacacacagccucguggcugaguccaccggcgggccggucgugucucacaccgugcccagcggagaccaggaagccgcccugccugucuccucugcuacacggcaucuguggcucagcuccucucccccugacaacaaacccggcggggaucugccugcccuuagcccgucccccaucagacagcacccugcggacaagcugcccagccgcgaggcugaucucggagaggccugucaaucccgggaaaccguucuguuuucucaugagcacaugggcagcgaacaguaugacgccgaugcugaggaaacaggccuggacggguccuggggauucccuggcaaacccuuuacgaccauucacaugggggugccgcauucuggaccuacacuuacccccagaacaggcagcuccgauguggccgaccagcugugggcucaggagcggaagcaccccacccgccucggguggcaagaguucggacugagcacggauccuaucaagcuccccugcaauucugaaaacgucaccuggcugaaaccuagaccgaucucccggugucuugcccgccccagcucuccucuggugcccuccugcagcccuaagacagcgggcacccucagacagcccacacuggagcaggcccagcaaguugugauucgggcucaucaggaacagcuggacgagauggccgagcuuggcuuuaaagaagagacccugaugucucagcucgcuagcaaugauuucgaagacuuugucacacaacuggacgagaucauggugcucaaguccaaauguauucagucucugagaagccagcuucaacuguaccuuaccugccacgggccgacggccgccccugaaggaacaguucccuccuga

SEQ ID NO: 71169 - RNA, 999 nt, Artificial Sequence
  derived and/or modified sequence opt5 from KIF25__Homo_sapiens__NP_005346
augaccuggacaagcggccagcugcaaagagagaagcaggcccggcccggguccggagcugugcucgccuucccugacgauaaagaccugcgcgucuacggcccggcggaaucucagagcgcuguuuuuggggaugugugcccccuucugacgucccuccuggacggauauaacgugugugucauggccuacggccagaccgggucuggaaagagcuauacaaugcuuggcagacacuccgaugacggcccugugcugccccucgauccucaaucugaccuggggaucauuccccggguugccgaggaacuguuccgccucauccuggagaauaccagcagauccccuaaaguggaagucagcauuguggagguuuacaacaaugauaucuuugaccuucuggcuaaggauucuauugccgcuguguccggagucaaacgggagguggugacagccaaggacggccgcaccgaagucgcgcuccuggccagcgaggcuguugggucugccuccaaacuuauggaacuggugcauggaggccuccagcugagagcuaagcacccgacacuggugcaugccgauagcucucggucccaccucaucaucaccgucacgcugaccacagcgagcugcuccgacucuaccgccgaccaggcuuguagcgccacacuuccccgcgagcagaccgaggcugggagagccggacggucccgcagagccagccaaggcgcucuggcgccucagcucgugcccggcaacccugccgggcaugcugaacagguucaggcccggcugcaacuuguggauucugccggauccgagugcgucggcggggacgcuaagcugcucgugauucuguguaucagccccucucagcgccaccuggcccagacgcuccaaggacugggcuucgggauuagagcgcggcagguucagagaggaccggcucgcaaaaagccucccagcucccagacagaaggcaaacggagaccugauuga

SEQ ID NO: 71170 - RNA, 5649 nt, Artificial Sequence
  derived and/or modified sequence opt5 from KIF26A__Homo_sapiens__NP_056471
auggugggcagaggggucccccugugcgccgcucaaccugccguugcggagggaggcccggcucgggaacccccuccccuccuggaggugucuccuagaaagagacuucccgccgggccugaccaagauccgugcggaucccggcccgccccugaaggcgcuggggccggacccgagcagggccacucugcuggcgggggaggcuggugccgccacugucacaccaaacugguggaacucaagagacaggccuggaaacuggucuccgggccuggaaccacgcuucgggaccccugccuguccgcccuccugcuggauaagcucccggccccuggcgcucugcccgccugucgcccugaggcugagagacggugcgacgugugugccacccaucuucagcaacugacacgcgaagccaugcaccuccugcaggcccccgcuucucaugaggaucuugacgcgccgcacgggggaccuagccuggcuccgcccuccaccacaaccucuagcagagauacaccuggccccgccggcccugccgggcggcagcccggacgcgcuggcccggacagaaccaaagggcucgcgugguccccuggacccagcguucaggugucugucgccccugcuggccucggcggggcccuguccacggugaccauccaagcccagcagugccucgaagggauguggagcguuucucgggugaacuccuuccugcccccugcuugucuugccgaggcggcugucgccgccguggcuguggccgauacaguccgcgaguguccucccguugcuggccccgacgggcugagcaaggccuggggaagaggcgggguguguaccucugcgcucgugacacccacccccggauccgucggcgggagcacgggcccuuccgccgcugccagcuuuuucauucgggcuaugcagaagcugagccuugccuccaaaagaaagaaaccgcaucccccucccccucccgcgacacgcggaaccagcacauacccuaccgauuuuucuggcgugcugcaacucuggcccccgccugcgcccccuugccugcugcgggcugccuccaagaccaaagacaaucccgggagcaucggaaagguuaaggugaugcucagaauuuggccggcucagggcgcccagcgcucugccgaagcuaugagcuuccugaaagucgauccucggaagaaacaagugauccuuuaugaccccgcggccgggccucccggauccgcuggccccagacgcgccgccacagcugccguuccuaagauguuugcguucgacgcuguguuuccgcaggauucugagcaggccgaagucugcagcgggacgguggccgacguccugcaguccgugguuagcggcgcugauggauguauuuucucuuuuggccauaugucccucgggaaaagcuacaccaugaucggaaaggacucuagcccccaaagccugggcaucgugccuugcgccauuuccuggcuuuuccggcugaucgaggaaagacgcgagcggacagggaccagauuuucuguccgcgugagcgcgguugagguguguggacgggaucagucccucagagaccugcuggcugaagucgcccccggcucucuccaggauacacagagcccugggguguaucugcgggaggaccccgugugcggcgcccaacuucagaaccaguccgaacugcgcgcuccuaccgccgagaaagcugccuucuaccucgaugcggcccuggcugccagaagcacgucucgggcuggauguggcgaagacgccagacgcuccagccacaugcuguuuacacuucauguuuaucaguaccggauggagaagugcgggagaggaggcaugucugggggacgcuccagacuccaccugauugaucugggcagcugugaggccgcugcggggcgggccggcgaagcugccggaggcccgcucugccugucucuuagcgcccugggguccgucauccucgcucuggugaauggagccaagcacgugcccuaucgcgaccauagacugaccaugcuucuccgggagagccuggcgaccgcuggcugucgcacaaccaugauugcccacgucucugacgccccugcucaacaugccgaaacacuguccacggugcagcucgcggcuagaauccaccggcugcgccgcaaaaaggccaaauacgccagcuccucuagcgggggagaguccucuugcgaagagggccgggcucgcagacccccucaucuucggcccuuccacccgagaaccguugcccuggauccugaccgcacaccgcccugucucccuggcgaucccgacuacagcuccucuagcgagcaguccugcgauaccgugauuuaugucgggccuggaggcgcugcccugagcgaccgggaacugacagauaacgaggggccgcccgacuucgugccuaucauccccgcgcuuucuagacaccgcccuuccaagggaccccgggaugccgaccauuuuagaugcagcaccuucgcugaacuccaggagcgccuggaguguauggauggcaaugaagggccgucuggaggcccuggcgggacggacggagcccaggcuucccccgcccggggcgggagaaaaccuuccccucccgaggccgcuucuccccgcaaggcgguuggaaccccgauggccgcuuccacaccucggggcagcuccgggcccgauacccaccagggaacacccgaaccuugcaaggccauuguguggggcgaccagagagaggacagcucugccuggccggaacugcucguccccgagaaagcugccgugagcggcgggcggcgcccucugcccuccccugcgcccccuccgccccaacuucuggaggcuuguagagccccugaggaacccggaggcgggggaaccgauggcguugcccggacgccucccguggggaugucuggacaggucgcuggcagcccgaugcucccuggcgccacaugcccccgccuggcggccggguccagaugucccgaacggggacugcuuaccacaaccgugacccuccagagaccuguggagcugaacggcgaagacgagcuggucuuuacaguuguggaggaacucucucugggggcucuugccggagcuggccgccccacgagccuggccuccuucgauucugacugcagccuccgggcucuggccuccgggagcagaccugugucuaucauuuccagcaucaaugaugaguuugacgcguacaccucucaggccccggaaggaggcccccuggagggcgcugccugggcuggguccagccauggauccucuauuagcuccuggcuuagcgaagucucuguguguacagccgauucccgcgacccuacaccccaaccucgguucagccccgauucucuggccggccucgaccccgggggaccucccgcucuggauggcagccucggggacggauccucuggcuuucugggcccugauagacccgacagcccugggcccacauggggaccgugcccuggcgagguugcggccguggcucccucccgccccgggcgggagccucaggccggaccgucuagaugggccagcgcugcccagaccauccacuccagccuuccccgcaagccuagaacggcgucugccacaacccgggucggcugugcucgccuggggcagagcccucccggaagaggcggccucuucgaagaccccuggcugcugcgggugggggagugcgauacccaagccgcuagcgccggacgcgcgccuucccccacacuuggcucuccgagacugccugaagcccagguuaugcucgcuugugcccagcggguggucgacgggugcgagguggcugccagagcugcccgccggcccgaggcgguugccagaaucccuccccugcgccggggagcuaccacacucggcgugacgaccccggccgucagcuggggagaugcuccuacagaagugguggccugcuccggcucucugaaagccagccccaccuccaagaaaggacuugcgcccaaggcuggcuuucugccuagacccagcggggccgcuccuccggcgcccccuacacggaagucuucccucgagcagcgcagcucucccgccuccgcuccuccccacgccgucaacccugcgagaguuggagccgcugccgugcugcggggcgaagaggaaccgcgccccagcucuagagcugaccauagcgugccucgggccaccuccucucugaaagcgcgcgccagcaaggucgaggcugcccacagacuugcugggcaugccucccuggagcgguaugaaggacucgcucacagcuccucuaaaggccgcgaggcccccgggagaccuccccgggcggugccgaagcugggcguuccucccagcucccccacgcauggaccugcccccgcuuguagaucuggcgccgcuaaagccgugggggccccuaagccgcccgucggaggcgggaagggacgcggccucguggccgggggcagccgggcucugggaccuuccguuaaacuuucuaccgccagcgugacaggcagaucccccgggggaccugucgccggcccccgcgcugccccgcgggcugggccuagcgugggagccaaggcgggcagaggcaccgucauggggacaaaacaagcccugcgcgcugcccacucucgggugcacgaacuguccgcuagcggagcccccggcagagggggaucuuccuggggcagcgcggauucugacuccgggcaugauagcggaguuaaugugggcgaggaacgcccucccaccggcccggcccucccuucccccuacagcaaggucacagcuccccggagaccucagcgcuauucuagcgggcacggauccgacaacucuagcgugcuguccggcgagcuucccccugccauggggcggaccgcucuguuccaucacucuggaggcagcuccggguacgagucucucagacgcgauagcgaagccacgggauccgcuagcucugccccggacuccaugagcgagucuggcgcggccucccccggcgcuagaacacggagccugaaauccccuaagaaacgcgccaccgggcuccagagacggagacugauucccgccccucuucccgauaccacagcucugggacggaagccuucucugccgggccaauggguugaccugcccccuccccuggccgggagccuuaaggaaccuuuugagaucaaaguguaugaaauugacgaugucgagcgccugcagagaccccggccgaccccucgcgaggcgcccacgcagggacucgcuugcguguccacaagacugcggcucgccgaacgcagacagcaacggcugcgcgaggugcaggccaagcauaaacaccuuugugaggaacuggcugagacccagggcagacugaugcucgaacccgggcgguggcuggagcaguucgaaguugacccugagcuugaacccgagagcgccgaguaccuggcugcccucgaacgcgcgacagccgcucuggagcaaugcgucaaucucuguaaggcccacgugaugauggugaccugcuuugauaucucugucgcugccuccgcggccauuccuggaccgcaggaaguggacguuuga

SEQ ID NO: 71171 - RNA, 6327 nt, Artificial Sequence
  derived and/or modified sequence opt5 from KIF26B__Homo_sapiens__NP_060482
augaacagcguggccggcaauaaggagagacuggcuguguccacccgggggaaaaaguacggaguuaacgaagugugcucucccacaaaaccugccgcgccguucagccccgaguccugguaucgcaaggcuuacgaagagucuagagccggcagccggccuacgcccgaaggggccggauccgcucucggcucuagcgggaccccuucccccggaagcggcaccucuuccccuagcucuuuuaccggcuccccggggcccgccagcccuggaaucggcaccucuucccccgggagccugggaggcuccccuggguucggaaccggcucucccggcagcggguccggaggcgggagcucuccgggauccgaccgcggcguguggugugagaauugcaacgcuagacuuguugagcugaaacggcaggcccuccgccugcuucugccugggcccuuuccuggaaaggaucccgccuucagcgccgugauucacgacaagcuccaaguucccaauacaaucagaaaggcuuggaacgaucgggacaaucgcugugauauuugcgccacccaucugaaccagcugaagcaggaagcuauccagauggugcucacgcuggagcaagccgcgggcucugaacacuaugacgccagcccuuguuccccgcccccucuuucuaauauucccacccuggugggcagcagacaugucgggggacuccagcagccucgggauugggcuuuuguucccgccccgugcgcuacauccaacuacaccggcuucgccaauaaacacgggagcaagccuucuucccugggagugagcaacggcgccgagaaaaagucugggucccccacacaucaggcuaaggucagccuucaaauggcgaccuccccuucuaauggcaacauccugaauagcguggccauccaggcucaccaguaucucgacggaacguggucccugucucgcacaaacggcgugacccuguaccccuaucagauuagccaacucaugacagaguccagcagagaagggcugaccgaggccguccuuaaccgguacaaugccgauaaaccuucugcuuguuccguucccgccagccagggaucuugcguggcguccgaaaccagcacaggcacgucuguggcugccagcuuuuucgcccgcgcugcccagaagcugaaccucuccagcaaaaagaaaaagcacagaccgucuaccuccagcgcugccgagccuccccuguuugcgacauccuucucugggauccuucaaaccucucccccuccggcgcccccuugucugcuccgggcugucaauaaagugaaggacacacccggacugggcaagguuaaagugaugcugagaauuugcuccacccucgcccgcgauacguccgaaagcuccucuuuucugaaggucgacccucggaaaaagcagaucacacuuuacgauccccugaccugugggggccagaacgcuuuccagaaaagaggaaaucaagugccucccaagauguuugccuucgacgcgguuuucccgcaggacgccagccaggcugaggugugcgccggcaccgucgcugaggugauucaguccgucgugaacggggccgauggaugcgucuuuuguuucggccaugccaagcucgggaaaagcuauacaaugaucggaaaggacgauucuaugcaaaaucugggcauuaucccuugcgcuaucuccuggcuuuuuaaacugauuaacgaacgcaaggagaaaaccggggcgcgguucagcgugagagucucugccguggaaguuuggggcaaggaggaaaaucuccgcgaccugcuguccgagguggcuacaggaagccuccaggauggccagucucccggggucuaccugugugaggacccuaucugcggaacgcagcuucaaaaccaguccgaacugcgggcccccaccgccgagaaggcugccuuuuuccucgaugcggcuauugccagcagacgcucccaccagcaggacugugaugaagacgaucaucggaauagccacguguuuuucacacugcacaucuaucaauacagaauggagaaaucuggcaaagggggaaugagcggcgggcgcucccggcugcaucuuauugaccucggcucuugcgugaaagcccugagcaagaacagagaaggaggcuccgggcugugucucucucugagcgcucuuggaaauguuauccuggcccucgucaacggcuccaaacacaucccguauaaggagucuaagcuggcgaugcugcuucgggagagccucgggaauaugaacugccgcaccacaaugauugcucauaucuccgccgccgugggaagcuacgcugaaacccugucuacgauucagaucgccuccagagugcugcggaugaaaaagaaaaagaccaaauauacaagcucuagcagcggcggcgaguccucuugugaagaggggagaaugcgccggccuacccagcucagacccuuucacacacgcgcuaccgucgacccugauuuccccauugcccaucugagcuccgaccccgauuacuccucuagcagcgagcaaucuugcgacacggugaucuacaucggaccuaacggcacagcgcuuagcgauaaggaacugaccgacaaugaggggccgcccgauuuuguuccuauugugcccgcccuccagaaaacaagaggagacucccggccugcugaagccggcgaggcugccgccgggaagucugaacgcgauugucugaagugcaacaccuucgcugagcugcaggagagacuugacugcaucgauggaagcgaggaacccuccucuuuuccuuucgaggaacucccggcgcaguucggccccgaacaagccagccggggcccucgccugucccaggcugccggggccagcccccugucugaguccgacaaagaggauaauggaagcgaaggccagcucaccaacagagaggggccugaacugcccgcuuccaagaugcagcggucucacagcccggucccugccgcggcucccgcccacucccccucuccugccagcccccgcuccgugccuggauccucuagccaacauagcgcuucuccgcuuguucagucccccagccugcagucuagcagagagucccucaauucuuguggcuuuguggaagggaaaccucggcccaugggaagcccucgccugggcauugccucccugagcaagacauccgaguauaaacccccgucuagcccuucccagagaugcaaggucuacacgcaaaagggcgugcuucccucuccugcgccccucccucccagcuccaaagacucugggguugcuagccgggagucccugcugcagccggaagugagaaccccucccgucggaaugagcccccaggugcucaagaaaucuauguccgccggcagcgagggguucccugaaacaccgguggacgaugagcaacaggccgcuacccccucugaguccaagaaagaaauccugagcacaaccauggucacgguucagcagccucuugagcugaacggagaagacgagcucguguuuacacugguggaggaacugaccauuucuggcguccuugauuccgggcgccccaccagcaucauuuccuucaauagcgacuguucugcccgggcucuggccagcggauccagaccugugucuaucaucagcuccauuucugaggaucucgaaugcuauagcuccacagcgcccguuucugaggugagcaucacccaauuucugccucucccgaagaugucccuggacgaaaaggcccaggaugcuggcagccgccggucuuccauuagcucuuggcuuuccgagaugagcgccggcuccgaaggggagcagucuugucacagcuucaucgcucagacaugcuuuggacauggcgaggccauggccgaacccgucgcuuccgaguucgugagcucucugcaaaacacggcgguuguguguagagaaaaaccuaaggccucccccgacaaucuccugauucugagcgagaugggggaugacucuuuuaacaaagcugccccuaucaagggaugcaaaaucagcaccgucuccaaggccauggugacaauuucuaauaccgcuaaccuuagcuccugugaaggcuacauccccaugaagacaaauauuaccguuuauccgugcaucgccaugucuccucgcaacauucaggagcccgaggcgcccacggcuaccccuaaagccgggcccacacuggcccagagccgggaauccaaggagaauagcgcuaaaaaggaaaugaaauucgaggauccuuggcucaagagagaggaagaggugaaaaaggaaaccgcccacccgaacgaggaaggaaugaugcgcugugagacagcgaccggccccucuaacgccgagacacgggcugaacaggagcaagacggcaagccuucccccggggauagacugagcuccucuagcggagaagucuccgccucuccugugaccgacaauuuucggcgcguggucgacggcugcgagauggcucuccccgggcuggccacgcagagcccgguucacccuaacaaauccgucaaguccucuagccuucccagagcuuuccagaaagccagccggcaggaggaaccugauucucuguccuacuauugcgcggccgagacaaauggagugggcgcugccagcgggacacccccuucuaaggcuacccucgaaggaaaagucgccucccccaagcauugugugcuggcccgcccgaagggcacaccuccccugcccccuguuagaaaaagcucucuugaccaaaagaaccgggcuagcccgcagcacuccgcgagcggcuccgggaccucuagcccccugaaucagccugccgcuuuucccgccggacucccugaugagcccuccggcaaaacgaaggacgccucuagcuccucuaaacuguucagcgcuaagcucgaacaacuggccuccagaagcaacucucuugggcgcgcgacagugucccauuacgagugccugagccuggaacgggccgagucucucuccagcgucucuuccagacugcacgcuggaaaggauggcaccaugccucgcgccgggcggagccuuggaagaucugcuggcacaagcccgcccagcagcggcgccuccccuaaagcggggcagucuaagaucagcgccgugucccgccugcuccuggcuucuccccgggccagaggaccuagcgcuuccaccacaaaaacccucucuuucagcacgaagucccugccccaggccguuggccagggguccucuuccccgccuggaggcaaacauacccccuggagcacacaaucucuuucccgcaauagaagcuccgggcuggcuucuaagcugccccuccgggccgugagcggccgcaucuccgagcugcuucagggaggcgcgggggccagaggacugcagcuccgggcuggcccugaagccgaggcucgcgggggagcccuggccgaagacgagcccgcggcugcccaccuccugccuucuccguacagcaagauuacacccccuagacggccccacagauguuccagcggccaugggucugauaacuccagcguccuuucuggcgagcugccucccgcuaugggaaaaacagcccuguuuuaucacagcggcggguccucuggauacgaaagcgugaugcgcgacuccgaggccaccggcagcgcuucuuccgcccaggauagcacguccgaaaauucuagcuccgucgggggacggugcagaucucucaagacaccuaaaaagcgcagcaacccgggcucccaacggagacggcugauccccgcgcuuucucuggacaccagcuccccugugcgcaaacccccuaauagcacagggguuagauggguggauggcccccuccggucuuccccgcgcggacugggcgagccuuucgaaauuaaggucuaugagaucgacgacguggagagacuccagcggcgcagagggggagccagcaaggaagcuauguguuuuaacgccaaacugaagauucuugagcaucggcagcagcgcaucgcugaaguuagagccaaauacgaguggcugaugaaggaacuggaggcgaccaaacaauaucucaugcuggaucccaauaaguggcuuucugaguucgaccuggaacaggugugggagcucgauucccuggaauaccuggaggcccucgaaugcgucaccgagcggcuugagagcagagugaacuuuuguaaagcucaccugaugaugaucacaugcuucgacauuacgucucgccggagauga

SEQ ID NO: 71172 - RNA, 2235 nt, Artificial Sequence
  derived and/or modified sequence opt5 from KIF2A__Homo_sapiens__NP_001091981
auggccaccgcuaacuucggcaagauccagauugggaucuacguggagauuaaaagaagcgacggacggauccaccaagccauggucacaucccugaaugaagauaacgagucuguuacgguggaauggauugagaauggcgacaccaaggggaaagaaaucgaucucgagagcaucuuuucccugaaccccgaccuugugccugaugaggaaauugagccgucucccgaaacaccucccccucccgcgagcuccgcuaaggucaauaaaaucgugaagaaccgcagaaccguugccucuauuaagaaugacccuccgagccgggauaaccgcguggucggauccgccagagcucggcccagccaguucccugagcagucuuccagcgcccagcaaaauggcucuguguccgacaucagccccguucaggcugccaaaaaggaguuugggccucccucucgcagaaaauccaacugcgugaaggaagucgagaaacugcaggaaaagcgggagaagcgcagacuccagcaacaggaacugcgggagaaacgcgcgcaggauguggacgccacaaauccgaacuaugagauuauguguaugaucagagauuuccggggaagccuugacuaccgcccucugaccacagcugaucccauugacgaacauagaaucugcguguguguccggaagagaccucucaauaaaaaggagacccagaugaaagaccuggauguuaucacgauucccuccaaggacguggugaugguccacgaacccaaacaaaagguggaucugacccgcuaucucgagaaccagacauuucgguucgacuacgccuuugaugacucugcuccuaaugaaaugguuuauagauucaccgcccgcccgcugguggagacaaucuuugagcggggcauggcgaccugcuucgccuacggccagacggggagcggaaagacacauaccaugggcggggauuuuuccgggaaaaaccaagacuguagcaagggcauuuaugcucuugccgcuagagaugucuuccugaugcucaaaaagcccaacuacaaaaagcuggaacuucagguguacgccacauuuuucgagaucuauucugggaagguuuucgaccugcucaaucgcaaaaccaagcugcgggugcuggaagauggaaaacagcagguccaaguggucggccuccaggagagagaagugaagugcguugaggacgugcugaaacuuauugacaucggcaacuccugucgcaccagcgggcagacaucugccaaugcucacagcucccggucucaugcggucuuucagaucauucugagacgcaagggaaagcuccacggcaaauucagccugaucgaucuugccgggaacgagcggggagcugacacguccagcgccgauagacaaacccggcuggaaggcgccgagauuaauaagucucuccuggcucugaaagaaugcauccgcgcccucgggagaaacaagccucacacacccuuucgggcguccaaacugacccaggugcuuagagacagcuucauuggagaaaauucucgcacauguaugaucgcuaccaucuccccuggcauggccagcugcgagaacacgcugaauacacuccgguacgccaacagaguuaaggaauuuggcauuucccccucugauaucccguucagccagggguccggaucucgcccugaccugagccccuccuaugaguacgaugacuuuagcccuucugugaccagagucaaggaacuuaccguggaucccacagcugccggcgacgugcggccuauuaugcaucaucccccgaaucagaucgaugaccuggagacccaauggggaguuggauccagcccucagcgcgaugaccucaaacugcugugugaacagaacgaggaggaagucucuccccaacucuucacauuucacgaggcugugucccagaugguggaaauggaggaacaggucguggaggaccacagagccguuuuccaggagagcauucgguggcuggaagaugagaaggcgcuucuggaaaugacggaggaaguggacuaugaugucgacucuuacgccacccaacucgaggcuauccuggagcagaaaauugauauccugacagaacuucgcgacaaggugaaauccuuuagagccgcucuccaggaggaggagcaggccagcaagcaaaucaaucccaaacggccucgcgcgcuguga

SEQ ID NO: 71173 - RNA, 2022 nt, Artificial Sequence
  derived and/or modified sequence opt5 from KIF2B__Homo_sapiens__NP_115948
auggccagccaguucugccugcccgaguccccuugucucucuccgcugaagccccuuaaaccucacuuuggcgacauccaagaagggauuuacguggcuauccagagaagcgauaagcggauucaucuggccgucguuaccgagaucaaccgcgaaaauuauugggugacaguggagugggucgaaaaagcggugaagaaaggaaagaagauugaccucgagacgauccugcuucugaaccccgcucucgauuccgccgagcacccuaugcccccuccgccccugucuccucuggcccucgcucccagcuccgccaucagagaccagcggaccgcuacaaaauggguugccaugauuccucagaagaaucaaaccgcgucuggcgauagccuggacgugcgcguccccuccaaaccgugccuuaugaagcagaaaaagagcccuugucugugggaaauccagaagcuccaggagcaaagagaaaaacggcgcagacugcagcaggagauucgggcccgcagagcucuugaugugaacacacggaaucccaacuacgagaucaugcauaugauugaagaguaucgcagacaccuggacucuuccaagaucagcguucucgaaccuccccaggagcaucggauuugcguguguguccgcaaaagaccccugaaucaacgggaaaccacacugaaggaucucgacaucaucaccgugccuucugauaacguggucaugguucacgaguccaaacagaagguggaccugacgagauaccuucagaaucaaaccuucugcuuugaucacgccuucgacgacaaagcuagcaacgagcugguguaucaguuuacagcccagccgcucgucgaaucuauuuuccgcaaggggauggcgaccuguuuugccuacggacagacaggcuccgggaagaccuauacgaugggaggcgauuucagcggcacagcucaagacugcuccaaagggaucuacgcccugguggcucaggauguuuuucuucugcuccggaauagcaccuacgagaagcuggaccugaaaguguauggaacauucuuugaaauuuacggcgggaaggucuaugaucuccugaacuggaaaaagaaacuucaggugcuggaggacggaaaucagcaaauccagguugugggccuccaggaaaaggaggucuguugcguggaggaaguccugaaccuuguggagauugggaauagcuguagaaccucccgccagacccccguuaacgcccauagcucucggucccacgccguguuccaaaucauccucaagagcggaagaauuaugcauggcaaauuuucucuggucgaucuggcuggcaacgaacgcggggcggacacaacgaaggccagccggaaaagacagcuggagggagcugaaaucaauaagucccuccuggcccuuaaggagugcauucuggcccucggccagaacaaaccucacacccccuuccgcgcuucuaagcugacacuggugcuucgggauagcuucaucgggcaaaauuccucuaccugcaugauugccacaaucucuccuggaaugaccuccugugagaacacgcucaauacacugagauacgcgaaccgcguuaaaaagcugaauguggacguccggcccuaucacagaggccauuacccgaucgggcacgaagcuccucggaugcucaaaagccauauuggaaacucugagaugucccugcagcgcgaugaauuuaucaagauucccuaugugcagagcgaggagcagaaggaaaucgaggaaguggagacccuuccuacccugcucggcaaagacacaaccauuuccggcaaggggucuagccaauggcuggaaaauauccaggagagagccggaggcguucaccaugacauugauuucugcaucgcccggucccugucuauccuugagcagaaaauugacgcucucacagaaauccagaagaaacugaagcugcuccuggccgaucuucacgucaaaagcaagguggaguga

SEQ ID NO: 71174 - RNA, 2055 nt, Artificial Sequence
  derived and/or modified sequence opt5 from KIF2C__Homo_sapiens__NP_001284584
auggccauggacagcucccugcaggcuagacucuuccccggccuggccaucaagauucaacggucuaacgggcuuauccacagcgcgaaugugcgcaccgucaaccuggagaaauccugcguuucuguggaaugggcugagggaggcgccacaaaggggaaagaaauugauuuugacgauguggccgcuaucaauccugagcuccugcagcuucugccgcuccaucccaaggacaaccugccucugcaggaaaaugucacgauucagaaacaaaagagacggagcgugaacuccaagauccccgccccuaaagagucucuccgcagcagauccacccggaugagcacaguuucugagcugcgcaucaccgcucaggaaaaugauauggagguggaacuucccgccgcggccaacuccagaaagcaguucagcgucccucugcggcgcaaaucuugucucgugaaggagguugagaaaaugaagaauaagagagaagagaaaaaggcucagaacuccgaaaugcggaugaaacgcgcccaagaguacgacagcucuuuuccgaauugggaguucgcuagaaugauuaaggaguuucgggccacacuggagugccacccccuuaccaugacagauccuaucgaagaacaucgcauuugugugugcgucagaaaacggccccugaacaagcaggaacucgcgaaaaaggagaucgacgugauuuccaucccuagcaagugucugcugcucgugcacgaacccaaacugaaggucgaucuuaccaaauaucuggagaaucaggccuucugcuuugacuucgcuuuugaugagacggccuccaacgaaguuguguacagauucaccgcucgcccgcucgugcagacaauuuuugagggaggcaaggccaccuguuucgccuaugggcaaacaggaucuggcaaaacccauacgaugggcggggaccugagcggaaaggcucagaaugcguccaagggcaucuacgccauggcuagccgggaugucuuucuucugaaaaaccagccuugcuauagaaagcucgggcuggaaguguacguuacauucuucgagaucuauaacggaaaacuguuugaccuccugaauaagaaagccaaacuucgcgugcuggaagacggcaagcaacagguccaggugguugggcuccaggagcaccuggugaacucugccgaugacgucauuaagaugaucgauaugggauccgcuugucggaccagcggccaaacauucgccaauucuaacagcuccagaucucacgcgugcuuucagauuauccuucgcgcuaagggccggaugcaugggaaauucagccugguggaccucgccggaaaugagagaggcgccgauaccuccagcgcugaccgccagacccggauggaaggggccgagauuaacaagucucugcuggcucucaaagaauguaucagagcccugggacagaauaaggcgcacacacccuuucgcgaguccaaacuuacgcaaguccugcgggauagcuucaucggcgagaacucuagaaccugcaugauugccacaaucuccccugggauuagcuccugcgaauacacccucaauacacugcgguacgcugaccgcgugaaggagcugucuccccauagcggacccuccggcgaacagcuuauccagauggagaccgaagagauggaggccuguucuaacggcgcucucauuccugggaaucugagcaaggaagaggaagaacuguccagccagaugucuuccuuuaacgaagccaugacgcaaaucagagagcucgaggaaaaagcgauggaggaacugaaggagaucauucagcagggaccggauuggcuugaacugagcgagaugacagagcagcccgacuaugaucucgaaaccuucguuaauaaagccgagucugcucuggcccaacaggcuaagcacuuuuccgcccugcgggacgugaucaaagcccuuagacucgcuaugcagcuggaggagcaagcgagccgccagauuucuagcaagaagcggccucaguga

SEQ ID NO: 71175 - RNA, 2181 nt, Artificial Sequence
  derived and/or modified sequence opt5 from KIF3A__Homo_sapiens__NP_001287720
augcccaucaacaagagcgagaaaccugaauccugcgacaaugugaaggucguugugagaugucggccgcugaacgagcgcgaaaaaucuaugugcuacaagcaggccgugagcgucgaugagaugagaggcaccauuacagugcacaaaacggacuccucuaaugaacccccuaagaccuucacauuugauaccguuuucgggcccgagagcaagcaacucgacguguauaaccugacagcucggccuaucauugauuccguccuugagggauacaauggcaccaucuuugccuaugggcagacaggaaccggcaaaacguucaccauggaaggggugcgcgcgauucccgagcugagaggaaucaucccuaacucuuuugcucauauuuucggccacaucgccaaggccgaaggcgacacacgguuucucguucgcgugagcuaccuggagauuuauaaugaggaagucagagaucuucuggggaaagaccagacccagcggcucgaggugaaggaacgcccggaugugggagucuacaucaaagaccuguccgcuuauguugugaacaaugccgaugacauggauagaauuaugacacugggccauaagaaccggagcgugggggcuaccaauaugaacgagcacucuucccgcagccaugccaucuucacgauuacaaucgaauguucugagaagggaaucgacggcaauaugcacgucagaauggggaaacuccaccugguggaccuugcgggauccgagcggcaagccaagaccggcgcuacaggccagcgccugaaagaagccaccaagauuaaccucagccugucuacccuugggaauguuaucuccgcucugguggauggaaaaagcacacauguccccuacagaaacuccaagcucacgcggcugcugcaggacucucucggcgggaacagcaaaaccaugaugugcgccaauauuggaccugcggauuacaacuaugacgagacaaucuccacccugagauacgccaaucgcgcuaagaacauuaagaauaaagcccggaucaacgaagaucccaaggacgcccuucugagacaguuucaaaaagagaucgaagaacucaagaaaaagcuggaggaaggcgaggaaauuagcgggucugauaucuccggaagcgaggaagacgaugacgaggagggcgaagugggcgaggauggggaaaagcgcaaaaagcggagaggaucuagcuccucuagcuccagcgacucuacauguuccguuauugagaaaccucuugacaaguuccugcccaaucaggcuggcaaaaagaaggugagcccggauaaaaugaucgagaugcaggccaagauugacgaggagcgcaaagcucucgaaaccaagcuggauauggaggaagaggagcggaacaaagcgagagccgaacuggagaagcgcgaaaaggaccuccugaaagcucagcaagagcaccagucucuucuggaaaagcucuccgcccuggagaaaaaggucaucgucgggggaguggaucuucuggccaaagcugaggaacaggagaagcuccuggaagagagcaauauggaacuggaggagcggagaaaacgcgccgaacaacuccggagagagcuggaagagaaggagcaggaacggcuugacaucgaggaaaaguauacgucccugcaggaggaagcgcagggcaaaacaaagaaacucaagaaaguguggaccaugcugauggcugccaagucugagauggccgaucugcaacaggagcaucagcgcgaaauugaggggcuucucgaaaacaucagacagcugagccgggagcugagacuccaaaugcugauuaucgacaauuuuauuccucgcgauuaccaggaaaugaucgagaacuauguucacuggaaugaggacauuggcgaauggcagcuuaagugcguggcuuacaccggaaacaauaugcggaaacagacacccgucccugauaagaaagagaaggaccccuucgaaguggaucugucccacguuuaucucgccuacaccgaggaaucucugagacaaagccugaugaaacuugagcgccccagaacauccaagggcaaggcucggccuaaaacggggcgcagaaagcggagcgccaaaccggagaccgugaucgacucucuccugcaguga

SEQ ID NO: 71176 - RNA, 2244 nt, Artificial Sequence
  derived and/or modified sequence opt5 from KIF3B__Homo_sapiens__NP_004789
augagcaagcugaaauccucugagagcgugagagucguugugcggugccgccccaugaacggcaaggaaaaagccgcuuccuacgacaagguggucgauguggacguuaaacucggacaggugucugucaagaauccuaagggaaccgcccacgagaugccgaaaacauucacguuugaugcgguguaugacuggaacgcuaagcaauucgaacuguacgaugagaccuuuagaccccuuguugacagcgugcugcagggcuucaaugggacaaucuuugccuauggacagaccggcacagggaaaaccuacacaauggaagggauucggggcgauccugagaagcgcggcgucauccccaacuccuucgaccauauuuuuacccacaucucuagaagccagaaucaacaguaucucgugcgggccuccuaccuggagauuuaucaggaagagauccgcgaucuucugagcaaagaccagacgaagagacucgaacugaaggagcggccugauaccgggguguacgucaaagaccugucuuccuucguuacaaagagcgugaaagagaucgaacaugugaugaacgucggaaaucaaaaccgcucugugggcgcuaccaauaugaacgagcacuccagcagaucucaugccauuuuuguuaucacaauugaauguuccgagguggggcucgauggagaaaaucacauccgggucggcaagcugaaccuuguggaccuggcugggagcgagcgccaggccaaaaccggagcgcagggcgagagacucaaggaagccacgaaaauuaaucugucccuuucugcucugggcaacguuaucagcgcccucguggacgggaaguccacacacauucccuaccgggauagcaagcugacccgccugcuccaggacucucugggaggcaaugcuaaaacagucaugguggccaacgucgggccugcguccuauaacguggaggaaacccuuaccacacugagauacgccaaucgggcuaagaacaucaaaaauaagccgagaguuaacgaggaucccaaagacgcccuccugcgcgaguuccaagaggagaucgcucggcuuaaggcccagcuggaaaagagaagcauuggacgccggaaaagacgcgagaagcggagagaaggcgggggaucuggcggcgggggagaggaagaggaggaagagggcgaagagggggaggaagagggagaugacaaagaugacuauuggcgcgaacagcaagagaagcucgaaaucgagaaacgggccauuguggaggaucauagccuggucgcugaagagaagaugagacugcucaaggaaaaagagaagaaaauggaagaccugcgccgggagaaggaugcggccgagaugcuuggcgcuaaaaucaaggccauggaauccaagcugcucguugggggcaaaaauauuguggaccacacgaacgagcagcagaagauccuggaacagaaaagacaagagaucgccgaacagaagcggcgcgagagagagauucagcagcaaauggaaucucgggacgaggaaacccuugagcugaaagagacauacagcucccuccagcaggaaguggauaucaagaccaaaaagcugaagaaacuguuuagcaagcuccaggcugucaaagccgagauucaugaccugcaagaagaacacaucaaggaaagacaggagcuugagcagacacagaaugaacugacccgcgagcucaaacugaagcaccugauuaucgaaaacuucaucccucuugaggaaaagucuaaaauuaugaaucgggcguuuuucgaugaggaggaagaccauuggaagcuccaccccaucacgagacuggagaaccaacagaugaugaaacgcccuguguccgcugugggauauaagagaccccugagccagcaugcccggaugucuaugaugauucgcccggaagccagauaccgggcugagaauaucguucuccuggaacuugauaugccuucccgcacaaccagagacuaugagggccccgccauugcuccuaaaguccaagccgcgcuggaugccgcucuccaggacgaggaugaaauccagguggacgccagcuccuucgagucuaccgcuaacaagaagucuaaagcccggcccaaguccgggcgcaaaucuggaagcuccagcagcuccagcggcacacccgcgucucagcuguacccucaauccagagggcuggugccgaaguga

SEQ ID NO: 71177 - RNA, 2382 nt, Artificial Sequence
  derived and/or modified sequence opt5 from KIF3C__Homo_sapiens__NP_002245
auggccagcaagaccaaggcuuccgaggcccugaagguggucgcgagaugccggccccucucucgcaaagaagaggcugccggccacgaacagauccugacaauggacguuaaacuugggcaagugacgcugagaaacccucgggccgcuccgggagagcuccccaaaaccuucacauuugaugccguguacgacgcuagcuccaagcaggccgaucuguaugacgaaaccguccgcccucuuauugauucugugcugcagggcuucaaugggacaguuuuugcguacggacagaccggcacagggaagaccuauacgaugcaaggaaccuggguggagcccgagcucagaggcgucaucccuaacgccuucgaacauauuuuuacacacaucagccggucccagaaucagcaguaccuggugcgcgcuucuuaucuggagauuuaccaagaagagaucagagaccuccugagcaaagagcccggcaagcggcuugaacugaaagagaacccugaaaccgggguuuauaucaaggaucucuccagcuucgugacaaagaaugucaaggagauugaacaugugaugaaccugggaaaucagacccgcgccgugggcucuacgcacaugaacgaggucuccagcagaucucaugcuaucuuuauuaucacaguugaguguuccgaacgggggagcgacggacaggaucacauucgcgugggcaaacuuaaucugguggaccucgccgggucugagagacagaacaaagcgggaccgaauaccgccggcggcgcugccacacccuccagcgggggaggcgggggaggcgggggauccggcggcggggcuggaggcgaacggccuaaggaggccucuaaaaucaaccugagccuguccgcccucgggaaugucauugcugcgcuggccggaaaccgcagcacccacauccccuacagagauucuaaacuuacccggcugcuccaagacucccugggcgggaaugcuaaaacaaucaugguggccacgcuuggcccugccagccauucuuacgaugaaagccuguccacccucagauucgcuaaccgcgccaagaacauuaaaaauaagccccggguuaacgaggacccgaaggacacacugcugagagaguuucaggaagagaucgcgcgccucaaagcucagcuggaaaagcggggaaugcuuggcaaaagaccucgccggaagucuagcagacgcaaaaaggccguguccgcucccccuggguaucccgagggacccgucauugaggccuggguggccgaagaggaagaugacaauaacaauaaccaccggccuccgcaacccauccuggagagcgcucucgaaaagaauauggagaacuaccugcaggagcagaaagaaagacuugaggaagagaaggccgcgauucaggaugaccgcucucugguuuccgaagagaaacaaaagcuccuggaggaaaaagagaagaugcuggaagaucuccggagagagcagcaggccaccgaacugcuugcugccaaguauaaagcuauggagagcaagcugcucaucggcgggcggaauaucauggaccauacaaacgagcagcaaaagaugcuggaacugaagcgccaggagauugccgaacagaaaagacgggagagagaaaugcagcaagagaugaugcuucgcgaugaggaaaccauggagcuccggggaacguacacaucucugcagcaggaaguggaggucaagaccaagaaacugaagaaacucuaugcgaagcugcaggccgugaaagcugagauccaagaccagcacgaugaauacauuagaguccgccaggaccuugaggaagcccaaaaugagcagaccagagaacugaagcucaaauaucugaucauugagaacuucaucccucccgaggaaaagaauaagaucaugaaccggcuguuucuugauugcgaggaggaacaguggaaauuccagccucucgugcccgcuggcguuuccagcucccaaaugaagaaacgcccgacaucugccgugggguacaagagaccuauuagccaguacgcccgggucgcuauggcgaugggcucccacccccgcuauagagccgaaaauaucauguuucuggagcuggacgugucuccucccgcuguuuucgagauggaguucagccaugaccaggaacaggauccucgggcccuccacauggaacgccugaugagacuugacuccuuucuggagcggcccagcaccucuaaagugcgcaaguccagaagcuggugucaaucuccgcagcggccuccucccuccacaacgcaugccagccucgcuucugccagccugagacccgcgaccgucgcugaucacgaauga

SEQ ID NO: 71178 - RNA, 3699 nt, Artificial Sequence
  derived and/or modified sequence opt5 from KIF4A__Homo_sapiens__XP_011529195
augaaggaggaagugaaaggcauccccgucagaguugcccugcggugccgcccucucgugccgaaggagauuagcgaagggugucagaugugccuguccuucgugcccggagagccucaagucgugguuggcaccgacaaaucuuuuacauacgauuucguguuugaccccagcacggaacaggaggaggucuucaacaccgcuguggccccucuuaucaaggggguuuuuaaaggauauaaugcgacagugcuggcuuacggccagaccggguccggaaagacauauucuaugggcggcgccuacaccgccgaacaggagaacgaacccacagucggggugauuccuagagugauccaacuccuguucaaggagauugauaaaaagagcgacuuugaguucacccuuaaagucuccuaucuggaaaucuacaaugaggaaauccucgaucugcuguguccgucucgggagaaggcucagauuaacauccgcgaagaccccaaagagggaauuaagaucguuggccucacggagaagaccgugcugguggcccuugauacagucagcugccuggaacaggggaauaacuccagaaccguggcuagcacagccaugaacucucaguccagccggucucacgcgauuuuuaccaucucccucgagcaacgcaaaaagagcgacaaaaauucuuccuucagaagcaagcugcaucuuguugaucuggccggauccgaacggcagaaaaagacgaaagcugagggcgaccgccucaaggaagggauuaauaucaacagaggacugcugugucucggcaaugugaucucugcccugggcgaugacaagaaagggggauuugucccuuaucgggauagcaaacuuacacgccugcuccaggacucccugggcgggaacagccacacccuuaugauugcuugcgugucucccgccgacuccaaucuggaggagacacucaacacccugagauacgcggaucgggcccgcaaaaucaagaauaaaccuauuguuaacaucgacccccagaccgcugaacugaaccaucucaagcaacaggugcagcaacugcagguccuucugcuccaggcccacggaggcacacugccggggagcauuacgguggagccuucugaaaaucuucagagccugauggagaagaaccaaucccucgucgaagagaaugagaaacugucuagaggacugagcgaagcugccggccagaccgcccagaugcucgagcggaucauccugacagaacaggcuaacgagaagaugaaugcgaaacuugaggaacugagacaacaugccgcuuguaagcucgaucugcagaaacugguggagacccuugaagaccaggagcucaaggaaaacguugagauuaucugcaaucugcagcaacugauuacacagcucuccgaugagaccguggccuguauggccgcugccaucgacacggcggucgaacaggaggcucagguggaaacaagccccgagaccucucgcuccagcgaugccuucaccacacaacacgcccugcggcaggcucagaugucuaaggaacuuguugagcugaacaaagcccucgcucugaaggaggcccuggcgagaaaaaugacccaaaaugacucccagcuucagccuauucaguaccaauaucaggauaacaucaaggaacucgagcuggaagugaucaaucugcagaaagagaaggaagaacucguccuggagcuucagacagccaagaaagacgcuaaccaagccaagcugagcgaacgccggagaaaacgccuccaggagcuggaaggccagauugcugaucugaagaaaaagcugaaugagcaguccaaacuccugaagcugaaggagucuacggaacggaccgugagcaaacucaaccaagagaucagaaugaugaagaaucagcgcgugcagcugaugcggcaaaugaaagaagacgccgagaaguuuagacaguggaaacagaagaaggacaaagaaguuauucagcuuaaggagcgcgaucggaaaagacaauacgagcugcucaagcuggaacggaacuuccagaaacaguccaacguccugcgcagaaagacagaggaagcggccgcugccaauaagcggcuuaaagacgcucuccagaagcaaagagagguggccgauaaacgcaaggaaacccagucucgggggauggagggaacagccgcuagagugaaaaacuggcugggcaaugagaucgaagucauggugagcaccgaggaagcgaagcgccaccugaacgaccuccuggaggauagaaagauucuugcccaggacguugcucagcugaaagaaaagaaagaguccggggagaaucccccucccaagcuccggcgcagaacguucagccugaccgaagugcggggacaagucucugaguccgaagauagcaucacaaaacagauugagucucuggagaccgaaauggaguuucgcuccgcccagaucgccgaccuucagcaaaagcugcucgaugcugaaagcgaggacagaccgaaacagcggugggaaaacaucgccacaauucuggaggcgaagugcgcucucaaguaucugaucggcgagcuugugucuagcaaaauucagguuuccaagcuggaaagcucucucaaacaauccaagaccagcugugccgauaugcagaaaaugcuguucgaggaacgcaaucauuuugccgagaucgaaacggagcugcaggcugagcuugugagaauggaacagcaacaccaggagaagguccuguaccuccugucccagcuccagcaaucucagauggccgaaaagcagcuggaggaaagcguguccgagaaagagcagcaacuucugucuacacucaagugccaggacgaggagcuggaaaagaugcgggagguuugcgagcagaaccaacagcugcuucgcgaaaaugagauuaucaagcagaaacugacccuccuucagguggcgagcagacaaaagcaucuccccaaggauacacugcuuuccccugacucuagcuucgaauaugugcccccuaaacccaagccgucccgggucaaagagaaguuucuggaacagagcauggacaucgaggaucugaaauacuguucugagcacuccgugaacgaacacgaggacggggauggcgacgaugacgaaggagaugacgaggaauggaagccuaccaagcucgucaaaguuagcagaaagaauauucagggcugcucuuguaaaggguggugcggaaacaagcaguguggcugccgcaaacaaaaguccgauugugggguggacugcuguugcgaucccaccaagugucggaauagacagcagggaaaagacagccugggcacaguggagcgcacgcaggauucugagggguccuucaaacuugaagacccuaccgaggucacacccggccugagcuuuuucaacccugugugcgcuacccccaauuccaagauccucaaggaaaugugcgacguugagcaagugcugagcaaaaagacaccgccugcccccucucccuuugaucucccugaacugaaacaugucgccaccgaguaucaggagaacaaggcuccgggaaagaaaaagaaacgggcccuugcuagcaacacguccuucuuuucuggcuguagccccauugaagaggaagcccacuga

SEQ ID NO: 71179 - RNA, 3705 nt, Artificial Sequence
  derived and/or modified sequence opt5 from KIF4B__Homo_sapiens__NP_001092763
augaaggaggaagugaaaggcauccccgucagaguugcccugcggugccgcccucucgugccgaaggagauuagcgaagggugucagaugugccuguccuucgugcccggagagacccaagucgugguuggcacagacaaaucuuuuacguacgauuucguguuugacccuuguaccgaacaggaggaggucuucaacaaggcuguggcgccccuuaucaaagggauuuuuaagggauauaaugccacaguucuggcuuacggccagaccgggagcggaaagacauauuccaugggcggcgccuacaccgccgaacaggagaacgaaccuacaguggggaucauucccagagucauccaacuccuguucaaagagaucgauaagaaaucugacuuugaguucacccuuaaggugagcuaucuggaaauuuacaaugaggaaauccucgaucugcugugcccuucccgggagaaagcucagauuaacauccgcgaagacccgaaggagggaauuaagaucgugggccucacggagaaaaccguccugguugcccuugauacagugucuugucuggaacaggggaauaacagcagaaccguggcuuccacagccaugaauagccagucuucccggagccacgcgauuuuuaccaucucuaucgagcaacgcaagaaauccgacaagaacugcagcuucagaucuaaacuccaucuggucgaucuugccggauccgaacggcagaagaaaacgaaggcugagggcgaccgccugaaggaagggauuaauaucaacagaggacuccugugucugggcaaugugauuagcgcccucggcgaugacaaaaagggguccuuuguucccuaucgggauucuaaacugacacgccuucugcaggacagccucggaggcaacucccacacccugaugaucgcuugcgugagcccugccgacucuaaucuugaggagacacuguccacccucagauacgcggaucgggcccgcaagauuaaaaacaagcccaucgucaauaucgacccucauaccgcugaacugaaccaccugaagcagcaagugcagcagcuccaaguucugcuucugcaggcccaugggggaacacuccccggcagcauuaacgcugagccgucugaaaaucugcagagccuuauggagaaaaaccagucccugguggaagagaaugagaagcucucuagaugucugagcaaagccgccgggcaaacggcucagaugcuggaacggaucauucucaccgagcaggucaacgaaaagcugaaugcgaaacuugaggagcugagacagcacguggccugcaagcucgaucugcaaaagcuggucgaaacacuugaggaccaggaacucaaagagaacguggaaaucauuuguaaucugcagcagcugaucacccaacucuccgaugagacaguugcuugcaccgccgccgcuaucgacacggccguggaggaagaggcgcaggucgaaacaagcccugagaccucucgcuccagcgaugcuuucaccacacagcacgcccugcaucaggcccaaaugucuaaggaagugguugagcuuaacaaugcucuggcccucaaagaggcucuggugcggaagaugacccagaacgacaaucagcugcaacccauucaguuucaguaccaggauaacaucaaaaaucuugaacucgaggucauuaaccugcaaaaggaaaaggaggaacuggugagagagcuccagacagccaaaaagaaugugaaccaggcgaaacuguccgagcaccgccauaaacuucugcaggaacucgagggacaaaucgccgaccugaagaagaaacugaacgaacagagcaaacuucucaagcugaaggaguccacggagcggaccguuucuaagcugaaucaggaaauuuggaugaugaaaaaccagagaguccaacucaugcgccagaugaaggaggaugcugaaaaauuccggcaguggaagcaaaagaaagacaaggaggugauccagcugaaagaaagagaccgcaagcggcaguaugagcuucugaaacucgagagaaauuuccagaagcaaagcuccgugcugcgccggaagacagaagaggccgcugccgcgaacaaaagacugaaggaugcccuucagaaacagcgggaagucaccgacaagcgcaaagagacacagucucacggcaaggaaggcauugcugccagagugcggaauuggcucgggaacgagaucgagguuauggugagcaccgaagaggcuaagagacaccugaaugaucugcucgaagaccgcaaaauccuggcccaagaugucgugcagcuuaaggagaaaaaggaaucccgggagaacccuccucccaaacugagaaagugcacguuuagccucucugagguucauggacaggugcuggaauccgaggacuguauuaccaaacagaucgaaagccuggagacagagauggaacuucgcucugcccaaauugcugaucugcagcagaagcuccuggacgcggaguccgaagauagacccaagcagugcugggagaauaucgccaccauucucgaagcuaaaugugcccugaaguaccuuaucggcgagcuggucagcucuaaaauccacgugacaaagcucgagaacagccugcggcaauccaaagccagcugcgcugacaugcagaagaugcuguucgaggaacagaaucauuuuucugaaauugagaccgaacuucaagccgagcugguucgcauggagcagcagcaccaggaaaaggugcucuaucuggucucccaacuccaggagagccagauggcggaaaaacagcuggagaaguccgcuucugaaaaagagcaacagcuugugagcacgcugcagugucaggaugaggaacucgagaagaugagagaagugugcgagcaaaaccagcagcugcugcaagagaaugaaaucauuaaacagaaacuuauccugcuccaggucgccucccggcagaagcaucugccgaacgacacacuccugucucccgauagcuccuucgaguacauuccucccaagccuaagcccucucgcguuaaagaaaaguuucuugagcaaagcauggacaucgaagaccugaaauauuguuccgagcacagcgugaaugagcacgaagauggggacggagauggcgacucugaugagggggacgaugaagaguggaagccgaccaagcuggugaaagucuccagaaagaacauccagggcugcagcuguaaaggauggugcggcaacaagcagugugggugccggaaacagaagucugacugcggaguggauuguuccugcgacccuacaaagugucgcaauagacaacagggcaaagauagccucgggaccguugaacagacccaggacucugagggauccuucaagcuggaggaucccacagaagugacgccuggccuuagcuuuuucaaccccgucugcgccaccccuaauuccaaaauucugaaggagaugugugacauggaacaagugcucagcaaaaagacagcucccgccccgucuccuuuugaccugcccgagagcaaacauggggcgaccgaauaccagcagaacaagcccccuggcaagaaaaagaaacgggcucucgccuccaauacaucuuucuuuagcggaugcuccccgaucgaggaggaagcccacuga

SEQ ID NO: 71180 - RNA, 3099 nt, Artificial Sequence
  derived and/or modified sequence opt5 from KIF5A__Homo_sapiens__NP_004975
auggccgagaccaacaaugaaugcagcaucaaggugcuguguagauuccggccccucaaccaggcugagauucugcgcggcgacaaguuuaucccuauuuuccaaggggaugacuccgucguuaucggaggcaagccguacguguuugauagaguguuucccccuaauacaacgcaggaacaggucuaucacgccugcgcgaugcagauugugaaagacguucuugcuggguacaacggaaccaucuucgccuauggccaaacaucuagcgggaagacccauacaauggagggaaaacugcacgauccccagcucaugggcaucauuccucggaucgcccgcgacauuuucaaucauaucuacuccauggaugaaaaccuggaguuucacauuaaggugucuuauuucgagaucuaccuugacaagauuagagaucugcucgacgucaccaaaacaaaucugagcgugcaugaagauaagaaccggguucccuuugugaaaggcuguaccgagcgcuucgucuccucuccugaagagauccuggacgugaucgaugagggaaagagcaauagacacguggcugucacgaacaugaaugaacacuccagccggucucauuccauuuuucucaucaacauuaaacaggagaauauggaaaccgagcagaagcugagcgggaagcuguaucuuguugaccucgccggcucugaaaaaguguccaagacaggggcugagggagccgugcuggacgaggcgaaaaacaucaauaagagccuuucugcccugggcaacgucauuuccgcucucgccgaagggaccaaaagcuacgugccguaccgcgauuccaagaugacaagaauccugcaagacucucugggaggcaacugccggaccacgauguucaucuguugcagccccuccagcuauaaugaugcugagacaaaaucuacccucauguuuggccagcgcgccaagacaauuaagaacaccgcguccguuaaucuggaacuuaccgccgagcaguggaaaaagaaauacgaaaaggagaaagagaagacaaaggcucagaaagaaacgaucgccaagcuggaggcugaacucagcagauggcggaacggggagaaugugccugaaaccgagcgccuggccggagaggaagccgcucuuggcgcggagcugugugaagagacacccgucaacgacaauucuagcauugugguuagaaucgccccugaggaacggcaaaaauaugaggaagagauuagacgccucuacaagcagcuggaugacaaagaugacgaaaucaaccagcaaucccagcugaucgagaagcucaagcagcagaugcuggaucaagaggaacuucuggugucuaccagaggggacaaugagaaaguccagcgggaacucagccaucugcaguccgagaacgaugcugccaaggacgaagugaaagagguccuucaggcccuggaggaacucgcugugaauuaugaccaaaagagccaggagguugaagagaaaucucagcagaaccaacugcugguggaugaacucucccagaaggucgccacaaugcugagccuugagucugagcugcagcgccuccaggaaguguccggacaccaacggaagagaauugcggagguucugaauggccugaugaaagaccuuagcgaguucuccgugaucgucgggaacggagagauuaagcuccccguggagaucucuggcgcuauugaagaggaguucaccguggcccgccuguacaucagcaaaauuaaguccgaaguuaaaucugucgugaagcggugcagacagcuggaaaaucuccagguggagugucaccgcaaaauggaggucacgggccgggaacugagcuccugccaacuucugaucagccagcacgaggccaagaucagaucucucacagaauauaugcaguccguggagcugaagaaacgccaucuggaagagagcuacgauucucuuuccgacgagcucgcuaagcugcaggcccaagaaaccguucacgagguggcucugaaagauaaggaaccggacacccaggaugccgacgaggucaaaaaggcgcucgaacugcagauggagagccaucgggaggcccaccauagacagcuugcucggcugcgcgaugaaauuaacgagaagcaaaagacaaucgacgaacucaaggaucugaaccagaaacugcagcuugagcucgagaagcugcaggccgacuacgaaaaacugaagucugaggaacacgaaaagagcaccaaacuccaagaacugacauuucuuuaugagagacacgagcaguccaagcaggaucugaaagggcucgaagagacgguggcucgggaacugcaaacccugcauaaucuuagaaaacucuucguucaggacgugacaacccgcgucaaaaagagcgccgagauggaaccugaggacucuggaggcauucacucccagaagcagaaaaucagcuuucuggagaacaaucuggaacaacucacaaaggugcauaaacagcugguucgggauaacgcggaccuuagaugugagcugcccaagcucgaaaaacgccugagagccaccgcugagcgggugaaggcccuggaaggggcucuuaaagaggccaaggagggagccaugaaggauaaacgcagauaccagcaggaagucgaccggauuaaggaggcugugcgcuauaaauccucuggcaagagagggcacagcgcgcaaaucgccaaaccugugcggcccggccacuaccccgcuuccucuccuacgaauccguauggaacccgcagccccgaaugcaucuccuacacaaacucucuguuccagaauuaucagaaccucuaccugcaggccaccccuagcuccacaagcgauauguacuuugccaauucuugcaccuccagcggcgcuacgucuuccgggggaccccucgccagcuaucaaaaggcgaacauggacaauggcaacgcuacagauauuaaugacaacagaucugaucugccuuguggguacgaggccgaggaccaggccaaacuuuucccccugcaucaggaaaccgcugccuccuga

SEQ ID NO: 71181 - RNA, 2892 nt, Artificial Sequence
  derived and/or modified sequence opt5 from KIF5B__Homo_sapiens__NP_004512
auggccgaccuggcugagugcaacaucaaggugauguguagauuccggccccucaaugaaagcgaggucaaccgcggcgauaaauacauugccaaguuucagggggaagacaccguugugaucgcguccaaaccuuaugcuuucgauagaguguuucaaucuagcacaucccaggagcaggucuacaaugacugcgccaagaaaauugugaaggauguucuggaaggauauaacggcacgaucuucgccuacgggcagaccucuagcggaaagacacacaccauggagggcaaacuucaugacccggaggggaugggaauuaucccccggaucgugcaagauauuuuuaauuauaucuacuccauggacgaaaaccuggaguuccacauuaaggucucuuauuuugaaaucuaccucgauaaaauucgcgaccugcuugaugugagcaagacaaaucuguccguucaugaggacaaaaacagagugccuuacgucaagggcuguaccgagcgguucgugugcagccccgaugaagugauggacacaaucgacgagggcaagucuaaucgccacgucgcuguuaccaacaugaaugaacauuccagcagaucucacuccauuuuucucaucaacgugaaacaggagaauacgcagaccgaacagaagcugagcgggaaacuguaucucguggaucuggccggaucugagaaggucuccaaaacaggcgcugagggggccgugcuugacgaagcgaagaacaucaauaaaagccuguccgcccucggaaacguuauuucugcucuggccgagggcagcaccuacgugccuuaucgggauuccaagaugacacgcauccuucaagacagccucgggggaaacuguagaaccacgauugucaucugcuguucucccuccagcuacaaugaaucugagacaaagagcacccugcuguucggccagcgggcuaaaacaauuaagaacaccgugugcguuaauguggaacugaccgccgagcaguggaaaaagaaauaugagaaggaaaaggagaaaaacaagauccuccgcaauacaauccaguggcuggaaaacgagcuuaauagauggcggaacggcgaaacggucccuauugaugagcaauuugacaaagagaaggcgaaucuggaagccuucaccguggauaaagacaucacacucaccaacgauaagccggcuacagccauuggggucaucggaaauuuuaccgacgcugagcgcagaaagugugaagaggagauugccaaacuguacaagcagcuugaugacaaagacgaagagaucaaccagcaaucccagcugguggaaaagcucaaaacgcagaugcuggaucaggaggaacugcucgccucuacacggagagaccaagauaauaugcaggcugagcugaaccgccuucaggcggagaaugacgccagcaaggaagagguuaaggaagugcugcaggcucucgaggaacuggccgucaacuaugaucaaaaaucccaggagguggaggacaagaccaaagaauacgagcuucugagcgaugaacucaaccagaagucugccacccuggcuuccaucgacgccgagcugcagaaacucaaggaaaugacaaaucaccagaaaaagcgggcggcugagaugauggccagccugcuuaaggaucuggccgagauuggcaucgcuguugggaacaaugacgugaaacaacccgaaggaaccggcaugauugaugaggaguucacagucgccagacucuacaucucuaagaugaaauccgaagugaagacgauggugaaacgcugcaagcagcuggagagcacccagacagaauccaacaagaaaauggaggaaaaugagaaggaacuggcugccugucaacuucggauuucucagcaugaggcgaaaaucaagagccucaccgaguaucugcagaacguugaacagaaaaagagacaacuggaggaauccgucgacgcccucucugaggaacuggugcagcuucgcgcucaggagaaggugcacgagauggaaaaagagcaucugaauaagguccaaacagccaacgaagugaaacaggcuguugagcagcagauucaaagccaccgggaaacccaccagaagcagaucuccagccucagagaugagguggaggccaaagcgaagcugaucacggaccugcaggaccaaaaucagaagaugaugcuugaacaggagcgccuccgggucgaacaugagaaacugaaggccaccgaucaagagaaaucuagaaagcugcacgaacucacagugaugcaggaccgccgggagcaggcuagacaggaucugaaagggcuugaagagaccguugccaaggaacugcaaacacuccauaaccugcggaaacuguucgugcaggaccuugcuacccgcgucaagaaguccgccgagauugauagcgacgauacgggaggcucugccgcucagaaacagaagaucuccuuucucgagaauaaccuggaacaacugacaaaagugcacaagcagcucguuagagacaaugcggaucugcggugcgagcuuccuaaacuggaaaagagacuccgcgccaccgcugagcgggugaaggcccuggaaagcgcccugaaagaggcuaaggagaacgccucuagagaccgcaaaagauaccagcaggaagucgaucggauuaaggaggcggugcgcagcaaaaauauggcuagacggggccauuccgcccaaaucgccaagcccauucgcccugggcagcaccccgcugccagcccgacacacccuucugcgaucagaggaggcggggcuuucgugcagaacucccagcccgucgccguucggggaggcgggggcaagcaaguguga

SEQ ID NO: 71182 - RNA, 2874 nt, Artificial Sequence
  derived and/or modified sequence opt5 from KIF5C__Homo_sapiens__NP_004513
auggccgaccccgcugagugcagcaucaaggugauguguagauuccggccucugaacgaagccgagauucuccgcggcgauaaauuuaucccgaaguucaaaggggacgaaaccgucguuauuggacagggcaagcccuacguguuugauagagugcugccucccaauacaacgcaagagcaggucuauaacgcgugcgcuaaacagaucgugaaggacguucuugaaggguacaauggaaccauuuucgccuauggccagacauccucugggaagacccacacaauggagggaaaacugcaugauccucaacucaugggcaucaucccccggauugcccacgacaucuuugaucauauuuacagcauggacgagaaccuggaguuccacaucaagguguccuauuuugagauuuaccuugauaaaauccgcgaccugcucgaugucucuaagaccaaucuggcugugcaugaagacaaaaacagaguuccuuaugugaagggcuguacagagcgguucgucagcuccccggaggaagugauggaugugauugacgaggggaaggccaaucgccacgucgcuguuaccaacaugaaugaacacucuagcagaucccauagcaucuuucugaucaacauuaaacaggagaauguggaaacggagaagaaacucucuggaaagcuguaccuuguggaccuggccggcuccgagaaagucagcaagaccggggcggaaggagccgugcucgaugaggcuaaaaacaucaauaagucucuguccgcccuuggcaacguuauuagcgcucuggccgaagggacaaagacccacgugcccuaccgggacucuaaaaugacacgcauccuccaggauucccugggaggcaauugcagaaccacgauugucaucuguugcagcccuuccguguucaacgaggcggaaacaaagucuacccugauguuuggccagcgggccaaaacaaucaagaacaccguuagcgugaaucucgagcugaccgcugaggaauggaaaaagaaguaugagaaagaaaaggagaaaaacaagacacuuaaaaaugucauucaacaucuggaaauggagcucaaccgcuggagaaauggggaggccgugcccgaagacgagcagaucuccgcuaaggaucagaagaaccuggaaccuugugacaauacgcccauuaucgauaacauugccccggucguggccggaaucagcaccgaggagaaagaaaaguacgacgaggaaaucucuucccuuuaucggcagcuggaugacaaagaugacgagauuaaucaacagagccagcucgcugaaaagcugaaacaacagaugcuggaccaggaugagcuccuggcgucuacacgcagagacuacgagaagauccaggaagaacuuacccggcugcaaauugaaaacgaggccgcuaaggaugaaguuaaagaggugcuccaggcccuggaggaacuugccgucaauuaugaccaaaagagccaggagguggaagauaaaacaagagcuaacgagcagcugaccgacgaacucgcccagaagacgacaacccugaccacaacccagcgcgagcugucccagcuccaagagcugucuaaucaccagaaaaagcgggcgacagaaauccuuaaccugcuccugaaagaucugggcgagauugggggaaucauuggcacgaaugacguuaagacccuugcugaugugaacggggucaucgaagaggaguucacaauggccagacucuacaucagcaagaugaaauccgaaguuaagagccuggugaaccgcucuaaacagcuggaguccgcccagauggacagcaaucggaagaugaacgcuucugaaagagagcucgccgcuugccaacugcuuauuucccagcacgaagccaaaaucaagagccugaccgauuauaugcagaauauggagcaaaagcgccggcagcucgaggaaucccaggacucucugagcgaggaacuggcgaaacuuagagcccaggagaagaugcaugaaguguccuuucaagauaaagagaaggagcaccucacacgccugcaggacgcugaagagaugaaaaaggcccuggaacagcagauggagucucaucgggaagcucaccaaaagcagcucagcagacugcgcgacgagauugaggaaaaacagaagaucauugaugagauccgggaccuuaaccagaaacugcaacucgaacaggagaagcuguccagcgauuacaauaaacugaagaucgaggaccaggaaagagagaugaaacuugaaaagcuccugcugcucaacgauaagcgggagcaagcccgcgaagaccugaaaggacuugaggagaccgucucuagagaacugcagacgcuccauaaucugcggaagcuguucgugcaggaucuuaccacaagagugaaaaaguccgucgagcucgacaacgaugacggcggcgggagcgcggcccagaaacaaaagauuucuuuccuggaaaauaaccuggagcagcucaccaaggugcacaaacagcugguucgcgauaaugcugaccuucggugugaacugccuaagcucgagaaaagacugcgcgccacagcugagagagugaaggcccuggaauccgcccuuaaagaggcuaaggaaaacgcgaugcgggaucgcaagagauaccagcaagaggucgaccggaucaaagaagccgugcgcgcuaagaauauggccagacgggcccacagcgcucagauugccaaacccauccgcccuggacauuaucccgcgucuagccccaccgcuguucacgccauuagaggcgggggaggcuccagcucuaacuccacgcauuaccagaaguga

SEQ ID NO: 71183 - RNA, 2394 nt, Artificial Sequence
  derived and/or modified sequence opt5 from KIF6__Homo_sapiens__NP_001275949
auggugaagcagaccauccaaauuuucgccagagucaaacccccuguucggaagcaccagcagggcaucuacagcauugacgaggaugaaaaacugaucccgucccucgagauuauccugccccgcgaccuugcugauggguuugugaacaauaagagagaaucuuauaaauucaaguuucagcggaucuucgaccaagaugccaaccaggagacaguguuugaaaauauugcgaagccugucgcuggaagcgugcuggccggcuacaacgggacgaucuucgccuauggacagaccggcuccgggaaaacauuuaccauuacaggaggcgcugagcgcuacucugacagaggcaucauuccccggacccucagcuauaucuucgagcagcugcaaaaggauuccucuaaaauuuacacaacccauaucagcuaucuugaaaucuacaaugagugcggguacgaccugcucgauccucgccacgaagccuccagccuggaggaccugcccaagguuacgauucucgaggauccugaccagaacauccaucugaaaaaucuuacccugcaccaggcuacaaccgaagaggaagcccucaaccugcuuuuucugggagauacaaauagaaugauugcggagaccccgaugaaccaggccucuacgcggucccauuguaucuucacaauucaccucagcucuaaggaacccggcuccgcuaccgugcgccacgccaagcugcaucuggucgaccucgcugggagcgagagaguggccaaaacaggaguuggcgggcaucugcuuaccgaggcgaaguauaucaaucugucucuccacuaccuggaacaagugaucauugcccuuuccgagaaacaccggagccacaucccuuaucgcaacuccaugaugaccucuguccugagagacagccucggaggcaauugcaugacaacgaugauugcuacccugucccuggaaaagcggaaccucgaugagagcaucucuacaugucgcuuugcccagagaguggcucugauuaaaaaugaagccgugcuuaacgaggagaucaacccccggcuggucaucaagagacuccagaaagaaauucaagagcugaaggacgaacuugccaugguuaccggcgagcagcgcacagaagcucugaccgaggcggagcuccugcagcuggaaaagcucaucacguccuuccuggaggaucaggacagcgauucucggcuugaagugggggccgacaugagaaaagugcaucacugcuuucaucaccugaagaaacuccugaaugauaagaaaauucuggagaacaauacagucagcuccgagucuaaggaccaagauugucaggaaccucuuaaggaggaagaguaccgcaaacuccgggacauccugaagcagagagauaacgaaauuaauauccuggugaacaugcucaaaaaggagaaaaagaaggcucaggaggcccugcaucuugccggaauggaccgccgggaguucagacaaagccagucucccccguuccgccugggcaauccugaagaagggcagcggaugagacucagcucugcucccucccaggcccaagacuuuagcauucugggaaaacgcuccucccugcuucacaagaaaaucggcaugcgggaggaaaugagccucgggugccaggaggcguucgagaucuuuaagagagaucacgcugacuccguuaccauugaugacaacaaacagauccugaagcagcgguucucugaagccaaggcccugggagagagcauuaaugaagcucgcuccaaaaucggcauuucugagaacauggccgugccucucaugcccgaucaacaggaagagaagcugagaagccagcuugaggaagagaaacggagauauaagaccauguuuacacgccugaaagcucucaaggucgaaaucgagcaucugcaacugcuuauggacaaagccaaggugaagcuccagaaagaguucgaaguuuggugggcggaggaagccaccaaucuccaggugaacucccccgcugucaauagccuggaucacacaaagccuuuucugcagacgucugacucccaacaugaguggagccagcugcuuucuaacaaauccagcggcgggugggaagugcaggaucagggaaccggccgguucgacgucugugaugugaaugccagaaagauccugccgucucccugcccuagcccccacucccaaaaacagagcucuacauccaccccucucgaggacagcauucccaagcgcccgguuuccucuaucccucugacaggggauagccagaccgacuccgacauuaucgcuuuuauuaaggccagacagucuauccugcaaaaacagugucuuggaagcaacuga

SEQ ID NO: 71184 - RNA, 4032 nt, Artificial Sequence
  derived and/or modified sequence opt5 from KIF7__Homo_sapiens__XP_005254959
augggccuggaggcccagagacuccccggggcugaagaggccccugugcgggucgcgcugcgcguuagaccgcuucugcccaaggaacuccugcacggacaucaaagcugccuucagguggagccuggccuggggcgggugacccucggacgcgacagacacuucggcuuucaugucgugcuggcugaagaugccgggcaggaggccguuuaccaggcuugugugcaaccccugcucgaggccuucuuugaaggauucaacgcuacagucuuugccuauggccagacgggcuccgggaaaaccuacacaaugggagaggcgucuguggccagccugcuugaagacgagcagggcaucguuccucgggcuauggccgaggcuuucaagcugauugaugaaaaugaccuccuggauugccuugugcacgucuccuaucuggagguguacaaagaagaguuucgcgaccuccuggaaguggggaccgccucuagagauauccagcugcgggaggacgagcgcggaaacgucguucucuguggcgugaaggaaguggaugucgaggggcuggacgaagugcuuagccugcucgagaugggaaaugcggccagacauacaggcgcuacccaccugaaccaccuuuccucucggagccauacaguuuucaccgugacgcuggaacaacgcggcagagcccccucccggcucccucgcccggcucccgggcagcugcuggucagcaaauuucacuucguggaucucgccggaucugagagaguucugaagaccggcuccacaggggagcggcuuaaggaaagcauucagaucaauucuucccugcucgcccugggaaacgugauuagcgcucuuggcgacccucagagacgcgggucucauauccccuaucgggauuccaaaaucacccgcauucugaaggacagccucggaggcaaugcgaaaacagucaugaucgccugcguguccccuucuagcuccgacuuugaugagacccugaacacgcugaauuacgcuagcagagcccaaaacauucggaauagagccacagucaacuggcgccccgaagcugagcggccgccugaagagaccgccucuggcgcgagagggcccccucgccaccgguccgagacaagaaucauucaccgcggacggagagcucccggccccgccaccgccagcgcugccgcugccaugcggcucggggcggaaugugcccgcuauagagcuugcaccgacgccgcuuacucucugcuucgggagcugcaggccgaaccuggacucccgggcgcggccgcuagaaaggugcgcgauuggcugugugccguugagggggagcggagcgcucuguccucugccagcggccccgacuccggaaucgaaagcgccucuguggaggaucaggcugcgcaaggcgccgggggaagaaaagaagacgagggcgcucagcagcuucucacacugcagaaucaagucgcccgccuggaagaggagaacagagauuuccucgccgcucuggaagacgccauggagcaguacaaacuucaguccgaucggcugcgcgaacagcaagaggaaaugguggagcucagacugcggcuggagcuuguucgcccuggguggggaggccccagacuccugaaugggcugccucccggcagcuuugugccgcggccucauacggcgccccucggaggcgcucacgcccauguccuggggauggugccucccgccugccuuccuggagacgaagugggcucugagcagcgcggggaacagguuaccaacggaagagaggcuggcgccgaacugcucacagaggucaaccggcugggguccggcagcuccgcggcuucugaggaagaggaagaggaggaagaacccccgcgcagaacccugcaccuucggagaaaucgcauuagcaacuguucccagcgggccggagccagaccuggcucucuccccgaacgcaaggggcccgagcugugccuggaggagcucgaugcugccaucccuggaagccgggcugugggcggguccaaagccagagugcaagcgcgccaggucccgcccgccacagcuagcgaguggcggcuggcccaggcucagcaaaagaucagagaacuugccauuaauauccgcaugaaagaggaacugauuggagagcucgugcggaccggcaaggccgcucaggcgcugaacagacagcauucucaacggauccgcgaacuggagcaggaggccgaacagguuagagcugagcuuuccgaagggcagcggcaacuccgcgagcuggaaggcaaagagcugcaggacgccggagagagaagccggcuccaggaauuuagacgccggguggccgcugcccagucucaaguccaggugcugaaggagaaaaagcaggcgacggaaagacuuguuucccugagcgcucagucugagaagcgccuccaagagcuggaacggaaugugcagcugaugagacagcaacagggccagcuucagcgccggcugagagaggaaacagagcaaaaacgcagacucgaagccgagaugagcaagcggcagcaccgcgucaaagagcuggaacucaagcacgagcagcagcaaaagauucugaagaucaagaccgaagagaucgccgcuuuccagagaaaacggcgcuccgggagcaacggaucugugguuucccuugaacagcagcaaaagauugaggagcagaaaaaguggcuggaccaggaaauggagaaagugcuccagcaaagacgggcccuggaggaacugggcgaggaacuucauaagagagaggcgauccuggcuaagaaagaagcccucaugcaggagaagaccgggcuggaaagcaaacgccuccgguccucucaggcccugaaugaggauauugucagagugagcucccgccuugagcaccuggaaaaggagcucucugaaaaaucuggacaacugcggcagggcuccgcucagucucagcaacagaucagaggcgagauugacagccugcggcaggaaaaggauucccuucugaagcagcgccucgagaucgacgggaaacugagacaaggaagccuccugucuccugaggaggaacggacacuuuuccagcuggaugaagccaucgaggcucuggacgccgcgauugaauauaagaacgaggccaucaccugucgccagagagugcuccgggcuuccgccagccugcuuucucagugcgagaugaaucugauggcuaaacucuccuaccugagcagcuccgaaacacgcgcccuccugugcaaguauuucgauaaagucguuacgcuuagagaggaacaacaucagcagcaaauugccuuuagcgagcuggaaaugcagcuggaggagcagcagcggcucguguacuggcuggaaguggcucuugagcgccaaagacuggaaauggaccggcagcucacccugcagcagaaggagcacgagcaaaacaugcagcuccugcuucagcaguccagagaucaccugggcgaagggcuggcggacagccgccggcaauaugaggccagaauccaggcucucgaaaaagagcugggacgcuacauguggauuaaucaggaacuuaagcagaagcugggcggggucaacgccgugggacauucucggggcggcgagaaaagaagccucuguuccgaggggcgccaagcccccggaaaugaagaugagcugcaccucgcuccugaacugcuuuggcugucuccccugacagagggcgccccucggaccagagaagagacacgcgaccucguucaugcgccccugccgcuuaccuggaagcggagcucccugugcggggaggaacagggaucuccugaggaacucagacagcgcgaggcugccgaaccccuggugggccggguccugccugugggggaggccggacuccccuggaacuucggcccgcuuagcaaaccuagacgcgagcugagacgggcuucccccggcaugaucgauguucgcaagaauccucuguga

SEQ ID NO: 71185 - RNA, 2373 nt, Artificial Sequence
  derived and/or modified sequence opt5 from KIF9__Homo_sapiens__NP_001128350
augggcaccagaaagaaagugcacgccuucguccggguuaagcccacagacgauuuugcucaugagaugauccgcuacggggacgauaaaagaagcauugacauccaccugaagaaagauauucggcgcggaguggugaacaaucagcaaacggacugguccuucaagcucgauggcguccugcaugacgccucucaggaucuuguguaugaaaccguugcgaaggacguggucagccaggcucuggauggguacaacggaacaaucaugugcuauggccagaccggggccggaaaaacauacaccaugaugggcgccacagagaauuauaagcacagaggcauucucccucgggcucugcaacagguguuucgcaugaucgaagagagaccgacccaugccaucacgguucggguguccuaccuugaaauuuauaacgagucucuguucgaccuccugagcacccugcccuacgucgggccuuccgugacacccaugaccaucguggagaauccucagggagucuuuauuaaaggccucucuguucaccugacaagccaggaagaggaugcuuucucccuucuguuugaaggggagaccaaccgcaucauugccagccacacgaugaauaagaacucuuccagaagccauuguaucuucacaauuuaccucgaggcgcacucucggacccuguccgaagagaaauauaucacaagcaagaucaaucuuguggaccuggccggaucugaacgccucggcaaguccgggagcgagggacaagugcugaaagaagcuaccuacauuaacaagucccugucuuuucucgagcaggccaucauugcucugggcgaccagaaaagagaucauauccccuuccggcagugcaaacuuacccacgcccugaaggacagccucggcgggaauuguaacaugguccuggugacaaauauuuauggagaggcggcccaacuugaagagacgcuguccagccuccgcuuugcuucuagaaugaagcugguuaccacagaaccugccaucaacgagaaauacgaugcugaacggauggugaagaaucuggagaaggagcucgcccugcuuaaacaggaacuggccauccacgacucccucaccaacagaacauucgucaccuaugauccgauggacgagauucagaucgcugaaauuaacagccaagugcgccgguaccuggagggcacgcuugaugaaaucgacauuaucucucugagacagaucaaggagguuuuuaaucaguuccgcgugguccucagccagcaagagcaggaaguggaguccacacugcggagaaaauauacccugauugaucgcaacgacuucgcggccaucucugcuauucagaaggccgggcucgucgauguggacggacaucugguuggcgaacccgaggggcagaauuuuggacuuggcguggccccuuucagcaccaaacccggcaagaaggcuaaauccaagaaaacauuuaaggagccucugagcucucucgcccggaaagaaggggcguccagccccgucaacggaaaggaccuggauuacgugucuaccuccaagacacaacugguuccgagcuccaaagacggcgaugugaaggacaugcuuucuagagaucgcgagacgagcuccaucgaaccucuccccucugacagcccuaaagaggaacugcggcccauuagacccgauaccccuccguccaagcccgucgcuuucgaggaguuuaaaaaugaacaggggagcgagaucaaccgcauuuucaaggaaaauaagucuauccugaacgagcggagaaaacgggccuccgaaacaacccagcacaucaaugccauuaagcgcgagaucgacgugacaaaagaggcucucaacuuucaaaagagccugagagaaaaacagggaaaguacgagaauaaaggccuuaugauuaucgaugaagaggaguuccugcucauucugaagcugaaggaccuuaaaaagcaguaucggucugaauaccaggaucucagagaccugcgcgccgagauccaguauugccaacaucugguggaucagugucggcacagacuccugauggaauuugacaucugguacaacgaguccuucguuauuccugaagacaugcagauggcucuuaaacccgggggcagcauccgcccuggaaugguccccgugaauagaauugugucucugggcgaggaugaccaagauaaguuuagccagcuccagcagcggguccugccggaggggccugacuccaucagcuucuauaacgccaaagugaagauugaacaaaagcauaauuaccugaaaaccaugaugggacuucagcaggcgcaccgcaaguga

SEQ ID NO: 71186 - RNA, 2145 nt, Artificial Sequence
  derived and/or modified sequence opt5 from KIFAP3__Homo_sapiens__NP_001191443
augagcaucgcccugggcaacaccuacagacggucccucucugacagcgagacaguguccguccugcaggcuucucuuugcgaagagaagaaagaaaagagcuccaaacccaaggauccuccgcccuucgaggggauggaaauugacgagguugccaauaucaacgauauggacgaguauauugaacugcucuacgaggauaucccugacaaagugcgcggaucugcgcugauucuucaacuggcuagaaaucccgauaaccucgaagaacugcugcucaaugagacggcccugggcgcccuugcucgggugcugcgcgaagacuggaagcagagcgucgagcucgccaccaacaucaucuauaucuuuuucuguuuuuccagcuucucucaguuucacgggcugauuacacauuacaagauuggagcucuuugcaugaauaucauugaucacgaacugaaaagacaugagcucuggcaggaggagcuguccaagaaaaagaaagccguggacgaggauccugaaaaccaaacccugcggaaggacuaugagaagacauucaaaaaguaccagggccucguugugaaacaggaacagcugcuucgcgucgcgcuguaucuccugcuuaaucuggccgaggauaccagaacagaacucaagaugcggaacaaaaauaucgugcacaugcugguuaaggcucuggaccgcgacaacuuugagcuccugauucuuguggucagcuuccugaaaaagcucucuaucuuuauggagaauaagaacgauaugguggaaauggacaucguggagaaacuggucaagaugauucccugugaacaugaggaucuucugaauaucacccucagacugcugcucaaccuguccuucgacacggggcuucggaacaaaaugguucaagugggacugcucccuaagcugaccgcccugcuuggcaaugauaacuacaaacagauugcuaugugcgugcucuaccacaucagcauggacgaucgcuuuaagucuauguucgccuauacagacuguauuccgcagcugaugaagaugcuguuugaaugcuccgaugagagaaucgaccucgagcugaucagcuucuguauuaaucuugcggccaacaaacggaauguccagcugaucugcgaaggcaacgggcucaagaugcugaugaaacgcgcucugaaguucaaagauccccuucucaugaagaugauuagaaauaucucccaacacgacggaccuaccaagaaccuguuuauugacuacgugggcgaucuggccgcucagaucucuaaugacgaggaagaggaguucguuaucgaaugucucgggacacuggccaaccuuaccauucccgaucuggacugggagcucgugcugaaagaauauaagcuggucccuuaccuuaaagauaagcucaaacccggagccgcugaggacgaucuggugcuggaaguugugaucaugauuggcacggucagcauggacgauuccugcgcggcccuccuggcuaagagcgggaucauuccggcccuuaucgagcugcucaaugcccagcaagaggacgaugaauuugugugucagauuaucuaugucuucuaccagaugguguuucaucaggcuacacgggacguuaucauuaaggagacccaagccccugcguaucugaucgaucugaugcacgacaaaaacaaugaaauuagaaaggugugcgacaacacacuugauaucauugcugaguacgacgaagagugggccaaaaagauccagucugagaaauuccgcuggcauaauucccaguggcucgaaauggucgagagccggcagauggaugaaucugagcaauaccuguauggagacgauagaaucgaacccuacauucacgagggcgacauccuggagcgcccugaucucuuuuauaacagcgacggccugauugccuccgaaggggcuaucucucccgauuucuuuaacgacuaccaccuucagaauggagaugugguuggccagcauagcuuccccgggucccugggaauggacggcuuugggcagccugugggcauucucggacggccggccaccgcuuauggcuucagacccgaugagccuuacuauuacggguacggaagcuga

SEQ ID NO: 71187 - RNA, 2022 nt, Artificial Sequence
  derived and/or modified sequence opt5 from KIFC1__Homo_sapiens__NP_002254
auggacccccagagaagcccucugcucgaggugaagggcaacaucgaacugaaacggccgcuuauuaaggcccccucccaacugccucucucugggagccgccugaaaagacggcccgaucagauggaggacggacuugaaccugagaagaaacgcaccagaggccugggggcuacaacgaagaucaccacaucccacccccgggucccuucucucaccacaguuccgcagacccagggacaaacaaccgcccagaaggugagcaaaaagacgggcccccgcugcuccaccgcgauugcuacagggcugaaaaaucagaagccugugcccgccgucccugugcagaaaucuggaaccagcggcguucccccgauggccggcgggaagaagccuuccaaaagacccgcuugggaucugaagggacaacucugugaccugaacgccgaacuuaaacggugccgcgagagaacacagacccuggaucaggagaaucagcaacuccaggaccagcugcgggaugcucaacaacaggugaaggcccuuggcacggaacgcacaacccuggaggggcaucucgcgaaaguccaggcccaggcugaacagggacagcaggagcugaagaaccugagagccugugugcucgagcuggaggaacggcuuagcacacaagaaggccugguucaggagcuccagaaaaagcaaguggaacugcaggaggagcgcagagggcuuaugucucagcuggaagagaaggaacggagacuccagaccuccgaggcugcccugucuagcucccaggcggaagucgccagccugcgccaagagaccguggcucaggccgcucuccugacagagcgggaagagagacuucacggacuggaaauggagcgccggagacuccauaaucagcugcaagaacuuaaaggcaacauccgcguguucugccgggucagaccuguucugcccggcgagcccacgccuccgcccgggcuccugcuguuuccuucuggacccggcgggccuuccgaucccccgacccgccucagccugucccggucugacgagagacgcggaacacuuagcggcgccccugcucccccuacccggcacgacuucuccuuugauagaguguuucccccugggagcggacaggacgaaguguucgaggaaauugcuaugcugguccagucugcgcucgauggcuaccccguguguaucuucgccuauggccagacaggguccggaaagaccuuuacgauggagggcgggccgggaggcgacccucaacuggaggggcugaucccccgggcccuucgccaucucuucagcguugcccaggaacugucuggccagggauggacauacagcuuuguggccuccuaugucgagauuuacaaugaaaccgugagagaccugcucgcuaccggcacacggaaagggcagggaggcgagugcgaaaucagacgcgccgggcccggaucugaggagcugaccguuacaaacgcgcgguaugugccugucagcugugaaaaggagguggaugcccuucugcaccucgcuagacaaaaucgcgccgucgcuagaacggcccagaacgaacgguccagccgcucucacuccguguuccagcugcagauuagcggcgagcauucuuccagagggcugcaaugcggcgcuccgcuuagccucguugaccuggccggauccgaacggcuggaucccggccucgcgcuggggccuggagagcgcgagagacuucgggaaacccaggccaucaauucuagccuguccacacucggccuggugauuauggcucugucuaacaaagagagccacguccccuaccgcaauuccaagcugaccuaucuccugcagaacagccuugggggaucugccaagaugcucauguuugugaauaucuccccucuggaagagaacguuagcgaaucucuuaacucccugagauucgcuagcaaagugaaucaaugugucauuggcacagcccaggcgaaccggaaguga

SEQ ID NO: 71188 - RNA, 2481 nt, Artificial Sequence
  derived and/or modified sequence opt5 from KIFC3__Homo_sapiens__NP_001123572
auggugcccagcagacggaccuggaaccugggcgccacaccuucccuccgcgggcuguggagagucggacgggcuccggagcccgaaccuggcauggcccgccccgcgccugcucccgccucuccugccgcuagaccguucccccacacggggccuggacggcuucgcaccggcagagggaaggacacacccguuugcggagaugaggacagcuccgcccggucugcugcccgcccugcgcuggcccaguguagagcucucagcguggauugggccggccccggcuccccgcaugggcuguaccuuacccugcaaguggaacaccucaaagagaagcugaucucucaggcucaggaagucagccggcugcgcuccgagcucggaggcacagaccuggagaaacauagagaucuucugaugguggaaaaugagcggcuccgccaggaaaugagacggugcgaggccgagcugcaagaacuuagaaccaagccugcggggcccuguccuggaugcgagcacagccaggaaucugcccagcugcgcgacaaacucucccagcugcaacuggagauggcugaaagcaagggcaugcucucugagcugaaccuugagguucagcagaagacagaucggcuggccgaaguggagcucagacugaaagacugucuugcugaaaaggcccaggaggaagaacgccugucccggagacuccgcgauagccaugagaccauugccucucugcgggcucaauccccucccgucaaauaugugaucaagacgguugaaguggagagcuccaaaaccaagcaggcgcugucugaaagccaggccagaaaucaacaccuccaggagcaggucgcuaugcagcgccaagugcugaaggaaauggagcagcagcuucaguccagccaccaacugacagcccggcucagagcccagauugcuauguacgagucugaacuggagcgcgcccaugggcagaugcuugaagagaugcagucccuggaggaagacaaaaaccgggcgaucgaggaggcuuuugccagagcccaaguggagaugaaggcuguccacgaaaaucucgccggaguucggaccaaccugcugacacuccagcccgcucugcgcacccuuacgaaugauuauaacggccugaaaagacaggugcggggcuucccgcuccugcugcaggaggcccuuagaagcgugaaggcggagauugggcaagccaucgaagaggucaauucuaacaaucaggaacuccugcgcaaauaccggagagagcugcagcuccgcaagaaaugccauaacgaacuggugagacuuaagggaaauauccggguuauugcucgcgugagacccgucacaaaggaggacggcgaggggccugaagccaccaacgcugugacauuugaugccgacgacgauagcaucauucaccuucuccacaaaggaaagcccguuuccuucgagcuggacaaaguguuuucuccucaagcgagccagcaggaugucuuccaggaagugcaagcccuggucaccuccuguaucgacggcuuuaaugugugcauuuucgcuuaugggcagaccggagccggcaagacauacacgauggagggcaccgcugaaaaccccgggaucaaccagcgggcccuucagcuccuguuuagcgagguucaagagaaagccucugauugggaauauacaauuaccguguccgcugcggagaucuacaaugaaguccugcgcgaccuccugggaaaggagccgcaggagaagcuggaaaucagacuguguccugauggcagcgggcagcucuacgugcccggacugacagaguuccagguucaaucuguggacgauauuaacaaagucuuugaguucggccauaccaaucggacgacagaauuuaccaaccugaaugaacacuccagccgcucccaugcccuucucaucgugaccgugagagggguugacugcucuacaggccugcggaccacaggaaagcugaaccucgucgaucuggcuggcagcgagcgcguggggaaauccggagccgagggcucuagacuucgggaagcccagcacauuaauaagagccuguccgcucucggggacgugaucgccgcgcugagaagccgccagggacaugucccuuuccggaacucuaaacugacguaucuucuccaagacucccugagcggcgauucuaagacccugauggugguucaggugucccccgucgagaagaauacaagcgaaacccucuacucucugaaauucgcugagagagugcgcagcguugaacuugggccuggccugcggagagccgagcucggauccuggagcucucaggagcaccuggaaugggagcccgccugucagacaccgcaaccuuccgcucgcgcccacagcgcgcccuccucuggcaccagcucccggcccgggucuauuagacgcaagcugcagccuagcgcuuga

SEQ ID NO: 71189 - RNA, 1182 nt, Artificial Sequence
  derived and/or modified sequence opt5 from KIN__Homo_sapiens__NP_036443
augggaaagagcgacuuccugacccccaaagccaucgcuaacagaauuaaguccaaagggcuccagaagcugcggugguacugccaaaugugucagaaacagugccgcgaugagaauggauuuaagugucacugcaugucugaaagccaucagagacaacuucugcucgccuccgagaacccucagcaguucauggacuauuuuucugaagaguuccggaaugauuuucuggaacuucugcgcagacgguucggcacaaagcgcgugcacaacaauaucgucuacaacgaguauauuagccauagagagcacauccauaugaaugcgacgcagugggaaacccucacagacuuuaccaaauggcuggggcgggagggacuguguaagguugaugaaacaccgaaaggcugguacauucaauauaucgaccgcgaucccgagaccaucagacggcagcucgagcuggaaaagaaaaagaagcaggaccuugaugacgaggagaaaacagcuaaguucauugaagaacaggugcgcagagggcuggagggaaaagagcaagaagugccuaccuuuacggagcucucccgggaaaacgaugaggaaaaggucaccuucaaucugucuaaaggcgccugcagcuccagcggcgccacaucuuccaagagcucuacccuugggcccuccgcucugaaaacaaucggaagcucugccuccgugaagcgcaaggagagcucccagucuagcacccaguccaaagagaagaaaaagaaaaagagcgcucucgacgaaauuauggagaucgaagaggaaaagaaaagaacggcccggacagauuacuggcugcaaccugagauuaucguuaagauuaucaccaaaaagcugggcgagaaauaucacaagaagaaagcgaucgugaaggaagucauugacaaauacacagccgugguuaagaugaucgacucuggggauaaacucaagcuggaccagacccaccuugagaccgugauucccgcuccuggaaagagaauccugguccucaacggcggguaccgcggaaaugaaggcacacuggaguccauuaacgagaaaacguuuagcgccaccaucgugaucgaaacaggcccgcuuaaggggcggagaguggagggcauucaguaugaagauaucucuaaacuggcuuga

SEQ ID NO: 71190 - RNA, 1047 nt, Artificial Sequence
  derived and/or modified sequence opt5 from KIR2DL1__Homo_sapiens__NP_055033
augagccugcucguggucuccauggccugcguuggcuucuuucugcuucagggggcuuggccccacgagggagugcauagaaagccuucucugcucgcccacccgggccggcuggugaaaagcgaagagaccgucauccuucaauguugguccgacgugauguucgaacauuuucugcuccaccgcgaggggauguucaacgauacacugagacugauuggagaacaucacgacggcguuucuaaggcgaauuuuagcaucucccggaugacgcaggaucucgcugggaccuaccgcugcuauggaucugugacacacagccccuaccaggucuccgccccuagcgacccccuggauauugugaucauuggccuuuaugagaaaccuucucuguccgcccagcucggccccaccguucuggcuggggagaacgugacacuuagcuguucuuccagaagcucuuacgacauguaucaucugucccgggaaggagaggcccacgaacgcagacucccugcuggcccgaaggucaaugggaccuuccaagccgauuuuccccugggaccugcgacacauggcgggaccuaccggugcuucggcagcuuucacgacucccccuaugaguggucuaaaagcuccgauccucugcucgugagcgugacgggaaaccccucuaauuccuggccgagcccuaccgagcccucuagcaagacaggcaacccucgccaucugcacauccuuaucgggaccuccgucguuauuauccuguucauucuccuguuuuuccuucugcacagaugguguucuaauaagaaaaacgccgcugugauggaccaggaaagcgccggaaaucggacagcuaacuccgaggauagcgacgaacaggauccccaggaggugaccuacacgcaacucaaucauugcgucuuuacacagcgcaagaucaccagacccucucagcggccuaaaacaccgcccaccgacauuaucguguacaccgaacugccuaacgccgagucccgcagcaagguugugucuugucccuga

SEQ ID NO: 71191 - RNA, 1047 nt, Artificial Sequence
  derived and/or modified sequence opt5 from KIR2DL2__Homo_sapiens__NP_055034
augagccugaugguggucuccauggccugcguuggcuucuuucuccugcagggggcuuggccccacgagggagugcauagaaagccuucucuucuggcccacccgggccggcucgugaaaagcgaagagaccgucauccugcaauguugguccgacgugcgcuucgaacauuuucuucugcacagagaggggaaguucaaagauacacuccaucugauuggagaacaccacgacggcguuucuaaggcgaacuuuagcaucgggcccaugaugcaggaucuggcuggaacguaccggugcuauggcuccgugacccauucuccuuaccagcucagcgcccccuccgacccucuggauauugucaucacaggccuuuaugagaaacccagccugucugcccagccugggccgaccgugcucgcuggagaguccguuacacugagcuguucuucccgcagcucuuacgacauguaucaccuuuccagagaaggcgaggcccaugaaugccgguucagcgcugggcccaaggugaauggaaccuuucaagccgauuucccucugggccccgcgacacacgggggaaccuaccgcuguuuuggcuccuucagagacucuccuuaugaguggagcaacuccagcgauccccuccuggucucugugacgggcaauccguccaacagcuggccuucucccaccgagccuagcuccaagacagggaauccccggcaucugcacauucucaucggaaccucuguggucaucauucuguuuauccuucuguucuuucuccugcaccgcuggugcagcaacaaaaagaaugccgcuguuauggaccaggaauccgccggcaacagaacagcuaauagcgaggauucugacgaacaggauccccaggaggugaccuacacgcaacuuaaccauuguguguucacacagcggaaaauuacccgcccuucccagagaccgaagacacccccuaccgacaucauugucuacaccgaacugcccaaugccgagagccggucuaaagugguuuccugcccuuga

SEQ ID NO: 71192 - RNA, 1026 nt, Artificial Sequence
  derived and/or modified sequence opt5 from KIR2DL3__Homo_sapiens__NP_056952
augagccugaugguggucuccaugguuugcgugggcuucuuucuccugcagggggccuggccccacgagggagugcauagaaagccuucucuucuggcucacccgggcccccucgucaaaagcgaagagaccgugauccugcaauguugguccgacguucgguuccagcauuuucuucugcaccgcgaagggaaguucaaagauacacuccaucugauuggagagcaccacgacggcgugucuaaggccaacuuuagcaucgggccuaugaugcaggaucuggcgggaacguacagaugcuauggcuccgucacccauucucccuaccagcucagcgcuccuuccgacccccuggauauugugaucacaggccuuuaugaaaaaccuagccugucugcccaaccggggcccaccguucucgccggagaguccgugacacugagcuguucuucccggagcucuuacgacauguaucaccuuucccgcgagggcgaagcucaugagagacgguucagcgccgggccuaaggucaauggaaccuuucaggcugauuucccccugggcccugccacacacgggggaaccuaccgcugcuuuggcuccuucagagacucucccuaugaauggagcaacuccagcgauccgcuccuggugucugugacgggcaauccuuccaacagcuggcccucuccuaccgagcccagcuccgagacagggaauccccggcaccuccauguccucauuggaaccucuguugugaucauccuguuuauucuucugcuguucuuucugcuucaccgcugguguugcaacaagaaaaaugcgguggucauggaccaggaaccugccggcaacagaacagugaaucgggaggauagcgacgaacaggauccgcaagagguuaccuacgcucagcugaaccauuguguguucacgcagcgcaagaucacaagacccucccagcggccuaaaacacccccuaccgacauuaucgucuacaccgaacuccccaaugccgagccguga

SEQ ID NO: 71193 - RNA, 1029 nt, Artificial Sequence
  derived and/or modified sequence opt5 from KIR2DL4__Homo_sapiens__NP_001074239
augagcaugucccccaccgugaucauucuggccugccucggcuucuuucuggaccagucugucugggcucacguugggggacaagauaagccuuucuguagcgccuggccguccgcgguggugccccagggcgggcaugucacacuuagaugccacuaccggcgcggauuuaacaucuucacgcuguauaaaaaggacggcgugccuguucccgagcucuacaauagaaucuuuuggaacucuuuccugauuagcccugugacccccgcucaugccgggacauaucggugucgcggauuucacccucauuccccgaccgaauggucugcccccagcaauccucuugucauuauggugacaggccuguacgagaaacccucccucaccgcuagaccuggccccacaguucgggccggggaaaacgugacccugagcuguucuucccagagcucuuucgauaucuaucaccugucccgcgagggagaagcucacgagcucagacugccggccgucccuagcaucaauggcacguuucaggcggacuucccccuugggccugccacccauggagagacauaccggugcuuuggcucuuuccacgggucccccuaugaauggagcgaucccuccgacccucugccggugucugugaccggaaaccccagcuccagcuggccuucucccacagagccuuccuuuaagaccgaugcugccgucaugaaucaagaacccgcuggccaucgcacgguuaacagagaggacagcgaugagcaggacccgcaggaagugacauacgcccagcucgaucacugcauuuucacccaacggaaaaucacaggcccuucucagcgcagcaagagacccuccaccgacaccucuguguguauugagcugccuaaugcggaaccccgggcccuuagcccugcucacgagcaucacucccaggcccugauggggagcucucgcgaaacaacggcucucucccagacccaacuggccagcucuaacguccccgccgcuggaaucuga

SEQ ID NO: 71194 - RNA, 1128 nt, Artificial Sequence
  derived and/or modified sequence opt5 from KIR2DL5A__Homo_sapiens__NP_065396
augagccugauggugaucuccauggccugcgucggcuucuuucuccugcagggggcuuggacccacgagggaggccaagacaagccccuucugucugccuggccuagcgcgguugugccgagagggggacaugugacacuccugugucggucccgccuuggcuucacgauuuuuagccuguacaaagaagaugggguccccgugccugagcucuauaacaagaucuucuggaaaagcauucugaugggacccguuaccccugcucacgccggcacauacagaugccggggcucccauccccgcucuccuaucgaauggagcgccccguccaauccccuggugauugucgugaccgggcucuuuggaaagccuagccugucugcucagcccggcccuacaguuagaaccggggagaacgugacacuuuccuguagcucucgguccagcuucgacauguaucaccugucucgcgaaggcagagcccaugagccccggcucccggcugucccuuccgugaauggaaccuuucaggccgauuucccccuggggccugcgacgcacggaggcaccuacacaugcuuuggcagccuucacgacucccccuaugaguggucugaucccagcgacccucugcucguguccgucaccgggaacucuucuuccagcucuagcuccccgacagaacccucuagcaaaaccggaauccgcagacaucugcacauccugauuggcacguccguugccaucauucucuucaucauucuguuuuucuuucuucugcauuguugcuguagcaauaagaagaacgcugccgugauggaucaggagccugcuggggaccggacagugaaucgcgaagauucugacgaucaagacccccaggaggucaccuacgcccagcucgaucacugcguguucacacagaccaaaaucaccuccccuagccaaagacccaagacaccgccuacggacaccacaauguauauggagcugcccaacgcgaaaccucggucucuuucccccgcccacaagcaucacagccaggcucugcgcggauccucuagagaaaccacagcccucagccagaaucggguugcuuccucucaugugccugccgccggcauuuga

SEQ ID NO: 71195 - RNA, 1128 nt, Artificial Sequence
  derived and/or modified sequence opt5 from KIR2DL5B__Homo_sapiens__NP_001018091
augagccugauggugaucuccauggccugcgucggcuucuuucuccugcagggggcuuggacccacgagggaggccaagacaagccccuucugucugccuggccuagcgcgguugugccgagagggggacaugugacacuccugugucggucccgccuuggcuucacgaucuuuucucuguacaaagaagaugggguccccgugccugagcucuauaacaagauuuucuggaaaagcauucugaugggacccguuaccccugcucacgccggcacauacagaugccggggcucccauccccgcucuccuaucgaauggagcgccccguccaauccccuggugauugucgugaccgggcucuuuggaaagccuagccugucugcucagcccggcccuacaguuagaaccggggagaacguggcccuuuccuguagcucucgguccagcuucgacauguaucaccugucucgcgaaggcagagcucaugagccccggcucccggccgucccuuccguggauggaacauuucaggcggacuucccccuggggccugccacccacggaggcacguauaccugcuuuagcucccuucacgauucucccuacgaguggagcgaccccuccgauccucugcucgugagcgucacaggcaauucuuccagcucuagcuccucuccgaccgaacccagcuccaaaacagggauccgcagacaucugcacauccugauuggaaccagcguugcuaucauucucuucaucauucuguuuuucuuucuucugcauuguugcuguucuaacaagaagaaugccgcugugauggaccagggcccugccggggaucggacggugaaccgcgaggacuccgaugaccaagauccccaggaagucacauacgcgcagcucgaccacugcguguucacccagacaaaaaucaccagcccuucucaaagacccaaggccccgccuaccgacacaacgauguauauggagcugcccaaugcuaaaccucggucccuuagccccgcccacaagcaucacucccaggcucugcgcggaucuagcagagagaccacagcccucucccagaaccggguugccucuagccaugugccugcugcgggcauuuga

SEQ ID NO: 71196 - RNA, 915 nt, Artificial Sequence
  derived and/or modified sequence opt5 from KIR2DS1__Homo_sapiens__NP_055327
augagccugaccguggucuccauggccugcguuggcuucuuucuccugcagggggcuuggccccacgagggagugcauagaaagccuucucuucuggcccacccgggccggcucgugaaaagcgaagagacagucauccugcaauguugguccgacgugauguucgaacauuuucuucugcaccgcgaggggauguucaacgauacgcucagacugauuggagaacaucacgacggcguuucuaaggcgaauuuuagcaucucccggaugaaacaggaucuggcugggaccuaccgcugcuauggaucugugacacacagccccuaccagcucuccgccccuagcgacccccuggauauugucaucauuggccuuuaugagaagccuucucuguccgcccagcccggcccuaccgugcucgcuggggagaacguuacacugagcuguucuuccagaagcucuuacgacauguaucaucuuucccgggaaggagaggcccacgaacgcagacugccggcuggcaccaaagugaaugggacauuccaagccaacuuuccccucggaccugcgacccauggcgggacguaccggugcuucggcagcuuucgcgauucccccuaugaguggucuaagagcuccgacccucugcuggucagcgugaccggaaaucccucuaacuccuggccgagcccuacagagcccucuagcgaaaccggcaauccuagacaccuccacgugcugaucgggacauccgucguuaagauccccuucaccauucuucuguuuuuccuccugcaucggugguguucugauaaaaagaacgccgcugugauggaccaggagcccgccggaaaucgcacggugaacagcgaagauuccgacgagcaggaucaccaggaagucagcuacgcuuga

SEQ ID NO: 71197 - RNA, 1017 nt, Artificial Sequence
  derived and/or modified sequence opt5 from KIR2DS2__Homo_sapiens__NP_001278624
augagccugaugguggucuccauggccugcguuggcuucuuucuccugcagggggccuggccccacgagggagugcauagaaagccuucucuucuggcccacccgggcccccucgugaaaagcgaagagaccgucauccugcaauguugguccgacgugcgguucgaacauuuucuucugcaccgcgaggggaaguacaaagauacacuccaucugauuggagaacaccacgacggcguuucuaaggcgaacuucagcaucgggccuaugaugcaggaucuggcuggaacguauagaugcuacggcuccgugacccauucucccuaucagcucagcgccccuuccgacccccuggauauugucaucacaggccuuuacgagaaaccuagccugucugcccagccggggcccaccgugcucgcuggagaguccguuacacugagcuguucuucccggagcucuuaugacauguaccaccuuucccgcgaaggcgaggcccaugaaagacgguuuagcgcugggccuaaggugaauggaaccuuccaagccgauuuuccccugggcccugcgacacacgggggaaccuaucgcugcuucggcuccuuuagagacucucccuacgaguggagcaacuccagcgauccgcuccuggucucugugacgggcaauccuuccaacagcuggcccucuccuaccgagcccagcuccaagacagggaauccccggcaccuucaugugcucauuggaaccucugucguuaaaaucccuuucacaauccugcuguuuuuccugcuccaccgcugguguagcaacaagaaaaaugccgcugugauggaccaggaaccggccggcaacagaaccgucaauuccgagcgggaaauuacgcgccccagcgagagaccuaagacacccccuaccgauacaucuauguacaucgaacugcccaacgcugagccgcgguccaaagugguguuuugcccucgcgcuccccagagcgggcuugagggaauuuucuga

SEQ ID NO: 71198 - RNA, 915 nt, Artificial Sequence
  derived and/or modified sequence opt5 from KIR2DS3__Homo_sapiens__NP_036445
augagccugauggugaucuccauggccugcgucggcuucuuuuggcuccagggggcuuggccccacgagggauucagacggaagccuucucugcuugcccauccgggccgccugguuaaaagcgaagagaccgugauucuccaauguugguccgacgugauguuugaacacuuccugcuucauagagaggggacauuuaacgauacgcugcggcucaucggagaacacauugacggcgucucuaaggcgaauuucagcaucgggcgcaugagacaggaucuggcuggaaccuaccggugcuauggcuccgugccccauucuccuuaccaguuuagcgcccccuccgacccucuggauauuguuaucacaggccucuaugagaaacccagccugucugcccagccugggccgaccgugcuugcuggagaguccgucacacugagcuguucuuccuggagcucuuacgacauguaucaccucuccaccgaaggcgaggcccacgaacgcagauucagcgcugggcccaaggugaacggaacauuucaagccgauuucccucugggccccgcgacccaagggggaacguaccggugcuuuggcuccuuccaugacucuccuuaugaguggagcaaauccagcgauccccuucugguuucugugaccggcaauccguccaacagcuggccuucucccacagagccuagcuccaagaccgggaauccccgccaccuccauguccugaucggaacaucuguggugaagcugcccuuuaccauucuccuguucuuccuucugcacagaugguguagcgacaaaaagaacgccuccgucauggaucagggcccugcugggaaucggacgguuaaccgcgaagacagcgaugagcaggaccaccaggaagugucuuacgccuga

SEQ ID NO: 71199 - RNA, 915 nt, Artificial Sequence
  derived and/or modified sequence opt5 from KIR2DS4__Homo_sapiens__NP_036446
augagccugauggugaucauuauggccugcgucggcuucuuucuccugcagggggcuuggccccaagagggaguucacagaaagccuuccuuccuugcccugccgggccaucucgugaaaucugaagagaccgugauccugcaguguuggagcgacgucauguuugaacacuuccuucugcaucgggaggggaaguuuaacaauacacuccaccugauuggagaacaucacgauggcguguccaaagcgaacuucucuaucgggcccaugaugccuguucuggcuggaacguaccgcugcuauggcagcgugccccacuccccuuaccagcucucugcccccagcgacccucuggauauggucauuaucggccuuuaugagaagccgucccugagcgcccagcccgggccuaccgugcaagcuggagagaauguuacacucucuuguuccagcagaucuuccuacgacauguaucaucugagccgggaaggcgaggcccacgaacgcagacuucccgcugugcggucuaucaacgggaccuuucaggccgauuucccucugggacccgcgacacauggcgggaccuaccgcugcuuuggauccuucagagacgccccguaugaguggagcaauuccucugauccucuccuggucagcgugacaggcaaccccuccaauagcuggccuucucccaccgagcccuccagcaaaacgggcaacccucggcaucugcacgugcucauugggaccucugucguuaagaucccguuuacaauucugcuuuucuuucugcuccaccgcugguguagcgacaagaaaaaugcugccgugauggaucaggaacccgcuggaaacagaaccgucaauuccgaggacucugaugaacaggaccaccaagaggugagcuacgccuga

SEQ ID NO: 71200 - RNA, 1335 nt, Artificial Sequence
  derived and/or modified sequence opt5 from KIR3DL1__Homo_sapiens__NP_037421
augagccugaugguggucuccauggccugcguuggccucuuccuggugcagagagcugggccccacaugggaggccaagacaagccuuuucuuucugccuggccgagcgcgguggucccccgcgggggacaugugacccugcggugucacuacagacaucgguucaacaauuuuaugcucuauaaagaggaucgcauccacauuccuaucuuccauggcagaauuuuucaggaauccuucaacaugucucccguuacaacggcucacgccgggaauuauaccugccggggaagccacccucauucccccacaggcuggucugccccuagcaacccgguggucaucauggugaccggcaaucaccgcaagcccucccugcuugcucauccugggccccugguuaaaagcggagagagagugauucuccaguguuggucugacaucauguuugaacacuucuuucugcacaaggagggcaucuccaaagauccuagccggcuggucgggcagauucaugacggagugucuaaggccaacuucuccaucggccccaugaugcucgcucuggccgggacauaccgcugcuacggaagcgugacccacacaccguaucaacuuucugcgccuuccgauccccuggacauugucguuaccggcccuuacgaaaagcccagccucuccgcccagcccggcccuaaagugcaggcuggggagucugugacgcugagcuguuccagcagaucuuccuaugauauguaccaucuuagccgggagggaggcgcccacgaacgcagacugccggcuguccggaaggugaaucgcaccuuucaggccgacuucccccucgggccugcgacacauggaggcaccuacagaugcuuugggucuuuccggcacagccccuaugagugguccgauccuucugacccccugcugguuagcgugacaggaaacccguccagcucuuggccuucccccaccgaaccuagcucuaaauccggcaaucccagacaccuccauauccugauuggcacgagcgucgugaucauucuuuucauccugcuccuguuuuuccuucugcaccucugguguuccaacaagaaaaaugccgcuguuauggaucaagagccugccgggaaccgcacagcuaauucugaggacagcgaugaacaggaccccgaggaagugaccuacgcccagcuggaccauugcgucuuuacacagcggaagaucaccagaccgucccaacgcccuaagaccccucccacagauacgauucuguauaccgagcuccccaacgccaaaccgcggucuaagguggucagcugucccuga

SEQ ID NO: 71201 - RNA, 1317 nt, Artificial Sequence
  derived and/or modified sequence opt5 from KIR3DL2__Homo_sapiens__NP_001229796
augagccugaccguggucuccauggccugcguuggcuucuuucuccugcagggggcuuggccccuuaugggaggccaagacaagccuuuccugucugccagaccgagcacaguggugccccgcgggggacacgucgcgcuccagugucauuaccggagaggcuuuaacaauuucaugcuguauaaagaggaucggucccacgugccuaucuuucaugggcgcauuuuccaggaaucuuuuaucaugggacccguuacgccugcucacgccggcaccuacagaugccggggcagccgcccccauucccuuacaggguggucugccccuagcaacccgcuggugauuauggucaccggaaaucacagaaagcccucccuccuggcucacccuggcccccugcucaaaagcggggagacagugauccugcaguguuggucugacguuauguucgaacacuuuuuccuucaucgggagggaauuuccgaagauccuagccgccuggugggccaaauccaugacggggucucuaaggccaacuuuuccaucggaccccucaugccggugcuggcuggcaccuauagaugcuacggcagcgugccucacucucccuaucagcuuuccgccccuagcgauccccuggacauugucaucacagggcucuacgagaaacccucccugucugcgcagccuggaccgaccguucaggccggcgagaaugugacgcugagcuguuccagcuggucuuccuaugauauuuaccaccucagccgggaaggggaggcucaugaacgcagacugcgggccgugcccaaggucaaccgcaccuuccaagcugacuuuccucuuggacccgccacacacggcgggaccuacagaugcuucggaucuuuccgggcgcugccuuguguguggagcaauuccucugauccccuccugguuagcgugacaggcaucugcagacaucuucacguccugauuggcaccuccgugguuaucuuucucuucauucugcugcucuuuuuccugcuuuaucgcugguguagcaacaagaaaaaugccgcugugauggaccaggagccggccggggaucggacggucaacagacaggacucugaugagcaggacccucaagaagugacauacgcucagcuggaccauugcgucuuuauccagcgcaagaucucccggcccagccaaagaccuaaaacaccccucaccgauaccucuguguauaccgagcugccuaaugccgaaccccgcuccaagguugugagcuguccgcgggccccucaguccggacuugagggcgucuucuga

SEQ ID NO: 71202 - RNA, 1233 nt, Artificial Sequence
  derived and/or modified sequence opt5 from KIR3DL3__Homo_sapiens__NP_703144
augagccugaugguggucuccauggccugcguuggcuucuuucuccuggaggggcccuggccucacgugggaggccaggacaagccguuccuuucugcuuggcccgggaccguggucagcgaaggacaacaugugacacugcaguguagaucccggcucggcuuuaacgaguucucucugagcaaagaagaugggaugccuguucccgagcuuuacaaucgcaucuuuagaaacuccuuccugaugggaccugugacgcccgcccacgcgggcaccuaucggugcuguucuagccauccucacuccccgacaggcuggagcgcucccucuaauccugucgugauuaugguuaccggggugcaucgcaagcccucccuccuggcccacccuggaccccuggucaaaagcggcgaaacagugauccuccagugcuggucugacgugagauuugagcgguuccugcuucaccgcgaggggauuaccgaagauccgcugagacucgucggacagcugcaugacgccggcucccaaguuaacuacagcauggggccuaugacacccgcucuugccggaaccuaucgguguuuuggcucugugacgcaccuuccuuacgagcucuccgcucccagcgauccccuggacaucguggucgugggccuguaugggaagccuucccucucugcccagccgggacccaccguucaggcgggcgaaaaugugacacugagcugcuccagccgcucucuuuucgauauuuaccaucuguccagagaggccgaggcuggggaacuccggcugaccgccguccuucgcgugaacggaacauuucaggcuaauuucccucugggccccguuacccacgggggaaacuauagauguuuuggcagcuuccgggcccucccucacgcguggucugaccccagcgauccgcugccuguguccgucacgggcaauucucgcaaccugcaugugcucaucgggacaagcgucgugaucauucccuucgccauccugcuguuuuuccugcuccacagauggugcgcuaauaaaaagaacgccguugugauggaccaagagccugcuggaaaucggaccgucaacagagaagauuccgacgagcaggauccccaggaagugacauacgcccagcugaaucauuguguuuuuacccaacgcaagauuacccggccuagccagagacccaaaacaccgccuacggacaccucuguguga

SEQ ID NO: 71203 - RNA, 1902 nt, Artificial Sequence
  derived and/or modified sequence opt5 from KIRREL2__Homo_sapiens__NP_115499
augcugagaaugcgggugcccgcccuccugguccuucuguucugcuuucgcggcagagcugggccuagcccgcacuuccuccagcaacccgaggaccugguugugcuucugggagaagaggcccggcucccuugugcgcugggcgcuuacugggggcuggugcaguggaccaaguccggacucgcccugggcgggcagcgcgaucuucccggauggucuagauauuggaucagcggcaacgccgcuaauggccagcaugaccugcacauucggccugucgaacucgaggaugaagccuccuacgagugccaagcuacacaggccgggcugcgcucuagacccgcgcagcuucaugugcugguuccuccggaggcuccccaggugcucggaggcccuagcgucucccugguggccgggguucccgccaaccugacgugucggucucgcggagacgcuagaccuacccccgaacuccugugguuucgggauggcgugcuucuggacggggccacauuccaccaaacccuccugaaggagggaacaccgggcagcgucgaauccacccuuacacugaccccuuuuagccaugaugacggcgcgacguucgugugccgcgccagaucucaggcucuccccaccgggcgggauacagccaucacccugucccugcaguauccucccgaggugacacucagcgcuucuccccacaccguccaggagggagaaaagguuauuuuucugugucaagccacggcccagccuccggugacaggcuaccgcugggcuaaagggggaucccccgugcuuggcgcgagagggccucggcuggaggucguggccgacgcuagcuuccucaccgaacccguuucuugcgagguguccaaugccgucggaagcgccaacagauccacagcucuggaugugcuuuuuggcccuauccugcaggccaagcccgaaccgguuucuguggacgucggcgaggaugcgagcuucuccugugcuuggcgcgggaauccucucccccgggugaccuggaccagacgcggaggcgcccaaguccuggggagcggagccacacugcggcucccuucugugggccccgaggacgcuggggacuauguuugcagagccgaagcuggccuguccggacuucgcggcggggccgcggaggcccggcugacggugaacgcuccucccgucgugaccgcccuccacagcgcuccggccuuucugagaggaccugcgcgccugcagugucuuguuuucgccucucccgcucccgaugccguggucuggagcugggacgaaggcuuucucgaggcugggucccagggacgguuccugguggaaacauucccugccccggagucuagaggcgggcugggccccggacucauuagcgugcugcauaucuccggcacccaggagagcgauuuuucucgcuccuucaauugcagcgcccggaacagacuuggggaaggaggcgcucaagcgucucuggggcggcgcgaccuccugccuacaguuagaaucgucgccggaguggcugccgccaccacgacacugcuuauggugauuaccggcgucgcucucuguugcuggcggcacuccaaagccagcgcguccuuuucugagcagaagaaucugaugagaauccccgggagcuccgauggcucuagcucccgcggaccugaagaggaagagaccggcagccgggaggacagagggcccauugugcauacagaucacucugaccugguucucgaagaggaaggaacccuggagacaaaggauccuacgaacggcuacuauaaagugcgcggggucuccccgcccgcuagcccugacucuagagugaccuccuuccaguggaaaagccccggaaucucuaaucuuccuuga

SEQ ID NO: 71204 - RNA, 1803 nt, Artificial Sequence
  derived and/or modified sequence opt5 from KIRREL3__Homo_sapiens__NP_001155179
augaagcccuuccagcuggaccuccuguuugugugcuucuuucuuuucagccaagagcugggccuccagaaaagaggguguugccugguccuuggauacauggccaaggauaaauuucggcgcaugaacgaaggccagguuuauuccuucucucagcaaccucaggaccaggugguggucagcgggcagccggugacccugcucugugcuauccccgaguacgauggauuuguucuguggauuaaggacggccuggcccucggggugggaagagaucuguccucuuauccucaauaccuugucgugggcaaucaccugagcggcgaacaucaccucaaaauccugcgggcggagcuucaggacgaugcuguuuaugaaugccaggccauucaggccgcuauccgcuccagacccgcccggcugacagugcucgucccucccgacgauccugugauucucgggggaccggugaucucucugcgcgcuggcgacccccugaaccugacgugucaugccgauaaugcgaagccugccgcuagcaucauuuggcuuagaaagggggaggucaucaacggagccaccuacuccaaaacacugcuccgggacggcaagcgcgagagcauuguuucuacccuguucaucucccccggggauguggaaaauggacaaagcauugugugcagagcuacaaacaaagccaucccuggcggcaaggagaccucugucacaauugacauccagcaucccccgcuugugaaucuguccguugaaccucagcccgugcucgaggacaacgucgugaccuuucacuguagcgcgaaagccaauccugcuguuacgcaauaucggugggccaagcgcgggcagaucauuaaggaggcuucuggagaaguguacagaaccacagucgauuacaccuauuucuccgagcccgugagcugcgaagucacaaacgcccugggcuccaccaaucugucucggacgguggacguuuacuuugggccccgcaugacaaccgagccucagagccuccugguggaucuuggauccgacgccaucuucagcugugcuuggacaggcaacccgucucugaccauugucuggaugaaaagaggguccggagugguucucagcaaugaaaagacccugacacuuaaaucugugcggcaggaggaugcgggcaaguaugucugcagagccguggugccccgcguuggcgcuggggagcgggaagucacgcugaccgugaacggaccucccaucauuagcuccacacaaacccagcacgcccuccacggcgagaaagggcagaucaaguguuuuaucagaucuacaccucccccggaccgcauugccuggagcuggaaagaaaaugugcuggaguccggaaccagcggccgguacacggucgaaacaaucucuaccgaggagggggugauuuccacccugacaaucagcaacauuguuagagcugauuuccagaccaucuauaacugcacagccuggaacucuuucggcuccgacacggaaaucauucgccucaaggagcaaggaagcgaaaugaaguccggcgcggggcuggaggcugaaucugugccuauggccgucaucauuggaguggccguuggcgcugggguggccuuucuuguccugauggcuaccaucguggccuucugcugugcgcggagccagagauccacaggaggccgcucugggauuagcggccggggaaccgagaaaaaggccagacuccgccugccccggagagcuuccaaacaggagugcaaugaacagggcagcuga

SEQ ID NO: 71205 - RNA, 1974 nt, Artificial Sequence
  derived and/or modified sequence opt5 from KIRREL__Homo_sapiens__NP_001273278
augcugagccuccugguguggauccuuacccuguccgacacauucucucagguucccccugaggauacgagaauugacggcgggccggucauccuccugcaagccggaacgccccacaaccuuacaugccgggcuuuuaaugccaagccugcggcuaccauuaucugguuccgcgauggcacacagcaggaaggggccguggccagcaccgagcugcucaaagacggaaagagagaaacaaccgugucccagcugcugauuaaccccacggaucucgacaucggccgggucuuuaccugucgcucuaugaaugaggcuaucccuagcgggaaagaaacauccauugagcuggaugugcaucaucccccuaccguuacacuuucuaucgagccgcaaaccgugcaggaaggagagagagucguguucacgugccaggccacagcuaaccccgaaauucugggcuaccggugggccaagggcggguuucucaucgaggacgcgcacgagagccgcuaugaaaccaauguugauuacuccuucuuuacagagccugugagcugugaaguccacaacaaagugggaucuaccaauguguccacccuggucaacguucauuucgcccccagaauugugguggacccuaagcccacaacgaccgauaucggcagcgacgucacacuuaccugcguguggguugggaauccgccucugacacucaccuggacgaagaaagauucuaacauggugcuguccaauagcaaccagcugcuccugaagucugucacacaagcugacgccggaaccuauaccugucgggcuauugugccccgcaucggcguugccgagagagaagugccucuuuacgucaaugggccucccaucauuuccagcgaggcggugcaguaugccguccggggagacggcggcaaaguggagugcuuuaucggguccacacccccgcccgaucgcauugcuugggccuggaaggaaaacuuccuggagguuggaacccucgaaagauacacaguggagcggaccaauucuggcagcgggguccuguccacccuuacaaucaacaacgugauggaagcugacuuucagacccacuauaauuguacagccuggaacagcuucggaccuggcaccgccauuauccagcuggaggagcgcgaaguucuccccguggggaucauugcuggagcgacgaucggcgccucuauucugcugaucuuuuucuucauugcucucgucuuuuuccuguacagacggagaaaaggcucccgcaaggaugugacccuucggaagcuggacaucaaaguggagacaguuaauagagaaccucucaccaugcacagcgaucgcgaggacgauacagccucugucagcaccgccacgcgggugaugaaggcuaucuacuccucuuuuaaagacgauguggaccugaagcaagaucuuagaugcgacacaauugacacccgcgaagaguaugagaugaaagaucccacaaacggguacuauaauguccgggcccaugaagacagaccgagcucccgcgcggugcuguacgcugauuaucgggccccuggacccgccagauucgacggccgcccuagcucucggcucucccacagcucuggguacgcucagcugaacaccuauuccagaggacccgccagcgauuacggcccugagcccaccccgccugggcccgcugcccccgcgggcacagacacgaccucccagcugucuuacgaaaauuaugagaaguuuaacagccauccuuucccgggagccgcuggcuaccccacauaucggcucggguacccucaagcucccccuuccggacuggagcgcacccccuaugaagccuacgauccuaucggcaaauaugccacagcgaccagauuuucuuacacgagccagcacuccgacuacgggcagcgguuccagcaaagaaugcagacacacguuuga

SEQ ID NO: 71206 - RNA, 417 nt, Artificial Sequence
  derived and/or modified sequence opt5 from KISS1__Homo_sapiens__XP_011507827
augaacagccugguguccuggcagcuccugcuuuuccugugcgccacccacuuuggcgagccccucgaaaaggucgcuucuguugggaauagcagaccuacaggacaacagcuggagucccuuggccugcucgccccgggggaacagucucugcccuguacggagcggaaaccugcggcuaccgcccgccugagcagacggggaacaucccucucucccccucccgaaagcuccggcagcccucagcaaccggggcugucugccccucauucccgccagauccccgcuccccagggagccgugcuugugcagagagagaaggaccugccuaacuacaauuggaacagcuucggccuccgguuuggcaaacgcgaggcugcccccgggaaucacggaagaucugcgggccggggguga

SEQ ID NO: 71207 - RNA, 1197 nt, Artificial Sequence
  derived and/or modified sequence opt5 from KISS1R__Homo_sapiens__NP_115940
augcacaccguggccacaagcggccccaacgcuuccuggggagccccugcgaaugcuucugggugcccgggcuguggggccaacgccagcgacggacccgucccuucccccagagcuguugaugccuggcuggugccucucuucuuugcugcccugaugcuucugggccucgugggaaauucucuggucaucuacgugauuugccggcauaagcccaugcgcacgguuaccaacuucuauaucgcgaaucuugccgcuacagacgugaccuuucugcucuguugcgucccuuucacagcccugcuguacccgcuccccgggugggugcugggcgauuuuauguguaaauucguuaacuauauucagcaagugagcguccaggcuaccugcgccacacuuaccgcgauguccguggacagaugguacgugacggucuuuccucugcgggcccuccaccgcagaaccccucggcuggcucuugccguuucucugagcaucugggugggcuccgcugccgugagcgcccccguccucgcucugcaucgccugucucccgggccgagagcguauuguuccgaggccuucccuagccgggcucucgaacgcgccuuugcccuguacaaucuucuggcucucuaucugcuuccccugcucgccacaugcgcguguuacgcugccaugcugagacaccugggacggguggccguucgcccugcucccgccgauucugcucuccagggccaggugcuggccgagagagcgggggccguccgggcuaaggugucccgccuuguugccgcugugguccuccuguucgccgcgugcuggggacccauucaacuguuucuugugcugcaggcccucggcccugcugggagcuggcauccgagaucuuacgccgcuuaugcccugaaaaccugggcccacuguauguccuacagcaacuccgcucugaauccccuccuguaugcguuccuuggaucucacuuucggcaggccuucagacgcgucugcccuugcgcuccccggagaccucgccggcccagacgcccgggcccuagcgaccccgccgccccucaugcugaacugcuccggcugggcucccaccccgccccugcgagagcucagaagcccgggagcucuggacuggccgcccgcggccuuugugugcucggggaggauaacgcuccgcuguga

SEQ ID NO: 71208 - RNA, 2931 nt, Artificial Sequence
  derived and/or modified sequence opt5 from KIT__Homo_sapiens__NP_000213
augagaggcgcccgcggggcuugggacuuccugugcgugcuccugcuucugcuccggguccagaccggaagcucccaacccucuguuagcccuggcgagccgucucccccuucuauccaccccggcaagagcgaucugauugugagagugggagacgaaauccggcuucuguguacagauccuggcuuugucaaauggacguucgagauucucgacgaaaccaacgagaauaagcagaacgaauggaucacagagaaagccgaggcgaccaauacagggaaguauaccugcacaaacaaacauggacuguccaauucuauuuacguguuuguucgcgaucccgcuaagcuguuccucguggacagaagccuguacggcaaggaagauaacgacacccuuguccgguguccucugacggauccggaggugaccaauuauucccucaaaggcugccaggggaagccccugccuaaagaccuucgcuuuauccccgauccuaaggccggaaucaugauuaaaagcguuaagagagccuaccaccggcugugucuccauugcucuguggaccaggaaggcaaguccguccugagcgagaaauucauccugaaggugcgccccgcuuuuaaagccgugccggucguuucuguguccaaggcuagcuaucuccugagagagggggaagaguucacagugaccuguacaauuaaagaugucucuuccagcguguacuccaccuggaagcgggaaaacucucaaacgaaacuucaggagaaguauaauagcuggcaccauggagacuuuaacuacgaacgccaggccacacugaccaucuccagcgcgagaguuaaugacucuggcguguucaugugcuacgccaacaauacauuuggguccgcuaacgucaccaccacacucgaggugguugauaagggauucauuaauaucuuuccuaugauuaacacgaccguguucgucaacgacggcgagaauguggaucugaucgucgaauaugaggccuuccccaaaccugaacaccagcaauggaucuacaugaaccggacauuuaccgacaagugggaggauuaucccaaaagcgaaaaugagucuaacauucgcuacgugagcgagcuucaccugacaagacucaagggcaccgaagggggaacguauacauuccugguuuccaauucugacgugaacgcugccaucgcguuuaaugucuacgugaacaccaaacccgagauucugaccuaugaucggcucguuaauggcaugcugcaguguguggccgcuggguucccugaaccgacaaucgacugguacuuuugccccggaaccgagcagagauguagcgccuccguccuuccuguggaugugcagacacugaacagcucugggcccccuuucgggaagcucguuguccaauccagcauugacucuuccgcuuuuaagcauaauggaacgguggaaugcaaagccuacaacgaugugggcaagaccagcgccuauuucaauuuugcuuucaaaggcaacaauaaggagcagauccacccccauacacuguuuaccccgcuucugaucggguucgucauuguggcgggaaugaugugcaucauuguuaugauccucacauacaaauaucugcagaagccuauguacgaggugcaauggaaggucguggaagagauuaacggcaacaauuauguuuacaucgaccccacccagcugccuuaugaccacaaaugggaauuuccccgcaaccggcucuccuucgggaagacgcugggagccggcgcuuucgggaaaguggucgaggccaccgccuacggccuuaucaagucugaugcugccaugacaguggcgguuaaaaugcugaagccuagcgcucaccucaccgagagagaagcccugauguccgagcugaaggugcuuucuuaccucggaaaucauaugaacauugucaaucugcugggcgccuguacaaucgggggacccacccucgugauuacggaauauugcuguuacggcgaccugcuuaacuuucugcgccggaaaagagauagcuucaucugcuccaagcaggaggaccacgcugaagccgcucucuauaaaaaucugcugcauagcaaggagucuuccuguagcgauucuacaaacgaguacauggacaugaaaccggggguguccuaugucguuccuaccaaggccgauaaacgccggagcgugagaauuggaucuuacaucgaacgcgacgugacacccgcgauuauggaggaugacgaacuugcccucgaucuggaggaccugcucagcuuuuccuaucaggucgcuaagggcauggccuuccuggcuagcaagaauugcauccaccgggaucuugccgcgagaaacauccugcucacccaugggcgcauuaccaaaaucugugacuuuggccuggcccgggacauuaagaaugauucuaacuacgugguuaaaggaaaugcuagacugcccgugaaguggauggccccugaauccaucuucaacugcgucuacacauuugagagcgacgugugguccuauggcauuuuccuuugggagcucuuuucucuggggagcuccccguaccccggaaugccuguugauucuaaauucuauaagaugaucaaggaaggcuuucggaugcugagccccgagcacgcuccugccgaaauguacgacaucaugaaaacguguugggaugccgacccccucaagcgcccuaccuucaaacaaauugugcagcugaucgagaagcagauuuccgaaucuacaaaucacaucuauagcaaccuugcuaacugcucccccaauagacagaaaccggucguggaucauagcguucggauuaacucugugggguccaccgcgagcuccucccaaccucugcucguccacgacgauguguga

SEQ ID NO: 71209 - RNA, 822 nt, Artificial Sequence
  derived and/or modified sequence opt5 from KITLG__Homo_sapiens__NP_000890
augaagaaaacccagacauggauccugacgugcauuuaccuccaacugcuucuguucaacccccucgugaagaccgagggcaucuguagaaaucgggucacaaacaauguuaaagacgugaccaagcugguggccaaccuuccuaaagauuauaugauuacacugaaguacgucccggggauggacgugcuccccagccacugcuggaucuccgaaaugguugugcagcugucugauagccugaccgaccuccuggauaaguuuuccaauauuucugagggacuuagcaacuauuccaucaucgacaaacuggucaauauuguggaugaccucguugaaugugugaaggagaacucuagcaaagaucugaagaaauccuucaagagcccugaaccccgccuuuuuacaccugaggaguucuuuagaaucuucaaucggucuauugacgcuuuuaaggauuucgucguggccuccgaaaccagcgacugcguggucucuuccacgcugagccccgagaaagauucucgcguuuccgugaccaagccuuuuaugcucccgcccguggcggcuagcucccugagaaacgacucuagcuccagcaaucggaaagccaagaacccucccggcgacucuucccugcauugggccgcuauggcccucccugcucuguucagccuuaucauuggguuugccuucggagcgcuguacuggaaaaagcgccagcccucucucacaagagccgucgaaaauauccagauuaacgaggaggauaaugaaaucagcaugcugcaagagaaagaacgggaguuucaggaaguguga

SEQ ID NO: 71210 - RNA, 3135 nt, Artificial Sequence
  derived and/or modified sequence opt5 from KLB__Homo_sapiens__NP_783864
augaagcccggcugcgccgcugggagcccuggaaacgaguggaucuucuuuuccaccgacgaaauuacaacgagauaccggaauaccaugucuaacggcgggcugcagcgcagcgugauccucuccgcccugauucuucugagagcggucacaggauucucuggcgaugggcgggcuaucuggagcaaaaauccgaacuuuacccccguuaaugagucccaacucuuccuguaugacacauuuccuaagaacuucuuuuggggaauuggcaccggcgcccuucagguggaagggucuuggaaaaaggauggaaaaggccccagcaucugggaccacuucauccauacacaccugaagaauguguccagcaccaacgggucuuccgauagcuacauuuuucucgagaaggaccugucugcccuggauuucaucggagucuccuuuuaucaguucagcauuucuuggccucgccucuuucccgacggcaucgugacgguugcuaaugccaaagggcugcaguacuauuccacccuucuggaugcucucgugcugagaaacauugaaccuaucgucacacuuuaccauugggaccugccgcucgcccugcaagagaaguauggaggcuggaaaaaugauaccauuaucgacaucuucaacgauuacgcgacauacuguuuccagauguuuggcgaccgggugaaguauuggauuaccauccacaaucccuaccugguugccuggcauggguauggaacgggcaugcacgcuccuggggagaaaggaaaccucgccgcuguguacacagucggccacaaucugauuaaggcccauagcaagguguggcacaacuauaacacccauuuccgcccccaccagaaaggguggcuuuccaucacacugggaucucacuggauugaaccuaauagaagcgagaacaccauggacaucuuuaagugccagcaauccauggugagcguccucggcugguucgcgaaucccauccauggcgauggggacuacccggaaggaaugcggaaaaagcuguuuucuguucuuccuauuuucuccgaggccgagaaacacgaaaugcgcggcaccgcugacuuuuucgccuuuagcuucgggcccaacaauuuuaagccucugaacacaauggcuaaaaugggacagaaugugucucucaaccugagagaggcccugaauuggaucaagcucgaauauaacaauccccggauucugaucgccgagaacggcugguucacggauagccgcgugaagaccgaagauacaaccgcuauuuacaugaugaaaaauuuucuuucccagguccugcaggcgaucagacucgacgagauccggguguucggguacacagccuggucucugcuugauggcuucgaguggcaagacgcuuauaccauucgcagaggacuguuuuacguugauuucaacagcaagcagaaagaacggaagcccaaauccagcgcccauuauuacaagcagaucauuagagagaauggcuuuucucucaaggaauccacgccugacgugcaagggcaguucccgugugauuuuagcuggggagucacagagucugugcugaaacccgaauccguugccagcuccccucaguucucugacccccaccuguauguguggaacgcuaccggcaaccgccuccugcaucgggucgagggggugagacuuaagacccgcccugcccagugcacagacuuugucaauaucaaaaagcaacuggagaugcucgcgcggaugaaagugacccacuacagauucgcucuggauugggccagcguucugcccacaggaaaccuuuccgccgugaaucgccaggcucuccgguauuacagaugugucgugucugaaggccugaagcuggggauuagcgccaugguuacgcucuacuauccgacccacgcucaucugggccuuccugagccccugcuccacgccgacggauggcugaacccuuccacagcggaagccuuucaggcuuacgccggccugugcuuccaggagcuuggggaucucgugaagcuguggaucaccauuaaugaacccaaccgccugagcgacaucuauaaucggucuggaaacgauacauacggcgcugcccauaaucuccuggucgcgcacgcccuugcuuggagacuguaugaccgccaauuucggccuucccagagaggggccgugagccucucucugcacgcugauugggccgagcccgccaacccguacgcugacucccauuggcgggcggccgagcgcuuccugcaguuugaaaucgcuugguucgccgagccucuuuucaaaaccggagauuaucccgccgcuaugagagaauacauugccagcaagcaccggagaggccucucuagcuccgcgcugccccgccugacggaggcugagcggagacuccugaaagggaccguggacuuuugugcccuuaaucauuucacaacccgcuuuguuaugcacgaacagcuggccggcagcagauacgauucugaccgggauauccaauuccuccaggacauuacacgccuguccagcccuaccagacuggcugucaucccguggggagugcggaaacuucuccgcugggugagacggaacuauggcgacauggauauuuacaucacggccuccgggaucgacgaucaggcgcuggaggacgaucgccugagaaaguauuaccucggaaaguaucugcaggaaguccuuaaggcuuaccugauugacaaagugcggaucaagggcuauuacgccuuuaaacucgccgaggaaaagucuaaaccccgcuucggguuuuucacaagcgauuuuaaggcuaaauccucuauucaauucuacaauaagguuaucagcuccagaggauuuccuuucgagaacucuagcucccggugcagccagacccaggagaauacagaauguaccgugugccuguuccugguccaaaagaaaccccuuauuuuucugggcuguugcuucuuuucuacccucgugcugcuccuguccaucgccaucuuccagagacagaagcgccggaaauuuuggaaggcuaaaaaccuucagcauauuccucugaagaaggggaaaagaguugugagcuga

SEQ ID NO: 71211 - RNA, 1857 nt, Artificial Sequence
  derived and/or modified sequence opt5 from KLC1__Homo_sapiens__NP_001123579
auguacgacaacaugagcaccaugguguauaucaaggaggauaaacuggaaaagcucacacaggacgagauuaucuccaaaacgaagcaagucauucagggccuggaagcccuuaaaaaugagcacaacucuauccugcagagccuccuggaaacccuuaagugccugaagaaagaugacgaguccaaucucguugaggaaaagucuaacaugauuagaaaaagccuggagaugcuggaacucgggcuguccgaggcucaggugaugauggcccuuucuaaucaucugaacgcgguggagagcgaaaagcaaaaacuccgggcucagguccgcagacugugucaggagaaucaguggcuucgggaugaacuggccaacacacaacagaagcuccagaaguccgagcagagcguggcccaacuggaagaggagaaaaagcaccuggaguucaugaaucagcucaaaaaguacgacgaugacaucucucccuccgaagauaaagacaccgauagcacaaaggaaccucuggacgaucuuuuuccgaacgacgaggacgaucccggacagggcauccaacagcagcauucuuccgcugccgcugccgcgcagcaagggggauaugaaauuccugcccgccugagaacccuccacaaucugguuauccaguacgcuagccagggccgguaugagguggccgucccccuuugcaaacaggcucuggaggaccucgaaaagacaucugggcaugaucacccugacguggccaccaugcugaacauucuggcgcucguuuaccgcgaucaaaauaaguauaaagacgccgcuaaccugcuuaaugaugcccuggcuaucagagagaagacgcucggaaaagaccaccccgccguggccgcuacccugaacaaccuugcgguccuguacggcaagcggggcaaauacaaggaagccgagccucucuguaagcgcgcucuggaaauuagagagaaagugcuggggaaggaucauccggacguggccaaacagcucaauaaccuggcccuucugugccagaaucagggaaaguaugaggaagucgaguacuauuaccaacgggcucucgaaaucuaucagacaaaacugggccccgaugacccuaacguugccaagaccaagaauaaccuggcguccuguuaccuuaaacaggggaaguucaaacaggcugagacacucuauaaggagauucugacccgcgcccacgaaagagaguuuggaagcguggacgaugaaaauaaacccaucuggaugcaugccgaggaacgggaggagugcaagggcaagcaaaaagacgggacguccuucggagaauacggcggcugguacaaggcuuguaaaguggauucuccuacagucaccacaacccugaagaaccucggggcccuguaucgcagacagggaaaauuugaggcugccgaaacccuugaggaagcggccaugcggagcagaaagcagggccuggacaaugugcacaaacaacgcguugcugaggugcucaacgaucccgagaauauggaaaagcggagaucccgcgagagccugaacgucgacgugguuaaguacgaaucugggccggauggaggcgaggaaguguccaugagcgucgaguggaauggggacggaacaggcucucugaaacggagcggcuccuucucuaaacuuagagccagcauccgccgguccagcgagaagcucgugagaaagcugaaagggggaucuucccgcgaaagcgagccuaagaaccccggcgcuucucuggccgaaccucucuuugucgagaaugauuccagcuccucugggcuggaggacgcgacggccaacuga

SEQ ID NO: 71212 - RNA, 1410 nt, Artificial Sequence
  derived and/or modified sequence opt5 from KLF10__Homo_sapiens__NP_001027453
auggaggaaagaauggagaugaucagcgaacggcccaaggaguccauguacucuuggaacaaaaccgccgaaaagagcgacuucgaggcuguggaggcccugauguccaugucuugcagcuggaaauccgauuuuaagaaauaugucgaaaaucgcccuguuacaccggugucugaccucagcgaggaagagaaccugcuucccggcacgccugauuuccacaccauucccgcguuuugucugacaccucccuacuccccuagcgacuucgagccgucucagguguccaaucucauggcucccgccccuagcaccguccauuuuaagucucuguccgauacagccaagccccacaucgcugccccuuucaaagaagaggaaaagagccccgugucugcuccgaaacuuccuaaggcccaagcgaccuccguuauuagacauacagccgacgcucagcugugcaaccaccagaccugucccaugaaagccgcuagcauccucaauuaucagaacaauuccuuucggcgcagaacgcaucugaacguggaggccgcgcggaagaauauuccuugcgccgcugucucucccaaccgcagcaagugugaaagaaauaccguggccgauguugacgagaaggcuuccgccgcccuguacgauuucagcgugcccucuuccgagacagucaucugccggagccaaccugcuccggugucuccccagcagaaaagcgugcucgucuccccucccgcgguuucugccgggggagugccucccaugccggugaucugucagauggucccucugcccgcuaacaauccugugguuaccacagugguccccagcaccccucccucccaaccgccugccgugugcccucccguuguguuuaugggcacgcagguccccaaaggggccgugauguucgucgugccgcagcccguugugcagagcucuaagccucccgucguguccccuaacggaacacgccuuagccccauugcuccugcccccggcuuuucuccguccgcggcuaaaguuaccccucaaaucgacagcucccggauuagaucucacaucuguagccaccccgggugcggaaagacauauuucaaauccucucaucugaaggcccacacccgcacccauacaggcgaaaagccuuuuagcuguuccuggaaaggcugcgagagacgguucgcccgcagcgaugaacucucuagacaccggagaacgcacaccggggagaagaaauucgcuugccccaugugugaccgccgguuuaugagauccgaucaucugacaaagcacgcccgccggcaucuuagcgcuaaaaagcugccgaauuggcagauggaagugucuaagcucaacgacauugcccugccucccaccccugcgcccacacaguga

SEQ ID NO: 71213 - RNA, 1539 nt, Artificial Sequence
  derived and/or modified sequence opt5 from KLF11__Homo_sapiens__NP_003588
augcacacccccgacuucgccggcccugaugacgcuagagccguggauaucauggacauuugcgagagcauccuggaacggaagcgccaugauuccgagagaucuacauguagcauucucgaacagacggacauggaggcggucgaagcucugguuugcauguccucuugggggcaacggagccagaaaggagaucuucugcgcaucagaccgcucacccccguguccgacucuggcgaugugacaaccacaguccacauggacgccgccaccccugagcugcccaaggauuuucauagccuuuccacacuguguauuaccccuccccagagcccugaccucguggagccgucuacgcggacccccguuuccccucaggugacagauagcaaggcuugcaccgccacagacguccugcaaucuuccgcugugguugcccgcgcgcugagcgggggagccgaaagaggccuccuggggcuugagcccgugccuucuucccccugucgggcuaaaggaaccagcgucauccgccacacgggcgaauccccggccgcuugcuucccuacaauccagacccccgacuguagacugucugauagccgggagggcgaggaacagcuccuggggcauuuugagacacuucaggacacccaccugaccgauucccuccugagcacaaaccuggugucuugccaaccuugucuccacaaauccggaggccugcuucugacggacaaggggcagcaggccggauggcccggcgcggugcagaccugcagccccaagaauuacgaaaacgaucucccucgcaaaacaaccccgcugauuucugucagcguucccgccccucccgugcuuugucaaaugaucccugugacagggcaguccucuaugcugcccgcuuuccucaagccgccuccccagcugagcgucggaaccgugagaccuauucuggcccaagcugcccccgccccucagcccguuuuugugggcccggcugucccucagggcgcggugaugcucguucugccccagggggcccuucccccuccggcucccugcgccgccaaugugauggcugccggaaacacgaaacugcucccucuggcgcccgcuccugucuucaucacauccagccaaaauugcgugccccaggucgacuuuucucggcgcagaaacuauguguguuccuucccuggcugccggaagaccuacuuuaaaagcucucaucuuaaggcccaccugagaacccauacaggggagaagcccuucaauuguuccugggauggaugcgacaaaaaguuugcccgcagcgaugaacucucccggcacagacgcacccacacaggcgagaaaaaguucguuuguccggugugcgaccggagauuuaugcgcucugaucaucugacgaaacacgcucggagacauaugaccacaaagaaaauuccuggguggcaggccgaggucggaaagcugaaccgcaucgcuagcgccgaaucccccggcucuccucucgugagcaugcccgcguccgccuga

SEQ ID NO: 71214 - RNA, 1209 nt, Artificial Sequence
  derived and/or modified sequence opt5 from KLF12__Homo_sapiens__XP_011533211
augaacauccacaugaagagaaaaaccauuaagaauaucaacacauucgagaaucggaugcugaugcucgacggcaugcccgccgugcgcgucaaaacggaacugcuugagagcgaacagggguccccuaacguucauaauuacccggauauggaggcugugccccugcuccugaacaaugugaagggagaaccucccgaggacucucuuagcgucgaucacuuucaaacccagacagagccuguggaccuguccauuaacaaagccagaaccucucccacagcgguuagcuccucuccugugagcaugaccgcuuccgccagcucuccguccagcacaucuaccuccucuagcuccagcucccggcucgccucuagccccacggucaucaccuccgugagcucugcuuccagcucuagcacaguucugaccccuggcccccugguggccuccgcuucuggggucggaggccagcaguuccuccauauuauccacccugugcccccgagcuccccuaugaaucugcaaagcaacaaacuuucucaugugcaccgcauccccgucguugugcaguccgugccugucguguauacagccguuagaagccccgggaaugugaacaauaccauugucgugccccugcucgaagauggacggggccacggcaaggcgcagauggacccucgcgggcugucuccgagacaguccaagagcgauuccgacgaugacgaucuucccaacguuacgcuggacucugugaaugagacaggaagcaccgcccucuccaucgcucgggccguccaagaagugcauccuucucccgucagccgcgugagaggcaaccggaugaacaaucagaaguuuccuugcuccauuagccccuucucuaucgaguccacacgcagacagcggcgcagcgagucuccggauuccagaaaacggcgcauucacagaugugacuuugaagggugcaacaagguuuacaccaaaagcucucaucugaaggcucaccggagaacccacacaggagagaagccuuauaaauguacgugggaaggcugcaccuggaaguucgcccgcagcgacgagcugacacggcauuacagaaaacacaccggggugaagcccuuuaaaugugcggauugcgaccgcuccuucagccggucugaucaucucgcccugcacagacgccggcauaugcuugucuga

SEQ ID NO: 71215 - RNA, 867 nt, Artificial Sequence
  derived and/or modified sequence opt5 from KLF13__Homo_sapiens__NP_057079
auggccgcugccgcguacguggaccacuucgcugccgagugccuggucagcauguccucuagagccguugugcauggcccccgggaagggccugagagccgcccggaaggagcugccguggcugccacccccacacucccuagagucgaggaacggcgcgauggcaaggacuccgcgucucuguuugugguugccagaauccuugcugaucugaaccagcaagcccccgcuccugcccccgcggagcggcgcgagggggccgcugccagaaaagcucggacgccuugucgccucccgcccccugcccccgaaccuaccagccccggagccgagggcgcugcggccgcuccgccuucccccgccuggucugaaccugagcccgaggccgggcuggaacccgagagagaaccuggaccggcuggcagcggcgagcccgggcuucggcagcgcgugagacggggacgcuccagagccgaccuggaaagcccucagcggaagcacaaaugccauuaugcgggcugugagaaggucuacgggaaaucuucccaccucaaggcucaucugagaacacacaccggagagcgccccuucgccugcagcuggcaggauuguaauaagaaauuugcccggucugacgaacuggcuagacacuaucgcacacauaccggcgagaagaaauucuccugcccuauuugugaaaagcgguuuaugagaagcgaucaccucacaaaacaugcccgccggcacgcuaacuuccaccccgggaugcugcaaagacgcggaggcggcucucggaccgggucccuuagcgacuacuccagaucugaugccagcuccccgacgaucagcccugcgucuucccccuga

SEQ ID NO: 71216 - RNA, 972 nt, Artificial Sequence
  derived and/or modified sequence opt5 from KLF14__Homo_sapiens__NP_619638
augagcgccgcuguggccugccuggacuacuucgcggcugagugucucgucuccaugucugccggcgccguugugcacagacggcccccugauccggaaggggcuggaggcgccgcugggagcgaggugggagccgcgcccccugaauccgcccugcccggcccugggcccccuggaccggcuucugucccccagcuuccucaagugcccgccccuagccccggcgcuggcggggccgcgccgcaucugcucgccgcuuccguuugggccgaccugcgcggaucuagcggcgagggguccugggaaaacagcggagaggcuccuagagccucuuccggcuuuagcgaucccaucccuugcucugugcagacccccuguuccgagcuugcccccgcuagcggggcggccgcugucugcgccccugaaucuuccagcgacgccccggcugugcccuccgccccugcggcucccggagccccugccgcuucuggcggcuucagcgggggagcccugggcgcugggcccgccccggcggccgaucaggcuccucggcgcagauccguuacacccgccgcuaagcggcaccaguguccuuuucccggaugcacgaaagccuauuacaagagcucucaucucaaaucccaccaacgcacccauacaggcgagagaccuuucagcugugacuggcuggauugcgacaagaaauuuacccggucugaugaacuggcgcgccacuauagaacacacaccggggagaagcgguucagcuguccccucugcccgaagcaguuuucccgcucugaccaucugacaaaacacgccagacggcauccuaccuaccaccccgauaugauugaguaucgcggaagacggagaacgccccgcaucgacccuccgcuuaccagcgaaguggaguccagcgcuucuggcuccggccccgggccugcccccagcuucacaaccugucuguga

SEQ ID NO: 71217 - RNA, 1251 nt, Artificial Sequence
  derived and/or modified sequence opt5 from KLF15__Homo_sapiens__NP_054798
augguggaccaucugcuccccgucgaugagaacuucagcuccccuaagugcccgguuggcuaccugggggacagacuugugggacggcgcgccuaucacaugcugcccucuccugugagcgaagaugacuccgaugcuucuagccccuguuccugcucuagcccugacucccaggcccucuguagcugcuacggcgggggacugggcaccgagucucaagauuccauccuugacuuucugcucagccaggcgacacuggggucuggaggcggcuccgggagcucuauuggagcuuccagcggccccgucgccugggggccuuggagacgggccgcugccccggugaaaggagaacacuucugucugcccgaguuuccucucggcgaucccgacgauguuccucgccccuuccagccgacgcuggaagagaucgaggaauuucuugaggaaaauauggagccuggggugaaggagguccccgaaggaaacuccaaagaccuggaugcuugcucucagcucagcgccggcccucauaagucccaucugcaccccggcagcucugggagagagcgguguuccccucccccgggaggcgcgagcgccgggggagcucaaggccccgggggaggcccuacccccgacggcccuauucccgugcuucugcagauccagccgguuccugugaaacaggaaucugggacaggacccgccagcccuggccaagcucccgagaaugucaagguggcccagcuccuggugaacauucaggggcagaccuucgcgcuggucccucaaguugugcccuccucuaaucucaaccugccgagcaaguuugugcgcaucgccccuguccccaucgcugccaaacccgugggauccggcccucuugggccgggccccgcuggacugcucaugggccagaaguucccuaaaaaucccgccgccgaacugauuaagaugcacaaaugcacauuuccuggguguagcaagauguauaccaagucuucccaccuuaaagcucaucugagacggcacacaggagagaagcccuucgcgugcaccuggccuggcuguggguggcgcuuuagcagaucugacgagcucucccggcaucgcagaagccacuccggaguuaaacccuaccagugcccggugugcgaaaagaaauucgcccggucugaucaccugagcaagcauaucaaaguccaccgcuuuccuagauccucucggagcgugagauccguuaacuga

SEQ ID NO: 71218 - RNA, 759 nt, Artificial Sequence
  derived and/or modified sequence opt5 from KLF16__Homo_sapiens__NP_114124
augagcgccgcuguggccugcgucgacuacuucgcggcugauguucugauggccaucuccucuggcgccguggugcacagagggcggcccggaccugagggcgcugggccggccgcuggacucgacguccgcgccgcgagacgggaagccgcuagccccggcaccccugggcccccucccccuccgcccgccgcuuccggaccuggccccggcgccgcggccgcuccucaucugcuugccgcuucuauucuggccgaucuccgcgggggacccggcgccgcuccugggggagcgagcccggccuccucuagcuccgcugccagcucucccuccagcggcagagccccuggggcugcccccucugcggcugccaagucccaccggugucccuuuccugacugcgccaaggcuuauuacaaaagcucucaucugaaaucccaccuucgcacacauacgggagagagaccguucgccugugauuggcagggcugcgacaagaaauuugcucggagcgaugaacuggcccgccaccacagaacccauacaggcgagaagcgguucuccuguccccucugcucuaagcgcuuuaccagaagcgaccaccuggcgaaacaugcccggcgccacccuggguuccaccccgaucugcucagacggccuggagcuagauccacaagccccucugacucccugccguguagccuugccggcucuccugcucccagcccugcccccuccccugcgcccgccgggcuguga

SEQ ID NO: 71219 - RNA, 1089 nt, Artificial Sequence
  derived and/or modified sequence opt5 from KLF1__Homo_sapiens__NP_006554
auggccaccgcugagacagcccugcccagcaucuccacgcucaccgcgcugggcccuuucccggacacacaggaugacuuucuuaagugguggagaucugaagaggcucaagauauggggcccggaccucccgacccuaccgaacccccucugcacgugaaaagcgaggaucagccgggcgaagaggaggacgaugaacgcggggccgacgccacaugggaucucgaccugcuucugaccaacuucuccggacccgagccuggcggggcuccccagacaugcgcccucgcuccuucugaagccagcggagcgcaguaucccccgccucccgagacccugggcgccuacgcuggcgggccuggacuggucgccggccuccugggguccgaggaucauucuggauggguucggcccgcucuuagagcccgggcgcccgacgccuuugugggcccugcucuggccccggcucccgccccugaacccaaggcccucgcucugcaaccuguguaccccgggccgggagcgggcagcuccggcggguauuucccucgcacgggacuuagcguccccgccgcuucuggcgccccuuacgggcugcucuccggauaucccgccauguacccugcuccccaguaucagggccacuuucagcuguucagagggcugcaaggaccggccccuggccccgcgaccagccccucuuuucucuccugucugggcccugggacagugggaaccggccuugggggaacagcugaggauccgggcguuauugccgaaaccgcccccagcaaacgggggcgcagaucuugggcucggaagcgccaggccgcucauacgugcgcccacccuggcuguggaaaauccuacacaaagagcucccaucugaaggcgcaccucagaacccacacaggcgagaaacccuacgccugcaccugggaaggguguggauggcgguucgcucgcucugacgagcugaccagacauuaucggaagcacacaggccagcgcccuuuuagaugccagcuuuguccccgggccuucagcagauccgaccaucuggcucuccacaugaaacgccaccuguga

SEQ ID NO: 71220 - RNA, 1068 nt, Artificial Sequence
  derived and/or modified sequence opt5 from KLF2__Homo_sapiens__NP_057354
auggcccugagcgagcccauccucccuuccuucucuaccuuugcuagcccgugcagagaacggggccugcaggagcgcuggcccagagccgaaccugaguccgggggaacagacgaugaccuuaacucugugcuggauuucauucucagcaugggccuggacgggcuuggagcggaagcugcccccgagccucccccuccgcccccucccccugccuuuuacuaucccgagccgggcgcuccucccccuuacuccgcccccgcugggggacuggucucugaacuccugcggcccgagcuggaugccccucucggcccggcgcugcacggccgcuuccuucuggcucccccugggagacucguuaaggccgaacccccugaggccgacggaggcgggggauauggcugugcucccgggcugacgcggggaccgcgcggccuuaaaagagagggcgccccugggcccgcggccagcugcaugcggggaccuggcgggagacccccucccccgccugauaccccuccccugucccccgacggaccggcucgccuccccgccccuggcccccgggcuagcuuuccucccccuuucgggggacccggcuuuggcgccccggggccuggacugcauuacgccccucccgcucccccggcguucggccuguuugaugacgccgcugccgccgcugccgcgcucgggcuggcuccucccgccgcccgcggacuucugacaccucccgcuucuccccucgaacugcuugaggccaagccuaaaagaggccggcgcuccuggccgagaaagcggaccgcuacacacaccuguagcuaugccgggugcggcaaaacauacaccaagucuucccaucugaaggcgcaccucagaacgcauaccggagaaaaacccuaucacuguaauugggauggcugcggguggaaguucgcccgcagcgacgagcugacacggcacuacagaaaacauaccggacaccgcccuuuucaaugucaucugugcgaucgggcuuucucuagauccgaccaccucgcccugcacaugaagcgccauauguga

SEQ ID NO: 71221 - RNA, 1038 nt, Artificial Sequence
  derived and/or modified sequence opt5 from KLF3__Homo_sapiens__NP_057615
augcugauguucgaccccgugccugucaagcaggaggccauggauccgguuagcguguccuaccccucuaacuauauggaaagcaugaaaccuaauaaguacggcgugaucuauuccacaccccucccugagaaauuuuuccaaacccccgaagggcugucucacggcauucagauggagccugucgaccuuacggugaacaagagaagcuccccgcccucugcuggaaauagcccuuccagccugaaauuucccucuucccaucggcgcgccagcccugggcucucuaugcccuccagcucuccgccuaucaagaaguacuccccucccagccccggaguucagcccuucggcgugccucuguccaugccgcccgucauggcggcugcccuuucuagacacgggauucggagcccuggaauccugcccgugauucagccuguugugguccaacccgugccguuuauguauaccucccaucuccagcagccucugauggugagccugucugaagagauggagaacuccagcucuagcaugcagguccccguuaucgaauccuacgagaaaccuaucucucaaaagaaaauuaagaucgaacccggcauugagccucagcgcacagauuauuaccccgaggaaaugagcccgccucucaugaacuccgugagcccuccccaggcccugcuucaggagaaucaccccucugugaucguccaaccgggcaaaagaccccugccuguggaaucccccgacacccagcggaagcgccggauucauagaugcgauuacgacggguguaauaagguuuauacaaaaagcucucaccucaaggcucaccgcagaacccauacaggagagaaaccuuacaagugcaccugggaaggcuguacguggaaauucgcccgguccgaugagcugacccgccacuuuagaaagcauacagggaucaaacccuuccagugcccugacugugaucggagcuuuucccgcucugaccaccuugcucugcacagaaagcggcauaugcucguguga

SEQ ID NO: 71222 - RNA, 1440 nt, Artificial Sequence
  derived and/or modified sequence opt5 from KLF4__Homo_sapiens__NP_004226
augagacagcccccuggcgagagcgacauggccguguccgaugcucugcucccgucuuucagcaccuuugccuccgggcccgcgggacgggaaaagacacugcgccaagcuggcgccccuaacaauagauggcgggaggaacuuucucacaugaaacgccugcccccuguccuccccgggagaccuuacgaccuggccgcugccacgguugcuaccgaucuugagagcggaggcgccggggcggccugcggaggcuccaaccuggcuccgcucccccggcgcgaaacagaggaguucaaugaccugcuggaucucgacuuuauccugucuaacagccuuacccauccucccgaauccguggccgcuacagugagcagcuccgccagcgcgucuuccucuucuuccccuagcuccucuggccccgccagcgcuccguccaccuguagcuucacauauccuauuagagccgggaaugaucccggagucgcuccuggcgggaccggaggcgggcugcucuacggacgggagucugccccuccgcccacggcccccuuuaaccuggcugacaucaaugaugugucccccagcggcggcuucguugcggaacuucugcgcccugagcucgaccccguguauauuccuccccagcagccgcagccucccgggggaggccugauggggaaguuuguccugaaagccucucucagcgcuccuggauccgaguacggcucucccagcgugaucuccguuagcaaggggucuccugauggaucccaccccguggucguggccccguauaacggcggcccucccagaaccugccccaaaauuaagcaagaagccgugagcucuuguacacaucugggggcuggaccuccgcuuuccaauggccaccggcccgccgcgcaugacuucccucuggggcgccagcuccccagcagaaccacaccuacccugggacuugaggaaguccuguccucucgggauugccaccccgcucucccucugcccccgggcuuucacccucaucccgggccuaacuaccccagcuuccugccggaccagaugcagccucaaguucccccucuccacuaucaggagcugaugccucccggcuccuguaugcccgaggaaccgaagcccaaacgcggaagacggucuuggccuagaaagcgcacggccacacauaccugcgacuacgccggcugugggaaaacauacaccaagagcucccaccuuaaagcucaucugcggacccacacaggagagaagcccuaucacugcgauugggacggcuguggguggaaguuugccagaagcgaugaacucacgcgccauuaccggaaacacaccggacauagaccuuuccagugccagaagugugaccgcgcuuuuucucgguccgaucaccuggcccuucacaugaaaagacauuucuga

SEQ ID NO: 71223 - RNA, 1101 nt, Artificial Sequence
  derived and/or modified sequence opt5 from KLF5__Homo_sapiens__NP_001273747
auggagaaguaccugacaccccagcucccuccggugcccaucauuccugaacacaaaaaguauagacgggacagcgccuccgucguugaucaauucuuuaccgacacggagggccugcccuacucuaucaacaugaauguguuccuuccugauauuacccaucugcgcacagggcucuauaaaagccagagacccugcgugacccacaucaagacagaaccugucgcuauuuucucccaucagucugagaccacagccccgcccccugcgcccacccaggcucugccugaauuuacgagcaucuuuuccucucaccaaaccgccgcccccgaggugaacaauaucuucauuaaacaggagcuuccgacaccugaccugcaucucagcguucccacccagcagggacaccuguaccaacugcucaacacaccugaucuggacaugcccuccagcaccaaucagacggcugccauggauacacuuaacgugucuauguccgcugccauggcgggccugaauacccacacaagcgccgucccccagaccgcugugaagcaguuucaagggaugccuccguguaccuauacaaugcccucucaguuccucccucagcaagccacguacuuucccccuuccccgcccagcucugaaccuggaucccccgaccggcaggcugagaugcugcagaaccuuaccccucccccuagcuaugccgcgacaaucgccuccaagcuggcuauucauaaucccaaccucccgaccacacugccuguuaauucucagaacauccaacccgugcgcuacaauagacggagcaaccccgaucuggaaaaacgccggauucacuacugcgacuauccuggcuguaccaaggucuacacgaaauccagccaucucaaggcccaccugagaacacacaccggggagaaaccguauaagugcaccugggagggaugugauuggcgcuucgcuagaucugacgaacuuacacggcauuaccgcaagcacaccggcgccaaacccuuucagugcggcguguguaauagauccuucagccggucugaucaucuggcccuccacaugaagcgccaucagaacuga

SEQ ID NO: 71224 - RNA, 714 nt, Artificial Sequence
  derived and/or modified sequence opt5 from KLF6__Homo_sapiens__NP_001153597
auggacgugcugcccaugugcagcaucuuccaggagcuccaaauuguccacgaaaccggcuacuuuuccgcccugccuucucuugaggaauauuggcagcagacaugucuggagcucgaaagauaccugcagagcgagccgugcuauguuuccgcuucugagaucaaguucgauagccaagaagaccuuuggacgaaaauuauccuggcccgggagaagaaagaagaguccgagcucaagauuucuagcucucccccugaagauacccugaucagccccucuuuuuguuacaaccuggagacaaauucccucaacagcgacgugucuuccgaaagcucugauuccagcgaggaacuguccccuaccgcgaaauucacaucugaccccaucggggaggugcuugucagcuccggaaagcugagcuccuccgugaccagcacaccuccgucuagccccgagcucucccgcgaaccuucucagcuguggggcugcguucccggggagcuuccuagccccggaaaggugagauccggcaccagcgggaaaccgggagauaagggcaauggcgacgcuucuccugaugggcggcgcagaguccaucggugucacuuuaacggaugccgcaaaguguauacgaaguccagccaucugaaagcccaccagagaacccauacaggcguuuuccccgggcucaccacauggccuuguaccuga

SEQ ID NO: 71225 - RNA, 693 nt, Artificial Sequence
  derived and/or modified sequence opt5 from KLF7__Homo_sapiens__NP_001257871
auggacgugcuggccagcuacuccaucuuccaggagcuccaacugguccacgauaccggcuauuuuucugcccuucccagccuggaagagacauggcagcagacgugccucgaacuggagagauaccuucagaccgaaccucggcgcauuuccgagacauucggggaggaccuggauuguuuucuccaugcuucuccgcccccuugcaucgaagagagcuucagacggcuggacccccugcuccugccuguugaagcggcuauuugugagaaguccucugccguggauauccuucugagccgcgacaaacuccuguccgagaccugccuuagccugcaacccgccucuuccagccucgauucuuauacagcugugaaccaggcccagcugaaugcugucaccucccugacaccuccgagcucucccgaacucuccagacaccuggugaagaccagccagacgcuuuccgccguugacggaaccgugacacugaaacucgucgcgaagaaagccgcucugucuagcgugaagguucggucccuuauuagcgcccauggccgcgaugugucugggguccugcacgaggcuauguccagcagaggaaccacaggcaacacccaagugcagucuccuagcaaugccacgacagcgaccgggguguuucccggacucacaauccugccuuccaccuga

SEQ ID NO: 71226 - RNA, 1080 nt, Artificial Sequence
  derived and/or modified sequence opt5 from KLF8__Homo_sapiens__XP_005262036
augguggacauggauaagcugaucaacaaucucgagguccagcugaacagcgaaggcggguccaugcaaguuuucaaacaggugaccgccucugugagaaaucgggaucccccugagauugaauaccgcagcaacaugacauccccgacgcuucuggacgcuaaucccauggagaacccugcccucuuuaaugacaucaagauugaacccccugaggagcugcuugcgucugauuucagccugccccaggucgaaccuguggaccucuccuuucacaaaccgaaggcuccccugcagccugccucuaugcugcaagcccccaucagaccucccaaaccgcagagcuccccucagacccucguugugagcacaucuaccuccgauaugagcacaucugcuaacauucccaccguccugacaccuggauccgugcuuaccagcucucaguccacgggcagccaacagauccugcauguuauccacaccauucccuccgugucucuccccaauaagaugggagggcugaagacaaucccugucguggugcagagccuuccgauggucuauaccacacugcccgccgacggcgggccugcugccauuaccguuccccucaucggaggcgauggcaaaaacgcgggguccgugaagguggacccuacgagcaugucuccccuggagauuccguccgauagcgaagagucuacaaucgagagcggauccucugcccugcagagccuccaaggccugcagcaggaaccugcugccauggcucaaaugcagggggaggaaucccuugaccugaaacggcgccggauucaucagugcgauuucgccggauguagcaaggucuacaccaaaucuucccaccucaaggcgcauagacgcauccacacaggcgagaagcccuauaaaugcaccugggacggguguagcuggaaguuugccagaucugacgaacugacccggcacuuccgcaaacauacaggaaucaagccuuuuagaugcacggauuguaaucgguccuucagccgcuccgaccaccuuucucugcauagacggcgccacgauaccauguga

SEQ ID NO: 71227 - RNA, 735 nt, Artificial Sequence
  derived and/or modified sequence opt5 from KLF9__Homo_sapiens__NP_001197
augagcgccgcugccuacauggacuucguggcggcucagugccuggucuccaucucuaacagagccgccguucccgagcacggcguggcuccugaugccgaacggcuccgccugccggagagagaagugaccaaggagcauggggaccccggagauacauggaaagacuauuguacgcuugucaccauugcuaagagccugcucgaucugaauaaauaccggccuauccaaacacccuccgugugcucugacagccuugaauccccugaugaggacaugggcucugauagcgacguuaccacagaguccgggagcucucccucccacagcccugaggaacgccaggauccgggaucugcccccuccccucugagccuccugcaucccggcguggcggccaaggggaaacacgcuucugaaaagagacauaaguguccuuauuccggaugcggcaaagucuacggcaagagcucccaccugaaagcccacuaucgggugcauaccggggagcgccccuuuccguguacauggccugacugccucaagaaauucucuagaagcgaugagcugacccggcacuaccgcacgcauaccggagaaaagcaguuuagauguccccuuugcgagaagcgguucaugcgcuccgaccaccugacaaaacacgcuagacggcauaccgaauuucacccuagcaugauuaagcgcucuaaaaaggcccucgcgaacgcccuguga

SEQ ID NO: 71228 - RNA, 1221 nt, Artificial Sequence
  derived and/or modified sequence opt5 from KLHDC1__Homo_sapiens__NP_751943
auggccgacagccagcuguucugcguggcugaggaaagauccggccacugugccgucguugaugggaacuuucucuacguguggggaggcuaugugucuaucgaggacaaugaagucuaccugcccaacgaugagauuuggaccuaugacaucgauagcgggcuuuggcggaugcaucugauggaaggagagcucccugcguccaugucuggcagcugcggggcuuguauuaauggaaagcuguacaucuucggcggcuaugacgauaaaggguacuccaaccgccuuuauuuugugaaucugagaacacgggacgagacguacauuugggaaaagaucaccgauuucgagggacaaccgcccacaccucgcgacaaacucucuugcuggguuuacaaggauagacugaucuauuuuggcggguacggaugucggcgccacagcgaacugcaggacugcuucgaugugcaugacgccuccugggaggagcagaucuuuuggggcuggcacaacgacguccauauuuucgauaccaaaacacagaccugguuucaacccgaaauuaaagggggagugccuccccagccuagagccgcucacacaugugccguucucggcaauaagggcuauaucuucgggggacgggugcugcagacccgcaugaacgaccuucacuaccugaaucucgauacguggaccuggagcggcagaauuacaaucaacggggagucuccgaagcaucgguccuggcacacccugacacccauugcugacgauaaacuuuuucugugcggaggccucagcgccgacaauaucccucugucugauggguggauccauaacgucaccacgaauuguuggaagcagcugacacaccuccccaagacccgcccuagacuguggcacacagcgugccuuggaaaagaaaacgagauuaugguguucggcggcuccaaggacgaucugcucgcccuggacaccgggcauuguaaugaucuucugaucuuucaaacccagcccuauagccuccugcggucuugccuggacugcauuggaaagaacuccaucaugcucgaaagccagauuucccugcuuccgccuaaacugcuccagcaagugcugaagaaaaucacauucugggcugccgcuaaccaccgcgaggagcagagaguccagaaggaagagacggaaaauaaauaccaauggaucucuagcaacuga

SEQ ID NO: 71229 - RNA, 1221 nt, Artificial Sequence
  derived and/or modified sequence opt5 from KLHDC2__Homo_sapiens__NP_055130
auggccgacggcaacgaggaucugagagcugacgaucuccccgggccugccuucgaaagcuacgaguccauggaacuggcgugcccggcugagcggucuggacacguggccgucagcgacggccgccauauguuuguuuggggaggguauaaguccaaucaggugagaggccuuuacgauuucuaucugccccgggaggaacucuggaucuacaacauggagaccgggcgcuggaaaaagauuaauacagaaggagacgugccucccucuaugagcggcuccugugccgucugcguggauagaguucuguaucuuuuuggcgggcaccauucucggggaaacacgaauaaauucuacaugcuggacagccgcuccaccgauagagugcuccaaugggagcggaucgacugucagggcauuccucccagcucuaaggauaaacugggggucuggguguauaagaacaagcugaucuuuuucggaggcuacggguaccucccugaagacaaaguucugggaacauuugaguucgaugagaccuccuuuuggaauagcucucacccgcgcggcuggaacgaccaugugcacauucuugacacagaaaccuucacauggucccagcccaucaccacgggcaaggcuccuagccccagagccgcucacgccugcgcgaccgucgggaaucggggauuuguguucggcgggcgcuauagagaugcccggaugaacgaccugcauuaccucaaucuggauacaugggaguggaacgaacuuaucccucagggaauuugucccgugggccgcucuuggcacucccugaccccggucagcuccgaccaucucuuucuguucgggggauucacaaccgauaaacaaccucugucugacgcuuggacguauugcaucagcaagaaugaguggauucaguuuaaccaccccuacacagaaaaaccuagacucuggcacaccgccugugcuuccgaugagggcgagguuaucguguucggcgggugcgccaauaaccugcuugugcaucaccgggcggcccauagcaacgaaauucugaucuuuucuguccagcccaagucccucgugagacugagccuugaggcuguuauuuguuucaaggaaaugcuggccaauucuuggaacugccuccccaaacaucugcugcacagcgugaaucagcgcuuuggauccaacaauacaucuggcagcuga

SEQ ID NO: 71230 - RNA, 1053 nt, Artificial Sequence
  derived and/or modified sequence opt5 from KLHDC8A__Homo_sapiens__XP_006711492
auggaggugcccaacgucaaggacuuccaguggaaaagacuggccccucucccgagccggcgcguuuacugcucccugcuugaaaccggcgggcaaguguaugcuaucggaggcugugaugacaauggggugcccauggauugcuuugaggucuacucuccugaagccgaccaguggacagcgcugcccagacucccuacggcucgggccggaguggccguuaccgcucugggcaagcgcauuauggugaucgggggagucggcacaaaccagcuuccccugaaagugguugagauguauaauauugaugaaggcaaguggaaaaagagaagcaugcuccgggaggccgcuauggggaucuccgugaccgccaaggacuaccgcgucuaugcggccggaggcauggggcuggaucugagaccucacaaccaucuccagcacuacgacaugcugaaagauaugugggugucucuugcuccgaugcccacaccucgguaugccgcuaccagcuuccugcgcggauccaagauuuacgugcucggcgggagacaaucuaaauacgccgucaaugcguuugagguuuucgacaucgaaacacggagcuggaccaaguuucccaacaucccuuauaaacgcgccuucuccagcuuugugacgcuggauaaucaucuuuacucucugggaggccucagacagggccggcuguaucgccagcccaaguuccugagaaccauggacguguuugauauggagcagggaggauggcucaagauggaacgguccuucuuucugaaaaagagacgcgcugacuucgucgccggcagccuuucugggcgggugauuguugcuggaggccuggggaaccaaccgacagugcucgagaccgccgaggccuuucacccugggaaaaauaagugggaaauccugcccgcuaugccuacacccagaugugcgugcuccagcauugucgugaaaaacugucuucuggccguuggcggcgugaaucaggggcucucugacgcugucgaggcccugugcguguccgauagcuga

SEQ ID NO: 71231 - RNA, 1065 nt, Artificial Sequence
  derived and/or modified sequence opt5 from KLHDC8B__Homo_sapiens__NP_775817
augagcgccggcgggggcagagcuuucgccuggcaaguguuucccccuaugccgaccugccgggucuacggaacaguugcgcaccaggacgggcaucugcucgugcugggaggcugugggcgcgcuggacuuccccuggauacggccgagacccucgacauggccucccacacauggcuggcucuugccccucugcccaccgcuagagccggcgcggccgcugugguccucggcaaacaggugcugguugucgggggaguggaugaagugcagucuccuguugccgcuguggaggccuuccugauggacgaaggccggugggagcgcagagcgacacucccccaggccgcuaugggggucgccaccguggaacgggauggaaugguguaugcucugggcgggaugggaccugacacagccccgcaagcccagguccgcguuuacgagcccagacgggauugcuggcuuagccugccuuccaugcccaccccuuguuauggcgcuucuacguuucuccauggcaacaagaucuacgugcuugggggacgccagggcaagcugcccgugaccgcguucgaggccuuugaccuggaagcuagaacauggacccggcacccgagccucccuucccgcagagccuucgccgggugcgcuauggccgagggaucugucuuuagccugggcgggcugcagcaacccggaccucauaauuucuauucccggccccacuuugugaacacaguugaaauguucgaucucgagcacggcagcuggaccaaacugccccgcucucuuagaaugcgggacaagagagcggauuuuguggucggcucccucgggggacauauuguggcuaucggcgggcugggaaaucagccuuguccgcugggcagcguugagucuuucucccuugcccgccggagaugggaagcccugcccgcuaugccuacggcccgcugcagcuguucuucccuccaggcugggccccggcuguuugugauuggcggagucgcccagggcccuagccaagcgguggaggcccugugccucagagacggggucuga

SEQ ID NO: 71232 - RNA, 1827 nt, Artificial Sequence
  derived and/or modified sequence opt5 from KLHL10__Homo_sapiens__NP_689680
auggagauggaaagcgccgcugccuccaccagauuccaccagccccauauggagcggaagaugucugcgauggcuugcgaaaucuuuaacgagcugcgccucgaaggcaaacugugugacguggucauuaagguuaauggguucgaguuuagcgcccacaaaaacauccuuugcuccuguucuagcuacuucagagcccuguuuacauccggauggaauaacacggagaagaaaguguauaauauuccuggcaucucuccggauaugaugaagcucauuaucgaauacgcuuauacccggacagugcccaucaccccugacaacgucgagaagcugcuugccgcugccgaucaauucaauauuauggggaucgugcgcggaugcugugaauuucugaaaagcgagcucugccuggacaacuguauuggcaucugcaaguucacagauuacuauuacugucccgagcugagacagaaagcguauauguuuauucuccauaauuucgaagagaugguuaagguguccgccgaauuucuggagcuuagcgucaccgaacugaaagacaucauugagaaggaugagcucaacgugaagcaggaagacgcuguuuucgaggccauccugaaauggaucucucacgauccucagaaucggaagcaacauauuuccauccuucugcccaaagugcgccucgcucugaugcacgccgaauacuuuaugaacaaugucaagaugaacgacuacgugaaagauagcgaggaaugcaagccugugauuaucaaugcgcugaaagccauguaugaccucaacaugaacgggccgucuaauuccgauuucacaaacccccugaccagaccucggcuucccuacgcuauucuguucgccaucggaggcuggagcggcgggucuccuacgaaugcuaucgaggccuaugacgcccgcgcugacagaugggucaacguuaccugugaggaagagagcccccgggcguaccacggagccgcuuaucucaagggcuacguguauauuaucgggggauuugauuccguggacuacuucaauuccgucaagcgcuuugauccggugaaaaagacauggcaucagguugccccuaugcacucuagacggugcuacgugagcgucaccgugcugggcaacuucauuuaugccaugggaggguuugacggcuacguucgccuuaauacagcugaaagauaugagcccgaaaccaaccaguggacgcugaucgccccuaugcaugagcagcgguccgaugcgagcgcuacaacccucuacggcaaaguguauauuugcgggggauucaauggcaacgagugucuguuuacagccgaagucuacaauaccgagucuaaccaauggaccgugaucgcccccaugagaucccgccggagcgggaucggagucauugcuuauggcgaacacguguacgccguugggggauucgacggcgcuaauagacugcgcucugccgaggcguacagccccguggccaacacauggcggacgaucccuaccauguuuaauccgagauccaacuucggcauugaggucguggaugaccuccuguuuguugucgggggauucaacggcuuuacaaccacauucaauguggaaugcuaugaugagaagaccgacgaaugguacgaugcucacgacaugucuaucuaucgcagcgcccuuuccuguugcguggugcccgggcuggcuaacguugaggaauacgccgcgcggagagacaauuucccuggacucgcccugcgcgaugaggucaaauauagcgcuucuacguccacacuucccguguga

SEQ ID NO: 71233 - RNA, 1821 nt, Artificial Sequence
  derived and/or modified sequence opt5 from KLHL12__Homo_sapiens__NP_001289980
auggacgugaacaaguucgaggccagcgucggcuuucuggauguuaaaaaguuccucuccaccuggaaacugcagaaucccagaacacacuuugugcuuucuccucauugcuucaugggagggaucauggcuccgaaggacauuaugacgaacacccacgccaaaagcauccugaauagcaugaacucucuccggaaguccaauacacugugugaugugacccuucgcgucgaacaaaaggacuuucccgcgcauagaauugugcuggcugccugcuccgauuacuucugugccauguuuacaucugagcucagcgaaaaaggcaagccuuauguugacauccaggggcugaccgcuuccacaauggagauucugcucgauuucguguacaccgaaacgguccacgugaccguugagaacgugcaggagcugcuucccgccgcuugccugcuccagcugaaaggagucaagcaagccuguugcgaauuucuugagagccagcuggacccuucuaauugucucggcauccgggauuucgcggaaacacauaacugcguggaccugaugcaggccgcugagguguuuucccagaaacacuuccccgaggucguucaacacgaagaguuuauccugcucagccagggggaaguggagaagcugauuaagugugaugaaauccagguggacucugaggagccugucuucgaagccgugauuaauuggguuaaacaugcuaagaaagagcgcgaagagucccuuccgaaccugcuccaguaugugagaaugccccugcuuaccccucgguacaucacagaugucauugacgccgaacccuucauccgcugcagccugcaauguagagaccucguggaugaggcgaagaaauuucaucugcggccugagcugcgcucucagaugcagggacccagaacccgggcccgccucggcgcuaaugaaguucugcuuguggucggcggguucggaucccaacagagcccgauugacguggucgagaaguaugauccuaaaacgcaggaaugguccuuucugcccucuaucacaagaaagcggcgcuacguggccagcguuucccuccacgacagaaucuaugugauuggcggguacgauggacggagcagacugucuuccgucgagugccuugacuacaccgcugaugaagacggcgugugguauagcguugccccuaugaacgugcgccgggggcuggccggagcuacaacccucggcgauaugaucuacgucucuggcggguucgacggaagcagacgccacaccuccauggagcgguaugaucccaauauugaccaguggucuaugcugggcgacaugcaaacagcgagagagggggccggacuggugguggcuagcggcguuaucuacugccucgggggauaugauggccugaacauucuuaauuccgucgaaaaguacgacccccacacgggccauuggaccaacgugacaccuauggccaccaaacgcagcggggccggaguggcucugcucaacgaucacaucuaugucgugggcggguuugacggaacagcccaucugucuuccguugaggcguacaauauccggaccgauagcuggacgacagugaccucuaugaccacaccgagauguuacgucggcgcuaccgugcugcgcgggcggcuuuaugccauugccggcuacgacggaaacucccuccugagcuccaucgaaugcuaugaucccauuaucgacucuugggagguugugacaagcaugggcacgcagagaugugaugcuggggucugcgugcugcgcgagaaguga

SEQ ID NO: 71234 - RNA, 2064 nt, Artificial Sequence
  derived and/or modified sequence opt5 from KLHL1__Homo_sapiens__NP_001273654
augagcggcuccgggagaaaggacuucgaugugaaacacauccugcggcuccgcuggaagcuguuuucucaucccagcccuuccaccggaggcccggccgggggaggcugccuucagcaagacgggucuggcagcuucgagcacuggggacccucccagucuagacugcucaaaagccaggaacgguccggcgucagcacauuuuggaagaaaccuucuuccagcagcuccucuucuuccagccccuccucuagcuccagcucuuucaacccucugaaugggacgcuucugcccguugcuacccgccuccagcaaggagccccuggccaggggacacagcagccggcgagaacccuguuuuacguggagucccuggaagaggaagugguccccggaauggauuucccuggcccccaugagaaggggcucgugcugcaagagcuuaagguugaaccugacaacagcucucaggcuacaggagagggcuguggccaccggcuggugcucagcuccgucucugauuauuuugccgccauguucaccagcgacgugugcgaagcuaaacaggaggagauuaagauggaagggaucgaucccaaugcccugugggaccuuguucaguuugcuuacacaggaugucuggagcucaaagaagauaccauugagaaccugcuggccgcggccugccuccugcaacuuccucagguggucgaaguguguugccauuuccugaugaagcuccugcacccguccaauugucuuggcauccgcgcuuuugccgacgcucaggggugcauugagcugaugaaaguggcccacagcuauacgauggagaacaucauggaagucaucagaaaucaagaguuccuccugcugcccgcggaggaacuccauaagcugcuugccucugaugacguuaacgugccugaugaagagaccauuuuucacgcucugaugaugugggugaaguacgacaugcagucccgguguaaugaccucagcaugcugcuugccuucauccgccugccccuccugcccccucagauucuggcugaucucgagaaccaugcccuguucaaaaaugaccuugaaugccagaagcugauccucgaggccaugaaauaucaucugcugccggaaagacggacacuuaugcaaucuccccgcaccaagccuagaaaauccacagucggaacccucuacgcugugggcgggauggauaacaauaagggagcgacgacaauugagaaauaugaccugcggaccaaccuguggauccaggccggcaugaugaauggccgcagacuccaguuugggguugcugugauugaugacaagcuguucgucaucggaggccgggaugggcuuaagacacugaacaccguggaauguuacaaccccaaaaccaagacauggacgguucucccucccaugagcacccacagacacggacugggcgugacaguccuggaggggccgaucuacgccgugggcggacacgacggcugguccuaucuuaauaccgucgagcgcugggauccucagucucaacaguggacauuuguggccagcauguccauugcucggucuaccguugggguggccgcgcucaacggaaaacuguacagcgucggcgggagagacggauccagcugccugucuuccauggaauauuacgauccccauacgaauaaguggaacaugugcgcuccuauguguaaacgccggggcggggugggcguugccacaugcgacggauuccucuaugccgugggcgggcacgacgcucccgccagcaaucauuguucuagacugcuugauuacgucgagcgcuaugacccuaagaccgauaccuggacaaugguggcuccccuguccaugccgcgggacgccgugggaguuugccuccugggcgauagacuguacgcggucgggggauacgacggccagaccuaucuuaacacaauggaaagcuacgauccucagacgaaugaguggacccaaauggccucucucaacaucgggcgcgcuggcgccugugugguggucauuaagcagcccuga

SEQ ID NO: 71235 - RNA, 1830 nt, Artificial Sequence
  derived and/or modified sequence opt5 from KLHL20__Homo_sapiens__NP_055273
auggagggcaagcccaugagacggugcaccaacauccgcccuggggaaacaggaauggacgugacgagcagauguacccugggcgauccgaauaaacuccccgagggggucccucagcccgcccggaugccuuacauuuccgacaagcacccccgccaaacacuggaaguuaucaaccuucugagaaaacaucgggagcucugcgauguggugcuggucgugggagcuaagaaaauuuaugcccaccgcguuauccuuucugcguguagcccuuacuucagagcuauguuuaccggcgaacuggccgagucccggcagacagagguggucauucgcgacaucgaugaaagagccauggagcuccugaucgacuucgcuuauaccucucagauuacaguggaagaggggaauguucagacccugcucccggccgcuugccugcuucaacuggccgagauccaggaagcguguugcgaguuucucaagcggcagcuggaucccagcaacugucuugggauucgcgccuucgcugacacgcauuccugcagagaacugcuccggaucgccgauaaguuuacccagcacaauuuccaagaggugauggaaucugaggaguuuaugcugcugccugcuaaccagcucauugacaucauuagcuccgaugaacugaauguccgcagcgaggaacagguguucaacgccgugauggcgugggucaaauacucuauccaggagagacggccccaacuuccucagguucugcagcaugugagacucccccugcuuuccccgaaguuucuggugggcacagucggcagcgacccucucaucaaaucugaugaagagugucgcgaccugguggacgaggccaagaauuaucugcuccugccccaagaacggccucuuaugcaggggcccagaacccgcccccggaaaccuauuagaugcggagagguucuguucgcugugggcgggugguguuccggagaugccaucagcucugucgaacgcuacgacccgcagacaaacgaguggcggaugguggcuuccaugagcaagagacgcugcggcguugggguguccguccucgaugaccugcuuuaugccgugggaggccacgauggcucuagcuaccucaauuccgucgaacgguacgaccccaagaccaaccaguggagcucugauguggccccuacguccacaugcagaaccagcguugggguggcuguccugggaggcuuucuguaugcggugggaggacaagacggcguuucuugucugaauauuguggagcgcuacgaucccaaagagaacaaguggacacgggucgccagcauguccaccagacggcucgggguggcuguggccguucugggaggcuuccuuuaugccgucggcgggucugacggaaccagcccucugaauacaguggaacgcuacaacccccaggagaacagauggcacacgaucgcuccgaugggcacccggagaaaacaucucgggugcgccguguaucaggauaugauuuacgcggucggaggccgcgacgacacaaccgaacuguccagcgcugagcgguauaauccuagaacaaaccaguggucucccgugguugccaugaccucccgcagaagcggggugggccuggccgucgugaauggacaacuuauggcuguuggcggguuugauggaacgacauaccucaagaccaucgagguguucgacccugaugccaacaccuggcggcuguacggcgggaugaauuaucgcagacugggaggcggggucggcgugaucaaaaugacacacugugaaucucauauuugguga

SEQ ID NO: 71236 - RNA, 1770 nt, Artificial Sequence
  derived and/or modified sequence opt5 from KLHL25__Homo_sapiens__NP_071925
augagcguguccguccacgagaccagaaagucucggagcuccacaggcucuaugaacguuacgcuguuccauaaagccagccaccccgacugcgugcucgcucaucugaauacccuucgcaagcacuguauguuuacagaugugacccugugggccggggacagagcguucccuugccaucgggcuguccucgccgccuccucucgcuacuuugaagcuauguucagccacggacugagagagucccgggaugacacagugaacuuucaggauaaucuucacccggaaguucuggagcuccugcuggacuucgccuauagcucucgcaucgcuauuaacgaagagaaugccgagucccuccuggaagcgggcgauaugcuucaauuucaugacgugagagaugccgcugccgaguuccuggaaaagaaccucuuucccagcaauugucuggggaugaugcuucugucugacgcucaccagugccggcgccucuacgaguucuccuggagaaugugucugguccauuuugagaccgugcggcagagcgaagauuucaacucucuguccaaggacacacuccuggaucuuaucagcuccgacgagcuggaaaccgaggacgaacgcguuguguuugaggccauucuccagugggucaaacacgaucuggagccuagaaaggugcaccuucccgaacugcuccggucugugcgccuggcgcugcucccuagcgacugccugcaagaggccgucuccagcgaagcucugcugauggccgaugagagaacgaagcucaucauggacgaagcucugcgguguaaaacccgcauucuucagaaugauggaguugugacaucucccugcgccagaccucggaaggccggccauacccugcucauccuugggggacagacauucaugugugacaaaaucuaucagguggaucacaaggcuaaagagauuaucccgaaggcggaccugcccuccccuagaaaggaguucagcgccucugcuauuggcugcaaagucuacgugaccggcgggcgcggaagcgaaaacggcguuuccaaggaugugugggucuaugacacggugcaugaggaauggucuaaagccgcccccaugcucaucgcucgguuugggcacggaagcgccgagcuggaaaauugucuuuacguugugggcgggcauacaucccuggcgggagucuucccugcuagccccucugugucccucaagcaagucgagaaauaugauccgggcgccaacaaguggaugaugguggccccucugagagacggcguuagcaaugcugccguggucucugcuaaacugaaacuuuuuguguucgggggaaccuccauucaccgcgacaugguuagcaaggugcagugcuacgaucccuccgagaaccgguggacaaucaaagccgaaugcccucagcccuggagauacaccgcggccgcuguccucggcucucagauuuuuaucaugggaggggacaccgaguucacagccgcuagcgccuaucgcuuugauugugaaacgaaucaauggacccggaucggcgacaugacagcgaagagaauguccugccacgcccuggcuucugggaacaaacuguacguggugggaggcuauuucggcacccagcgcuguaagacacucgauugcuacgaccccaccagcgauacguggaacuguauuacaaccguuccuuauucccugaucccgaccgccuuugucagcacauggaaacaucuucccgcuuga

SEQ ID NO: 71237 - RNA, 1848 nt, Artificial Sequence
  derived and/or modified sequence opt5 from KLHL26__Homo_sapiens__NP_060786
auggccgagagcggcggguccucuggaggcgcugggggaggcggggccuucggagcgggccccggcccugaaagaccgaacagcaccgcugacaagaauggggcccugaaaugcacauuuuccgcccccucucacagcacgucccuccugcagggacuugcuacccugcgggcccaaggccagcuccuggaugugguccuuacaaucaaccgcgaggcuuucccugcccauaagguugugcuggcggccuguucugacuacuuuagagcuauguucaccgggggaaugcgggaagccagccaggaugugauugagcucaaaggcgucuccgcucgcgggcugagacacaucauugacuuugccuauagcgcggaagugacacuggaucucgacugcguucaggaugugcugggagccgcugucuuccuucaaaugcugcccgugguugagcucugugaggaauuucugaaggccgcuaugucuguggagaccugccuuaauaucggccagauggccacaaccuucucccuggccagccuccgggaaucugucgacgcuuuuacguuccgccauuuucugcagauugcggaggaggaagauuuccugagacucccucuggagcggcuuguguuuuuccugcaguccaaccgccuccaaagcugugccgaaaucgaccuguucagagcugccgugcgguggcuucagcacgaucccgcccgcagaccucgggcuucucauguccugugccacauccgcuuuccgcucaugcaguccagcgagcugguugacuccgugcagacccuggauauuaugguggaagacguccucuguagacaauaccugcuugaggccuucaauuaucaggugcugcccuuucggcagcacgagaugcaaucuccuagaacagcgguucgcagcgacgugcccucccucgucaccuucggcgggacaccuuacaccgauagcgaccggucuguguccagcaaaguuuaucagcugcccgaaccgggagcuagacauuuucgcgagcuuacggaaauggaggugggcugcucucacacaugugucgccgugcuggauaacuucgucuacguggccgggggacagcaucuccaguaucggagcggcgaaggggcuguugacgccugcuacagauacgauccucaccugaaucgcuggcugcggcuccaagcuaugcaggaguccagaauccaguuucagcugaacgugcuuuguggaauggucuaugccaccggcggccgcaaucgggcggggucucuggccagcguggagagauacugcccccgccggaacgaauggggauaugcuugcucccucaagagacggacauggggccacgccggggcugccagcggaggccgccuguacauuucugggggcuauggaaucuccguugaggacaagaaagcgcugcauuguuacgauccuguggccgaccaaugggaguucaaggcucccaugagcgaacccagaguccuucacgccauggugggcgcugggggacggauuuaugcccucggcgggagaauggaucauguggaccgcugcuuugauguucuggccgucgaauacuacgugccugagaccgaccaguggaccucuguguccccgaugcgggcuggacagagcgaggcgggcuguugccugcucgaaagaaaaaucuauauugucgggggcuacaauuggcgccugaacaaugugacaggaaucguucagguguauaacacggacaccgaugagugggaaagagaccuucacuuccccgaguccuuugccggcaucgcuugugccccuguccugcucccccgggccgggacacgcagauga

SEQ ID NO: 71238 - RNA, 2628 nt, Artificial Sequence
  derived and/or modified sequence opt5 from KLHL29__Homo_sapiens__NP_443152
augagcagacaccauucccgguucgagcgcgacuacagagugggcugggaucggcgcgaauggucugucaacgggacccacggaacaacgagcaucugcuccguuaccucuggcgccgggggaggcacagcuagcucccugucugugagacccgggcuccugccucuuccggugguccccagccggcugccuacccccgccacagcgccugcucccuguaccacaggauccagcgaggccauuaccucucucguggccuccagcgcuucugccguuacgaccaaggcuccuggcaucuccaaaggcgacagccagucucaagggcuggccacauccauucgcuggggacagaccccgaucaaucagagcacacccugggauaccgacgaaccucccuccaagcagaugagagagucugauaacccuggcacggggcccugggugacaaccgucgcggccggaaaucaaccgacacuuauugcucauagcuauggcguggcccagccucccaccuuuuccccugcuguuaacgugcaggcccccgucaucggggugacccccagccugccuccgcacgugggaccccagcucccucugaugcccggccauuacucucugccucaacccccgucccagccucucagcucugucguugugaauaugcccgcgcaggcccuguaugcuagcccucagccccuugccguguccacacugccuggcgucgggcaaguggcucggcccggaccgacggccguuggcaacgggcacauggccggaccucuccugcccccucccccgcccgcucagccuucugcgacccuucccagcggcgccccugcuacaaaugggcccccuaccacagacuccgcccacggacugcagaugcuccgcaccaucggcgugggcaaauacgaguucacggaucccgggcauccgagagagaugcugaaggagcugaaccaacagcggcgcgccaaggcuuuuacagaccucaaaauugucguggaaggaagagaguucgaaguucaccagaaugugcuggccagcugcucucuuuauuuuaaggaucugauccagcgguccguccaagacagcggccaagggggacgcgagaaacucgagcuggugcuuucuaaccugcaggcggauguccucgaacugcugcucgaguucguguacaccggcucccugguuauugacagcgcuaaugccaagacccuucuggaagccgcuuccaaauuucaguuccauacauuuuguaaggugugcgucucuuuccucgagaaacagcugaccgccagcaacugucuuggggugcuggcuauggccgaagcgaugcagugcuccgagcucuaucacauggccaaggcuuuugcccugcagaucuucccugagguugcugcccaggaagagauucugucuaucagcaaggaugacuuuauugcguacguguccaaugacagccucaacacaaaagccgaagaacuggucuacgaaacggugaucaaguggaucaaaaaggaucccgcuaccagaacacaauaugccgcugagcuucuggccgugguucggcucccuuucauucaccccucuuaccugcugaaugucguggacaacgaggaacuuaucaaauccagcgaggccuguagagaucucgugaacgaagcuaagcgcuaucauaugcugccgcacgcgcggcaggagaugcagaccccuagaacacgcccccggcugucugccggcgucgcugaagugauuguucucgugggaggcagacagauggucgggaugacccaacgcucccugguggccguuacgugcuggaauccucagaacaauaaaugguacccccuugccagccugcccuucuaugaccgggaguuuuucucuguggucagcgcuggagauaacaucuaccucuccggcgggauggagagcggagugacccuggccgacguuugguguuauaugucucugcuugauaauuggaaccucguguccagaaugacagucccucgcugccggcauaauagccugguguacgacggcaagauuuacacccucgggggccugggaguggcgggcaacgucgaucacguugaaagauaugacacaaucaccaaucagugggaggcuguggccccgcugcccaaggccgugcauuccgcugccgcgacggucugugggggaaaaaucuacguguuuggcgggguuaacgaagcuggacgcgccgccggcgugcuucaaucuuaugucccucagacaaauaccuggagcuucauugagucccccaugaucgauaacaaguacgcuccugccgugacacugaauggguuuguuuucauucucggcggagcuuaugcccgggcgaccaccaucuacgaccccgagaaaggcaacauuaaggccgggccuaauaugaaccacucuagacaguuuugcagcgcugugguccuggacggaaaaaucuaugccacaggcgggaucguguccucugaaggaccggcucugggcaacauggaggccuacgaacccacgaccaauacauggacccuucucccucacaugcccugcccuguuuuccggcauggguguguggucauuaagaaguacauccagagcggcuga

SEQ ID NO: 71239 - RNA, 1794 nt, Artificial Sequence
  derived and/or modified sequence opt5 from KLHL2__Homo_sapiens__NP_001154993
augguguggcuggaggccagaccccagauccucuucgucugcaccaagcaaggccaccagaaaccucuggacagcaaggaugacaacacagaaaaacauuguccgguuacggugaaucccuggcacaugaagaaggcuuuuaaagugaugaacgagcuucggucccagaaucugcucugcgaugucaccauuguggccgaagacauggagaucucugcgcaucgcguugugcuggcugccuguagcccuuacuuccacgccauguuuacaggggaaauguccgagucuagagcuaagcggguccgcauuaaagagguggauggauggacccuuagaaugcugaucgacuauguuuacacagccgaaauucaggugaccgaggaaaacguccaagugcuccugcccgcugccggccugcuccagcugcaggaugugaagaaaacaugcugugaguuccuugagagccagcugcauccugucaauugccucgggauccgggcguuugccgacaugcacgcuuguaccgaucugcuuaacaaggccaauacguaugcugaacaacacuucgccgacguugugcuguccgaggaauuucucaaccugggaaucgaacaggugugcucucugauuagcuccgauaaacucaccaucagcucugaggagaaggucuucgaggcggugauugccuggguuaaucaugacaaggaugugcgccaggaauuuauggcuagacugauggagcacguccggcuuccccugcucccucgcgaauaccuggugcagagaguugaggaagaggcccuugugaaaaacuccagcgcuuguaaggacuaucugaucgaggccaugaaauaccaucuccugccgacagaacaacggauucugaugaagucuguccgcaccagacuccggacacccaugaaucugccuaaacuuaugguggucgugggcgggcaggcccccaaggcuauccgcuccguugagugcuaugacuucaaagaagagagauggcaccagguggcggaacugccuagccggagaugucgcgccggaauggucuacauggcuggccucguguuugccguuggcggguucaacggaucucugcgggugagaaccgucgauuccuacgaccccgugaaggaucaauggacgagcguggccaauaugcgcgaccggagauccacacuuggcgcugccguucugaacgggcuccuguaugcggucggaggcuuugaugggucuaccggacugagcuccguggaggcuuacaauauuaagagcaacgagugguuccacguggccccgaugaacacacgccggucuuccgucggcgugggcguugucgggggacuccuguaugccgugggcggguacgacggagcuagcagacagugccuuucuaccguggaaugcuauaaugccaccacaaacgaguggacguacaucgcugaaaugagcacccgccgguccggcgccgggguuggagugcugaauaaccuccuguaugcggucggcggccaugaugggccucuggugagaaaaucuguugagguguacgaccccacaaccaaugccuggcgccaggucgcugauaugaacaugugucggagaaaugccggagugugcgcugugaacggccuucucuacgucguugggggagacgauggcagcuguaaucuggccuccguggaguauuacaacccuacaaccgacaaguggacgguggucagcucuugcauguccacagggcggagcuaugcgggcgugaccguuaucgacaaaccccuguga

SEQ ID NO: 71240 - RNA, 1905 nt, Artificial Sequence
  derived and/or modified sequence opt5 from KLHL31__Homo_sapiens__NP_001003760
auggcccccaagaaaaagaucgugaaaaagaacaaaggcgacauuaaugagaugaccaucauugucgaagauagcccucugaacaagcucaaugcucugaacgggcuucuggagggaggcaaugggcucuccugcaucucuagcgaacugacagacgccuccuacggaccgaaccuucuggagggccucucuaagaugagacaggaaaauuuccugugugaucugguuauugggacgaaaaccaagagcuuugacgugcacaaauccgugauggcgucuugcagcgaguauuucuacaacauccucaagaaagaucccuccauccaacgggucgaccugaaugauauuagcccucuuggacuggcuacagugaucgccuaugccuacaccggcaagcucacacugucucuuuauaccauuggcuccaucauuagcgcugccguuuaccugcagauccauacacucgugaagauguguucugacuuucugauucgcgagauguccgucgaaaacugcauguaugugguuaauaucgcugagaccuacagccugaaaaacgccaaggcggccgcucagaaauucaucagagauaauuuucucgaguucgccgaaucugaccaguuuaugaagcugacguucgagcaaauuaacgaacuucugaucgaugacgaucuccagcugcccuccgagauuguggcuuuucagaucgccaugaaauggcuugaguucgaccagaagcgggucaaauacgcggccgaccugcucagcaauauucgcuuugggaccaucuccgcucaagaucuggugaacuaugugcagucugucccuagaaugaugcaggacgccgauugucaccggcugcucguugacgcuaugaacuaccaucugcuucccuaucaccagaauacacugcaaagccgcagaacccggauccgcggaggcugcagagugcucgugacagucgggggacggccuggccugaccgaaaagucccuuagccgcgauauucuguacagagacccggaaaacggguggucuaagcucacggagaugcccgccaaauccuucaaucaguguguggccguuauggauggauuucuguauguggcuggcggcgaggaccagaacgaugcgcggaaucaagccaagcaugcugucagcaacuucugccgcuacgacccuagauucaauacauggauccaccuggccucuaugaaccagaaacggacccacuuuagccucuccguguucaaugggcugguuuaugccgcuggaggcagaaacgccgaagggucucuugcgagccuggaguguuacgugcccuccacaaaucaguggcagccuaagaccccgcucgaagucgcucgcugcugucaugccagcgccguggcugauggacggguccuggugaccggcggguacauugccaacgcuuauucuagauccguuugcgccuacgaccccgcgagcgacucuuggcaagagcugccuaaucuuuccacaccccgcggauggcacugcgccgugacgcucagcgaucgggucuaugugaugggcggcucccagcuggggccuagaggagaacgcguugacgugcugaccgucgaguguuacucucccgcuacaggccaguggagcuaugccgcuccccuccagguggggguguccaccgccggaguuucugcgcugcauggccgggccuaccuugucgggggcuggaacgagggagagaaaaaguauaagaaaugcauccaauguuuuagcccugaacugaaugaauggacagaggaugacgaacucccggaggcuaccgugggcguguccugcuguacgcugagcaugcccaacaacgucacaagagagucucgcgccuccagcgugucuuccguuccugugagcauuuga

SEQ ID NO: 71241 - RNA, 1752 nt, Artificial Sequence
  derived and/or modified sequence opt5 from KLHL35__Homo_sapiens__NP_001034637
augagacagggccacgcccccgaggaaagcgagccugggugcgaagcuccgugugccggacccugccaugcgcaacgggugcugcaggcucucaacgccuaccgcagauccggcacccugacagacgucguucuucgggccgggggacgcgauuucccuugucacagagcugcccugucugcuggcagcgccuauuuucggucccucuucgcggccgggcgccccgagagaggaccugcuguggugcccgucgugccuguugccccggaagcucccggcacgucuccugccggcgcggccgcugcccuggcugugguccuugacuacguguauggggccggaguucggcugcgcgccgaggaugaggcugcggccgugcucgcucuggccgaaagacugggcgucgccgggcuccgggaggcuugcgugcgcuuucuggaaggaagacuucgggccgcgaauagccuggcucuccgcagaguggccgccgcuuucucccuggcuccccuugcugagcgguguggcagaguccugcgccaggccuuugcggagguugcccggcaugcugacuuccucgaacuggccccugaugaggugguggcucugcucgccgaccccgcgcugggggucgccagagaagaggcuguguuugaagccgcuaugcgcuggguucggcacgaugccccggccagacgcggacagcuucggagacugcucgagcaugugcgccugccucuucuggcucccgcguacuuccucgagaaggucgaagccgacgagcugcugcaagccugcggcgaaugucggccucuccugcuugaggccagagccugcuuuauccugggccgcgaagcuggggcccuccggaccagaccccggcgcuucauggaucuggcggaggugauuguugugaucggaggcugugacagaaaagggcuucugaagcuccccuuugcugaugccuaucacccugagucucagcgguggacaccgcugcccagccugccuggauacaccagauccgaguucgccgcuugcgcccuccgcaacgacgucuaugugagcggcgggcacauuaauucucaugaugucuggauguuuuccagccaccuucauacauggaucaaaguggcgucucuucacaagggacgguggagacacaaaauggcuguugugcagggccagcuguucgccgucggcggguucgacggacuccgcagacugcauuccguggaacgguacgaccccuuuagcaacaccugggccgcugccgcuccucugcccgaagccguuucuuccgcggccguggcuagcugugccggcaagcuguucgucauugggggagcucgccaaggcggggugaauacagauaaggugcagugcuuugacccgaaagaggauagauggucccuccggucuccugcccccuucagccagcgcugccuggaagccguuucccuggaggacaccaucuacgucaugggcggacucaugagcaagaucuuuacguaugauccuggcaccgacguguggggagaggcugcggugcugcccucuccugucgaauccuguggggugacaguuugcgauggcaaagugcacauucuugggggaagagacgaucggggcgagagcaccgacaaggucuucacauuugaucccucuagcggccagguggaaguucaaccgucccugcagcgcuguaccucuagccaugggugcgugacgaucauucagucccucggaagauga

SEQ ID NO: 71242 - RNA, 1668 nt, Artificial Sequence
  derived and/or modified sequence opt5 from KLHL3__Homo_sapiens__NP_001244123
augggcaaggccuucaaagugaugaacgagcugagaagcaagcagcuccugugcgacgucaugaucguugcugaagauguggagauugaagcccaccgggugguccuugcggcuuguucccccuacuuuugcgccauguucaccggggacaugucugagagcaaagccaagaaaaucgaaauuaaggauguggacggacaaacacuguccaagcucaucgauuauauuuacacggcugagaucgagguuaccgaagagaaugugcagguccugcuuccugccgcuucucugcuccagcugauggacgugcgccagaacuguugcgauuuucugcaaagccagcuccauccgacaaauugucugggcaucagagccuucgcggacguucauaccugcacagaucuucugcagcaggccaacgcuuaugccgaacaacacuuucccgaggugaugcucggggaggaguuccugucccuuucucuggaccaggucuguagccucauuuccagcgauaaacugaccgugucuuccgaagaaaagguguuugaggcugucaucagcuggauuaauuacgaaaaagagacacggcuggagcacauggccaagcucauggaacauguucgccugccucuucugcccagagacuaucucgugcagaccguggaggaagaggcgcugaucaaaaacaauaacacgugcaaggauuuccuuauugaagccaugaaguaccaucugcucccucuggaccagcggcugcucaucaaaaauccccgcaccaagccuagaacaccggucucucugcccaaagugaugauuguugugggaggccaagcuccuaaggccauccgguccgucgaguguuaugacuuugaggaagaucgcugggaccagaucgcugagcuucccagcagacggugccgcgccggggugguuuucauggccggacacguguacgcugucggcggcuuuaacgggucucugagagugcggaccgucgauguguacgacggaguuaaagaucaguggacauccauugcgagcaugcaagaacgcagauccacccucggcgccgcugugcugaaugaccuucuguaugccgucgggggauucgauggcucuacggggcucgccagcguggaggcuuacuccuauaagacaaacgaaugguuuuucguugccccuaugaauacccggagaagcucugugggagucggcgugguggagggcaaacuguacgcgguugggggauaugacggcgcuucccgccagugucugagcacagucgagcaguacaaccccgccaccaaugaauggaucuauguggccgauaugucuacccggagaagcggggcuggagugggcguccucuccgggcagcuguacgccacaggaggccacgacggcccgcuugugcgcaagucuguugagguguacgauccugggacgaacaccuggaagcaagucgcugacaugaacaugugccggagaaaugccggagugugcgcgguuaacggccugcucuauguggucgggggagacgauggcagcuguaaucuggccuccguggaauacuauaaccccguuacagacaaauggacccugcuuccuacaaauaugagcaccgggcgcucuuacgcuggcguggccgucauucacaagucccucuga

SEQ ID NO: 71243 - RNA, 1866 nt, Artificial Sequence
  derived and/or modified sequence opt5 from KLHL40__Homo_sapiens__NP_689606
auggcccugggccucgagcaggcugaggaacaaagacuguaccagcagacccuucugcaggacgggcucaaggauaugcuggaccacggaaaauuccuugauugcgugguccgggccggcgaacgcgaguuucccugucauagacugguucucgcggcuugcagcccuuauuuccgggcccgcuuucuggccgaaccggagagagcuggggagcugcaccucgaagaggugucccccgacguggucgcccaagugcugcauuaccuuuauacaucugaaaucgcucuggaugaggccagcguucaggaccucuucgcggccgcucaccgguuucagauuccuuccaucuucacgauuugugugucuuuucugcagaagcgccuuugccugagcaacugucucgccgucuucagacugggacugcuccuggauugcgcucggcuugccguggcggcccgcgacuuuaucugugcucauuucacccugguugccagagaugcugacuuucucggccuguccgccgaugagcuuauugccaucaucucuagcgacgggcugaauguggaaaaagaggaagcugucuucgaggcggugaugcggugggccggauccggcgaugcugaagcccaagccgagcgccagagagcucuccccacaguguuugagagcguccggugccgccugcugccuagagccuuccucgaaucucggguugagagacacccccuggugcgcgcgcagccugaacuucugcggaaggugcagauggucaaagacgcucacgagggcagaauuaccacacuccgcaagaagaaaaaggggaaagacggagccggcgccaaggaagcugauaaagggaccuccaaggccaaggcugaggaggacgaagaggccgaacggauccugccgggcauucuuaacgauacacugagauucggaauguuucuccaagaccugaucuucaugauuagcgaggaaggggcgguggccuacgaucccgcugccaaugaguguuauugcgcuucucuguccaaccagguuccuaaaaaucaugugagccucgucaccaaggagaaccagguguuuguugccggaggccuguucuacaaugaagacaacaaagaggaucccaugucugcguauuuucuucaauucgaccaccuggauuccgaauggcucggcaugccuccccugccgagcccucgcugucuguuugggcuuggagaggcccucaauuccaucuacguggucggcgggcgggagauuaaggacggagaaagaugccuggauucugugaugugcuacgaccgccugagcuucaaauggggcgaguccgacccccucccuuaugucguguacgggcauacgguucugagccacauggaucuuguguaugucaucggaggcaagggcucugaccggaaaugucugaacaagaugugcguguacgaucccaagaaauuugaauggaaggagcucgcucccaugcagaccgccagaucccuguucggggcuacaguucacgacggacgcaucauuguggccgccggcgucaccgauacagggcugaccagcucugcugaaguguauagcaucacggacaauaaaugggcgccuuuugaggccuucccgcaggagcgguccucucuuagccucgugucccugguuggaacacuguacgcuauuggcggguuugccacccucgaaacagagagcggcgaacugguccccaccgagcuuaacgauaucuggagauauaaugaagaggagaagaaaugggaaggagugcugcgggagauugccuacgcugccggcgcgaccuuccucccugugcgccugaacguccugugucuuacaaagauguga

SEQ ID NO: 71244 - RNA, 1821 nt, Artificial Sequence
  derived and/or modified sequence opt5 from KLHL41__Homo_sapiens__NP_006054
auggacagccagagagagcuggccgaagaacuccggcuguaccaauccacccuucugcaggauggccucaaggaccugcuugaugagaaaaaguucaucgacugcacacugaaagcuggggauaagucucuccccugucaccgccugauucugagcgccugcuccccuuauuuuagagaguacuuccucucugaaaucgacgaggcgaaaaagaaggaggugguccuggauaacguugacccggcuauucuugaucugaucauuaaauaucucuacagcgccuccaucgaccugaaugauggaaacgugcaggacaucuuugcccuugcuucucgguuccagauucccagcguguuuacggucuguguguccuaucugcaaaagcgccucgccccuggcaauugccuggcuauccugagacucgggcugcuucuggauuguccccggcucgccauuagcgcgcgcgaguucguuucugacagauuugugcagaucugcaaagaagaagacuucaugcagcuguccccucaggagcuuauuagcgucaucucuaacgauucccugaauguggagaaggaagaggccguuuuugaagcugugaugaaauggguccggaccgacaaggagaaccgcgugaagaaucucagcgaaguguucgauuguauuagauuucggcugaugacagagaaauacuucaaggaccaugucgagaaagaugacaucaucaagucuaaccccgaucugcagaaaaagauuaaaguucucaaggacgccuuugcuggaaagcugccugaaccguccaaaaaugccgcgaagaccggcgccggggaggugaacggagaugugggcgacgaagaucuucugcccggcuaucucaaugacaucccucgccacgggauguucgucaaagaccugauucuucuggugaacgauacagcugccguugcuuacgaccccaccgagaaugaaugcuaccucacagcccuggccgagcaaaucccuagaaaccauagcuccauugugacccagcagaaucaaaucuaugucgugggaggccuguacguugaugaggaaaacaaggaccagccccuccagucuuauuucuuucaacuggauagcaucgcuuccgaguggguggggcuuccgccucugcccagcgcgcggugucucuucggacugggcgaagucgacgauaaaauuuacguggucgccgggaaggaccugcagacggaggcuucucuugauuccgugcucugcuaugacccuguugccgccaaguggaacgaagugaaaaagcugcccaucaaagucuacggacacaaugugauuagccauaagggcaugaucuauugucugggcgggaaaaccgaugacaagaagugcacaaaccgcguuuuuauuuucaaucccaaaaagggagauuggaaagaccucgcuccuaugaagaucccgagaucuauguuuggcguggccguccacaaagggaagaucgugauugcgggaggcgugaccgaggacgggcugagcgcuuccguugaggccuucgaucuuacaaccaacaagugggacgucaugacggaauuuccccaggagcggucuagcaucucccuggugagccucgccggaucucuguacgcuauuggcggcuucgccaugauccagcuggaauccaaagaguuugcuccuacagaggugaaugauauuuggaaguacgaagacgauaaaaaggagugggccgggaugcuuaaagaaaucagauaugcgagcggagccucuugccucgcuacccgccugaaccuguucaagcucuccaaacuguga

SEQ ID NO: 71245 - RNA, 1518 nt, Artificial Sequence
  derived and/or modified sequence opt5 from KLHL42__Homo_sapiens__NP_065833
augagcgccgaggaaauggugcagaucagacuggaggaccggugcuaccccgucuccaagcgcaaacucauugaacaaucugauuauuucagagcucuguaccggagcggcaugcgcgaggcccuuucccaggaagcugggggaccugagguucagcagcugagaggccucucugcgccggggcugcggcuugugcuggacuuuaucaacgccggaggcgcccgcgagggguggcuccugggacccagaggcgaaaagggcgggggaguggaugaggacgaagagauggaugaggucagccugcucuccgaacugguggaggcugccucuuuccuucaaguuaccagccugcuccagcugcuucugucccaggugcggcucaauaacugucuggaaauguaucgccuggcucaggucuacggccucccugaccugcaagaggccugccuuagauuuauggugguucacuuccaugaagugcuguguaaaccccaguuucaccuccuggggagcccuccccaggcgccuggagaugucucucuuaagcagcggcugcgcgaggccagaaugacaggcacgccggugcucguggcucugggggacuuccugggaggcccccucgccccucaucccuaucaaggcgagccucccuccaugcugcgguacgaagagaugaccgaacgcugguuuccgcuugcuaauaaccugccucccgaucucgucaauguuagaggguauggaagcgccauucuggacaacuaccuuuucaucgugggcggguaccggauuacaucucaggagaucuccgcggcccacagcuauaauccuucuaccaacgaauggcugcaaguggcuuccaugaaucagaaaagaagcaacuuuaagcucgucgccguuaauuccaagcuguacgcuaucggaggccaggccgugucuaacguggagugcuauaaucccgagcaggaugccuggaacuucgucgcuccccugccuaauccgcucgcggaauuuagcgccugugagugcaaagggaagauuuacgugaucggaggcuauacaacccgcgaccggaacaugaacauucugcaguacugucccuccagcgauauguggacacuuuucgaaaccugcgacguucauaucagaaaacaacagauggugucugucgaggaaacgauuuauaucgugggcgggugucugcacgagcucggaccuaaucgccgguccagccagucugaggacaugcugaccguccagagcuacaacacagugaccagacaauggcuguaccuuaaggaaaauacauccaaaucuggccucaaccugaccugcgcucugcacaaugaugggauuuauaucaugagccgcgacguuacgcucuccacaagccuggagcaucggguguuucuuaaguacaacaucuucucugauuccugggaagccuucagacgcuuucccgccuucggacacaaucugcucgucagcucucuguaucugccuaacaaggcugagaccuga

SEQ ID NO: 71246 - RNA, 2130 nt, Artificial Sequence
  derived and/or modified sequence opt5 from KLHL5__Homo_sapiens__NP_001007076
augagcggcuccagaaaggaguucgacgugaaacagauccugaagauucgguggcgcugguuugggcaccaagccucuagccccaacuccaccgucgauucucagcagggagaguucuggaauagaggccagacaggggcuaacggaggccggaaauuucucgacccuugcagccugcaacuuccgcuggccuccaucggguaccgcagaucuagccagcucgauuuccaaaauucccccagcuggccuauggcgucuacguccgaaguucccgcuuuugaguucaccgccgaagacuguggaggcgcccauuggcuggaucggccugaaguggacgauggcacaagcgaggaggaaaacgagucugacuccagcucuugccgcaccuccaauagcucccagacacuuucuagcugucacaccauggaacccugcacauccgaugaguuuuuccaggcucugaaccaugccgagcagaccuuuaagaaaauggaaaauuaucucagacacaagcagcugugugacgugauucuggucgcuggggaucggcgcaucccugcccauagacucgugcugagcucuguuuccgacuacuucgcggccauguuuacgaacgaugugcgggaggcucgccaggaagagauuaagauggaaggagucgagccgaauagccuuuggucucugauccaauaugccuacaccggcagacucgagcugaaagaagacaacaucgagugccuucugagcacagcuugucuccugcagcugucccaggugguugaagccugcuguaaguuccucaugaaacaacugcaccccucuaauugccuugggauucggagcuuugcggacgcccagggauguaccgaucugcacaagguggcucauaacuauacaauggagcacuucauggaagucauccgcaaucaggaguucgugcuccugccugccuccgagauugcuaaacuucuggccagcgacgauaugaacauccccaaugaagagaccauucucaacgcccugcugacgugggugagacaugaccucgaacagcggagaaaggaucugucuaaacuucuggcuuacauccgccucccucugcuugcgccccaauuucuggccgacauggagaacaauguccucuuccgggaugacauugaaugccagaagcugaucauggaggcuaugaaguaucaucugcucccggagagacgcccuaugcugcagagcccccggacaaaaccuagaaaguccaccguuggcacacuuuuugccgucgggggaauggauucuaccaaaggcgccaccuccaucgaaaaguacgaccugcgcacaaacauguggacgcccguggcuaauaugaacggccggagacuccaguucgggguggccgugcuggaugacaaacuguacguugugggaggccgcgacgggcuuaagacccucaauacagucgagugcuauaaccccaagaccaaaacauggagcgugaugccuccgauguccacccaccggcacggacugggcguugcggugcuggaagggcccauguacgcugucggaggccacgauggcuggucuuaucucaauacgguggagagaugggacccucaagcccgccaguggaacuuugucgccacaaugagcacgccccgguccaccguggggguugcugugcugucuggaaagcuguacgccgucggcgggagagauggaagcuccugucuuaaaagcguggagugcuucgacccucauacaaauaaguggacccucugugcucagaugucuaaacggcgcggcgggguuggcgugacaacguggaacggacugcuguaugccauuggcgggcacgaugcgcccgccuccaaucuuaccagcagacucucugacugcgucgaacgguacgauccgaagacagacauguggaccgcuguggccuccaugagcaucucuagagaugcugugggaguuugucugcugggcgacaagcucuaugccgucgggggauacgauggccaggcguaccugaacacaguggaggccuaugacccucaaaccaaugaauggacccagguggcuccccuuugccuggggcgcgccggcgcuugugucgugaccguuaaacucuga

SEQ ID NO: 71247 - RNA, 1866 nt, Artificial Sequence
  derived and/or modified sequence opt5 from KLHL6__Homo_sapiens__NP_569713
augcugauggccggccagagaggggcuuggaccaugggagacguggucgaaaagagccucgaaggcccccuggccccuuccacagaugagccgucucagaaaacgggggaccuuguugaaauccugaacggagagaaggugaaauucgaugacgcgggccucagccugauucuucaaaaugggcuggaaacccuccggauggagaacgcucugacagaugugauccugugcgucgacauucaggaguuuuccugucaccgcgugguucucgccgccgcuucuaauuacuucagagccauguuuugcaacgaucugaaggaaaaauaugagaagcggaucauuaucaagggaguggacgcugaaaccaugcauacacuucuggauuacaccuauacaagcaaagcccucaucaccaagcagaauguccaacgcgugcuggaggcggccaaccuuuuccaguuucugagaaugguugacgcuugugccuccuuccucacggaggcucugaaucccgaaaacugcgugggcauucugcggcucgccgauacccacucucuggacagccuuaaaaagcagguccaguccuacaucauucaaaauuuugugcagauccugaacagcgaggaguuccucgaucugccuguggacacacuucaucacauucugaaaucugacgaucucuaugucaccgaggaagcgcagguuuuugagacagugauguccugggugcgccauaagcccagcgagagacugugucugcucccuuacguccuggaaaaugugcggcuuccccugcucgacccuugguauuucguugagaccguggaagccgauccgcugauccgccagugccccgaggucuuuccucuucugcaagaagcuagaauguaccaccucucuggcaacgagauuaucuccgagcggacgaagccccgcaugcacgaguuccagagcgaaguguuuaugaucauugggggauguacaaaagacgaaagauucguugccgaggugaccugccuggauccucugcggcgcucuagacucgaagucgcuaagcugccccuuacagagcaugagcuggaauccgagaauaaaaaguggguggaguucgccugugucacccucaaaaacgaaguguacaucagcggcgggaaggagacccagcacgacguuuggaaauauaauuccucuauuaacaaguggauccaaauugaauaccugaacaucggacgguggagacauaagauggugguccugggcgggaaaguguauguuaucggaggcuuugauggccuucagcgcauuaauaacguggagacauacgacccguuccacaauugcuggagcgaagccgcuccucuccugguccacguguccagcuuugcggccacgucucauaagaaaaagcuguaugugaucgggggaggccccaacgggaaacucgcuaccgauaagacacaguguuacgacccuuccaccaauaaguggagccugaaagccgccaugcccguugaggcuaagugcauuaacgccgucucuuuccgggauagaaucuauguggugggaggcgcgaugcgcgcucuuuacgccuacagcccccuggaagacuccuggugccucgucacacagcugucucacgagcgggccagcugugggauugcuccuugcaauaacagacuguauaucaccggaggccgcgacgagaaaaaugaagugaucgccacgguucuuuguugggauccggaggcucaaaagcucacagaagagugcgugcugccccggggcgucucccaucacgggagcgugaccauuagaaaaucuuacacccauauccgccggauuguuccuggagccguguccgucuga

SEQ ID NO: 71248 - RNA, 1761 nt, Artificial Sequence
  derived and/or modified sequence opt5 from KLHL7__Homo_sapiens__NP_001026880
auggccgcuagcggcguggagaaguccucuaaaaagaaaaccgaaaagaaacuggccgcgagagaggaagcuaagcuccuggccggguucaugggagucaugaacaauaugcggaagcagaaaacacuuugcgacguuauccugauggugcaagagcgcaagauucccgcccacagagugguccucgcugccgcuagccacuuuuucaaccugauguuuacgaccaauaugcuugaauccaaaucuuucgagguggagcugaaggaugccgaaccugacaucauugagcagcucguugaauuugcguacacagcccggaucagcgugaacuccaauaacguccagucucugcuggaugcugccaaucaguaucaaauugagccggugaaaaagauguguguugacuuccucaaggaacagguggaugcuagcaacugccugggcaucuccguccuugccgaaugucuggacugccccgagcucaaagcgaccgccgaugacuuuauccaccagcauuucacagaaguguacaagaccgaugaguuucugcagcuugacgugaaacgcgucacacaucugcucaaucaagauacccugacgguuagagcugaagaccagguguaugaugccgcugugcgguggcugaaguacgacgagccuaaccgccagcccuucauggucgacauucucgccaaagugagauuuccucugaucagcaagaauuuccuuucuaaaaccguucaggccgagccccugauucaagauaacccugaaugucucaagauggugaucuccgggaugcgguaucaucugcuuagcccggaggaccgcgaggagcuggucgauggaacaagaccccggcgcaagaaacacgacuacagaauugcucucuuuggcgggucucagccucaguccugccgguauuucaaucccaaggauuacagcuggaccgacauccgcuguccuuucgagaaaagacgggaugcggccugcguguuuugggacaacguuguguacauucugggaggcucucaacuguuccccaucaagagaauggauuguuauaaugucgugaaagacuccugguacagcaagcucggcccgccuacaccccgcgauucccuggcugccugcgccgcugaagggaagaucuauaccucuggaggcagcgaggucgggaacuccgcccuuuaccuguuugaauguuaugacacgcggacagagagcuggcacaccaaaccuucuaugcucacacagagaugcucccauggaaugguggaagcgaacggccugauuuacguuugcgggggaagccuuggcaauaacgugucuggccgcguccugaauagcugugagguguaugaccccgcuaccgaaaccuggacagagcucugccccaugaucgaggcccggaagaaccacgggcugguuuucgugaaagauaagauuuuugccgucggaggccagaaugggcugggaggccucgacaacguggaauacuacgauaucaaacugaaugaguggaagaugguguccccuaugccguggaaggggguuacggucaaaugugcugccgugggaucuauuguguauguccuugcuggcuuccagggcguggggagacugggacauauccucgaauacaacaccgagacagacaaguggguugccaauagcaaagugcgcgcguuucccgucaccuccugccugaucugugugguugauacaugcggcgccaacgaggaaacccuggagacguga

SEQ ID NO: 71249 - RNA, 1854 nt, Artificial Sequence
  derived and/or modified sequence opt5 from KLHL9__Homo_sapiens__NP_061335
augaaggugagccugggcaacggggagaugggagucuccgcccaccuccagcccugcaaagcuggcaccacaagauucuuuacgucuaauacccauagcuccguugugcugcaaggguucgaccagcuucggaucgaaggacugcucugugaugugacacuggucccuggcgacggggaugagauuuuuccggugcaccgcgccaugauggcgucugcuagcgacuacuucaaggccauguuuaccggaggcaugaaagaacaggaucuuaugugcaucaagcugcauggcguuaacaaaguggggcucaagaagauuaucgacuucauuuauacagccaaacugucccugaauauggauaaccuccaggacacccuggaggcugccucuuuucuucaaauccugcccguccucgauuucuguaagguguuucugaucagcggaguuucccuugacaauugcguggaagucggcagaauugcuaacacauacaaucugaucgagguggauaaauaugugaacaauuucauucucaagaacuuuccugcccugcugagcaccggggaguuccucaaacugcccuuugaacggcuugcguucguccugucuuccaauagccucaagcacuguacggagcuggaacuuuucaaggccgcuugccgcuggcugagacucgaggacccucggauggauuacgccgcuaaacugaugaagaacauccgcuuuccccugaugaccccucaggaccucauuaauuauguucagacaguggacuucaugagaaccgauaacacaugugugaaucugcuucuggaggccucuaacuaccagaugaugccguauaugcaacccgucaugcaguccgaccggaccgcgauccgcagcgauucuacgcaucucgugacacugggaggcguucuuagacagcagcugguggucuccaaagaacuccggauguacgacgagcgcgcccaagaauggagaagccuggcuccuauggaugcuccccgguaccagcacgggauugccgugaucggaaacuuucuguauguugugggcggccaguccaauuacgacaccaaggggaaaacagccgucgauaccguguuccgcuuugacccuagauauaacaaguggaugcaagucgccucucucaaugagaaacggaccuucuuucaccugagcgcucuuaagggacaucuguacgcggugggcgggagauccgccgcuggagaacucgccacaguugagugcuauaacccccgcaugaaugaguggagcuacguggccaagaugucugaaccgcacuauggccaugcugggacggucuacggaggccugauguacaucuccggcgggauuacccacgauacauuccagaacgagcugauguguuuugacccugauaccgacaaauggaugcagaaggcccccaugacaaccgugcggggacuucacugcauguguacgguuggcgacaaacucuaugugaucgggggaaaucauuucagaggcacaagcgauuacgacgauguccugucuugcgaauauuacagcccuacccuggaccaguggacccccauugcggcuaugcuccgcgggcaauccgaugugggcguggccguuuuugagaacaagaucuaugucgugggaggcuacucuuggaauaaccggugcaugguggaaauuguccagaaauaugaccccgagaaggaugaguggcacaagguguucgaccugccugaaagccuugggggaaucagagccuguacacugaccguuuuuccgcccgaggaaaauccuggcucccccagccgcgagucuccucucuccgcucccagcgaucauucuuga

SEQ ID NO: 71250 - RNA, 3039 nt, Artificial Sequence
  derived and/or modified sequence opt5 from KL__Homo_sapiens__NP_004786
augcccgccagcgcuccuccgagacggccccgcccucccccucccucccugucucuccugcuugugcugcucggccuugggggaagacggcuucgcgccgagccuggcgacggggcgcagaccugggcuagauucagccggccgcccgccccugaagccgcuggacuguuucaaggcacauuccccgauggguuucucugggccgucggauccgcugccuaccagacggagggcggcuggcagcagcacgggaagggagcgucuaucugggacaccuucacacaucacccucuggcucccccgggcgauagccgcaacgccucccugccucucggggcccccucuccucugcaacccgcuaccggagacguugccagcgauuccuauaauaacguguuuagagacacagaagcgcuucgggagcugggcgugacccauuaccgcuucagcauuucuugggccagaguccuccccaauggguccgcuggagugccuaaccgggaaggccugcgcuauuacagacggcuucuggagcgccucagagagcugggcguucagccgguggucacacuguaucacugggaucucccccagcggcugcaggacgccuacgggggaugggcuaauagagcccuugccgaucauuuucgcgacuaugcugaacugugcuuccggcacuuuggcgggcaagugaaauacuggaucaccauugauaacccuuacguuguggcguggcacggauaugccacgggcagacucgcucccgggauccgcggaagcccucggcugggcuaccuugucgcccauaaucugcuccuggcccacgcuaagguguggcaucuguauaacaccucuuucagacccacacagggcggacagguguccauugcccucagcucucacuggaucaauccgcgccggaugaccgaccacuccaucaaagagugucaaaagagccuggauuuuguccuugggugguucgcgaaaccuguuuuuauugacggcgacuaccccgaauccaugaagaacaaucugucuagcauccucccugauuucacagaguccgagaagaaauucauuaaggggaccgcugacuuuuucgcccugugcuuuggacccacgcuuagcuuccagcugcucgauccucauaugaaauuuagacagcuggaaucucccaaccugcgccagcuccuguccuggaucgaccuugaguucaaucacccgcaaauuuuuaucguggaaaacggcugguucgugagcgggacaaccaagcgggaugacgccaaauauauguacuaucugaagaaguuuauuauggagacacucaaagcuaucaagcuggauggcgucgacgugaucggauacaccgccuggucucugauggauggcuucgaauggcauagaggguacagcauucgccggggacuguuuuauguugacuuccucucccaggauaaaaugcugcugccuaagucuagcgcucucuuuuaccagaaacugaucgagaagaauggcuucccuccccuucccgagaaccagccgcuggaagggaccuuccccugugacuuugccuggggaguggucgacaacuauauucaaguggauacaacgcucucccaguucaccgaccugaauguuuaccugugggaugugcaccauagcaaaagacuuaucaaggucgacggcguggucacaaagaaacggaagucuuauugcguggauuuugcggccauucagccucagaucgcucuccugcaagagaugcacguuacccacuuccgcuuuucccuggacugggcccucauccugccccuugggaaccagagccaggugaaucauacaauucugcaguacuauagauguauggcuucugaacucguccgggugaacaucaccccuguuguggcccuguggcaacccauggcgccuaaucagggccugcccagacuucucgcccgccagggagcuugggagaacccguacacggcccuggcuuucgccgaauacgcccggcugugcuuucaggagcucggccaccaugucaaacuguggauuacaaugaaugagccuuauaccagaaacaugaccuacuccgcugggcacaaucuucugaaggcgcacgcccucgcuuggcauguguauaacgaaaaauuccgccacgcccaaaauggaaagaucagcauugcccugcaggcugauuggaucgagcccgccuguccuuuuucccagaaggacaaagaaguggcggagagaguucuggaguucgauaucggcuggcuugcugaacccauuuuugggucuggagacuacccgugggucaugcgggauuggcucaaccaacgcaauaacuuccugcugccuuauuuuacagaggacgaaaagaaacucauccagggcaccuucgauuuccuggcccuuagccauuacacaacgauucugguggacuccgagaaggaagaccccaucaaauauaaugauuaccucgaggugcaggagaugaccgacauuacauggcugaacucuccuagccaggucgccgugguucccugggggcugagaaaggugcuuaacuggcugaaguuuaaauacggcgaucuccccauguauaucauuuccaauggaaucgacgauggccugcacgcugaagacgaucaacuccgggucuacuauaugcagaacuacaucaaugaggcccugaaggcgcauauucuugacgggaucaaccugugcggauauuucgcuuacagcuuuaaugaucgcaccgccccuagauucggccucuaucgguacgccgcugaccaguuugaaccgaaagccucuaugaagcacuaccgcaaaauuaucgauuccaacggguuccccggaccugagacacuggaaagauuuugucccgaggaguucaccgugugcacggaauguagcuuuuuccacacccggaagucucugcuugcuuuuauugccuuccuguucuuugcguccaucaucagccucucucugauuuucuauuacagcaagaaaggccgcagauccuauaaguga

SEQ ID NO: 71251 - RNA, 831 nt, Artificial Sequence
  derived and/or modified sequence opt5 from KLK10__Homo_sapiens__NP_002767
augagagcuccccaccuucaucucagcgccgccuccggcgcgcgggcucuggccaagcugcugccucuccugauggcccagcuuugggcugccgaggcugcccugcucccgcaaaacgacacccgccuggaucccgaagcguacgggucuccuugcgccagaggaagccagcccuggcaagugucccuguucaauggccucucuuuucacugugcugggguccugguugaccagagcugggugcuuacagccgcucauugcggaaacaaaccucugugggcccgggugggcgaugaccaccuccugcuucugcagggggagcagcuccgcagaacgacccgguccgucgugcaucccaaguaucaccagggaucuggcccuauccugccgcgcagaacagaugaacacgaccugaugcuccugaaacuugcgcggcccguugugcugggcccucgcgucagagcccuccagcugcccuaccggugugcucaaccuggggaucagugccagguggccggauggggcaccacagcugcccgcagaguuaaguauaauaaagggcuuaccuguagcuccauuacaauccugagccccaaggagugcgaaguguucuacccgggagucgugaccaacaauaugauuugugccggccucgaccgggggcaggauccuugccaaucugacuccggaggcccccuggugugugaugagacgcugcagggcauccucagcuggggagucuauccuugcgggucugcucagcaucccgcgguuuacacccaaauuuguaaguauauguccuggaucaacaaagugauccgcagcaauuga

SEQ ID NO: 71252 - RNA, 753 nt, Artificial Sequence
  derived and/or modified sequence opt5 from KLK11__Homo_sapiens__NP_001129504
augagaauccugcagcucauucugcuugcccuggcuaccggccucgucgggggagagacacggaucauuaagggcuucgaaugcaaaccccacagccaaccuuggcaggccgcgcuguuugagaagacgcgccuucuguguggggcuacccucaucgccccgagauggcugcugacagccgcucauugccucaaaccccgguacauugugcaccugggacagcauaaccuucagaaggaagagggcugugaacaaacccgcacagccaccgaguccuucccucaccccggguuuaauaacucucugccuaauaaagaccauagaaacgauaucaugcucguuaagauggcuagccccguguccaucacaugggccgugcggccucugacccuuucuagccgcugcgucacggcgggaaccuccugucugauuucuggcuggggcagcacauccagcccgcagcucagacugccccacacccugcggugcgccaauaucacaauuaucgagcaccagaagugugaaaacgcuuauccugggaauauuaccgacacgauggugugcgccucuguucaggagggaggcaaagauuccugucaaggggacagcggaggcccccucgugugcaaccagucucugcaggggaucauuuccuggggacaggauccuugugcuaucacacgcaagcccggcgucuacaccaaagugugcaaguauguugacuggauccaagaaacaaugaaaaauaacuga

SEQ ID NO: 71253 - RNA, 765 nt, Artificial Sequence
  derived and/or modified sequence opt5 from KLK12__Homo_sapiens__NP_062544
augggccugagcaucuuccuccugcuuugcgugcuggggcucucccaggccgcuacccccaagauuuuuaacggaacagaguguggcagaaauucucaaccuuggcaggucgggcuguucgaaggaacgagccuucggugcggcgggguucugaucgaccaccgcugggugcucaccgccgcgcauuguuccggaucuagauacugggugcggcugggcgagcacagccugucccagcucgauuggacagaacagauucgccauucuggcuuuagcgucacccacccgggguaucugggagcuuccacaagccaugagcacgaccuuagacugcuccggcugcgccuucccgugagaguuaccucuuccgugcaaccucugccccucccuaacgauugcgccacagccggcaccgaaugucacgucagcggguggggaaucacgaaucauccccggaacccuuucccggaccugcugcagugccucaaucugucuauugugucccacgcuaccugucauggcguuuaccccgggcgcaucacaagcaacauggugugcgccggaggcgucccuggccaggaugcuugucagggggacucuggaggcccccuugugugcgggggagugcugcaaggccucgucuccugggggagcguuggaccuuguggccaggauggcauccccgggguguauaccuacauuugcaauuccacacuggugggacuuggcaccucuuggaacuuuaauagcugccagccguucuga

SEQ ID NO: 71254 - RNA, 834 nt, Artificial Sequence
  derived and/or modified sequence opt5 from KLK13__Homo_sapiens__NP_056411
auguggccccuggcccucgugaucgcuagccugacccuugcccuguccggcggggucucucaggagagcuccaagguucucaacacaaauggaacgucuggcuuccugccugggggauauaccugcuuuccgcacagccaacccuggcaggcggcccuucuggugcagggcagacuccugugugggggagugcugguccauccuaaaugggugcucacagcugcccacugccugaaggaaggccuuaaaguuuaccugggcaagcaugcucucgggcggguggaggccggagaacagguccgcgaggugguucacuccauuccccauccugaauacagacggucucccacccaccugaaccacgaccaugauaucaugcuucuggagcuccaaagcccugugcagcugacaggcuauauucagacccugccgcucucccacaauaaccgccugacacccgggaccacguguagagucagcggauggggcaccacaaccucuccucaggugaauuaccccaaaacacuucaaugcgcuaacauccagcugcgguccgacgaggaaugucgccagguguauccugggaagauuaccgauaauaugcucugcgccggaacgaaggagggcggcaaagacagcugugaaggggauucuggaggcccccuggucugcaacagaacacuuuacgggaucguuuccuggggagacuucccguguggccagccugaucggcccgggguguauacccgcgugagcagauacguccuguggauccgggagacaauucgcaaguacgagacccaacagcagaaauggcucaagggaccucaauga

SEQ ID NO: 71255 - RNA, 804 nt, Artificial Sequence
  derived and/or modified sequence opt5 from KLK14__Homo_sapiens__NP_071329
augagccugagagugcucggcuccgggaccuggcccucugccccuaagauguuccugcuucugacagcucuccagguccuggccaucgcgaugacgcaaagccaggaggacgaaaacaaaauuaucggaggccauaccugcacacgguccucucagccguggcaggcugcccuucuggccgggccccgcagacgguuucucuguggaggcgcucugcugagcgggcaauggguuauuaccgccgcucacugcggacgcccuauccuccagguggcccugggcaagcacaaucuuagacggugggaggcgacacaacaggugcugcgcgucgugagacagguuacccaucccaacuacaauucccggacacacgauaacgaccucaugcugcuucagcugcagcagccugcccgcauuggcagagcugugcggcccaucgaagucacccaagccugugcuucuccugggacgagcugccgcguguccggauggggcaccaucagcucuccgauugccagauaucccgcgucccuccaguguguuaauaucaacauuagcccugaugaggugugccagaaagccuacccccggacaaucaccccugggauggucugugcuggagugccccaaggcgggaaggacucuugccagggagauuccggcggcccgcuggugugucgcgggcagcugcagggacucgucagcuggggcauggaaagaugcgcccugccuggguaucccggaguuuacacaaaucuuuguaaauaucggucuuggauugaggagaccaugagagacaaguga

SEQ ID NO: 71256 - RNA, 768 nt, Artificial Sequence
  derived and/or modified sequence opt5 from KLK15__Homo_sapiens__NP_001264010
auguggcugcuccugacccuuagcuuccugcucgccuccacagcucaggacggcgauaagcugcuugagggggacgaaugcgcgccccacucucaaccuuggcaaguggcccuguacgagagaggacgguuuaacuguggcgcuagccucaucuccccgcauuggguccugucugccgcccacugccagagccgcuucaugagaguucggcugggggaacauaaucuccgcaaaagagauggacccgagcagcugcggacgaccucccgcgugauuccucaccccagauaugaagcucggucucaucgcaacgacaucaugcuucugagacucgugcagccugcccggcugaauccccagguccgcccugcugugcuuccgacaagauguccccacccuggcgaggccugcguugugagcggguggggacuggucucccacaacgagcccggcaccgcgggcagcccucggucucaggugucccuccccgauacacugcauugugccaauauuagcaucauuucugacaccuccugcgauaagagcuacccggggcgccugacaaacaccaugguuugugcuggagccgaaggcagaggggcugagucuugcgaaggagacuccggcgggccucucguguguggaggcauccugcagggcaucgucagcuggggagaugugcccugcgacaauacgaccaaaccugggguguauacaaaggucugucacuaccuugaguggauucgggagaccaugaaaagaaacuga

SEQ ID NO: 71257 - RNA, 789 nt, Artificial Sequence
  derived and/or modified sequence opt5 from KLK1__Homo_sapiens__NP_002248
augugguuccuggugcucugccuggcccuuagccugggcgggaccggagcugcgcccccuauccaguccagaauugucggcgggugggagugugaacaacacucucagccguggcaggccgcucucuaccauuuuagcacauuccagugcggaggcauccugguucaccggcaaugggugcuuacggccgcccauuguauuuccgacaacuaucagcuguggcucgggcgccacaaucuguuugaugacgagaacaccgcucaguucgugcaugucucugagagcuuuccccacccuggauucaauaugucccugcucgagaaccacacaagacaggccgaugaagacuacucucaugaucugaugcuucugcggcucaccgagcccgcugacacaaucaccgaugccgugaagguuguggagcugccuacagaagaacccgaagucggcagcacgugccuugcguccggcugggggagcauugagccugagaauuuuucuuucccggacgaucugcaauguguggaccucaaaauccugcccaacgaugaaugcaagaaagcccacguucagaaggugaccgacuuuaugcugugugucggacaucucgagggcgggaaagauaccugcgugggagacuccggcgggccucugaugugugacggagugcuucagggcgucacaagcuggggcuauguucccugcgggaccccuaauaagcccucuguggcugugcgcguccuguccuacgugaaguggaucgaagauacaauugccgagaacagcuga

SEQ ID NO: 71258 - RNA, 672 nt, Artificial Sequence
  derived and/or modified sequence opt5 from KLK2__Homo_sapiens__NP_001002231
augugggaccuggugcucagcaucgcccuguccgucggcugcaccggggcuguuccccuuauucagucuagaaucgugggaggcugggagugugaaaagcacagccaaccuuggcaaguggccgucuacucccaugggugggcgcacugcggaggcgugcugguucauccgcagugggugcucacagcugcccacugucugaaaaagaacucucaggucuggcuugggcggcauaaucuguucgagcccgaagauacgggacagcgcgugccuguuagccacuccuuuccccacccucucuauaacaugucucugcugaaacaucagagccucagacccgacgaggauuccagccacgaccugaugcuucugcggcucucugaaccugccaagauuaccgauguggucaaagugcugggccuuccgacacaggagcccgcucugggcaccacaugcuacgccuccggguggggaagcaucgagccugaagaguuccuccgccccagaucucugcagugugugucccugcaucuccugagcaaugacaugugcgcucgggccuauucugaaaaggucaccgaguuuaugcuuugugcgggccuguggacagggggaaaggauaccugcggcguuucccacccuuacagccaacaccucgaggggaaaggauga

SEQ ID NO: 71259 - RNA, 717 nt, Artificial Sequence
  derived and/or modified sequence opt5 from KLK3__Homo_sapiens__NP_001025218
augugggugcccgucguuuuccugacccucagcgugacauggaucggcgccgcuccucugauucuuuccagaaucgucgggggaugggagugcgaaaagcacucucagccguggcaagugcugguggccagccggggccgcgcgguuugugggggagugcucguccauccccagugggugcugacggcugcccacugcauuagaaacaaauccguuauccuucugggccggcauucucucuuucacccugaggacaccggacagguguuccaggucagccauuccuuuccccacccucuguacgauaugucucugcucaagaaucgcuuccugagacccggggacgauagcucccacgaccuuaugcugcuccggcugagcgaaccugccgagcuuacagaugcugugaaagugauggaccugccgacccaagaacccgcccucggcacaaccuguuaugcuucuggcuggggguccauugagccugaggaauuucugacacccaagaaacugcagugcgucgaucuccauguuaucagcaacgacgugugugcccaggugcacccucagaaggucaccaaguucaugcugugcgcgggacgcuggacgggcgggaaaucuaccuguuccugggugauccuuauuacagagcugaccaugcccgcccucccgaugguucugcauggaagccuugugccuuggagaggcggggucuga

SEQ ID NO: 71260 - RNA, 765 nt, Artificial Sequence
  derived and/or modified sequence opt5 from KLK4__Homo_sapiens__NP_004908
auggccaccgcuggcaaccccugggggugguuccugggauaccucauccugggcguggccgggagccuugucuccggaucuugcagccagauuaucaauggcgaggacuguuccccucacucucaaccguggcaggcggcucugguuauggaaaacgagcucuuuugcagcggggugcuggugcauccccaguggguccuuuccgccgcccacuguuuccaaaauucuuauacaauuggacugggccuccauagccuggaagcugaucaggagccuggcucccagaugguggaagccagccugucuguuagacaccccgaguacaaccggccucuccuggcuaaugaccuuaugcugaucaagcucgaugaguccgugagcgaaucugacacgauucgcuccaucagcaucgccucucagugccccaccgcggggaacuccugucuggucagcggauggggccuucuggccaaugggagaaugccuacagugcuccagugcguuaacguguccgucgugucugaggaaguguguagcaaacuguaugauccgcuguaccaucccuccauguuuugcgcuggaggcgggcaagaccagaaggauagcuguaauggagacucuggcggcccucucauuugcaacggguaucugcagggacuugucuccuucggcaaagcccccugugggcagguuggagugccuggcguguacaccaaucugugcaaguuuacagaguggaucgagaaaaccguccaagcuagcuga

SEQ ID NO: 71261 - RNA, 882 nt, Artificial Sequence
  derived and/or modified sequence opt5 from KLK5__Homo_sapiens__NP_036559
auggccaccgcuagacccccuuggaugugggugcugugcgcccucaucacagcgcugcuucugggcgucacggagcacguucucgcuaacaaugacgugagcugugaucauccguccaacaccgugcccucugggagcaaucaggaccugggagccggcgccggggaagaugcucgguccgacgauucuagcucccgcauuaucaacggaucugacugcgauaugcacacacaaccuuggcaggccgcccuucugcucagacccaaucagcuguacuguggcgcuguccuggugcauccucaguggcuccugaccgcggcccacugccggaagaaaguuuuccgcgugagacuugggcauuauagccugucccccgucuacgagagcggacaacagauguuucagggcgugaagucuauuccucacccgggcuauucccaccccgggcauagcaacgaccucaugcugaucaaacuuaaucggcgcauuagaccuacaaaggauguucggcccaucaacgugucuucccacuguccuagcgcuggaaccaaaugccuggucucuggcugggggacaaccaagagcccccaggugcauuucccgaaggugcuccaaugucugaauaucuccguccugucccagaaacgcugcgaagacgccuacccuagacagauugaugacacgauguuuugugcuggagauaaggccggccgggacucuugccagggggacagcggaggccccguuguguguaacggcucccuccaagggcuggugagcuggggagauuauccuugcgcgcgccccaauagacccggcgucuacaccaaccuuugcaaauucacaaaguggauccaggagaccauucaggccaauucuuga

SEQ ID NO: 71262 - RNA, 735 nt, Artificial Sequence
  derived and/or modified sequence opt5 from KLK6__Homo_sapiens__NP_001012982
augaagaaacugauggugguccucagccugaucgccgcugccugggcggaggaacagaacaagcugguucacggcgggcccugcgacaaaaccucccauccuuaccaagcugcccuguauacaucuggacaccuccuguguggcggggugcuuauucauccgcugugggugcucacggccgcucacugcaagaaacccaaucugcaggucuuccugggaaagcauaaccucagacagcgggagagcucccaggaacaaucuagcgugguucgcgccgugauccacccugauuacgacgcugccucccacgaucaggacauuaugcugcuuagacuggcgcggcccgccaagcucucugagcugauccagccucuuccccuggaacgcgauuguagcgcuaauaccacauccugccauauucucggcugggggaaaaccgccgacggagauuuuccugacacaauccagugugcuuauauccaccuggucagcagagaggagugcgaacaugccuacccgggccaaauuacccagaacaugcugugugcgggcgaugagaaguaugggaaagacucuugccagggagauuccggcgggccccucguguguggagaccaccuucggggccuuguuagcugggggaauaucccuugcggaucuaaggaaaaacccggcguguacacaaacgucugucgcuauaccaauuggauucagaagacgauccaagccaaguga

SEQ ID NO: 71263 - RNA, 546 nt, Artificial Sequence
  derived and/or modified sequence opt5 from KLK7__Homo_sapiens__NP_001193982
augaacgaguacaccgugcaccugggcagcgacacacucggggauagacgggcccagcgcaucaaggcuuccaaaucuuucagacaucccggauauagcacgcaaacccacgucaaugaccugaugcuuguuaagcugaacucccaggcccggcucucuagcauggugaaaaaggugcgccugccuuccagaugcgagccgcccggcacaaccuguacagucucuggguggggaaccacaaccagcccugaugugacguuucccuccgaccuuaugugcguugaugugaaacugauuagcccucaggacuguaccaaggucuacaaggaucuccuggaaaauucuaugcugugcgcgggcauccccgacuccaaaaagaacgcuuguaauggggauagcggaggcccucucgugugccggggcacacugcaggggcuuguuucuuggggaaccuucccguguggccaacccaacgacccugggguguauacacaggucugcaaauuuaccaaguggauuaaugauacgaugaaaaagcaucgcuga

SEQ ID NO: 71264 - RNA, 783 nt, Artificial Sequence
  derived and/or modified sequence opt5 from KLK8__Homo_sapiens__NP_009127
augggcagaccccggccucgcgccgcuaagaccuggauguuccugcuccugcuugggggagccugggcgggccacagcagagcucaggaggacaaagugcucgggggacaugaaugccaaccgcacucccagcccuggcaggccgcccuguuucagggccaacagcugcuuugugggggaguccugguuggcggcaacugggugcucacagcugcccauugcaagaaaccuaaguacacggugcggcugggggaucacucucugcagaauaaagacggacccgagcaggaaaucccugucgugcaaagcauuccccauccuuguuauaacuccucugauguugaggaccacaaucacgaucucaugcugcuucagcugcgcgaccaggcuagccucggcuccaaggugaagccgaucucucuggccgaucauugcacccagcccgggcaaaaauguacagucagcggauggggcaccgugacauccccuagagaaaacuuccccgacacccuuaauugcgcggagguuaagauuuuuccucagaaaaagugugaggaugccuaccccgggcagaucacagacggaauggugugcgcuggcagcucuaaaggcgccgauaccugucaaggggacuccggaggcccgcuggucugcgauggggcucuccagggaauuacgagcuggggcucugacccuugugggcgguccgacaagcccggaguguauaccaacaucugccgcuaccuggauuggaucaagaaaauuaucggcagcaagggcuga

SEQ ID NO: 71265 - RNA, 753 nt, Artificial Sequence
  derived and/or modified sequence opt5 from KLK9__Homo_sapiens__NP_036447
augaagcugggccuccugugcgcccuucugagccuccuggcugggcacggaugggccgacaccagagcgaucggcgcugaggaaugucggcccaacucccagccuuggcaagccgggcuuuuccaucugacacgccucuuuugcggagccacgcugauuucugauagauggcugcucaccgcugcccacugucggaaaccguaccugugggugcgccuuggcgagcaucaccuguggaagugggaagggcccgagcaacucuucagagucacagacuuuuucccucaucccggauuuaauaaagaucugagcgcuaacgaccacaaugaugacaucaugcuuauucggcugccucgccaggccagacucucccccgcgguucagccucugaaccugucucagaccugcgugagcccgggcaugcagugucucaucuccggcuggggagccgugucuagccccaaggcucuguucccugucacacuucagugcgccaauauuuccauccuggaaaacaaacucugucacugggcuuaucccgggcauaucagcgauucuaugcugugcgccggccuuugggaagggggacggggcuccugucagggggacagcggaggcccucuggugugcaauggcacccucgcggggguugugucuggaggcgccgagcccuguucccgcccgagacggccugcugucuacacaagcgugugccacuaucuggauuggauucaagagaucauggagaacuga

SEQ ID NO: 71266 - RNA, 1917 nt, Artificial Sequence
  derived and/or modified sequence opt5 from KLKB1__Homo_sapiens__NP_000883
augauccuguucaagcaggccaccuacuuuauuagccucuucgcuacaguguccugcggcugucugacgcaacuuuaugagaacgccuuuuucagagggggagacgucgcgucuauguacacccccaaugcucaguauugccagaugcgguguacauuucacccucgcugccuccuguucagcuuucugccggccuccucuaucaacgauauggagaaaagauucggcuguuuucuuaaggacagcguuaccgggacacugcccaaagugcaucggaccggagccguguccggccacucucucaagcagugcgggcaucaaauuagcgcuugucaccgcgauaucuacaaaggagucgacaugagaggcgugaauuucaacguuuccaaggugagcucugucgaagaaugccagaagcgguguacauccaauauucgcugccaguuuuucagcuaugccacccagacguuucauaaagcugaguacagaaacaauugucugcugaaguauucuccuggcgggacccccacagccaucaaagugcucuccaacguugaaagcggauucucucugaagccuugcgcgcuuuccgagaucggcugccacaugaauauuuuccaacaccuggccuuuagcgauguggacgucgcucgggugcucacccccgaugccuucgugugucgcacaaucugcaccuaccauccuaacugucuguuuuucacguuuuacacaaaugucuggaaaauugagucccagagaaacguuugccuucugaagaccucugaaagcgggacaccguccagcucuacaccccaggagaauaccaucuccggauauagccuccugaccuguaagcggacgcugccugaacccugccacucuaaaauuuacccuggcguggacuucgggggagaggagcucaacgugaccuuugucaagggcgugaauguuugucaggaaacaugcaccaaaaugauccgcugucaauucuuuacauauagccugcuucccgaggauugcaaggaagagaaauguaagugcuuccugagacucuccauggacggcucuccgacccggauugcuuacgggacgcagggaagcuccggcuauagccugcgccuuugcaacacaggggauaacucuguguguaccaccaaaacauccaccagaaucgucggaggcacaaauagcucuuggggagaauggccuuggcaagugucccugcagguuaagcucacggcccagcggcaucugugcgggggcagccugaucggccaccagugggugcucaccgcggcccacuguuuugacgggcugccccuucaggaugucuggagaauuuacuccggaauccugaaccucucugacauuacaaaggacaccccuuucagccaaaucaaagagauuaucauccaucagaauuauaagguguccgagggcaaccacgauauugcucugaucaaacuucaggcuccccugaauuacacagaauuucagaagcccauuugccucccuucuaaaggggacaccagcacgaucuacaccaacuguugggucacaggauggggcuucuccaaggagaagggggaaauucaaaauauccugcagaaagugaacaucccgcugguuaccaaugaggaaugccagaagcgcuaucaggauuacaaaauuacacaacggauggugugugccggcuauaaggagggaggcaaagacgccugcaagggggauagcggaggcccccucgucuguaagcauaacgggauguggagacuggugggaaucaccucuuggggcgaggggugcgcccgccgggaacagccuggcguuuacacgaaaguggcugaguauauggacuggauucuugaaaagacacaguccagcgauggaaaagcgcagaugcaaucucccgccuga

SEQ ID NO: 71267 - RNA, 537 nt, Artificial Sequence
  derived and/or modified sequence opt5 from KLLN__Homo_sapiens__NP_001119521
auggacagacccggcccugggagcgcccggccgggacgcaccgugcacgucuggggcuacagaguugaguggaaggugcggaacgggcgcaaacugcagcccuccgaaugggcuggaagaggcgaucucgggggauucaagcggcgcuggaaagacacaagagccacggugggcaccacauuucggcgcagaucucgggucagccuggugggcgagcuuuccaaguucccucugcccucugauagcuccgggggaaaaucuagcuccagcuuugcgcgcggcgcucucgccuggugcagacaacggaauccuaaccccucuugugccgcugccgaaaccggggcucgcacaucccugccuaaggagagaugccggggauggagacuuggcaauuggcugcauaagcacccgcaucccaacaccuguccucgccuccccgccugcuggcugccucccauccugacagaaagaggggagcggguuccgaaacucgugccucugcuugcguguuaucccaagagcaaaccuaaggacuga

SEQ ID NO: 71268 - RNA, 678 nt, Artificial Sequence
  derived and/or modified sequence opt5 from KLRB1__Homo_sapiens__NP_002249
auggaccagcaagccaucuacgcugagcugaaccuccccaccgauagcggcccugaauccucuagcccguccucucugcccagagacgugugccaggggagcccuuggcaccaguucgcccuuaagcuguccugugcgggaauuauccuccugguccuuguugugacaggccugucugugagcgucacgucccucauucagaaaagcucuaucgagaagugcuccguggauauucaacagagccggaauaaaaccacagaacgccccgggcugcugaacuguccuaucuauuggcagcagcucagagagaagugccugcuguuuucucauaccguuaaucccuggaacaauucccuugcugacuguagcacaaaagaaucuucccuccugcuuauccgggauaaggacgagcugauucacacccaaaaccucauccgcgauaaggccauucuguucuggaucggacugaauuuuagccucuccgagaaaaacuggaaguggauuaauggcucuuuccugaacagcaaugaccuugaaaucagaggggaugccaaagagaacuccugcauuagcaucucucagacauccguguacagcgaauauuguucuaccgagauccgguggauuugccagaaggagcugacgccuguccgcaauaaaguguacccggacagcuga

SEQ ID NO: 71269 - RNA, 648 nt, Artificial Sequence
  derived and/or modified sequence opt5 from KLRC1__Homo_sapiens__NP_998822
auggacaaccagggcgugaucuacagcgaucugaaucugcccccuaacccgaagagacaacagcggaaacccaaggggaauaaauccucuauucucgccaccgagcaggaaaucacauaugcugagcuuaaccugcagaaggccagccaagacuuccagggaaaugauaaaacguaccacugcaaggaccucccuuccgcgcccgaaaagcugauugucggcauccuugggauuaucugucugauccucauggcuucuguugugaccauuguggucaucccuagccgccauugcggacacugucccgaggaauggauuacauauuccaacucuugcuacuauaucggcaaagagagacggaccugggaggaaagccugcuggccuguacauccaagaauagcucucuccuguccauugauaacgaggaagagaugaaauuucuuagcaucauuucuccuuccagcuggaucgggguguuccgcaauucuucccaucacccguggguuaccaugaacggacuggccuuuaagcaugagaucaaagacagcgauaaugcugaacucaacugcgccgugcugcaggucaauagacuuaaguccgcucaguguggcucuagcauuaucuaccacugcaagcacaaacuguga

SEQ ID NO: 71270 - RNA, 696 nt, Artificial Sequence
  derived and/or modified sequence opt5 from KLRC2__Homo_sapiens__NP_002251
augaacaagcagagaggcaccuucagcgaggugucccuggcccaagaccccaaacggcagcagcgcaagccuaaagggaauaagucuagcaucuccggaacagaacaggagauuuuucaagucgaacucaaccugcagaauccgucucuuaaccaccagggcaucgauaaaauuuacgacugccaggggcugcugcccccucccgagaagcucacggcugaaguucuuggaaucauuuguaucgugcugauggccaccgugcucaagacaaucguccugauuccuuuccuggagcaaaauaacuuuagccccaauaccagaacacagaaagcgcggcauugcggccacuguccugaggaauggaucaccuauuccaacucuugcuacuauauugggaaggagcgcagaacaugggaagagagccuccuggcuuguaccuccaaaaauagcucucuucuguccaucgauaacgaggaagagaugaaguuccucgccagcauucugccgucuuccuggaucggaguguuucggaauagcucucaucaccccuggguuacgauuaacggccuugccuucaaacauaagaucaaggacuccgauaaugcugaacugaacugcgccgugcuccaggucaaucgccugaaaagcgcucaguguggcuccucuaugaucuaccacugcaagcacaaacuguga

SEQ ID NO: 71271 - RNA, 477 nt, Artificial Sequence
  derived and/or modified sequence opt5 from KLRC4__Homo_sapiens__NP_038459
augaacaagcagagaggcaccuacagcgaggugucccuggcccaagaccccaaacggcagcagcgcaagcucaaagggaauaagaucucuauuagcggaacaaaacaggaaaucuuccaagucgagcugaaccuucagaaugcuuccucugaucaccagggcaacgacaagacguaucauugcaaggggcugcucccuccgcccgaaaaacugaccgccgagguucuuggaauuaucuguauugugcugauggcgacagugcucaagaccaucguccugaucccuugcauuggcgugcuggaacagaauaacuuuagccucaauagacggaugcaaaaagcucgccacugugggcauugccccgaggaguggaucacauacuccaacucuuguuauuacauuggaaaggaaagacggaccugggaggaacgcguuugcuggccugugcugagacggacacuuaucuguuuccuguga

SEQ ID NO: 71272 - RNA, 651 nt, Artificial Sequence
  derived and/or modified sequence opt5 from KLRC4-KLRK1__Homo_sapiens__NP_001186734
augggcuggaucagagggcggcgcagcagacacuccugggagaugucugaguuccauaacuacaaucuggaccucaagaaaagcgauuuuuccacccgguggcagaagcaacgcugccccguggucaaaucuaaguguagagaaaacgccagcccuuucuuuuucugcuguuuuauugcuguugccaugggaauccgguucauuaucauggugacaauuugguccgcgguguuucuuaauucucuguucaaccaggaaguccagaucccgcugacggagagcuauugcggccccuguccuaaaaauuggaucugcuacaagaacaauuguuaucaguuuuucgacgaauccaagaacugguacgagagccaggcuucuugcaugucccaaaaugccagccuccugaaaguguauucuaaggaggaucaggaccuucugaaacucguuaaguccuaccacuggauggggcuggugcauauucccaccaacggaagcuggcagugggaagauggcucuauccuguccccuaaucuccugacaauuaucgagaugcaaaaaggggacugugcccuuuaugcuagcuccuuuaagggauacauugaaaacugcucuacccccaauacauacaucuguaugcagcgcaccgucuga

SEQ ID NO: 71273 - RNA, 540 nt, Artificial Sequence
  derived and/or modified sequence opt5 from KLRD1__Homo_sapiens__NP_001107868
auggccguguucaagaccacacuguggagacucaucagcggcacgcuggggauuaucugccuuucccugauggcuacccucggcauucugcuuaaaaacucuuuuacaaagcugagcaucgagcccgccuucaccccuggaccgaauauugaacuccagaaagacuccgauuguugcucuugucaagagaagugggucggguaccggugcaacuguuauuuuaucagcuccgaacagaaaacauggaaugagucucgccaccugugcgcgagccagaaguccagccugcuccagcugcaaaacaccgacgaacuugauuucaugucuuccagccagcaguuuuacuggaucggacugucuuauuccgaggagcauacagcuuggcucugggaaaauggcagcgcccugucucaguaccuuuuccccuccuuugagaccuucaacacgaagaauuguauugccuauaacccuaaugggaacgcucuggacgaaagcugcgaggauaaaaauagauacaucuguaagcaacagcucauuuga

SEQ ID NO: 71274 - RNA, 570 nt, Artificial Sequence
  derived and/or modified sequence opt5 from KLRG1__Homo_sapiens__NP_005801
augaccgacagcgugaucuacuccaugcuggagcuccccacagccacgcaggcucaaaacgauuauggcccucagcagaagucuagcuccucuagaccgagcugcuccugucuggucgccauugcgcuugggcugcucaccgcuguucugcuuucugugcugcucuaccaguggauccugugccaaggaagcaauuauuccacaugugccagcugccccucuuguccugaccgguggaugaaauacggcaaccacugcuauuacuucuccguggaagagaaggauuggaauagcucucuggaauuuugucucgcccgcgacucccaucugcuugucauuaccgauaaccaggagaugagccugcuccagguguuccugucugaggcuuuuugcuggaucgggcuuagaaauaacuccggauggcggugggaagacggcagcccccugaauuucucccgcauuucuagcaacuccuuuguucagacauguggggccaucaauaaaaacggacuccaagcuagcucuugcgaggugccucugcacugggucuguaagaaagugagacuguga

SEQ ID NO: 71275 - RNA, 1230 nt, Artificial Sequence
  derived and/or modified sequence opt5 from KLRG2__Homo_sapiens__NP_940910
auggaggaaagcugggaggccgcucccggcgggcaggccggagcggaacugccuauggagccggugggcucccucguccccacccuggaacaaccucagguucccgcuaaggugagacagccugaggggcccgagucuagcccuuccccggccggagccguggaaaaagcugccggcgcugggcuugagcccucuagcaagaaaaagccucccuccccucggcccggaucuccgcgcgucccuccccugagccucggcuacggcgugugcccugaaccucccucccccgggccggcccugguuaaacuucccagaaacggagaggcgccuggcgccgagcccgcuccuagcgccugggcucccauggaacuccagguggacguccgggugaagccgguuggggccgcgggaggcuccuccacaccuagcccccgcccuucuacgagauuccugaaggugcccgucccugagucccccgccuuuagccggcacgcugauccggcccaucaacugcugcuccgcgcuccuucucaagggggaaccuggggcagacggucuccccuggccgccgcucgcacagaaagcggcugugacgcggaggggagagccucccccgcugaaggaucugccggcagcccuggguccccgaccugcugucggugcaaagagcuuggacuggagaaggaagaugccgcucuccugccccgcgccggccuugacggggaugagaaacugccuagagcggugacacucaccggacugcccauguaugucaagagccuguacugggcucucgccuucauggccgugcugcuugcuguuucuggcguggugaucgucgugcuggccucccgggcuggcgcccgcugucagcagugcccucccggguggguucucagcgaggaacacuguuauuacuuuucugcggaagcccaggcuugggaggccagccaggcuuucugcuccgccuaucaugcgacacugccucuucugucucacacccaggacuuucucggaagauaccccgugagccggcauuccugggucggcgccuggagagggccgcagggauggcacuggauugaugaggcuccucugcccccucaacugcuccccgaagacggcgaggauaaucuggacaucaacuguggggcccuugaagagggcacgcugguggcugccaauugcagcaccccgcgcccuuggguuugugccaaaggaacacaguga

SEQ ID NO: 71276 - RNA, 1461 nt, Artificial Sequence
  derived and/or modified sequence opt5 from KMO__Homo_sapiens__NP_003670
auggacagcuccgugauccagagaaagaaagucgccguuauuggcgggggacuggugggcucucuccaggcuugcuuccuggccaagcggaacuuucaaaucgauguguacgaggcgcgcgaagacaccagagucgcuacauucacgcgggggcgcagcauuaaucuugcccugucccacagaggacggcaggcccucaaagcugugggccuggaggaucagaucguuucucaagggauucccaugcgcgccagaaugauccauagccuuuccggaaagaaaucugcuaucccuuauggcaccaagagccaguacauucuguccgugagccgggaaaaccucaauaaggaccugcugacagccgcggagaaauauccgaacgucaagaugcacuuuaaucaucgccuccugaaauguaaccccgaagagggcaugaucaccgugcuugggucugauaagguuccuaaagacgugacaugcgaucugauugucggaugugacggcgccuacuccaccgugagaagccaccucaugaagaagccccgguucgauuauucucagcaguacaucccucauggguauauggagcugacaauucccccuaaaaauggagacuacgcuauggaaccgaacuaccuucacaucuggccccgcaauaccuuuaugaugauugcccugccuaacaugaauaaguccuucacgugcacccucuuuaugcccuucgaggaauuugagaaacugcugacaagcaacgauguggucgacuucuuucaaaaguauuucccugaugcuaucccccucaucggcgagaaacugcuuguucaggacuuuuuccugcucccggcccagccuaugauuucugugaaguguuccagcuuccacuuuaaaucccauugcgugcugcuuggggacgcggcccacgcuaucguccccuucuuuggacagggcaugaaugccggcuucgaagauugucugguguuugacgagcucauggauaaguucucuaacgaccugagccugugccucccuguguuuuccagacugcggauucccgaugaccaugcuaucagcgaucuuucuauguacaauuauauugaaaugcgcgcccacguuaacuccagcugguucaucuuucaaaagaacauggagagauuccugcacgccaucaugcccucuaccuuuauuccucucuacacaauggucaccuucagccggaucagauaucaugaagcugugcagcgcuggcacuggcagaaaaagguuauuaauaaagggcuguuuuuccuuggaucccugaucgcgauuucuagcacguaccuccugauccauuauauguccccgcggagcuuccugagacuccgccggcccuggaacuggaucgcccacuuuagaaauacaaccuguuucccugcuaaggccguggacucucuggagcaaauuuccaaccuuaucagccgcuga

SEQ ID NO: 71277 - RNA, 11919 nt, Artificial Sequence
  derived and/or modified sequence opt5 from KMT2A__Homo_sapiens__NP_001184033
auggcccacagcugccgguggcgguuccccgcucgcccuggaaccaccgggggaggcgggggaggcgggagacggggacugggcggcgcuccccgccagagagugcccgcccuccugcuuccucccgggccucccgucggaggcgggggaccuggcgccccucccuccccucccgccguugccgcugccgcugccgcggccgggucuagcggagcuggcgugccuggcggggccgcugccgcguccgccgcuucuagcuccucugccagcuccuccucuagcuccucuagcagcgcuucuuccggacccgcccugcuccgggugggccccggguuugacgccgcucugcaagucagcgcggccaucggaacgaaccuucgcagauuccgggcuguguuuggcgaguccgggggaggcggcgggucuggagaagacgagcaguuccugggcuuugggagcgacgaagagguucgcgugagauccccuacccggagccccucugucaagaccuccccucgcaaacccagaggacggccccgcagcggcucugauagaaauagcgccauucucuccgacccuucuguguucagcccgcugaacaaguccgaaaccaaaagcggggauaagaucaaaaagaaggacucuaaauccauugagaagaaacggggcagacccccuacauuucccggaguuaagaucaaaauuacccacggcaaggauaucagcgagcugccuaaggggaauaaagaagacucucucaagaaaaucaagcgcacacccuccgccaccuuccagcaggcuacgaaaauuaagaaacugcgggccggaaaacuuagcccgcugaaguccaaguuuaagaccggcaaacuccaaaucgggagaaagggagugcagauuguccgccggagaggccgcccucccucuacagagcggaucaaaaccccuagcgggcugcuuauuaacuccgaacuggagaagccccagaaggugagaaaagauaaggagggcacaccuccccucaccaaagaagacaagacggugguccgccagucuccgcggagaaucaaaccuguucgcauuauccccagcuccaagcggacagaugcgaccaucgcuaagcaacugcugcagagagccaaaaagggagcccagaaaaagauugagaaagaagcugcccagcuccaaggccggaaggugaagacacaggugaaaaauauccgccaguucauuaugcccgucgugagcgcuaucucuuccagaauuaucaagaccccucggagauuuaucgaggacgaagauuacgacccgcccauuaaaaucgcccgccuggagagcaccccuaacucucgguucuccgcgcccagcugugggucuagcgagaaguccagcgccgcuucucaacacuccagccagauguccucugacagcuccagaucuagcuccccuucuguugauacaagcacggacucccaggccagcgaagagauucaggugcuucccgaggaaagaucugauaccccugaaguccaucccccgcugccuaucucccaaagccccgagaaugagucuaacgacagacggucccgcagauacagcgugucugaacgguccuuuggaagccgcacaaccaaaaagcucuccacacugcagagcgcuccucagcagcaaaccucuagcucucccccuccgccccuucugacgcccccuccgccccuccagcccgccagcagcauuuccgaucacacacccuggcugaugccucccaccaucccucuggcgucucccuuccucccugccagcaccgcuccgaugcagggcaaaagaaaguccauccugcgggagcccacauuccgcuggaccucucuuaagcauagcagauccgaaccucaguacuuuagcucugccaaauaugcuaaggaggggcugauucggaaacccaucuucgacaauuuucgcccucccccgcucacaccugaagauguuggauucgccuccggcuuuagcgccucugggacggcugcguccgccagacuguucagcccccuucacuccggcacccgguuugacaugcacaagagaucuccccugcuccgcgcuccucgguucacacccagcgaggcccauuccagaauuuuugagagcgugacccugccuucuaaccgcacauccgccggaaccagcucuagcggcgucuccaaucggaaaagaaagcgcaagguguucucuccgauccggagcgaacccagauccccuucucacagcaugcgcacgcgguccgggagacugucuucuagcgagcucagcccccugaccccucccuccucugucagcuccucucuuagcauuuccgugagcccgcuggcuacaucugcccucaacccuaccuuuacauuccccucccauagccugacccaaucuggagaauccgcggagaaaaaucagcggccucgcaagcagacgagcgcucccgccgagccuuuuucuagcuccucucccacaccgcuguucccuugguucacccccggcagccagacagaaagagggcggaacaaagauaaggcccccgaggaacuuuccaaagaccgcgaugcugacaagagcguugagaaggacaaauccagagaacgggauagagagcgcgagaaggaaaauaaacgggagucuagaaaggaaaaacgcaagaagggaagcgagauccaauccucuagcgcccucuacccugugggccgggucuccaaagaaaaggugguuggggaggacguggcgaccucuagcuccgcuaaaaaggccaccggccgcaagaaguccucuucccacgauagcggaacagacauuacgucugucacccugggcgauacaaccgccgugaaaacaaagauccugaucaagaaagggcgcggaaaccucgagaagaccaaccuggaccuuggcccgacggcucccucccuggaaaaagagaagacacucugccugagcaccccuucuuccagcaccgugaaacacuccacaagcucuauugggagcaugcuggcccaggcugauaaacuucccaugaccgacaagcggguugccucccuccugaaaaaggcgaaagcccagcuguguaagaucgaaaaaucuaagagccucaagcaaacagaucagccuaaagcucagggacaggaguccgacucuagcgaaacguccgucagaggcccccgcauuaagcaugugugcagacgggccgcuguggcccugggccgcaaaagagccgucuuuccugaugacaugccgacccuuucugcucugcccugggaggagcgggaaaagauccucagcuccauggggaaugaugacaaaagcucuauugcgggauccgaggacgccgaaccucuggcucccccuaucaagcccaucaagccggugacacgcaacaaagccccucaagagccgcccguuaagaaaggcagacggagcagacgcugugggcagugcccuggaugucaggugcccgaggauugcggcgucuguaccaauugccuggacaagccuaaauucgggggacggaacauuaagaagcaguguugcaaaaugagaaagugccaaaaucuucaguggaugccgucuaaagccuaucuccagaagcaggcuaaagccgugaagaaaaaggaaaagaaauccaagacaagcgagaaaaaggauuccaaagaaucuagcguugugaagaacgucguggacuccagccaaaagcccaccccuucugcgcgcgaggaucccgcuccuaaaaaguccagcucugaacccccgccucggaaacccguugaggaaaagagcgaagagggcaauguguccgccccuggccccgaaucuaaacaggccacgaccccugcuagcagaaaguccucuaagcaggucagccaacccgcccuggugaucccgccucagccgcccacaaccgggccuccgcggaaagaggugcccaagacaaccccuuccgaacccaaaaagaaacagccucccccucccgagagcggaccggagcagucuaagcaaaagaaagucgcgccucgccccuccauuccuguuaagcagaaacccaaggaaaaagagaagccgccucccgugaacaaacaggaaaaugcuggcacacugaacauccucagcacccuguccaaugggaacucuagcaagcagaagauucccgccgacggagugcacagaauccgggucgauuuuaaagaggacugugaagccgagaaugugugggagaugggcgggcuuggaauccugacguccguuccuauuacaccccgcguggucugcuuccucugugcuucuagcggccauguggaauuuguuuacugccaaguguguugcgagccuuuccacaaguuuugucuggaagagaacgagagaccgcuggaagaucagcuugagaauuggugcugucggcgcugcaaauucugucaugucugcggcagacagcaccaggccaccaagcaacuccuggaaugcaacaaaugucggaacuccuaucaccccgagugccuggggccuaauuaccccaccaagccuacaaagaaaaagaaaguguggaucuguaccaagugcguucgcuguaaaagcugcggaucuacgacacccggcaaggggugggacgcucaguggucccaugauuuuagccucugucacgacugcgccaagcuguucgcgaaaggaaacuuuuguccucuuugcgauaaguguuacgacgacgaugacuaugaaucuaaaaugaugcagugcggcaagugcgauagaugggugcauuccaaaugugagaaucugagcgggaccgaggacgaaauguacgagauucucucuaaccugccggaauccgucgccuauacaugcgugaauuguaccgagcggcaccccgcugaauggagacuggcccuugagaaggagcugcagaucagccucaagcaagugcugacagcucuccugaacucucgcaccacgagccaccuucugcgguacagacaggccgccaaaccucccgaucucaauccugaaaccgaggaauccauucccagccgcuccucuccggagggaccugauccgcccguccugacagaaguuagcaagcaggaugaccaacagccucuggaucuugagggcgugaaacggaagauggaccagggcaacuauaccuccgugcuggaguucucugaugacaucgucaaaaucauucaggcugcgaucaauagcgacgggggacaacccgaaauuaagaaagccaacuccaugguuaagagcuuuuucaucagacagauggagcgcguguucccuugguuuagcgugaagaaaucccgguucugggaaccgaauaaggucagcucuaacuccggcaugcuccccaaugcugugcugccucccagccucgaucauaacuacgcccaguggcaggagagagaggaaaauucucacacagagcaaccuccccugaugaaaaagauuaucccggccccuaaacccaaggggccuggagaacccgacuccccgaccccucuucauccgcccacgccucccauucugagcacagaucgcucucgggaggacuccccugaacucaacccgcccccuggcaucgaggauaacagacagugcgcucugugucugaccuauggggacgauagcgccaaugacgcgggacgccuucuguacaucggccagaacgaguggacacacguuaauugcgcucucuggucugccgaaguguuugaggaugacgauggcucccugaagaacguccauauggccgugauucgggggaaacagcucagaugugaguucugccaaaagcccggagcuaccgucggcuguugccugaccagcuguacaagcaauuaccacuuuaugugcucccgcgccaaaaacugcguguuccuugacgauaagaaaguuuauugucagagacaccgggaccugaucaagggggagguggucccugaaaauggauuugagguguuccgcagaguuuuuguggacuucgagggcauuucucugcggagaaaguuucucaacgggcuggaacccgagaauauccauaugaugauuggaagcaugacgaucgauugccuuggcauccugaacgaccucuccgauugugaagacaaacuguucccuauuggcuaccagugcucucgggucuauuggagcaccacagaugcgcgcaagagauguguguauaccugcaaaaucguggagugucggccgcccguugucgaaccugacauuaauuccacaguggagcacgaugagaaccgcaccaucgcccauucucccacgagcuucacagaauccagcucuaaggagucccaaaauaccgcugaaauuaucagcccucccucuccggacagaccuccccacucccagaccagcggguccugcuauuaccaugugaucucuaaagucccccggauucgcacaccuagcuauucccccacccagagaucuccuggaugucggccgcuccccagcgccggcuccccuacacccacgacccacgagaucgugacaguuggggauccucugcuuagcucuggacugcgcuccauuggcagcagacggcacucuaccagcucccugucuccccagcgcagcaagcucagaaucauguccccgaugcggacagggaacaccuacagccgcaauaacgugucuuccgucagcacgaccggaacagcuaccgaccuggaguccucugccaaggugguugaucaugugcuuggcccucugaacagcuccacaucucucggccaaaauaccagcacauccucuaaccugcagagaacggucgugaccguugggaauaaaaacagccaccucgacggauccucuagcuccgaaaugaagcagagcucugcuuccgaucuggugagcaaaucuagcucccuuaagggcgagaaaacaaagguccugagcuccaagucuagcgaaggguccgcccauaauguggcguaccccggcauuccuaaacuggcgccccaggugcacaacaccaccucucgggagcucaaugucagcaagaucggcuccuuugcugaaccuucuagcguuuccuucagcucuaaagaggcccuguccuuuccccaccuucaucugagagggcaacgcaacgaccgggaccagcacacagauagcacgcagucugcuaauuccagcccggacgaggauaccgaagugaagacacucaaacugucuggcauguccaacagaagcucuauuaucaaugagcauaugggauccagcucccgcgaccggagacagaagggcaaaaagagcugcaaggaaaccuucaaagagaagcacucuagcaaauccuuucucgaacccgggcaagugacaaccggagaggagggcaaccugaagccugaguucauggaugagguccuuacgcccgaauauauggggcagcgcccuuguaauaacgugucuagcgacaaaaucggagauaagggccuguccaugccggggguucccaaggccccucccaugcaaguggagggcucugccaaagaacugcaggcuccucggaagagaacagucaaagugacccucacaccccugaagauggagaaugagagccaauccaaaaacgcgcuuaaggaaagcucuccugccagcccccugcagauugagagcacaucuccgaccgaaccuaucuccgcuagcgagaaucccggagacggcccuguugcccagcccucuccgaacaacacauccugccaagauagccaguccaauaacuaccagaaucucccugugcaggaccgcaaccugaugcugcccgaugggcccaagccucaagaggacggaucuuuuaaacggagauauccccgccggagcgccagagcucgguccaauauguucuuuggccucaccccucuuuacggggucagaagcuauggagaagaggacauuccguucuacucuuccagcacgggcaagaaacgcgggaagcggucugccgaaggccagguggauggagcggacgaucugagcacauccgacgaggaugaccuguauuacuacaacuuuaccagaacagucaucucuagcggcggggaagaaagacucgccucccauaaucuguucagagaggaggaacagugcgaucuucccaaaauuagccagcuggacggaguggaugacggcaccgaaucugauacguccguuaccgcuacaaccagaaagagcucucaaaucccuaagcgcaacgggaaagagaauggaacagaaaaccucaagaucgacagacccgaggaugccggcgagaaagaacacgugaccaaguccagcgugggccacaaaaaugagccuaagauggacaacugucauuccgucucucggguuaaaacacaggggcaggacagccuggaagcucagcuguccucucucgagagcucccgcagagugcacaccagcacgcccucugauaagaaucuucuggacacauauaacaccgaacugcucaaguccgauagcgacaauaacaacucugaugacugcggaaauauucugccguccgauaucauggacuuugugcuuaaaaacaccccuagcaugcaagcccugggcgagucucccgaguccagcagcuccgaacuccugaaucugggggagggacucggccuugauucuaaccgggaaaaggacauggggcuguucgaggucuucagccagcagcugccuacaaccgagcccguggauuccucuguuagcuccucuauuagcgcggaggaacaguuugaacucccucuggagcuucccuccgaccugucugugcucacaacgcgcagcccgaccguccccucccagaauccuagcagacuggccgugaucucugacuccggagaaaaacgggucacaauuaccgaaaagagcguggcuucuuccgagagcgaucccgcccugcucucuccuggcguugaccccacaccugaaggccauaugaccccggaucacuucauccaggggcacauggacgcugaucauaucuccuccccucccuguggauccguggagcagggccacgggaacaaucaagaccuuacgcgcaacagcucuacccccggacugcaggucccugugagccccacaguuccgauucagaaucagaaauacgugccuaacuccaccgauucucccggcccuagccaaaucuccaaugccgcuguccagacaacaccuccccaucugaagcccgccacggaaaagcucauuguggugaaccagaauaugcagccccuguauguucuucaaacacugcccaacggggucacccagaaaauccagcucacaucuagcguguccucuaccccuagcgugauggagaccaauacauccguccugggacccaugggcggcgggcugacgcucaccacaggacuuaacccuagccugccgaccucucaaucccuguuucccagcgcgucuaagggccuccugccuaugucccaccaucagcaccuucacagcuuccccgccgcuacacaguccucuuuuccucccaacauuagcaauccuccguccgggcugcucaucggaguucagcccccucccgacccucaacugcuggugagcgaaucuucccagagaaccgaucucagcacgacaguggccacccccucuuccggccuuaaaaagcggccgauuagccgccugcagacccgcaaaaacaagaagcuggcucccucuagcacaccuuccaauaucgcccccucugacgucgugagcaacaugacccucaucaauuucacaccuucccagcugcccaaccauccuagccuucuggaucucgggucucugaauacguccagccaccggaccguuccgaacauuaucaaaagauccaagucuagcauuauguacuuugagcccgccccucugcucccccaauccgugggaggcacagcggcuaccgccgcuggcacaucuaccaucagccaggacacgucccaucuuaccagcgggucugucuccggacuggccuccucuuccagcgugcugaauguugugucuaugcagacaaccacaaccccuacauccagcgccucuguccccggccacgugacccucacgaacccgcgccugcuugggacaccugauauuggaagcaucuccaaucugcucaucaaagcuagccagcaaucccugggcauucaggaccagcccguggcccugccucccucuagcgggauguucccucagcucggaaccucccaaacccccucuacagcggccaucacggcugccagcuccauuugcguccuuccgucuacccagacaaccggcaucacagcugccagccccuccggcgaggcggacgaacacuaucagcugcaacauguuaaccagcugcucgccagcaagaccgggauucacucuucccagcgggaucuggacagcgcuucuggaccucagguguccaauuuuacacaaaccguggaugcccccaacagcaugggccuugagcagaauaaagcucugucuuccgccguccaggcuagcccuacgucccccgggggaagcccgucuuccccuagcucuggccagagaagcgccucccccucugugccugggcccaccaagccuaagcccaaaacaaagcgcuuccaacucccgcuggacaaaggaaacggcaagaaacauaagguuagccaucugcggaccuccucuagcgaagcgcauaucccugaucaggagacaaccucccucacgagcggcacagggacccccggagccgaagcugagcagcaggacacagccucuguggagcaauccagccagaaagaauguggccagccugcugggcaagucgccgugcuucccgagguucaggugacccagaacccggccaaugaacaggagucugcggagcccaagacggucgaagaggaagaguccaacuuuagcuccccucugaugcuguggcuccaacaggaacagaagagaaaagagucuaucaccgagaagaaacccaagaaaggacugguguucgaaauuagcuccgaugacggcuuucagaucugcgcugagagcauugaagaugccuggaagucucuuacagacaagguucaagaggcccgcuccaaugcucggcugaaacagcucagcuucgccggggugaacggacugagaaugcugggcauccuccacgaugcugucguguuccugauugaacagcuuucuggcgccaagcacugucgcaauuacaaauuucgguuccauaagccugaggaggcgaacgaacccccucugaauccgcacggguccgccagagcugagguccaucuccggaaaagcgccuuugacauguucaacuuucuggcuucuaagcaccgccagcccccugaauauaaucccaacgaugaggaagaggaggaagugcaacuuaagagcgccagacgggcgaccuccauggaccugccuaugcccaugcgcuucagacaucucaaaaagacaucuaaagaggccguuggaguguaccggagcccgauccacggcagagggcuguuuugcaagcgcaauauugacgcuggagaaauggucaucgaguacgccggcaacgugauccgguccauucagaccgauaaaagagagaaguauuacgacagcaaggggaucggcuguuauauguuccgcauugaugacucugaagugguugaugcuacaaugcacggaaaugccgcucgguuuaucaaccauuccugcgagccuaauuguuacagcagagugauuaacaucgacggccagaaacacaucgucauuuucgccaugcgcaagaucuauagaggggaggagcugaccuacgauuauaaauuucccauugaagacgcguccaacaagcucccuugcaauugcggagccaaaaagugucggaaguuccugaacuga

SEQ ID NO: 71278 - RNA, 8148 nt, Artificial Sequence
  derived and/or modified sequence opt5 from KMT2B__Homo_sapiens__NP_055542
auggccgcugccgccggcggcgggagcugccccgggccuggguccgcucggggacgguuccccggccgccccagaggggccggaggcggcgggggacggggcgggcgcggaaacggcgccgagagagugcgggucgcucuccgcagagggggaggcgccaccggcccugggggagcugaacccggcgaggacaccgcccuccugcggcuucuggggcuccgcagaggacugcggcgccuuagacggcugugggccggcccucgcguucagagagggcggggaagaggccgcggccggggguggggacccucuagaggcugugugccugaagaggaauccuccgacggggagucugacgaggaagaguuucaaggauuccacagcgaugaagacguggccccguccucucuccgcagcgcucugcggucccagagaggccgcgcgccccgggggagaggccgcaagcauaaaacgaccccucugcccccuccccggcucgcugaugucgccccgaccccucccaagaccccugccagaaaacgcggagaggagggcacagaacggauggugcaggcccugaccgagcuucugagacgggcucaggcgccccaagcuccccgcagcagagccugcgaaccuucuaccccgcggagaucccgcgggcggcccccuggaagacccgccggcccuugucgcagaaagcagcaggcuguuguggucgcggaggccgcugugaccauccccaaaccggaaccucccccucccguugugccugucaagcaccagacggggagcuggaagugcaaagagggacccggcccggggccuggcacaccccggcgcggaggccaaucuuccagagggggacggggcgggcgcggaagaggcagagggggcggacuccccuuugugauuaaguucgugagccgcgccaaaaaggucaaaaugggccagcugucucuugggcuggaguccggacagggccaggggcaacaugaagagagcuggcaggacguuccucagagacgggugggauccggccaagggggcucuccguguuggaagaagcaggaacagaaacucgaugacgaggaagaggagaagaaagaagaggaagagaaggauaaagaaggagaggagaaggaagaacgcgccguggcugaagagaugaugcccgccgcggagaaagaagaggcuaagcugccucccccuccccugacaccucccgccccgagcccucccccuccccucccgccucccuccaccagcccuccgcccccucugugcccgcccccucccccucccgucucuccuccgccccuuccuucucccccucccccgccugcccaggaggaacaagaagaguccccgcccccugugguucccgcuacauguuccagaaagcggggcagaccuccgcugacccccagccagcgcgccgagcgggaagcugccagagcggggccugagggaacgagcccucccacacccaccccgucuacagccaccggcgggccucccgaagacagcccuaccguggcucccaaauccacaacguuucucaagaauauccgccaguucauuaugccugucgugagcgcccggucuuccagaguuaucaaaacaccccgccgguuuauggaugaggacccgccuaagccgcccaaaguggaagucagcccugugcugagaccgcccauuacaaccucuccucccgucccucaggagcccgcuccugugccgagcccuccccgcgcccccacaccucccagcaccccgguuccucuucccgagaagcggagauccauccugcgggaacccacguuccgcuggacaucucucaccagagagcugccucccccuccgcccgcgccucccccucccccggccccuucucccccucccgcuccugccaccuccucccggcgcccccugcuccugagagcuccgcaauuuacaccuagcgaagcccaccuuaagaucuacgaguccgugcugacaccgcccccucucggagccccggaagcucccgagccugagcccccucccgcggaugacagcccugccgaacccgagccgcgggcugucggcagaacaaaccaucugucucuuccucgcuucgcccccgugguuacgaccccugugaaagccgaagucagcccccacggcgcuccggcccugagcaaugggccucagacacaggcgcagcuccugcaaccccugcaggcucuccagacccagcugcuuccccaagcccugccucccccucagccgcagcuccaacccccucccucuccucagcagaugcccccucuggagaaggcccggauugcuggagugggcucccugccgcuuagcgggguggaggagaaaauguuuucucuccugaagagagccaaaguucagcuguucaagaucgaccaacagcagcagcaaaaggucgcggcuagcaugccccucuccccuggaggccagauggaggaaguggccggggccgugaaacagauuagcgaucgcggacccguccggucugaggacgaauccguggaggcuaagagagagcgcccuagcggccccgaauccccgguucagggcccucggaucaaacacgugugcagacaugccgcugucgcccuggggcaagcgcgcgccauggugcccgaggauguucccagacuuucugcucugccucuccgggaccgccaggaucuggccacagaagacaccagcuccgcuucugagacggaaagcgugcccuccagaucucggcgcggaaaggucgaggccgccggcccugggggagagagcgaaccgaccggcuccgggggaacacuggcucacacccccagacggagccuuccuucucaucacggcaaaaagaugagaauggcgcgcuguggccacugccgggggugucucagagugcaggauugcggauccugcguuaacugucuggacaagcccaaauuuggcgggccuaauacaaagaaacaaugcuguguguaucgcaagugcgauaaaauugaggcccggaagauggaaagacuggcuaaaaagggacggaccaucgucaagacgcuccugcccugggacagcgaugagucuccggaagccuccccuggacccccugggccccgcagaggagccggcgcuggcgggccgcgggaggaggugguggcccauccuggacccgaggaacaggacagccuucugcagcgcaaaucugcgagacggugugucaagcagcgccccuccuacgacauuuucgaagauagcgacgauuccgagccuggcgggcccccugcuccgagacggcgcacacccagagagaacgaacucccucugcccgagccugaggaacaaagccggcccagaaaaccuacccugcagccgguucuucagcucaaggcccgccggagacuggacaaagaugcccuggcucccggaccuuucgccucuuuucccaauggcuggacagggaagcagaaguccccugacggagugcaccgcgugcgggucgauuucaaagaagacugcgaucucgagaacguguggcugaugggcggccuuuccguucugaccucugugcccgggggaccgccuauggucugucuccugugcgcgagcaagggccugcaugagcuuguguuuugucaaguuugcugugaccccuuccaccccuuuugccucgaagaggcugaaagaccucugccccagcaucacgauaccuggugcugucgccggugcaaauucugucacgugugcgggagaaagggacgcggcuccaaacaucugcucgagugugaacggugcagacacgccuaucauccugccugucuggggccgucuuaccccacacgcgcuacgcggaagagacgccacuggaucugcagcgccugugucagaugcaaguccuguggagcuaccccuggcaaaaauugggacguggaguggucuggcgauuauagccuuugcccccggugcacacagcuguacgagaaggggaacuauuguccuaucugcacccgcuguuacgaagacaaugacuacgaguccaaaaugaugcagugcgcccaaugugaucacuggguucaugcgaagugcgaaggacucagcgacgaggauuaugaaauucugucuggccugcccgacuccgugcuuuacacaugugggccgugcgccggagcugcccagccuagauggcgggaggcucugagcggcgcccuccaagggggccugagacagguccuccagggccugcuuucuuccaaaguggugggcccccugcuccuguguacccagugcgggccugauggaaagcagcugcaccccggcccuugugggcuucaagccgucagccagcgguuugaggacggacauuauaaguccguucacucuuucauggaagauauggugggcauccugaugcgccauagcgaggaaggggagacgcccgacagacgggcuggcggacagaugaaaggccuccugcucaagcugcuugaguccgcguuugggugguucgaugcccacgacccgaaauacuggcgcagaagcacacggcugcccaacggagugcucccuaaugcuguccugcccccuucucuggaucacguguaugcccaguggcgccaacaggaaccggagacccccgaauccggccagccucccggggacccuagcgccgcuuuucagggaaaggaucccgccgcguucucucaucuugaggacccuagacaaugcgcucugugccucaaauacggcgacgccgauagcaaggaagccgggcggcugcucuauauuggccagaacgaguggacccacguuaauugugcuaucugguccgccgagguguuugaagagaacgacggaucucugaaaaacguccaugcggccguggcucgcggcagacagaugcggugcgaacuuugucugaagcccggggccacaguuggaugcugucugagcuccugccucucuaauuuccacuucaugugugcucgcgccagcuacugcauuuuucaggaugacaagaaaguguucugucaaaagcauaccgaucugcuugacggcaaagagaucgucaacccggauggguuugacgugcugagacgggucuacguggauuucgaaggaaucaauuuuaagcgcaaauuccucacaggccuggagccugacgcuauuaacguucucaucggguccauuagaaucgauagccugggcacgcuuucugaccuguccgacugcgagggacggcuguuucccauuggcuaucaguguagcagacucuacugguccaccguggaugcccgccggagaugcugguaucgcugccggauccuggaauacagaccuugggggccccgcgaggaaccggcgcaccuugaggccgcugaagagaaucagacaaucguccacucuccugcccccagcuccgagcccccuggaggcgaagaucccccucuggauaccgacgugcucguuccgggggcucccgagcggcauucuccuauucaaaaccuggaucccccucucagacccgacagcggauccgccccgccucccgccccucgcagcuucucuggcgcucggaucaaggugcccaauuauuccccuagcagacgcccccugggcggggucucuuuuggaccgcuucccuccccuggcagccccucuagccugacacaccauauuccuaccgugggggaucccgacuucccugcgccgccccggagaucccggagaccuucuccccuggccccucgcccuccucccagccggugggcuagcccgccccucaagacgagcccccagcugagagugcccccucccaccuccguugucacagcccuuacccccacaucuggagaacuggccccucccggcccugcuccgucucccccucccccugaggaucucgggcccgacuuugaggauauggaagugguguccggacuguccgccgcggaccucgauuucgccgcuagccugcuuggcaccgagccuuuucaggaagagaucgucgccgcuggcgccaugggguccucucacggaggcccgggggacagcuccgaagaggagagcucucccacaucccgcuacauucacuucccugugaccguugugagcgcgcccggacuggccccuucugcuacgcccggcgccccgagaaucgaacagcuggacggggucgaugacggaacagauuccgaggcugaagccgugcaacagccccggggccagggcaccccucccagcgggccuggaguugugcgcgcuggcguccucggggccgcgggagacagagcccggcccccugaggaucugccgucugaaauuguggacuucguucuuaaaaaccugggcgggcccggagauggcggcgcugggccucgcgaggagucccugcccccugcgccuccccuggcuaauggaagccagcccucccaaggccugaccgccagccccgccgacccuacaagaaccuuugcguggcuccccggggcuccuggagugcggguccuuucucugggccccgccccggaacccccuaagcccgcuacgagcaaaaucauccuggugaacaagcucggacagguguucgucaaaauggccggagagggcgaaccuguucccccgccugugaagcagcccccucugcccccuacaauuucccccaccgccccgacaucuuggacccuuccucccggcccucugcucggggugcugcccgucgugggaguugugcgcccggcucccccucccccucccccuccgcugacacucguccuuagcuccggccccgccucuccucccagacaggcgauccgggugaagcgcguuagcaccuuuuccgggagaucuccucccgccccgccucccuauaaagcuccucggcuggaugaggacggagaagccagcgaggauacgccccaagugccuggccugggguccggaggcuucagccgcgucagaaugaagacccccacagugcggggcguccucgaccuggauagaccgggggagcccgcuggagaagagucuccuggcccccuucaggaacgcuccccucugcucccccugccugaggacgggccgccccaggugccugacggacccccugaucugcuccuugagagccaguggcaucacuacucuggcgaagccuccagcuccgaggaggaacccccgucuccugacgauaaagaaaaucaagcgcccaagcggaccgggccucaucugagauuugagauuagcuccgaggacggauucagcguugaagccgagucucuggaaggcgcuuggcgcacacucaucgagaaagugcaggaagcccggggccacgcuagacugcgccaucuuuccuuuagcgggaugucuggagcccggcugcucggcauucaccacgaugcugugaucuuccuggccgagcagcugcccggggcgcaaagaugucagcauuacaaguuucgcuaucaccagcagggagagggccaagaggaaccuccccucaacccccauggggccgcucgggccgaagucuaccuuagaaagugcaccuucgacauguuuaauuuccuggcuagccagcaccggguucugcccgagggcgccacgugugaugaagaggaggacgaagugcagcuccgcuccacaagacgggccaccucucuggagcuuccuauggcgaugcgcuucagacaccugaaaaagacaagcaaagaagcugugggagucuaucgguccgccauccauggcagagggcucuuuugcaagcgcaacauugaugccggagagauggugaucgaguacucuggcauuguuauccggagcgugcugaccgacaaaagagaaaaguucuaugaugggaagggaauuggcuguuacauguuucgcauggacgacuucgaugucguggacgcuaccaugcacgggaaugccgcucgguuuaucaaccauuccugcgagcccaacuguuucagcagagucauccacguggaaggccagaaacauauuguuaucuuugcccugcgccggauucucagaggagaggaacuuacauaugauuacaaguucccuaucgaggacgcgucuaauaaacugccgugcaacuguggcgccaagcgcugcagacgguuucugaauuga

SEQ ID NO: 71279 - RNA, 14736 nt, Artificial Sequence
  derived and/or modified sequence opt5 from KMT2C__Homo_sapiens__NP_733751
augagcagcgaggaagacaagucuguggagcagccccaaccuccucccccucccccugaagaacccggagccccugcucccagccccgccgcggcugacaaacggccucgggggcgccccagaaaggacggagccuccccuuuccagcgggcccgcaaaaagcccagaucucggggcaaaaccgcugucgaagaugaggacagcauggaugggcuggagaccacggaaaccgagaccaucguugaaaccgagauuaaggagcaguccgccgaagaggacgcugaagccgagguggauaacucuaagcagcugaucccgacccugcaacgcagcguguccgaagagagcgcgaacucucuugucuccgugggaguugaggccaaaauuagcgaacagcugugcgcuuuuuguuacugcggcgagaagucuucccucgggcagggagaccugaaacaguucagaaucaccccuggcuuuauucuucccuggcggaaccaaccuagcaauaagaaagauaucgacgauaacucuaauggcacauaugaaaagaugcagaacuccgcucccagaaagcagagagggcagcggaaagagcgcagcccccaacagaauaucguguccugugucucugugagcacccagacggcuuccgacgaucaagccggaaagcugugggacgaacucagccugguuggccugccugacgcgauugauauccaggcccucuucgacucuaccgggaccugcugggcucaccacagauguguggaguggucccugggagucugccagauggaggaaccgcuucuggugaacguggauaaagccgucguuagcggcucuaccgagcggugugcuuuuugcaagcaccucggggccacaauuaaauguugcgaagagaaguguacccagauguaccacuaucccugcgccgcuggagcgggcacguuccaagacuuuagccacaucuuccugcuuugcccugaacauauugaucaggcccccgagcgcuccaaagaggacgcuaauugugccgugugcgauucuccuggcgaccugcucgaucaguuuuucuguacaaccugcgggcagcacuaccacggaaugugucuggacaucgccgugacaccccugaagagagcuggcuggcaaugcccggaauguaaggucugccagaacuguaaacagagcggggaggauuccaagaugcucgugugcgacaccugugacaaaggauaucauaccuuuugccugcagccuguuaugaaauccgugcccacaaauggcuggaaaugcaagaacugucggauuugcaucgaaugugggacgagaucuuccagccaauggcaccauaauugccuuaucugugauaacugcuaccagcagcaggacaaucuguguccuuucugcggaaaguguuaucaccccgagcuccaaaaagauaugcugcacugcaacauguguaagcgcuggguccaucuugagugcgacaaaccuaccgaucacgaacuggacacacagcucaaggaggaauacauuugcauguacuguaaacaucugggcgccgagauggaucggcugcagcccggcgaagagguggagaucgcggaacucaccacagacuauaacaaugagauggaaguugaggggccggaagaucaaaugguguuuucugagcaggcugccaacaaggacgucaauggacaggaguccaccccuggcauugugcccgaugccguccaggugcacacggaagaacaacaaaagagccaucccuccgaaucucuggacacagauagccuucugaucgcuguuuccucucagcacaccgugaacaccgagcucgaaaaacagauuagcaaugaggucgacuccgaggaccugaagaugagcucugaagugaaacacaucugcggggaggaucaaaucgaagacaagauggagguuacagagaacauugaaguggucacccaucagaucacagugcagcaggagcaacuucagcugcucgaagaaccugaaacggugguuuccagagaggagagccgcccgcccaaacuggucauggaaucugugacccugccucucgagacacuggugagcccccacgaagagagcauuucucuuuguccugaggaacagcuggucaucgagcggcuccaaggagaaaaggagcagaaggaaaauagcgagcuguccaccggccugauggauagcgaaaugacacccaccauugaggggugcgugaaagacguuucuuaccagggcggaaaguccaucaaacuuagcuccgagacggaaucuagcuucuccucuagcgccgauaucuccaaggcugacgugucuagcuccccuacccccagcucugaucucccgucccaugacaugcugcacaacuauccuagcgcccugucuuccagcgcgggcaauauuaugcccacaaccuacaucucugucacaccuaaaauugggaugggaaagcccgccaucaccaaaagaaaguucuccccgggccgcccucggagcaagcagggggcuugguccacgcacaacacaguguccccucccucuuggagccccgauauuuccgagggaagagaaaucuuuaaaccccgccaacuccccggcucugccauuuggagcaucaagguugggcggggcuccggauucccgggcaaaagacgccccagaggggcuggacugucuggcagagggggacggggccgcagcaaacuuaaauccgggaucggcgccgugguccugccuggagugucuaccgcggacauuagcuccaauaaggaugacgaggagaacagcaugcauaauacaguugugcucuuuucuuccagcgauaaguucacccugaaccaggacaugugugucgugugcggcucuuuugggcagggagccgaaggcagacugcuugcuuguucccagugcgggcaauguuaucaccccuacugcgugagcaucaaaauuaccaaggucguucucuccaaaggauggcggugucuggagugcacagugugcgaagccuguggcaaggcuacggacccugggagacugcuccugugcgaugacugugauaucucuuaucauaccuacugccuugaucccccucugcagacagugccgaaaggcggauggaaguguaaguggugcgucuggugucgccacugcggcgccaccagcgccgggcuccggugugaguggcagaauaacuacacacagugcgcucccugugcgucccugagcucuugcccugugugcuauagaaacuaccgcgaagaggaucugauucuucaauguagacagugcgaccgguggaugcaugccguuugucagaaucucaacaccgaggaagagguggaaaaugucgcugauaucggauucgacugcuccaugugucgccccuauaugccugccagcaacgugcccucuagcgauugcugugaguccucucugguugcccagaucgugacgaaagucaaggaacuggacccgccuaaaacauacacccaagauggcgugugccucaccgagagcgggaugacacagcugcagucccuuaccguuacagugcccagacggaagcgcucuaaacccaagcugaagcucaaaauuaucaaucaaaacagcgucgcugugcugcagacgccucccgacauucaguccgagcacagcagagacggagaaauggaugacucucgggagggcgaacugauggauugugacggcaaguccgagagcuccccugaacgcgaggccguggaugacgagaccaaaggggucgaaggaacagauggcguuaagaaaagaaagcggaaaccguaucgccccgggaucggaggcuuuauggugagacagcggucuagaaccgggcaaggaaagacaaagcgcagcgugauucggaaagacuccucuggcagcaucuccgagcagcuuccuugcagagaugacggcuggagcgaacagcuccccgauacccuggucgacgagucuguguccguuacggagagcaccgaaaagaucaaaaagcgcuaccggaaaagaaagaauaagcuggaggaaacauucccugcguaucuccaggaggccuucuuugggaaagaucugcuugacaccucucgccaauccaagauuagccuggacaaccucucugaagauggagcccagcugcuguacaaaacaaauaugaacaccggcuuucuugaccccagccuggauccgcuccuguccucuagcuccgccccuacaaagagcgggacccacggacccgcugacgauccucucgccgacaucuccgaggugcugaauacggaugacgauauucuuggcaucauuucugacgaucuggcgaaaagcgucgaccauuccgauaucgggcccgugacagacgacccuucuagccucccccagccgaacguuaaucaguccucucggccucugagcgaggaacaacuggauggaauccuuucccccgagcuggacaagauggugaccgauggcgcuauucucggcaagcuguacaaaauccccgaacucgggggaaaggacgucgaggaucuguuuaccgccgugcuuagcccugccaacacacagccgacaccccucccucagcccccucccccuacgcaacuccugccgauucacaaucaggacgcuuuuucuagaaugccccugaugaacggccuuaucggguccagcccucaucugccccacaacucucucccucccggauccggccuggggacauucagcgccauugcucagucuuccuauccggaugcccgcgacaaaaauagcgcguucaacccuauggccuccgaucccaauaacagcuggaccucuagcgcucccacagucgaaggagagaaugacaccauguccaacgcccagcggucuacacucaagugggagaaagaagaggcucugggcgaaauggccaccguggccccuguucuuuacacgaauaucaacuuucccaaucugaaggaggaguucccugauuggaccacaagagugaagcaaauugcuaaacuguggcggaaggcgagcucccaggagcgcgccccguauguccagaaagcuagagacaaccgggccgcccuccgcaucaauaaggugcagaugucuaacgacagcaugaaaagacaacagcagcaggauuccaucgaccccucuagccggauugauuccgagcuguuuaaggacccucuuaagcaaagagaaagcgagcaugaacaggaguggaaauuccgccagcagaugcggcaaaagucuaaacagcaggcuaagaucgaggccacccaaaaacuggaacagguuaagaaugagcagcagcaacagcagcagcaacaguuuggcucccagcaccuccuggugcagagcgggucugauacacccuccagcggcauucaauccccucucacaccccagccgggcaacgggaauaugucuccugcgcagagcuuccacaaagaacuguuuacgaagcaacccccuuccacacccaccagcacaucuuccgacgaugucuucgugaagccucaggcucccccgccuccgcccgccccuagcagaaucccgauucaggacucucuuagccaggcccaaaccucccagcccccuucuccccagguguuuagcccuggauccucuaacagcagacccccuucccccauggauccguacgcuaaaaugguuggcaccccucggcccccucccgucgggcauagcuucucuagacgcaacuccgccgcgccgguggagaauuguacaccucugagcuccgugucucggccccugcagaugaacgaaacgaccgcuaauagacccagcccuguccgcgaccucugcuccucuagcacaaccaacaaugaucccuaugccaagccuccggacacacccagaccugugaugaccgaucaauuucccaaaucccugggacuuagccggucuccuguuguguccgagcagacggccaagggccccaucgcugccggcacaagcgaccacuucaccaaaccuucuccgcgcgcugacgucuuucagagacagcggauccccgauuccuacgcccgcccucugcucacccccgcgccucuggacagcgggcccggaccguucaagacaccuaugcaaccgcccccuucuucccaggaucccuauggcagcgugucucaggccagcagacggcucuccguugacccuuacgagagaccggcucugacaccccgcccuauugauaacuucagccauaaucaauccaacgaccccuacucucagccuccccuuacaccgcacccugccgugaaugagagcuucgcucaccccucccgggccuucucucagccugggacgaucagcagacccaccucccaggauccguauucucaaccucccggaacaccccgcccugucguggacagcuacucccagagcucuggcaccgcccgguccaacacagaucccuauagccagccuccggggacccccagaccuacgaccguugaccccuacucucagcaaccucagacaccccggccuuccacccagacagaucuguuugugaccccggucacaaaucagcgccauagcgaccccuaugcucacccucccggaacgccuagacccggcauuucugugccguacucccaaccucccgcgacaccccggccucgcaucagcgaaggcuucacaagaucuuccaugacccggcccgugcugaugccuaaccaggacccguuucuccaggccgcucagaaucgcgggcccgcccugccuggaccccuugucagaccucccgauaccugcagccaaacaccgcggccucccggcccugggcugagcgacacguucucccgcguuucucccagcgccgcuagagauccuuaugaccagucccccaugaccccgcggucucagagcgauuccuuuggaacaucucaaaccgcccaugacguggcggaucagcccagaccuggcagcgaaggguccuucugugcuagcucuaacucccccaugcacagccagggacagcaauuuucuggcgugucccagcucccuggcccgguccccacaagcggggugaccgacacgcagaauacaguuaacauggcccaggccgauaccgagaagcugcgccaacggcagaaacucagagaaauuauccugcagcagcaacagcagaagaaaaucgcuggacgccaagagaagggcucccaggacucuccugccgugccccauccugggccccuucagcacuggcagccugagaaugucaaccaagcguucacccggcccccgccucccuacccuggaaacauuagaagccccguggccccgccucugggcccccgcuacgcuguuuuucccaaagaucagcgggggccuuaucccccugacguggccuccaugggcaugagaccgcacggauuccgcuucggcuuucccgggggaucucauggcacaaugccuagccaggaacgguuccuggugcccccucagcaaauccagggguccggagugagcccccagcucagacgcucugucuccguggauaugccgcggccucugaauaacagccagaugaauaaccccguuggccuuccucaacacuuuucuccccagagccugccugugcagcagcauaauauucucgggcaggcuuacaucgagcugagacaccgcgcccccgacggcagacaacggcugccguucuccgcucccccuggaucuguggucgaagccagcuccaaccuccgccacggcaauuuuauucccagaccugacuuccccgggccucggcauaccgauccgaugagacggcccccucagggacuucccaaccaacugccuguucaccccgaccuggaacaggucccgccuagccagcaggaacaaggccauucugugcacuccagcuccauggucaugcgcacacucaaucauccccucgggggagaguuuucugaggcgccucuuagcaccuccgugcccucugaaacgacaagcgauaaccugcagaucaccacacagccguccgacggccucgaggaaaagcuggauucugacgauccuagcguuaaggagcuggacgugaaagaucucgagggggucgaagugaaggaccuugaugacgaggaucuggaaaaucugaaccucgacaccgaggacggcaaagucguggaacuggauacgcuugacaaucuggagaccaacgaucccaaucucgacgaucugcugagauccggagaguucgacauuaucgccuauacagaucccgaacucgacaugggcgauaagaaaagcauguuuaacgaggaacuugaccugccuaucgaugacaagcuggacaaccagugcguuucuguggagcccaagaaaaaggaacaagagaauaaaacccucguccuguccgauaagcacagcccucagaaaaagucuacagugaccaacgagguuaaaacagaagugcuuuccccgaauagcaaggucgagucuaagugugaaaccgagaaaaacgacgaaaauaaggauaacguggacacgcccugcagccaggcuuccgcccacagcgaucugaaugacggggagaaaacaucccuccauccuugugaucccgaccuguucgagaagcggaccaaccgcgaaaccgcuggaccuucugccaaugugauucaggccagcacacaacugcccgcucaggauguuaucaacuccugcggcauuaccgggucuacaccuguccucagcucccuucuggcgaaugagaaaucugacaacagcgauaucagaccguccggaucucccccucccccuacgcugcccgccuccccguccaaucacgugagcucucugcccccuuuuauugcucccccuggccgggugcuggacaacgccaugaauagcaacgucaccguugugagccgcgugaaccaugucuucucucagggcgugcaaguuaaucccgggcuuaucccuggacaguccacagugaaccacagccugggcaccgggaagccggccacacagaccggaccccagacgucucaauccggcaccagcuccaugagcgggccucagcagcucaugaucccccagacacuggcucaacagaauagagaacggccucugcuccuugaggagcagccccugcugcuccaggaucugcuugaccaagaacgccaggagcagcaacagcagagacagaugcaagccaugauucggcagcgcucugaaccguuuuucccuaacaucgacuucgaugcgauuaccgaccccaucaugaaggccaaaauggucgcucugaagggaauuaauaaagugauggcccagaacaaucucggcaugccucccaugguuaugagcagauuuccuuucaugggccagguggucacagggacccaaaacuccgagggacagaaucugggcccccaggcuaucccgcaggaugggucuaucacgcaccaaauuagccggcccaacccucccaauuuuggaccuggcuucgugaacgacucccagcgcaagcaguacgaagaguggcugcaggagacacaacagcuccuucagaugcaacagaaauaucuggaggaacagaucggggcccauagaaagucuaagaaagcgcugagcgccaagcagcggaccgcuaaaaaggccggaagagaauuucccgaggaagaugcugagcaacucaaacacgugacagagcagcaguccaugguccagaagcaacuggaacagauucgcaagcagcagaaagagcaugccgaacuuaucgaggacuaccggauuaagcaacagcagcaaugugcuauggccccgccuaccaugaugcccagcguucagccucagcccccucugauccccggcgcgaccccgccuacaaugucucagcccacguucccuauggugccccaacagcuccagcaccagcaacauaccacagugauuuccggccacaccagcccggucagaaugcccucucugccuggguggcagcccaauuccgccccugcucaucugccccucaacccuccgcgcauccagcccccuaucgcccagcuucccauuaaaacaugcaccccugcucccggaacggugagcaaugccaacccgcaaucuggcccucccccucggguugaauuugaugacaacaaucccuucuccgagagcuuucaggagagagaacgcaaggagcggcugagagaacagcaggagcgccaacggauccagcugaugcaggagguggauagacaacgcgcccuccagcagcggauggaaauggagcagcaugggauggucggauccgaaauuucuagcuccagaacaagcgugucucaaaucccuuucuauuccagcgaccugcccugugauuuuaugcagccgcuuggcccccugcagcagucuccucaacaccagcagcagauggggcaaguucuccagcagcaaaacauucagcagggaagcaucaauucccccucuacccagaccuucaugcaaacaaacgagcggagacaggugggcccucccagcuuugucccugacuccccgagcauccccgugggcucuccuaauuucuccagcguuaaacaggggcauggaaaccugucuggcaccuccuuccagcaaagccccgugcgcccuuccuuuacacccgcgcugccggcugccccucccgucgcuaauucuagccucccuugcgggcaggauuccacgauuacccacggacauucuuaccccggcagcacacagucccuuauccagcuguacagcgacauuaucccggaagagaaggggaaaaagaagcggacccgcaagaagaaacgcgacgaugacgccgagucuacaaaggcccccuccaccccucacagcgauauuacggcucccccuacccccggaaucucugaaacaaccuccaccccugccgugagcaccccgucugagcugccccaacaggcggaccaggaauccgucgagccugugggccccagcacaccuaacauggccgcuggccagcucuguaccgaacuggagaauaaacuucccaacagcgauuucucccaagccacgccuaaucagcagacauaugcuaacucugagguugacaagcugagcauggaaaccccggccaagaccgaggaaaucaaacucgagaaggcggaaacagaguccugccccgggcaagaggaaccuaaacuggaggaacagaauggaucuaagguggagggcaacgccgucgcuugucccgugagcuccgcccagucuccuccccacagcgcuggggccccggcugccaaaggagauuccggcaaugagcugcucaagcaucuucugaagaacaaaaagucuagcucccugcucaaccagaaacccgaagggagcauuugcucugaggacgauugcacgaaggacaauaaacugguggaaaagcaaaacccugcggagggacuucagacccugggcgcccagaugcagggcggguuuggauguggcaaucaacuccccaagacagaugggggauccgaaaccaaaaagcagagaagcaaacggacacagcgcaccggcgagaaggcugccccuagaucuaaaaagcggaagaaagacgaggaagagaagcaggcuauguacuccagcacagacaccuucacgcaccugaaacaacagaacaaucugucuaaucccccuaccccgcccgccucccucccucccacaccucccccgauggccugccagaagauggcgaauggguuugcuaccacagaggaacuggccggaaaagccggcguucuugugagccaugaagucaccaagacgcugggcccuaaacccuuccaacucccuuuucgcccccaggaugaccugcuugcuagagcccuggcucaggggccuaagacaguggauguucccgccucccucccgacacccccucacaacaaucaggaggagcugcggauccaagaccacuguggagaucgcgacacacccgauagcuucgugccuucuagcucccccgaaucugucgugggcgucgaggugagcagauauccggaccugucccucguuaaggaggagccucccgaaccugugcccucuccuauuauccccauucugccgagcaccgcggggaaauccucugagagccggcgcaacgauaucaagacggagccuggaacccuuuacuuugccucccccuucggcccuagccccaaugggccgagaucuggccugauuuccgucgcuaucacacuccaucccaccgccgcugaaaacaucagcucugugguugccgcguuuuccgaccugcuucacgugcggauuccuaauagcuaugaggucuccucugcccccgaugugccuagcaugggacugguguccagccaucgcaucaaccccggccucgaauacagacagcaucugcugcuccgggggccuccgcccggaucugcuaauccucccagacugguuuccagcuaucgccuuaaacagccuaacguccccuucccgccuacaucuaacggccuguccggguacaaggacagcucucauggaauugccgagagcgcugcccuccggccccaguggugcugucacugcaaaguggugauccugggcuccggggucagaaagucuuuuaaggaucuuacccugcucaauaaagacagccgcgaguccacaaagcggguggaaaaagacauuguuuucuguagcaacaauugcuucauccuguacucuuccaccgcucaagccaagaacagcgagaauaaagaauccaucccuucucugccccagagcccuaugagagagacgcccuccaaggcguuucaccaguauucuaacaauauuagcacacucgaugugcauugucugccgcagcuucccgaaaaggccuccccucccgcuagcccucccaucgccuucccuccggccuuugaggcugcccaagucgaggcgaaacccgacgaacugaaggugaccguuaaacucaagccucgccugcgggcugugcacggcggauucgaggauugcagaccccuuaacaaaaaguggcgcggcaugaaguggaaaaaguggucuauucauaucgucauuccuaaagggaccuuuaagcccccgugugaagacgagaucgaugaguuccugaaaaagcucggaacaucccugaaaccugaccccgugccuaaggauuaccggaagugcugcuuuugucacgaggagggcgacgggcugaccgauggacccgccagacuccugaaucuugaccuggaucucuggguucaccugaacugcgcccuuuggagcacagaaguguaugagacgcaggcuggcgcccugaucaaugucgaacucgcucugcggcgcgggcugcagaugaaauguguguucugccauaagaccggcgccacaucuggaugucacagauuucggugcaccaacauuuaccauuucacaugugcgaucaaagcccaaugcauguuuuucaaggacaaaaccaugcucuguccgaugcacaagcccaagggcauucaugagcaggaacuguccuauuuugcuguguuccgcagagucuacguucagcgggaugaggugagacagaucgccagcauugugcaacgcggggagcgggaccacacguucagagucggaucucuuaucuuucacaccauuggccagcugcucccucagcagaugcaggcuuuccauucccccaaagcccuguuuccugugggguaugaagcgagccgccuuuacuggucuacacgguacgccaauagacgcugcagauaucuguguagcaucgaggaaaaggacggacggcccguuuucgugauccgcauugucgagcagggccacgaggaucucgugcuguccgacaucagcccuaaagggguuugggauaagauucuggaaccgguggcuugcguccgcaaaaaguccgagaugcuccagcuguuucccgccuaccuuaagggcgaagaccuguucggacucaccgugucugcugucgcccggaucgccgagagccugccuggcguggaggcuugcgagaacuauacauuucgcuacgggagaaauccccuuauggagcugccucucgcgguuaaccccaccggaugugcccgguccgaaccuaaaaugucugcucaugugaagcgcuucguccugagaccgcacacgcugaacagcacauccaccucuaagagcuuucaguccacagugaccggcgagcuuaaugcccccuauagcaagcaauucguucauucuaaauccagccaguaccggaagaugaagaccgaauggaaaucuaacguguaucuggccagaucccgcauucaggggcucggacuguacgcugcccgggauaucgagaagcacacaauggucaucgaauacauuggcacgaucauuagaaaugagguggcgaaccgcaaagagaagcucuaugaaagccagaaucggggcguguacauguuuagaauggacaacgaucacguuaucgacgcuacccugacagggggaccugcccgcuauauuaaucauucuugcgcccccaacugugucgcugagguggugaccuucgaacggggccacaaaaucaucauuuccagcuccagacggauccaaaagggggaggaacuuugcuacgauuauaaauuugacuucgaggaugaccagcauaagauuccuugucacugcggagccgucaauugucgcaaguggaugaacuga

SEQ ID NO: 71280 - RNA, 16614 nt, Artificial Sequence
  derived and/or modified sequence opt5 from KMT2D__Homo_sapiens__XP_005269219
auggacucccagaagcuggccggcgaggacaaagacuccgaacccgcugccgaugggccugccgcuucugaggaccccuccgccaccgaauccgaucuccccaacccucacgugggggaggucucuguucugagcuccggcucuccccggcuucaagaaaccccucaggacugcagcgggggacccgugcggcgcugugcccugugcaacuguggcgagccuucccuccacgggcagagagagcugcggcgcuucgaacuucccuucgauuggcccagaugcccuguggucagccccggaggcucuccuggccccaacgaggcugugcugcccuccgaagaccucagccagaucggguucccugagggacugacgcccgcccaccugggcgagccugggggaucuuguugggcucaccacuggugcgccgccugguccgccggcguuugggggcaagaaggacccgagcucuguggcguggauaaggcuauuuuuagcggcaucucucagcggugcucccacuguacccgccugggggccagcauucccugcagauccccuggauguccgcggcuuuaccacuuccccugcgcuacagccucuggcagcuuucuguccaugaaaacccuccagcugcuuugcccugaacacagcgagggggcggccuaucuggaagaggcucgcugugccgucugcgagggacccggcgaacucugugaccuguucuuuugcaccucuugugggcaucacuaccauggagcuugccuggauaccgcccucaccgccagaaagcgggcuggcuggcaguguccugagugcaaagugugucaagcgugccgcaagcccggcaaugacuccaagaugcugguuugugaaaccugcgauaaaggguaucacacguucugccuuaagccgccuauggaggaacugcccgcccacagcuggaaauguaaggcuugcagagugugucgggccugcggagccggcucugcugagcucaacccuaauagcgagugguuugaaaacuacucccugugucaucgcugccacaaagcccaagggggccagaccaucagaucugucgcggagcagcauacacccguguguagccgguucuccccucccgaaccgggcgacaccccuacagacgagcccgaugcucuuuauguggccugccaggggcagcccaagggcggacacgucaccagcaugcagccuaaggaaccgggcccccugcaaugugaggccaaaccucucgggaaggcuggaguucagcuggagccccagcuggaagccccucucaaugaggaaaugccccugcuuccucccccggaggagucuccucugagcccgccucccgaagagagcccgacgucuccucccccugaagcuagcagacucuccccgcccccugaggaacugccggccagcccccuuccugaggcgcugcaucucucucgcccccuggaggaaagcccucugagcccucccccggaggaaucuccccucagcccucccccugaguccagccccuuuucuccgcuggaagaguccccucuuuccccgcccgaggaaucuccucccuccccugcccuggagacaccgcucuccccuccucccgaggcuucuccccuguccccucccuucgaggaaagcccccuguccccuccucccgaggagcuucccaccucucccccgccugaagccucccggcucuccccgcccccugaggaauccccgaugucucccccucccgaggagagcccuaugagcccucccccggaggcuucuagacuguuucccccuuucgaggaaagcccccuguccccucccccggaggaaucuccucucuccccgcccccugaggccucccgccugucucccccuccggaggacucccccauguccccucccccugaagagagccccaugucuccgccucccgaagugucccggcuuagcccucugcccguggucucuagacucuccccucccccggaggaaagcccucugagcccgcccccugaggagagcccgacaucucccccucccgaagcgagccgccuguccccucccccugaggauucucccaccagcccgccucccgaagacuccccugccucucccccgccugaggauagccuuaugucccucccccuggaagagucuccccugcucccucugcccgaggaaccucagcuuugcccgcggagcgagggcccccaccuguccccuagacccgaagaaccucaccucagcccccgcccugaggaaccgcaucugucuccccaagcugaggaaccucaccugagcccccaaccugaggaacccugucuuugcgccgugccggaggagccucaucucagcccccaggcugaagggccccaccugucuccucagcccgaggaacugcaccucuccccucaaaccgaggaaccgcaucugagccccguuccugaggagcccugccuuuccccucagcccgaagagucucaccugagcccgcaguccgaagaaccuugucucagcccccggccugaagagucucaucugucccccgagcuggaaaaaccgccucuuagccccagacccgagaagccucccgaggaaccuggacagugcccggcccccgaggaacucccucuguuucccccucccggcgagccuucucugagcccgcuccugggggaacccgcccuuuccgagccuggcgaacccccucugucuccccucccggaggagcugccucugagccccuccggagaacccucucuuagcccucaacugaugcccccugacccgcugcccccuccccuguccccuauuaucacagcugcggcgccucccgcucucagcccccugggcgagcuugaauaccccuuuggggccaaaggagauucugacccugagagcccccucgccgcuccuauccucgaaacgcccauuuccccgcccccugaggccaacuguaccgaucccgagccugugccgcccaugauccugccucccuccccuggcucucccgucgggccugcgagccccauucugauggaaccgcuuccuccccagugcuccccucugcuccagcacucucuggugccccagaauagcccgccuucccaauguuccccgcccgcucucccucugucuguucccuccccucuuagcccgaucggaaagguggucggcgugucugacgaggccgaacugcaugagauggaaacagagaaagucuccgagcccgaaugcccugcccucgagcccagcgcuaccucuccucugcccagcccgaugggggaucuguccuguccugcccccucuccugcgcccgcucuugacgacuucagcggccugggagaagauacagccccucucgacggcauugaugcccccgggucccagccggagcccggacagaccccuggcagccuggcuuccgagcucaaggggucucccgugcugcuugacccugaagaacucgcccccguuacgccuauggaaguguauccggagugcaagcaaacagcuggacagggcagccccugugaggaacaggaggaaccucgcgcccccgucgcgccuacaccucccacccugaucaaauccgauauugugaacgagaucucuaaucucagccagggggacgccuccgcuucuuuucccggcagcgaaccccugcuuggauccccugaucccgagggcgggggaagccugucuauggaacucggcguuuccacagacgugagcccggcccgggaugaggggucucugagacucugcaccgacucccugccugagacagaugacagccuucugugugaugcuggaacggccaucucuggcggcaaggccgaaggggagaaaggacggcgcagauccagccccgcucgguccagaauuaagcaaggccgcagcucuagcuuccccgggcggagacgcccuagaggaggcgcgcacgggggacggggccgcggcagagcccggcugaaauccaccgcuucuagcaucgaaacacucgucguggccgacauugacuccucucccagcaaggaggaagaggaggaagaugacgauaccaugcagaacacagugguucuguuuuccaauaccgacaaguucguccuuaugcaggauaugugcguggugugcgggucuuuuggacgcggcgccgaggggcaucugcuggcuuguagccagugcucccaauguuaccacccuuacugcgucaacagcaaaaucacgaaggugaugcugcucaaaggauggagauguguugaaugcauugugugugaggucugcggccaggccucugacccgucccggcugcuucugugugaugacugcgauaucagcuaucacaccuacugucuggaucccccucuccugacagugcccaaagggggcuggaagugcaaguggugcguuucuuguaugcagugcggcgcggcuuccccuggcuuccauugugaguggcagaauagcuauacccacugcgggcccugugccucccuugugacaugcccuaucugucaugccccguacgucgaagaggaucugcucauucaaugccgccacugugaaagauggaugcacgcuggaugcgagucucuguuuaccgaagacgauguggagcaggccgcggacgagggcuucgacuguguuagcugccagcccuauguggucaagccuguggcucccguggccccucccgaacucgucccgaugaaaguuaaggagcccgaaccucaauacuuucgguucgaggggguguggcugacggaaacaggaauggcccuucugcgcaaccugaccaugagcccccuccauaaaagacggcagagacgcggccggcuggggcuuccuggagaggcuggccuggagggcuccgaacccucugaugcccucgggccugacgauaagaaagacggagaucuggacacagaugagcugcucaagggcgaagggggaguggagcacauggaaugcgagaucaaacuugagggcccggucucccccgacguggaaccugggaaggaggaaaccgaggagagcaagaaaagaaagcgcaaacccuaucggccuggaauuggcggcuuuaugguuagacagcgcaagucucauacccggaccaaaaaggggcccgcugcccaggcggaagugcugagcggagauggccaaccggacgaggucaucccugccgaucugcccgcugaaggggccguggagcagucccucgcugaaggagacgagaagaaaaagcagcagagacgcggccggaaaaagucuaaacuggaggacauguucccugccuaccuucaagaagccuucuuugggaaggagcugcucgaucugagcagaaaggcucuguucgcgguuggagugggccggcccuccuuuggccucgggacgccuaaagccaagggagacggcgggucugaacgcaaagagcuucccaccagccagaagggagaugacggcccggauauugcugacgaagaguccagagggcuggagggaaaagccgauacacccggcccugaagacggcggggucaaggccagccccgugccuucugaucccgagaagccgggaaccccuggcgaagggaugcuguccagcgaccucgaucggaucuccacagaggaacugcccaaaauggagucuaaggaccuucagcagcuguucaaagauguucucggaagcgagcgcgaacaacaccugggcugugggaccccuggccuggagggauccagaacgccccuccagcggccuuuucuucagggcgggcugccccugggaaaccucccgucuagcuccccuauggacagcuaccccggccugugccagucuccuuuccuugacuccagagaacgcgggggauuuuucagccccgagccgggcgagcccgauucuccuuggacaggguccggcggaaccacccccagcacaccuaccacacccacgaccgaaggcgagggggacggacugucuuauaaucaacggucccuccagagaugggaaaaggaugaggaacugggccagcugagcacaaucucuccugugcucuacgcuaacauuaauuuuccgaaccuuaaacaagacuaucccgauuggagcucccgcuguaagcagaucaugaagcuguggcggaaagucccugccgcggacaaggcucccuaccugcagaaagccaaggauaauagagccgcucaccgcauuaacaaagugcagaagcaagccgagagccagaucaauaaacagaccaaggugggggacauugcgcggaagacagauagaccugcccuccaucugcgcaucccuccccagcccggagcucuuggcucucccccucccgccgcugccccuaccauuuucaucgggucccccacgaccccggcuggccugagcacauccgccgacggauuucucaaacccccugcgggcucuguccccgggccugauagccccggagagcuguuccugaagcucccuccgcaaguucccgcccaggugccuucccaggaccccuuuggccuugcuccugccuauccccuggaaccgagauucccuaccgcucccccuacauacccucccuaucccucucccaccggggcccccgcccagccucccaugcugggagcuagcucccggccuggcgcgggccaaccgggggaguuccacacaacacccccuggaacgccccgccaucagccuagcacacccgauccuuuucucaaaccgagaugccccucucuggacaaccuugccgugccugaaucccccggcgucgggggaggcaaggcuagcgagccucugcucucucccccgcccuucggggaaucccggaaagcccuggaggugaagaaggaggaacugggagccagcucuccuuccuacggacccccuaaucucggcuuuguugacagccccucuuccgggacccaccuuggaggccuggagcugaaaaccccugauguguucaaggcuccgcucacaccccgcgccagccaggucgaaccucaaagccccgggcugggacuuagaccucaggagcccccgccugcgcaggcccuggcucccuccccucccucucauccugacaucuuucggcccggcagcuacaccgauccguaugcccagcccccucucacgcccagaccucaacccccgccucccgaauccuguugcgcucugccuccccgcucucugccuagcgaccccuucucccgggugccggccucuccucagagccaguccagcucucagagcccccucacaccuagaccccuuagcgcggaggccuuuuguccgucucccguuaccccucgcuuccaaucccccgauccuuacagccggcccccuuccagaccgcagucucgggaccccuuugcuccucugcacaaacccccucgcccccagccgccugagguggccuucaaggcugggagccuggcccacacaucccucggagcuggcggcuuucccgccgcgcugccugccgggcccgcuggagaacuucaugccaaagucccuucuggccagcccccgaacuucgugagaagccccgggaccggagcuuucgucggcacaccuucccccaugcgguuuaccuucccucaagccgugggggagcccagccugaagccuccgguuccccagccuggacugcccccuccccacggcauuaauucucauuuuggcccggggccuacgcugggaaagccccaguccaccaacuauacaguggccaccggcaauuuccacccuagcgggucuccccugggaccgagcuccggcucuacaggggaaagcuacggacucagcccccuucgcccucccuccguccugccucccccugcgccggauggcucucugcccuaucucucccacggcgcuagccagagauccgggaucaccucuccuguggagaaacgggaggaccccggaacgggcauggggagcucccuggccacagcugaacuuccuggaacccaagaucccggcaugucugggcugagccagacagagcucgaaaagcagcgccaaagacagcggcugcgcgagcugcucauuagacagcagauccaacggaacacccuuagacaggaaaaagagaccgccgccgcugccgcgggagccguuggcccuccgggcuccuggggagcugagcccucuagcccugccuuugaacagcugucccgcggacagacacccuucgcuggcacgcaagacaagagcucucugguggggcucccucccuccaaacugagcggaccgauucuuggccccgggucuuuuccuuccgaugaccggcugagcagacccccucccccugccaccccgucuagcauggacgucaauucccgccagcucgugggaggcagccaggcguucuaccagcgggcccccuauccuggcucccugccccugcaacagcagcaacagcagcucuggcagcaacagcaggcuacagccgcuaccucuaugagauuugccaugagcgcucgcuucccuuccacacccgggccggagcugggacggcaggcccuuggcucuccucuggcggggaucagcaccagacuccccggaccuggcgaacccgugccugggcccgccggcccggcucaauuuaucgagcugcgccauaacguucagaagggacuuggccccgggggaacgccuuuccccggccaggggccuccccagcggccgagauuuuacccugucuccgaagauccccaccgccuggccccugagggacuccggggccuggcugugucugggcugcccccucaaaagcccagcgccccgccugcccccgagcucaacaauucccugcauccuacaccccacaccaaaggcccgacccuucccacaggacuggaacucgugaacagaccucccagcucuaccgagcugggccgcccuaauccccuugcgcuggaagcugggaagcucccuugcgaggacccggaacuggaugacgauuucgacgcccauaaagcccuggaggaugacgaggaacucgcucaccugggacuuggcgucgauguggccaagggggacgaugagcugggaacacucgaaaaccuggagacgaaugacccccaccuugaugaccugcucaacggcgacgaguucgaucugcuggcuuacaccgacccugaacucgauacaggggacaaaaaggauauuuuuaaugagcaucugagacuuguugaauccgccaacgagaaggcggaacgggaggcccugcuccgcggcguggagcccggaccucugggccccgaagagagaccgccucccgcugccgacgcuagcgaaccucggcuugccucuguccugcccgaggugaaaccuaagguugaagaagggggaagacaccccuccccgugucaguucaccaucgcgacacccaaaguggagccugcccccgcugccaauagccucggccuggggcugaagccuggacagucuaugaugggcucccgggauacccgcauggggacgggccccuuuuccucuuccggacauaccgcugagaaagccagcuucggcgcuacagggggaccuccggcccaccuccugacccccuccccucuuagcggccccgggggaucuagccugcucgagaaguuugaacuggaguccggcgcgcuuacacugccuggcgggcccgccgcuucuggagacgaacucgauaaaauggagagcucccuggucgccucugagcugccgcuccugauugaagaccuucuggagcacgaaaagaaggagcuccagaagaagcagcagcugagcgcccagcuucaaccugcucagcagcagcaacagcagcagcaacagcauucccugcucagcgcccccggcccugcgcaggcuaugucucugccccacgagggguccagcccgucucuggccggaucccagcaacagcucagccugggccuugccggggcuagacagcccggacugccucaaccccucaugccuacccagcccccugcccaugcucugcagcagcggcuugccccgucuauggcgaugguguccaaccaaggccacaugcugagcggccagcaugggggacaggccggccucguuccccagcaauccucucagccugugcugagccagaaacccauggggacaaugccucccuccaugugcaugaagccgcagcaacuggcuaugcagcagcaacuugccaauagcuucuuuccugauacggaccuggacaaauucgcugccgaagauaucauugaccccaucgcgaaggccaagauggucgcucucaaaggaaucaagaaagugauggcccagggcucuauugggguggcuccuggaaugaaccgccagcaggucucccugcucgcccaaagacugagcggcggccccucuagcgaucuucagaaucacguugccgcuggguccggacaggagcggucugcgggcgacccuagccagccccgcccgaaucccccuaccuuugcccaaggggugaucaaugaagcugaucagagacaguaugaggaauggcuguuccacacacagcaacugcuccagaugcagcugaaggugcuugaggagcagauuggaguccaucggaaaucccgcaaggcccugugugccaagcaaagaaccgcuaaaaaggccggccgggaauuucccgaggcggacgcugaaaaacucaagcuggugaccgagcagcagagcaaaauccaaaagcagcucgaucagguucgcaagcagcaaaaagaacacacaaaccugauggccgaguacagaaacaagcagcagcagcaacagcagcagcaacagcagcaacagcagcagcauucugccgugcuggcucuuuccccuagccaaucuccccggcugcucacgaaacugccugggcagcuucugccgggacacggccuccagcccccucagggacccccugggggacaagccggcgggcugcgccucacccccggaggcauggcucugccggggcagccuggaggccccuuccugaauacagcccuugcgcagcagcaacagcagcaacauuccggcggggccggaagccuggcuggcccuuccgggggauuuuuccccggcaaccucgcccugagaucucuugggccggacagccggcugcuccaggagagacagcugcagcugcaacagcagcgcaugcagcucgcucaaaagcugcagcagcagcaacagcagcagcaacagcagcaacaccuucugggacaggucgccauucagcagcaacagcagcagggccccggcgugcaaaccaaucaggcgcucgggccuaaaccccagggacugaugccucccuccucucaccagggccuucugguucaacagcucagcccucagcccccgcaagggccucagggaaugcugggccccgcccagguggcuguccugcagcaacagcauccuggggcccucggaccccagggcccucacagacaggugcugaugacacaauccagaguccuuagcucuccccagcuggcucagcagggccaagggcucaugggacaucgccuggugaccgcccagcagcagcaacagcagcaacagcaccagcagcaaggcuccauggccgggcuuagccaccuccagcagucucucaugucccauagcggacagccgaagcugucugcucaaccuaugggcucccugcagcagcuccagcaacagcagcaacugcagcagcagcaacagcuucagcagcaacagcagcagcaacugcagcagcagcaacagcuccagcaacagcagcugcagcaacagcagcagcaacagcagcuucagcaacagcagcaacagcagcugcagcaacagcagcagcaacuccagcagcagcaacagcagcaacagcagcaguuccaacagcagcagcaacagcagcagauggggcugcugaaccaaagccggacgcuccugagcccccagcagcagcaacagcagcaaguugcgcuuggcccuggaaugcccgccaaaccgcugcagcacuuuuccucucccggcgcucucgggccuacacugcuucugaccggaaaggaacagaauaccguggaucccgccgugagcuccgaggccacagaaggcccuucuacccaucaagggggcccccucgcuaucggcacaaccccugagagcauggccacggaaccgggggaggucaagcccucccugucuggcgacagccagcugcuccugguucagccucagccccagccucaacccuccucucuucagcugcagccgccucucagacugcccggacagcaacagcagcaagugagccuucugcacacagcgggcgggggaucccauggccagcucgggagcggaucuuccagcgaggcuucuuccgugccucaucugcuggcccagcccagcgucucucucggcgaucagcccggguccaugacccaaaaccugcuuggcccucagcagccgaugcuggaacgccccaugcagaauaacacaggaccucaacccccuaaacccggcccggugcuccagagcgggcagggacugccuggcguugggaucaugcccaccgugggacagcugcgggcccaacuccagggcguccuugcuaagaauccucagcugagacaccugagcccccagcaacagcagcaacuccaggcccugcuuaugcagcgccagcugcaacagagccaggcugugcggcagacgccucccuaucaagagccggggacccagacaucuccucuccagggccugcugggaugccagccccaacuuggcggguucccuggaccccagaccggcccgcuccaggaacugggggccggacccagaccucaaggacccccucgccugcccgcgccuccgggcgcccucagcacagggcccguccugggaccugugcaucccaccccucccccguccucuccucaggagcccaaacggccuagccagcuucccucccccucuagccagcugccuacagaggcucaacucccgcccacccacccuggcacgcccaagccucaggggcccacacuggaaccuccgcccggaagaguuuccccugccgcugcccagcuggcggacacccucuuuucuaaaggccuugggcccugggauccucccgacaaccuggccgagacccagaagccggaacaaagcucccuggugccuggacaucucgaccaggucaauggccaggugguucccgaggcuagccagcugucuauuaagcaagaaccucgggaggagcccugugcccuuggcgcucaguccgugaaaagagaagccaacggggagcccaucggagccccuggcacaagcaaucaucugcuccuggcugggccgcgcucugaagcgggacaucugcuucuccagaagcugcugcgggccaaaaacguccaacucuccaccggcagagggagcgagggacugcgcgcugaaauuaauggccauaucgauuccaaacuugccggccuggagcagaaacuccaggggacacccucuaacaaggaggacgccgcugccagaaagccucugacgcccaaaccuaagcgggugcagaaagcgagcgaucgccugguguccagcagaaagaaacuucggaaggaagacggaguucgcgcuucugaggcccuccugaagcaacugaaacaggaacucucccugcuuccccugaccgagccggccauuacagcuaacuucagccucuuugccccuuucggcucugggugccccgucaauggacagucccagcugagaggcgcuuuugggagcggagcccugccuaccggccccgauuacuauucucaacuucucacaaagaacaaucugagcaacccucccaccccgccuuccucucugccgcccacgccuccgcccagcgugcagcagaaaauggugaauggcgucaccccuuccgaggaacucggggagcaccccaaggacgcggccagcgcucgggauucugaacgcgcccugagagacacauccgagguuaaaagccuugaucugcucgcugcccugccuacacccccucauaaccagacagaagacgugcggauggaguccgaugaggacucugauagcccggacuccaucgugcccgcgucuagcccugaauccauucugggagaggaagcgccccgcuucccucaccuuggcagcgggagaugggagcaagaagaccgggcucucucucccgucaucccgcugaucccucgcgccuccauucccguguuuccugauaccaagcccuacggagcucugggccucgagguucccgggaaacugccugugacgacaugggagaagggaaagggcagcgaagucucugugaugcuuaccguuuccgccgcggccgcuaaaaaucugaacggcgugauggucgccguggcugagcuccugagcaugaagauccccaauucuuaugaagugcuguuccccgaguccccugccagagccgggacagaacccaaaaagggagaggcugagggcccugggggaaaagaaaagggccuugaggggaagucccccgacaccggaccggauuggcucaaacaguuugacgccguccugccuggcuacacccugaagucucagcucgauauucugagccuucugaaacaggaaucccccgcgccugagcccccuacacaacauagcuacacguauaacguuuccaaucucgacgugcggcagcugucugcucccccgccugaggaacccagcccucccccgucuccccuggccccuucccccgccagcccucccaccgagccucuuguggaacucccgacagagccccuggcugaaccucccgucccuagcccccugccgcucgccucuagcccugaguccgcgagacccaagccucgcgcucggccgcccgaggaaggcgaggauagcagaccuccgcgccugaaaaaguggaagggggugcgguggaaaagacuucgccugcuccugaccauccagaagggaucuggccggcaagaagacgagagagaaguugccgaguucauggagcagcuggggacagcccuucgccccgauaaagugccucgggacaugagacggugcuguuuuugccacgaagagggagauggcgcuaccgacgggcccgcccgccuccugaaccuggaccucgaucuguggguccaccuuaauugugcucugugguccacggaaguguacgagacacagggaggcgcccucaugaacguugaaguggcgcugcauagaggccugcuuaccaagugcagccucugucagcggaccggggccacaucuuccugcaaucgcaugagauguccuaacgucuaucacuucgcuugcgccauucgggcuaaauguauguucuuuaaggacaagaccaugcugugccccaugcauaaaaucaagggaccuugugagcaagagcugagcucuuucgccguguuuagacgcguuuacaucgaacgggaugaggugaaacagauugcguccaucauucagagaggcgaacgccuccacauguuccgggucgggggacugguguuucaugccaucggccagcuucugccgcaccaaauggcugacuuccacagcgccacagcucucuaucccgucggguacgaggccacgagaauuuauuggucccugcgcaccaauaacagacggugcugcuaccgcuguagcaucggcgaaaacaauggaagaccugaguuugugaucaagguuauugagcagggccuggaagaucuuguguucacagacgccucuccccaggcugucuggaaccggaucauugagccuguggccgcgaugcgcaaagaagcugauaugcucagacuguuucccgaguaccugaagggggaggaacucuucggacugaccgugcaugccguucuucggaucgccgagucccugccgggcguggaaagcugccagaauuaucucuuucgcuacgggagacacccucugauggagcugccccuuaugauuaacccuacaggaugugcucggucugaacccaagauccugacccauuauaaaagaccccacacgcucaauagcaccuccaugucuaaggccuaccaaagcacauucaccggcgagacaaacaccccuuauuccaaacaguuuguccacucuaagagcucccaguaccgccggcugagaacagaguggaaaaauaacguguaucucgcgcgcagccggauucaagggcugggccuuuacgcugccaaggaccuggaaaaacauaccaugguuaucgaguacaucggaacgauuaucagaaaugaaguggccaaccgccgggagaagauuuaugaggaacagaauagaggcaucuacauguuccggauuaacaaugagcacgucaucgaugcuacacucaccgggggaccggcccgcuauaucaaccauucuugcgcucccaauuguguggccgaagucgugaccuucgacaaggaggauaaaauuaucauuaucuccagcagacggauuccuaagggcgaggagcugacauacgacuaucaguuugauuucgaagacgaccagcacaaaauccccugccauuguggggcguggaacugccgcaaguggaugaacuga

SEQ ID NO: 71281 - RNA, 5577 nt, Artificial Sequence
  derived and/or modified sequence opt5 from KMT2E__Homo_sapiens__NP_061152
augagcaucgugauuccccugggcguugacaccgccgaaacauccuaccucgaaauggcugccgggucugagccugaaagcguugaggcguccccggugguggucgaaaagucuaacagcuauccccaccagcuguacacguccucuagccaccacucccauagcuauaucggacuuccuuacgcugaucacaauuauggcgccagacccccucccaccccuccggccucucccccucccuccgugcugauuagcaaaaacgagguugggaucuucacaaccccuaauuuugacgagacaucuuccgcuaccacaauuagcaccucugaagauggauccuacggcacggacgugacccggugcaucuguggguucacacaugaugacggauauaugaucugcugugauaagugcagcgucuggcaacacauugacuguaugggcaucgaucgccagcacauucccgacaccuaccucugcgagagaugucagccgcggaaccuggauaaagaacgcgccgugcuucugcagagacggaagcgcgagaauauguccgacggcgauacaucugcuaccgagagcggggacgaaguuccuguggagcucuacacggccuuucaacauacacccaccuccaucacacugaccgccagcagagucucuaaagugaacgacaagcggcgcaagaaauccggagaaaaggagcagcacauuagcaaaugcaagaaagccuucagagaaggcucucggaaguccucccgcgugaaggggucugcuccugagaucgaucccagcuccgacggaagcaauuuuggcugggagaccaaaauuaaggccuggauggauagauaugaagaggcuaacaauaaccaguacucugaagggguccagcgggaggcccaacgcaucgcgcugagacucggaaauggcaacgacaaaaaggaaaugaauaaauccgaucugaacacaaauaaccuucuguucaagcccccuguugagagccauauccagaaaaacaagaagauucucaaaucugccaaggaccugccgcccgaugcucuuaucauugaguaucggggcaaauuuaugcugagagaacaguucgaggccaauggguacuuuuucaagcgcccuuaucccuuuguccuguucuacuccaaauuucacggacuggaaauguguguggacgcucggacguucggcaacgaggccagauucauccgccggagcugcaccccuaaugccgaagucagacacgagauucaggaugggacaauccaucuguauaucuacuccauucacucuauccccaagggaaccgagauuacaaucgcuuuugacuucgauuacggcaacuguaaguauaaaguggacugcgcgugccucaaggaaaauccggaguguccuguucugaaacgcagcuccgaaucuauggagaacauuaauagcggguacgagacccggagaaagaaaggaaagaaggacaaagauaucuccaaggaaaaagacacgcaaaaccagaauaucacacuugauugcgagggcaccaccaacaagaugaaaagccccgaaacaaagcagcgcaagcugucuccucuccggcuguccgugagcaauaaccaagagcccgacuuuauugaugacaucgaagagaaaaccccuauuucuaaugaggucgaaauggaguccgaagaacagaucgccgaaagaaagcgcaaaaugacacgggaggagagaaagauggaagcuauucuucaggccuucgcccggcuggagaaacgcgaaaagagacgggagcaggcucucgaaagaaucagcacggccaaaaccgaggugaagacagaguguaaggauacccaaauuguuucugacgcggaagugauccaggagcaggcuaaagaagagaacgccagcaagcccacaccggccaaagucaaucgcaccaagcagcggaaauccuuuagcagaucucgcacgcauaucggccaacagagacggcgccacagaaccguguccaugugcagcgauauucagccuuccucucccgacaucgaggucacaagccagcaaaacgauauugaaaacaccgugcugacaaucgagcccgaaaccgagacggcucuggccgaaauuaucacagagaccgagguuccugcucucaauaaguguccgacaaaguaucccaaaaccaagaaacaucuggugaacgaauggcuuuccgagaagaaugagaaaaccgggaagccuucugacggacugagcgagcggccccuccgcaucacaacggauccugaaguccuggccacccagcuuaacucccugcccggccucacauacucuccucacguguauagcacccccaagcacuacauuagauucacauccccguuucugagcgagaaacggcgcagaaaggagccuaccgaaaauaucucuggguccugcaaaaagcgguggcugaaacaggcgcucgaggaagagaacagcgccauucugcaucgcuucaauucucccugucaggaaagaucccggagcccugcuguuaacggagagaauaagucuccccuucugcucaacgacuccugcagccugccggaccugacgacaccucuuaagaaaagacgcuuuuaucaacuccuggauuccguguacagcgagaccucuacccccacaccuagccccuacgccacccccacacacacggacaucaccccuauggauccguccuucgcuacacccccucggauuaagucugacgaugaaaccuguagaaauggcuauaaacccaucuacagcccugucacacccgugaccccugggacgccgggcaacaccaugcauuuugagaauaucuccucucccgaaagcuccccugagauuaagcgccggacauauucucaggagggauacgacagaagcuccaccaugcugacacucggccccuuccgcaacagcaaucugaccgaacuugggcugcaggagaucaaaacaauuggauauaccucuccucgguccagaacggaagugaaccgccaaugccccggcgagaaggaaccgguuagcgaucuccagcuggggcuggacgccgucgagccuacagcgcuucacaaaacccucgagacccccgcccacgaucgggcugaacccaacucucagcuggacuccacacauagcggaagaggcaccauguacuccucuugggugaaguccccugaucggacgggggugaauuuuuccgucaacagcaaucugcgcgaccucacacccucucaccagcuggaggugggcggaggcuucagaaucuccgaaagcaagugucuuaugcaagaugacacccgggggauguucauggagacaaccgucuuuugcacaucugaagacggacuggugagcggcuucgggcgcaccgucaacgauaaucucauugacggaaacugcacgccucagaauccgccccagaaaaagaaagugucccugcuggaguauagaaagcggcagagagaggcccgcaaaucuggcagcaagaccgaaaacuuuccucuuaucuccguuucuccccaugcuagcgggucccucagcaauaacggcgauggaugugccucuuccaaugacaacggcgagcaaguggaucacacagccagccugccucugcccaccccggcuacagucuacaaugcgaccuccgaagagacgucuaacaauugcccugugaaggacgccacagcuagcgagaaaaacgagcccgagguucaguggaccgccuccacaucuguggaacagguccgggagagaagcuaccagcgcgcccuccugcuuuccgaucaucggaaggacaaagauagcgggggagaaucuccuuguguguccugcagccccucucacgugcaauccagcccuucuagccacuccaaccauaucccccagcugcaggcuaagggcccggucccuucuuucagcgagcucauggaggaccccgaucccgaaaauccugagccgaccaccacaaacgaaugucccuccccugacacgagccaaaauaccugcaaaucucccccuaagaugagcaagcccgggagcccuggauccguuauuccggcccaggcgcacggcaaaaucuuuacaaagcccgacccucagugggauucuaccgugagcgcuuccgaggccgaaaacggggugcaucugaaaacagagcugcagcaaaagcagcuuucuaauaacaaucaggcccucagcaaaaaccaucccccucagacccaugucagaaauuccagcgagcaacugucucagaagcugcccuccgugccgacgaagcuccacuguccucccagcccccaccuggaaaacccucccaaaucuuccacaccucauaccccgguucagcacggcuaucuuagccccaagccucccucucagcaacugggauccccuuaccgcccccaucacagccagagcccccaggugggcaccccucagcgggagccccaaagaaauuucuauccugcugcccagaaccuccccgcgaauacacagcaagcuaccagcgggacacuguuuacgcagaccccuucuggacagagcuccgccacauacucucaguucaaccaacagagccucaauuccaccgcgcccccucccccgcccccuccgcccccuucuagcuccuauuaccagaaccagcaacccucugcuaauuuucagaacuauaaccagcuuaaaggcagccugucccagcaaacagucuucaccagcgggccuaaucaggcccuccccggaacgaccucucagcaaacagugccuggccaccauguuacccccggccacuuucugccgucccagaacccuacaauucaucaccagaccgcugccgcgguggugcccccucccccgccuccgcccccugcccccgggccucaucucgugcagcaaccgaauagccaccagcagcacucuguugcucauguggucggacccgugcacgccgugacaccuggcucccauauccacagccagacggcugggcaccaucugcccccucccccuccgcccccuggacccgccccucaccaucaucccccgccucaccccuccaccggccuucaagggcugcaggcccagcaccagcacgucguuaacucugcucccccucccccuccgcccccucccccuagcuccgugcucgcgagcggacaucacacaaccucugcccaagcucugcaucaucccccgcaccagggcccuccccuguucccuuccagcgcccaccccaccgugccgccuuaccccucucaggccacacaccauacgacccuuggccccgggccucagcaccaacccagcggaacaggcccucauugcccgcugcccgucaccgggccucaccuccagccccagggaccuaauuccauucccacaccuaccgcuucuggcuuuuguccgcaccccgggagcguggcccugccucauggaguucaaggcccccagcaggcguccccugugcccggccagaucccgauucaccgcgcucaagucccucccacguuccagaacaauuaccaugggucuggauggcacuga

SEQ ID NO: 71282 - RNA, 1284 nt, Artificial Sequence
  derived and/or modified sequence opt5 from KNG1__Homo_sapiens__NP_000884
augaagcugaucaccauucucuuccugugcagcagacuucugcucucccugacacaggagucucaaagcgaagagaucgacuguaacgauaaagaccuuuuuaaggccguggaugcugcccugaaaaaguacaauucccagaaccagucuaauaaccaguucguccucuaucggauuacggaagcgaccaaaacaguuggcagcgacaccuuuuacuccuucaaguaugagaucaaggaaggggauugccccgugcaaucuggaaaaacauggcaggacugugaguacaaggaugcugccaaagccgcuaccggcgagugcacagccaccguggggaagcgcagcuccacgaaauuuagcgucgcuacccagacaugucagauuaccccugccgaaggaccggugguuacagcgcaauaugacugccugggcugugugcaccccaucucuacccaguccccugaucuggagcccauccucagacacgggauucaguacuucaauaacaauacgcagcacagcucucuguuuaugcuuaacgaagucaagcgggcccaacgccaggugguugcuggacugaauuucagaaucacauauuccauugugcagaccaacugcagcaaggagaauuuucucuuccugacaccugacuguaaaucucuuuggaacggcgauaccggcgagugcaccgacaaugccuacaucgauauucaacugcggaucgcuuccuuuagccagaacugugacauuuaccccgggaaggacuucguccagccuccgacaaaaaucugcgugggaugcccccgcgauaucccuaccaauucccccgaacucgaggaaacgcugacacauaccauuacaaagcugaacgccgagaacaaugcgaccuuuuauuucaaaaucgacaacgugaagaaagccagaguccagguuguggcuggcaagaaguacuucauugauuuuguggcccgggaaacgacauguucuaaagagagcaaugaggaacucaccgaguccugcgaaaccaagaaacuggggcaaagccuugacuguaacgcugaggucuaugugguuccuugggaaaagaaaaucuaccccacagugaauugccagccgcugggaaugauuucucucaugaagcgcccucccggcuucuccccuuuuagaagcucucggaucggggagaucaaggaggaaaccacaagccaucugcgcuccugugaguauaaaggaagaccucccaaggccggcgccgaacccgcuucugagcgggaagucagcuga

SEQ ID NO: 71283 - RNA, 861 nt, Artificial Sequence
  derived and/or modified sequence opt5 from KNSTRN__Homo_sapiens__NP_001136233
auggccgcucccgaggccccuccgcuggacagaguguuccggaccacauggcucagcacggaaugcgauucccacccccugccucccucuuaccgcaaguuucuuuucgagacccaggcggcugaccuggccggcgggacaaccgucgccgcuggaaaccuccugaaugaaagcgagaaagauuguggccaagacagacgggccccugggguucagcccugccgccuugugacaaugaccuccguggucaagacaguguauucucugcagccuccgagcgcucucuccggaggccagcccgccgauacccaaacgagagcgaccucuaaaagccugcugccuguucgguccaaggaaguggacgucagcaaacagcuccauucugggggacccgagaacgaugugacaaagaucaccaagcugcgcagagagaauggccagaugaaagccacagacaccgcuacgcggcgcaacguuagaaagggcuacaaaccucuuuccaagcagaaaagcgaagaggaacugaaggauaagaaucaacuccuggaggccgugaacaaacagcuucaccagaagcugacagagacccagggggaacucaaagaccugacacaaaaggucgagcugcucgaaaaauuucgggauaauugucuggcuauucuugagucuaagggacuggaccccgcccucggcuccgaaacccuggcgagccgccaggagucuaccacagaucauauggacuccaugcuucugcucgagacgcugcaggaggaacugaaacucuucaacgaaaccgccaagaagcaaauggaggaacugcagaucgcuuggaugaaucacgggauucuucaucagauguga

SEQ ID NO: 71284 - RNA, 6630 nt, Artificial Sequence
  derived and/or modified sequence opt5 from KNTC1__Homo_sapiens__NP_055523
auguggaacgacaucgagcugcucaccaaugaugacacaggaagcggguaccuguccgugggaucuagaaaggaacacggcacggcccuuuaucaggucgaucugcucguuaagauuagcuccgagaaggcuucucugaaccccaagauccaggccugcagccuuuccgacggguucauuaucguggcggaucagucugugauucugcucgacagcaucugucggucccugcagcugcaucucgucuuugauaccgaaguggacguugugggacugugccaggagggcaaguuccuucuggucggggaacgcagcggaaaucuccaccugauccaugugacaucuaaacagacccuucugacaaacgcuuuuguucagaaggccaaugaugagaacagacggaccuaccagaaucucgugauugagaaggacggcuccaacgaaggcacauauuacaugcugcugcucaccuauagcggguucuuuuguaucacgaaucugcagcuucugaaaauucaacaggccaucgagaacgucgauuucucuaccgcuaagaaacuccagggacagauuaaguccagcuuuaucucuacagaaaauuaccacacccugggcugccuuucccugguggccggggaccucgcuagcgaggugccugucauuaucggaggcacagggaacugugccuucuccaaaugggagcccgauucuagcaagaagggaaugaccguuaaaaaucugaucgacgcggaaauuaucaagggcgccaaaaaguuucaacugauugacaaccuccuguucgugcuugauacggacaaugugcugucccucugggauaucuauacacugacccccgucuggaacuggccuagccuucauguggaggaauuucugcucacaaccgaggcugacucucccuccagcguuaccuggcagggcauuacaaaccugaaacugaucgcccucacggcuucugccaauaagaaaaugaagaaccugaugguguacagccuuccuaccauggaaauccuguacucccucgaggucucuagcguguccagccugguucagacagggauuucuaccgauacaaucuaucugcuugagggagugugcaagaaugaccccaaacucuccgaagauagcgucucugugcugguccugcgcugucucaccgaggcgcugccugaaaacagacuuucccggcugcuccacaagcaccgcuucgccgaggcugagagcuuugccauucaauucggccuggacguggaacugguuuacaaagugaaguccaaucauauccuugagaaacucgcucugucuagcgucgaugccuccgaacagacggaguggcagcagcugguggacgaugccaaggaaaaccuccacaagauucaagacgacgaguucguugugaauuauugccugaaagcucaguggaucacauacgaaaccacccaggagaugcuuaacuaugcgaagacaagacugcucaaaaaggaggauaaaaccgcccugaucuacucugacgggcugaaggaaguccuucgggcucaugccaagcucacaacguuuuauggagccuucggcccggagaaauuuagcggguccagcuggauugaguuccugaauaacgaggaugaccugaaggauaucuuucuccagcugaaagagggaaaucuugugugugcucaauaccuguggcuccgccacagagccaacuucgaaucucgguuugacgugaagaugcuggagucccugcuuaauagcaugucugcguccguuagccuccagaaacugugccccugguucaagaacgaugucauuccuuuugugcgcagaaccgugcccgaaggccagaucauucuggcuaaguggcucgagcaggccgcccggaaucuggaacuuacagacaaagcuaacuggccugagaacggccugcaacucgccgagaucuucuuuaccgcugaaaagacagaugagcuggggcuggccucuagcuggcacuggauuucccuuaaagacuaccagaauaccgaagaggucugucagcugcgcacgcucgugaacaaucugagagaacucaucacccugcaucggaaguauaacugcaaacuugcgcugagcgauuucgagaaggagaauacaaccacaaucguuuuuagaauguucgacaaagugcucgcccccgaacugauuccgucuauccuggagaaguucauucgcgucuacaugcgggaacacgaucuucaggaggaagaacugcuccugcucuauaucgaggaccugcuuaacagaugcuccagcaaguccaccucucuguuugaaacggcuugggaggccaaagcuauggccgugauugcgugucucagcgacacagaucugaucuucgacgccguucugaagaucauguacgcugccguggucccuugguccgcugccguggaacaacuuguuaaacagcaucuggagauggaucaccccaaggugaaacuccugcaggagucuuauaagcucauggaaaugaagaaacugcuucgcggauacggcauucgggaggucaaucugcugaacaaggaaaucaugagaguggugcgcuauauucucaaacaagacgucccuagcucccuggaggaugcccuuaagguugcucaggcguuuaugcugucugacgaugaaaucuacagccuccggauuaucgaccugaucgauagagagcagggggaggacugccuccugcuucugaaaucccugccgcccgccgaagcugagaagaccgccgaacgcgugauuaucugggcccggcucgcucugcaggaggaaccugaucauagcaaggagggaaaagccuggagaaugucuguggcgaagacauccgucgacauucuuaaaauccugugugauauucaaaaggacaaucuccagaaaaaggacgagugcgaagagaugcugaaacucuucaaagaaguggcuagccugcaggagaacuuugaaguuuuccuuucuuuugaggauuacuccaauagcucucugguggccgaccugcgcgagcagcacaucaaggcccacgaagucgcucaagccaaacauaagccgggcuccacccccgagccuaucgcggcugaagugcggagccccuccauggagagcaaacuccacagacaggcccuggcccuucagaugucuaagcaggagcuggaagcugagcucacccugcgggcccucaaagaugggaacauuaagacagcucugaagaaauguagcgaccuuuucaaguaucauugcaaugccgauacgggcaaacugcuguuucucaccugucaaaagcugugccagaugcuugcggacaacguuccugugacaguccccgugggacugaaucucccguccaugauccacgaucuggccucucaggcugccaccauuuguagcccugacuuccugcucgaugcucuugaacugugcaaacacacacugauggccguugagcucucccgccaaugucagauggacgauugcggcauccugaugaaggccucuuuugggacccauaaggaccccuacgaagaguggagcuauuccgacuucuuuucugaggauggaauugugcuugaaagccagaugguccugccugugaucuacgagcucauuuccagccuggugccccuggcugaaucuaaaagauauccucucgaguccacgagccuucccuacugcucucugaacgaaggcgacgggcugguccucccgguuaucaacuccaucagcgcgcugcuucagaaucugcaagaguccucucagugggagcucgcccugcgguucguggugggauccuucggcacaugucugcagcacuccgucagcaacuuuaugaaugcuacccucucugaaaaacuuuucggggagaccacacuggugaaauccagacauguugugauggaacugaaggagaaagccgucauuuuuauccgcgaaaacgccaccacacuccugcacaagguguucaauugccggcuuguugaucuggaccucgcucugggcuauuguacgcugcucccucagaaggauguguuugagaaccuuuggaaacugauugacaaggccuggcaaaauuacgauaaaauccuggcgauuagccucgucggaucugagcuggcuagccuuuaccaggaaaucgagaugggccugaaguucagagaacucuccaccgacgcccagugggggauccgccugggaaaacugggcauuucuuuucagcccguguucagacaacauuuucucacaaagaaggaucuuaucaaagcccuggucgagaacauugacauggauaccagccugauccucgaguauugcuccacauuccagcuggacugugaugcugugcuucagcuguuuauugaaacccuccugcacaauacgaacgccgggcagggacaaggcgacgcgucuauggacagcgcuaagcggcgccaccccaaacugcucgccaaggcccuugagaugguuccucugcugaccuccacaaaagaucucgugaucagccugucugggauccuucauaagcuggacccguacgauuaugaaaugauugaggucgugcucaagguuaucgaaagagcugacgagaaaauuaccaauaucaacauuaaucaggcccuguccauccugaagcaccucaaaagcuaccggcgcauuucucccccuguggaucuugaguaucaguacaugcuggaacaugucaucacacugcccagcgcugcccaaaccagacucccuuuccaccugaucuucuuuggcacagcgcagaacuucuggaagauucuuagcaccgagcuguccgaagagucuuuucccacgcuccugcugaucagcaaacucaugaaguucucccuugacacacuguaugugagcaccgccaaacauguguuugaaaagaagcugaaaccuaagcuccugaaacuuacccaggcuaagucuuccacacugauuaauaaagagaucaccaagauuacgcagacaaucgagagcugccuccugucuaucguuaaccccgaaugggccgucgcuauugccaucucccuggcccaagauauuccggagggcagcuucaagaucucugcucucaaauuuugucuuuaccuggcggaacgguggcugcagaacauuccuagccaggacgagaagcgcgaaaaagccgaggcucuccugaagaaacuucacauccaguacagacgguccggcaccgaggccgugcugaucgcccacaagcucaauacagaagaguaucugcgcgugauugggaagcccgcucaucugaucgucucucucuacgaacacccuagcauuaaccaaagaauccaaaauuccagcggaaccgauuaucccgacauucaugccgcggcuaaagagaucgccgaggugaacgaaauuaaucuggagaagguuugggauaugcuucuggaaaaauggcucugcccguccacaaagccuggcgagaaacccucugaacuguucgagcuucaggaggacgaagcccugcggagagugcaguaccuccugcugagccgcccuaucgauuauuccucucggaugcucuuugucuucgcuaccagcacgaccacaacccuggggaugcaccaacuuacauuugcccacagaacccgcgcgcugcagugucucuucuaccuggccgacaaggagacgaucgaaucccuuuuuaagaaacccauugaggaagugaagucuuaucugcggugcaucacauuccucgcuagcuucgagacccugaacauucccaucacauacgagcuguuuuguuccagcccuaaagaaggaaugauuaagggccucuggaaaaaucauucucacgaguccauggccguuagacuggugaccgaacuuugccuggaguacaagaucuaugaccuccagcuguggaacgggcuucugcaaaaacuccugggcuucaauaugaucccguaccugcgcaagguccucaaggcuauuagcucuauccauucccuguggcaagugcccuauuuuagcaaagccuggcagcggguuauucagaucccucuucugucugcuuccugcccccucagcccugaucaacuguccgacuguagcgaaucucuuauugccgugcuggagugccccgucagcggagaucucgaccugaucggcguggcgagacaguacauccagcuggagcucccugccuucgcucuggccugucuuaugcugaugccgcacuccgaaaagcgccaucagcaaauuaaaaacuuucucgggucuugcgauccccaggugauccugaagcagcuugaggaacacaugaauaccggacagcuggcuggcuucagccaccaaauucggucccucauccugaacaauauuaucaacaaaaaggaguuugggauucuggccaagacaaaauauuuccagaugcucaagaugcaugccaugaauacgaacaauaucaccgagcuggucaacuaccuugcuaacgaccugucucucgaugaagcgagcguucugaucacagaguauuccaaacacuguggaaagccugugcccccugacaccgcccccugcgaaauucuuaaaauguuucugucuggccucagcuga

SEQ ID NO: 71285 - RNA, 1617 nt, Artificial Sequence
  derived and/or modified sequence opt5 from KPNA1__Homo_sapiens__NP_002255
augaccacacccggcaaggagaacuucagacugaaaagcuacaagaauaaaucccucaacccugacgaaaugcggcgcagacgggaggaagaggggcugcagcuucgcaagcagaaaagagaagaacaacuguuuaagcggcgcaauguggccacggcugaggaagagaccgaagaggaggucaugucugauggaggcuuccacgaagcccagaucagcaacauggagauggcgcccgggggaguuauuacauccgacaugaucgaaaugauuuucucuaagagcccggagcagcaacucuccgcuacccagaaauucagaaagcugcuuucuaaagaaccuaaucccccuaucgaugaggugauuagcacacccggcguggucgcccgguuuguggaguuccugaagcgcaaagaaaacugcacccuccaguuugaguccgccuggguucugacaaauaucgcuagcgggaacucucugcagaccagaaucgugauucaagccggagcugucccuaucuucauugaacuccuguccagcgaguuugaagacgugcaggagcaggccguuugggcgcuuggcaauaucgccggcgauucuacgaugugucgggacuaugugcuggauugcaacauucucccgccccugcuucagcuguucuccaagcaaaaucgccucaccaugacaagaaacgcugucugggcccugagcaaucugugucgggggaagucuccucccccugaguuugcuaaagugucccccugccucaacgugcugagcuggcuucuguucgucuccgacaccgauguucucgccgacgcguguugggcccugucuuaccuuagcgauggaccgaaugacaagauccaggcugugauugaugccggcgugugccgcagacuggucgaacuccugaugcauaacgacuauaaagugguuuccccugcucugcgggccguggggaacaucgucacaggagacgauauccagacccaagugauucucaauuguagcgcccugcagucucuucugcaccuccuguccagccccaaggagucuaucaaaaaggaggcuugcuggacgauuagcaacaucacagcgggcaauagagcccagauucagaccguuaucgacgcuaacaucuuuccugcccuuauuuccauccugcaaacagccgaguuccgcacccggaaagaagcugccugggcgauuaccaaugcuacaucugggggaagcgccgagcagaucaaguaccucguggagcugggcuguauuaagccccugugcgaucuccugacggucauggacuccaaaaucgugcaggucgcccuuaacggccuggaaaauauccucagacugggggagcaggaagcuaagcgcaacggaaccggcauuaaucccuauugugcccugaucgaggaggcuuacgggcuugauaaaauugaauuucuccaaagccaugagaaccaggaaaucuaucagaaggccuuugaccugauugagcacuacuucggaacagaagaugaggacucuuccaucgcgccucagguggaucugaaucaacagcaguacauuuuucagcaaugcgaggccccgauggaaggcuuccagcucuga

SEQ ID NO: 71286 - RNA, 1590 nt, Artificial Sequence
  derived and/or modified sequence opt5 from KPNA2__Homo_sapiens__NP_001307540
augagcaccaacgagaaugccaacacacccgcugccagacugcaccgguucaagaauaaaggcaaggacuccacggaaaugcgcagacggcgcaucgaggugaacgucgaacucagaaaagcgaagaaagaugaccagaugcugaagcggcgcaauguuucuagcuuuccugaugacgcuaccuccccgcuucaagagaacagaaauaaccaggggacagugaauuggucuguggaugacauugucaagggaaucaacagcuccaauguggaaaaccagcugcaggccacccaagccgcucggaaacuccugucucgcgagaagcagcccccuauugauaauaucauuagagccggccuuauccccaaauucguuagcuuucuggggcggacagacugcuccccuauccaguucgagagcgcuugggcccucaccaacauugcgucuggaacauccgaacagaccaaggccguggucgauggcggggcuauccccgccuuuauuagccugcuggcuucuccucaugcccacaucuccgagcaagcggugugggcccucggaaauauugcuggcgacggcagcguuuuccgcgaucuggugaucaaauacggggccgucgacccgcuucuggcucuccuggccgugcccgauaugucuucccuugccuguggauaucugagaaaccucacguggacccugagcaaccugugccggaauaagaacccugcucccccuauugacgcgguggaacagauccuccccacacugguccgccuucugcaucacgacgauccggagguucucgccgacaccuguugggcuaucuccuaccugacagauggcccuaaugagagaauugggaugguggugaagaccggagucgugccccagcuuguuaaacugcucggcgccucugaacugccuaucgugacgcccgcccugcgggcuauugggaacaucgucacaggaaccgacgagcagacacaagugguuauugaugccggcgcgcucgcuguguuucccagccugcuuaccaauccuaagaccaacauccagaaagaagccacauggacgauguccaauaucaccgccggcagacaggaccaaauucagcaggucgugaaccaugggcuggucccguuccucgugagcguucugucuaaggcugauuuuaaaacacagaaggaggccgugugggcugucaccaauuauacauccggaggcaccguggaacaaaucguuuaccuugugcacugcgggauuaucgagccccugaugaaccuccugacggccaaagacacaaagauuauccuggucauccucgaugcgauuagcaauaucuuccaggccgcugagaagcugggagaaaccgagaaacuuucuauuaugaucgaagaguguggcgggcuggacaagauugaagcccuccagaaccacgagaaugagagcguguauaaggcuucccugucucugaucgaaaaauacuuuagcguggaggaagaggaagaucagaacguugucccugagaccacauccgagggauauaccuuccaagugcaggacggcgcccccggcacauuuaauuucuga

SEQ ID NO: 71287 - RNA, 1566 nt, Artificial Sequence
  derived and/or modified sequence opt5 from KPNA3__Homo_sapiens__NP_002258
auggccgagaaccccagccuggaaaaucacagaaucaaguccuucaaaaacaagggccgggacguggagaccaugcgcagacaucggaaugaagucacaguugagcuccgcaaaaacaagagagaugaacaccuucuuaaaaagcggaaugugccucaggaggagucucuggaagacagcgauguggacgcugauuuuaaggcccaaaacgucacgcucgaggcgauucugcagaaugcuaccuccgacaacccggugguucagcuuucugccgugcaggccgcucgcaaacugcucagcuccgauagaaaucccccuaucgacgaucugauuaagucugggauccugcccauucucgucaaaugccuggaacgggacgauaacccuagccuucaauucgaggccgcuugggcccugacaaauaucgcguccggaaccagcgcccagacacaggcugugguucagucuaacgccgugccccucuuucugcgccuucugagauccccucaucaaaaugucugugagcaggcugugugggcccucggcaacaucauuggggacggaccgcagugccgggauuacgugaucagccugggcgucguuaagccccugcucucuuucauuuccccuagcauccccauuaccuuucugcgcaaugugacaugggugaucgucaaccuuuguagaaacaaagacccucccccgccuauggaaaccgugcaggagauucugcccgcgcucugcguucugaucuaucacacggacaucaauauucuuguggauaccgucugggcccugucuuaccucacagacgggggaaacgaacaaauccagauggugauugauuccggcguugugccuuuccuggucccccugcucagccaucaggaggugaagguccaaaccgcugcccugcgggcugugggcaauaucguuacagggaccgacgaacagacacaggugguccuuaacugugaugugcugucccacuuucccaaucuccugucucacccuaaggagaaaauuaacaaggaggccguuugguuccuuagcaauaucacggccggaaaccagcaacaggugcaggcugucaucgacgcgggccugauuccgaugaucauucaucagcucgccaaaggggauuuuggaacccaaaaggaagcugccugggccaucuccaaucugacaauuagcggccgcaaagaccagguggaguaucuggugcagcagaacguuauucccccuuucugcaaucuccugucugucaaggauucccaaguggugcaggucgugcuugacgggcugaaaaacauccucaucauggcuggagaugaagccagcaccaucgcggagauuaucgaagaguguggcggccuggagaagauugaaguucugcagcagcacgagaaugaagacaucuacaagcuggcuuuugagauuaucgaccaauauuucucuggggaugacaucgaugaagaccccugccucauuccugaggccacccagggaggcacauacaacuuugaucccacggccaaucugcagaccaaagaguucaacuucuga

SEQ ID NO: 71288 - RNA, 1566 nt, Artificial Sequence
  derived and/or modified sequence opt5 from KPNA4__Homo_sapiens__NP_002259
auggccgacaacgagaagcuggauaaucagagacucaaaaacuucaagaauaaaggccgggaccuggaaaccaugcgcagacaacggaacgagguggucguugaacuucgcaagaauaaaagagaugagcaucugcucaagcggcgcaacgugccccacgaagacaucugcgaggauagcgacauugauggggacuacagagugcagaauacaucccuggaggcuaucguccagaacgccucuagcgauaaucaggggauucaacuuuccgcggugcaggcugcccggaagcugcucucuagcgaccgcaacccuccgaucgaugaccugauuaaauccggcauccugcccauccucguucacugucuggaaagagaugacaauccuucucuucaguuugaggccgcuugggcccugacgaacauugcuagcgggaccuccgaacagacacaagccgugguccagagcaaugcggugccccucuuccugcggcuucugcauucuccucaccagaacguuugcgagcaggccgugugggcucucggaaauaucauuggcgacgggccccaaugucgcgauuaugucaucucccugggaguggugaagccucugcucagcuuuauuucuccguccauccccauuaccuuccugagaaacgucacauggguuauggugaaccuuugccggcauaaagacccucccccucccauggagaccauccaggaaauccugccggcccucugugugcugauucaccacacagaugucaauauccuuguggacaccguuugggcucugagcuaccucacggaugccggcaacgagcagauucaaauggugaucgacucuggcauugucccucaucuggugccccugcucucccaccaggaaguuaaggugcagaccgcggcccugcgcgcugucgggaauaucgugacaggaaccgaugagcagacacaagucgugcuuaacugcgacgcccugagccauuuuccugcucuccugacccaccccaaagaaaagaucaauaaggaggccguuugguuccuuuccaacauuacggccggcaaucagcaacaggugcaggcugucaucgaugcgaaccuggugcccaugauuauccaccuccuggacaaaggggauuuuggaacacagaaggaggccgcuugggccauuucuaaucugaccaucagcggcagaaaagaccagguugccuaucucauccagcaaaacgugauuccuccguucuguaaucugcuuacagucaaggacgcucagguggugcagguuguccuggaugggcucuccaacauccugaaaauggccgaagacgaggcggaaaccauuggaaaucugaucgaggaaugcggcggccuugagaagauugagcagcuccaaaaccaugaaaaugaggauaucuacaaacuggcuuaugaaauuaucgaccaguuuuucagcucugaugacaucgaugaggaccccucccuggugccugaagccauucagggaggaaccuuuggcuucaacagcucugccaacgugcccacagagggguuucaauucuga

SEQ ID NO: 71289 - RNA, 1608 nt, Artificial Sequence
  derived and/or modified sequence opt5 from KPNA6__Homo_sapiens__XP_011539462
augaccauggccagccccggcaaggacaacuacagaaugaaauccuauaagaauaacgcucugaauccugaggaaaugcggcgcagacgggaggaagaggggauccagcuccgcaaacaaaagagagaacagcagcuguucaaacggcgcaacguggagcuuauuaaugaggaagccgcgauguuugauucucugcucauggacagcuacgucuccucuacaacgggagagagcguuaucaccagagaaaugguggagaugcuguucuccgaugacucugaucuucagcuggcuacaacccaaaaguuucggaagcuccugagcaaagagccguccccucccauugacgaagugaucaacacaccccgcgucguggauagauucguugaguuucugaagcggaaugaaaacugcacccuccaguucgaggccgccugggcucugacaaauauugccagcggcaccucucagcagacgaaaaucgugaucgaagcuggggccgucccuauuuuuaucgagcuucugaacuccgacuucgaggaugugcaagaacaggcgguuugggcccucggaaauauugcuggcgacagcucugugugucgcgauuauguccugaacugcuccauccuuaauccccugcucacccugcugacaaagagcaccagacucacaaugacccggaacgccgugugggcucugucuaaucuuugucgcgggaaaaacccuccgcccgaguuugccaagguguccccuugccugcccguccucagcagacugcuuuucuccucugacagcgaucugcucgcggacgccuguugggcucuguccuaccugagcgacggaccuaacgaaaagauucaggccguuaucgauucuggcgugugccggagacucguggagcugcuuaugcacaaugacuauaaagucgcuucccccgcccugcgcgccgugggcaacauuguuacgggggaugacauccagacacaagugauccucaauuguagcgcucugccgugccuucugcaucuccugucuagcccuaaggaauccauucggaaagaggcguguuggaccaucucuaacauuacagccggaaauagagcucagauccaggccgucauugaugccaacaucuuucccgugcugaucgagauucuccaaaaggcugaguuccgcacccggaaagaagccgcgugggcuaucaccaaugccacaagcggcgggacgccugaacagauuagauaccugguuucccuuggaugcaucaagccccugugugaccuccugaccgugauggauagcaaaauuguccagguggcccugaacggccuugagaauauccuccgccugggggaacaggagggaaagcggucuggcuccggcgucaaccccuauugcgggcugaucgaggaggcuuacggacucgacaagauugaauuucugcaaagccacgaaaaucaggagaucuaccagaaagccuucgaucuuauugagcauuauuucggcguggaagacgaugacucuucccuggcuccucagguugacgagacacaacagcaguuuaucuuccagcaaccggaagcccccauggagggguuucagcucuga

SEQ ID NO: 71290 - RNA, 1551 nt, Artificial Sequence
  derived and/or modified sequence opt5 from KPNA7__Homo_sapiens__NP_001139187
augcccacccuggacgccccugaggaaagacggcgcaaguucaaauacagaggcaaggaugugagccuccggcgccagcaaagaauggcugucucccuggagcuucggaaagccaagaaagacgaacagacacugaagcgcagaaacaucacgucuuuuugcccggauacccccagcgagaagacagcgaaagggguugcugugucccucacccugggagaaauuaucaagggcgugaacucuagcgacccuguccuuuguuuccaggccacacagaccgcccggaaaaugcugucccaagagaagaaucccccucucaaacuggugauugaggcugggcugaucccccgcaugguugaauuucucaagucuagccuguauccuugccuucaguucgaggccgcuugggcccugacaaauauugcguccggaaccagcgaacagacgagagccguggucgagggcggggcuauccagccgcucaucgagcugcuuucuuccagcaacguggccguuugugaacaagcugugugggcccugggaaauauugcgggcgauggccccgaguuucgggacaacgucaucaccucuaaugccauuccucaccuccuggcucugaucucccccacacucccuauuaccuuccugcgcaacaucacauggacccuuagcaaucugugcagaaacaagaaucccuacccgugugauacggccgugaaacagauucucccugcucugcuucaucugcuccagcaccaggacucugaagugcuguccgaugccugcugggcccugagcuaucucacagacggguccaacaagcggaucggacaagucguuaauaccggcgugcugccccgccuugugguccugaugacaucuagcgagcucaacgugcugaccccuucccuuagaaccguugggaauaucgugacaggaacggaugaacagacccagauggcuauugacgcgggcaugcugaacguccucccccaacugcugcagcauaacaaacccagcauccagaaggaggccgcuugggcccucucuaauguggccgcugggccuugucaccauauucagcaacugcuugccuacgauguucugccgccccucguggcgcugcugaaaaacggagaguuuaagguccagaaagaagcuguguggauggucgccaauuucgccacaggcgcuaccauggaccagcuuauccagcucgugcacuccggcguucuggagccucuggugaaccuccugacagcccccgacgucaagauugugcuuaucauccuggauguuauuagcugcauccuccaagcugccgaaaagcggucugagaaagaaaaucugugucugcuuauugaggagcucgggggaaucgacagaauugaagcgcugcagcugcacgagaaccgccagaucggccagagcgcccucaauaucauugaaaagcauuuuggggaggaagaggaugagucccaaacccugcuuucucaggugaucgaccaggauuaugaguucauugacuacgaaugccuggcuaaaaaguga

SEQ ID NO: 71291 - RNA, 2196 nt, Artificial Sequence
  derived and/or modified sequence opt5 from KPNB1__Homo_sapiens__NP_001263382
augaaggagagcacccuggaagccaucggcuacauuugccaggacaucgaucccgagcaacuccaggacaaauccaacgaaauucugacagcuaucauucaggggaugagaaaggaggaaccuucuaauaacgugaaacuugccgcgacgaaugcucugcucaacagccuggaguucaccaaggccaauuuugauaaagaguccgaacggcacuucaucaugcaggucguuugugaggccacacaaugcccggacacccgcgugagaguggcugcccuucagaaccuggucaagaucaugucucucuauuaccaguauauggaaacauacaugggacccgcucuguuugccauuaccaucgaggcgaugaaaagcgauauugacgagguggcccugcagggcaucgaguucugguccaauguuugugaugaagaaauggaccucgcuauugaggccucugaagcugccgagcaagggcggccucccgagcauacaagcaaguuuuaugcgaagggagcccugcaguaccuugugccuauccugacccagacgcucaccaaacaggaugaaaacgacgaugacgaugacuggaaucccugcaaggcugccggcgucugucugaugcuucuggcuacaugcugugaggacgauauugugccucacguucucccguucaucaaagaacauaucaagaaccccgacuggcgcuauagagaugccgccgugauggcuuuugggugcauucuggagggaccugaacccucccaacugaagccucucgucauccaggcgaugcccacccugauugagcuuaugaaagacccgagcguggugguccgggauacagccgcuuggaccguuggccgcaucugugagcugcucccugaagccgccauuaaugacguguaccuggcuccccuucugcagugccucaucgagggccugucugccgaaccuagaguggcguccaacgucuguugggcuuucagcucucuggccgaggccgcuuacgaagccgcugauguggccgacgaucaagaggagcccgcgacguauugccucuccagcucuuuugaacugaucguucagaagcugcuugagacaaccgaccggcccgaugggcaccagaauaaccuccgcuccagcgccuacgaaucccugauggagauugugaaaaauucugcuaaggacugcuauccugccguccagaaaacaacccuugugaucauggagagacugcaacagguucuccagauggaaagccauauucaguccaccagcgaccggauccaauucaacgaucugcagucucugcucugugcuacacugcagaacgugcuucgcaagguccagcaccaagacgcccugcagauuuccgauguggucauggcgagccuccugagaauguuucagucuacggccggaagcggcggggugcaggaggacgcucugauggccguuuccacccuuguggaaguccucggaggcgaguuccugaaauacauggaggcuuuuaagccguuccuggggaucggacucaagaauuaugccgaauaccaagugugccuggccgcuguuggccuugugggcgaucugugucgggcgcuccagucuaacaucauucccuucugcgacgaggucaugcagcugcugcuugaaaaucucgggaacgagaaugugcaccgcagcgugaaaccucaaauccuguccguuuuuggagauauugcccuggcuaucggcggggaguucaagaaauaucucgaagucgugcugaacacacuucagcaggccagccaggcccaaguggacaagucugauuacgacauggucgauuaccugaaugaacucagagaguccugucuggaggcuuauaccggaauugugcagggccugaaaggggaccaggaaaacguucaucccgaugugaugcuuguccagccucggguggaguuuauccucagcuucauugaccacaucgccggagacgaagaucauacagacggcguuguggcgugcgcugccggccugaucggggaucuguguaccgccuuuggaaaggacguccucaagcugguggaggcuagacccaugauucacgaacuucugacggagggccgccggucuaaaacaaauaaggccaaaacccucgcgaccugggcuacaaaggagcugagaaaacugaagaaccaagccuga

SEQ ID NO: 71292 - RNA, 1740 nt, Artificial Sequence
  derived and/or modified sequence opt5 from KPRP__Homo_sapiens__NP_001020402
augugcgaccagcaacagauccaguguagacugccccuccagcaaugcugugugaagggcccuagcuucugcuccucucagagcccguuugcccagucccaggucguugugcaagcucccugugagaugcagauuguggauugcccugccucuugucccguccaggugugccagguuagcgaccaagcgccuugucagucccagaccacacaagugaaaugccagucuaagacgaaacaggucaaggggcaggcucaaugucagagcaaaaccacacaggugaagggacaggccgccucccaaagccagaccucuuccguucagagccaggcucccugccaaucugaaguguccuacguccagugcgaggccagccagccugugcagacauguuucguggaaugcgcuccggucuguuauaccgagacaugcuacguugaaugucccgugcaaaacuaugugccuugccccgccccucagcccguccagauguaccggggccgcccggcggugugucaaccucaggggagauuuucuacccagugccaguaucaaggauccuacagcuccuguggcccccaguuccagucucgggccacgugcaauaacuauaccccucaguuucaacugcgccccagcuacuccagcuguuucccccaguacagaucucggacauccuuuagcccuugcguuccgcagugccagacccaagggucuuauggcagcuucacagagcagcaccgcuccagaucuaccagccggugucuucccccuccccgcagacugcagcucuuuccucgguccugcucucccccgcgcagauucgagccuuguagcuccagcuaccugccccuucggccuucugaaggauuucccaauuauugcacgccuccccgcagauccgagccgaucuacaacagccgguguccuagacgccccauuuccucuugcagccaacggagaggccccaagugucgcaucgaaauuuccucuccuugcuguccgagacaggugcccccucagcggugccccgucgagaucccucccauccgccggagaagccaguccugugggccucaacccagcuggggagcuucuugcccggagcugcgcccucauguggaaccccggccucuccccuccuucugcccgccuagacgccuggaucagugucccgagagcccucugcagcggugcccuccgcccgcccccagaccccggcuccgcccugaacccuguauuucucuggagccuagaccccggccucuuccgagacagcuguccgaacccugccucuauccugagccccugccugcccuucgccccacaccgcggccuguuccccugcccagaccuggccaaugugagauccccgaaccucgcccgugccuccagcccugugagcacccugaacccugcccuagacccgagccgauuccucugcccgcuccuugucccagcccugaacccugccgggagaccuggcgcucuccgagcccuuguugggggcccaaucccgugccuuacccgggagaccugggcugccaugaguccagcccccacagacucgauacagaagcgccuuauugcgggcccucuuccuacaaccagggacaggagagcggcgccggcugugggccuggagacgucuuucccgaacggcgcggccaagaugggcauggagaccagggcaaugcuuucgccggggugaaaggagaggcuaaguccgccuacuucuga

SEQ ID NO: 71293 - RNA, 1143 nt, Artificial Sequence
  derived and/or modified sequence opt5 from KPTN__Homo_sapiens__NP_001278225
augaugggcgaggccgcuguggccgcggggcccugcccucugagagaagacagcuucacccgguuuuccucucagagcaacgucuacggacucgcuggcggggccggaggccgcggggagcugcuugccgcuacacugaagggaaaaguucucggcuucagauaucaagaucugcggcagaagauccgcccgguggccaaagaacuucaguuuaauuacauucccgaguccugucugaaccucgaacugcaguucacgccuuuucaacugugccacgcugaggugcaggucggcgaccagcucgagaccguguuccugcuuucugggaaugaucccgccauccaucuguauaaggaaaacgagggacuccaccaguuugaggaacaaccuguugagaaucuguuccccgaacuuacaaaccugaccagcuccgugcucuggcuggacguccauaauuuuccuggcacaucuagacggcugagcgcgcucgggugucaguccggauacgugcgcguugcccacguggaucagagaagccgggagguccugcagauguggucugugcuucaagacggcccgauuucccgcgugaucgucuucagccugucugcugccaaagaaaccaaggauagaccccuccaggacgaguauuccguucugguggcuagcaugcuugaaccugccguggucuaccgggaucugcucaaccgcgggcuggaggaccagcugcuccugcccggaucugaucaauuugacuccgugcuuugcagccugguuacagauguggaccucgacggcagaccugagguccugguggcgaccuauggccaggaacuucuguguuacaaguaccgggggcccgaguccggacucccggaagcccagcauggcuuccaucugcuguggcagcgcucuuuuagcuccccucuccuggcuauggcccacguugaucuuacgggggacggacugcaagagcucgcuguggucagccugaaaggcgugcacauucugcagcacucucuuauccaggccuccgaacucguccugaccagacugcggcaucagguggagcaaagacgccggagacuccaggggcuggaggauggagccggcgcuggccccgcggaaaaugccgcuagcuga

SEQ ID NO: 71294 - RNA, 567 nt, Artificial Sequence
  derived and/or modified sequence opt5 from KRAS__Homo_sapiens__NP_004976
augaccgaguacaagcugguggucguuggcgccgggggagugggcaaaagcgcucucacaauccagcugauucaaaaccacuucguggacgaauaugaucccacgaucgaggacuccuacagaaagcaggucgugauugauggggaaaccugccuucuggacauccucgauacagccggacaggaggaauauucugcgaugcgggaccaguacaugcgcaccggcgagggguuucuguguguuuucgcuauuaauaacacaaagagcuuugaggauauccaucacuauagagaacaaaucaaacgggugaaagacuccgaggaugucccuauggugcuuguuggaaauaagugcgaccugccgucucgcaccguggauacaaagcaggcccaggaccucgccagaagcuacggcauucccuucaucgaaaccuccgcuaaaacgcggcagggcgucgaugacgccuuuuauacccuggugcgcgagauuagaaagcauaaagagaagaugucuaaagacgggaagaagaaaaagaaaaagagcaaaacaaagugugugaucauguga

SEQ ID NO: 71295 - RNA, 516 nt, Artificial Sequence
  derived and/or modified sequence opt5 from KRBOX4__Homo_sapiens__NP_001123370
auggccaugagccaggagucccugaccuucaaggacguguuugucgauuucacacucgaagaguggcaacagcuggacucugcucagaaaaaccuuuacagagauguuaugcuggaaaauuauagccaccucguguccgugggcuaccuggucgccaagcccgacgugaucuuucggcuugggccuggagaggaaucuuggauggcggauggcgggacgccgguuagaaccugcgcuggagaggaccgccccgagguguggcaggucgaugaacaaauugaccauuauaaagagagccaggauaagcugccuuggcaggccgccuucaucggcaaagaaacacucaaggacgaguccgggcaggagucucggaccugucgcaagagcauuuaccuguccacagaauuugauagcgugagacaacggcugcccaaauauuacucuugggagaaggcuuucaaaaccuccuuuaagcucagcuggucuaaauggaagcugugcaagaaagaacgcuga

SEQ ID NO: 71296 - RNA, 1377 nt, Artificial Sequence
  derived and/or modified sequence opt5 from KREMEN1__Homo_sapiens__NP_001034659
auggcucccccugccgccagacuggcgcuccugagcgcugccgcccuuacccuggcugcccggccggcucccuccccuggccucgggcccggaccugagugcuucacagccaacggcgcggacuaccgcgggacgcagaauuggaccgcccugcaaggaggcaagcccugucuguuuuggaacgaaacauuccagcacccuuauaauacccuuaaauacccgaacggggagggaggccucggcgaacauaauuauugcagaaaccccgauggggacgugucuccuugguguuacgucgcugagcacgaagauggaguuuauuggaaguacugcgagauccccgccugucagaugccuggcaaucuggggugcuauaaagaccauggaaaucccccgccucugacaggcaccagcaagacauccaacaaacucaccauucagacguguaucucuuuuugccggagccaacgcuucaaguuugcugggauggaguccggauacgccuguuucugcggcaacaaucccgauuacuggaaguauggcgaagcggccucuaccgaguguaacagcgugugcuuuggggaccacacacagccuugcggaggcgaugggagaauuauccuguucgacacccuugugggagcuuguggcgggaauuacuccgccaugagcucugucguguauucccccgauuuucccgacacauacgcuaccggacggguuugcuauuggacgauucgcgugccuggcgccagccauauccacuucucuuuuccgcuguucgauaucagagacuccgccgauauggucgaacuccuggacggcuacacacaccgggugcuugcucgcuuucaugggagaagccggcccccucugucuuucaacguuucccucgacuucgugauucuguacuuuuucagcgaucgcaucaaucaggcgcagggauuugccguccuguaucaagcugugaaagaggagcucccccaggaaagaccugccgugaaccagaccgucgccgagguuauuacagaacaggcuaaccuguccgugucugccgcgcggagcuccaaggugcuuuacgucaucaccaccagccccucucacccgccucaaacagugcccggcuggacgguuuaugggcuggcuacccuccugauucuuacagugaccgccaucgucgccaaaauucugcuccaugugacauucaagucccaccgcguuccugcuagcggagaccugagagauugucaccagcccggcaccucuggggagaucuggagcaucuuuuacaaaccuuccacgucuauuagcaucuucaagaagaaacugaagggccagucccaacaggacgaucggaauccccucgugagcgacuga

SEQ ID NO: 71297 - RNA, 2067 nt, Artificial Sequence
  derived and/or modified sequence opt5 from KRIT1__Homo_sapiens__NP_001013424
augggcaaccccgagaauaucgaagacgccuacguggcugucauuagaccuaagaacaccgccagccucaauucccgggaguaucgcgcgaaaucuuacgaaauccugcugcacgagguuccgauugaagggcagaagaaaaagcggaaaaaggugcuucuggagacaaagcuccaaggaaacagcgagaucacgcagggcauucuggauuauguggucgaaaccacaaaacccaucuccccugcuaaucaggggaucagaggaaagcgcgugguucuuaugaaaaaguucccccuggacggcgagaaaauggggagagaagccucucucuuuauugugccuagcgucgugaaggauaacaccaaguacacauauacccccggaugcccuaucuucuacugucugcaggacauuaugcggguuugcuccgagucuagcacacauuuugccacccugacggcucgcaugcucaucgcccuggauaaauggcuugacgagagacacgcucaaucccauuucauuccggcccuguuucggcccagcccucucgaacgcaucaagaccaaugugauuaaccccgcguaugccacagagucuggccagaccgaaaauucccugcacaugggcuacagcgcucuugagaucaaaucuaagaugcuggcccucgaaaaagcugauacauguaucuacaacccucuguucggguccgaccugcaguauaccaauagagucgauaagguggugauuaaccccuacuuuggacucggcgccccggacuauagcaaaauccagauuccuaagcaagagaaguggcagcggucuauguccagcgucacggaggauaaauacgggaagguugaagcgacacgcauccugcuugagaaaggaaagugcaaucccaaccugcucaauggccagcuguccucuccucuucauuucgccgcugggggaggccacgccgaaauugugcagauccugcucaaccaccccgagaccgacagacauaucacagaucaacagggccggagcccccugaacauuugugaagagaauaaacagaacaauugggaggaagcugccaagcugcucaaggaggccaucaacaaaccuuaugaaaaggugcgcauuuacagaauggacggguccuaucggagcgucgagcugaaacacggaaauaacaccaccgugcaacagaucauggaaggcaugagacuuucucaggagacacagcaauacuuuacgauuuggaucugcuccgagaaucugagccuccagcugaagccguaccauaaaccccuucagcacguucgcgacuggccugaaauccuggcugagcucaccaaccuggauccccagcgggaaacaccucaacuguuccucagacgcgacgugcggcugccccuugaggucgagaagcagauugaagauccgcuggcgauccucauucuguuugacgaggccagauauaaucugcuuaagggguucuacaccgcuccugaugccaaacucaucacacuggccucucugcuccugcagauuguguauggaaacuacgaaagcaagaaacacaagcagggcuuucuuaaugaggaaaaccugaaauccaucguucccgugaccaagcucaagucuaaagcuccucauuggacgaaucgcauucugcacgaguauaagaaccugagcacauccgagggggucagcaaagaaaugcaucaccuucaacggauguuccuccagaauuguugggagauccccaccuacggagccgcguucuuuaccggccagaucuucacaaaggcuucuccuuccaaccauaaagugauucccgucuaugugggcguuaacaucaaggggcugcaucugcucaauauggaaaccaaagcccugcuuauuagccugaaguacggaugcuuuauguggcagcucggcgacacagauacguguuuccaaauccacucuauggagaacaagauguccuuuauugugcacaccaaacaggccgggcuggucgugaagcugcuuaugaaacucaauggacagcugaugccgacagaaagaaacagcuga

SEQ ID NO: 71298 - RNA, 1755 nt, Artificial Sequence
  derived and/or modified sequence opt5 from KRT10__Homo_sapiens__NP_000412
augagcgugagauacuccucuagcaagcacuauuccucuagccgguccggcgggggaggcgggggaggcgggugcggaggcggcgggggagucucuagccugcgcaucuccagcucuaaaggcucccucgggggaggcuucagcucugggggauuuuccggcggcagcuucucuagaggguccagcggaggcggguguuuuggaggcuccucugggggauacggcggccuugggggauucggcgggggaucuuuucggggcuccuaugggagcagcuccuucggcggaagcuacggcgggucuuuuggaggcgggagcuucggaggcggguccuuuggcggaggcucuuucgggggaggcggguuuggaggcgggggcuucggaggcggguuuggaggcggguucggaggcgacgggggccugcugagcggaaacgagaagguuaccaugcagaaucucaacgaucgccuggccuccuaucuugacaaagugagagcucuggaagagagcaauuacgaacucgagggcaagauuaaagaaugguaugagaagcaugggaacucucaccaaggagagccccgggauuacuccaaguacuauaaaacaaucgacgaucugaagaaucagauucugaaccucacgaccgacaaugccaacauccugcuucagauugauaaugcgcgccuggcugccgacgauuucagacucaaauacgaaaacgagguggcccugcggcagagcgucgaagcugacaucaauggccuucgcagagugcuggaugagcucacacugaccaaggccgaccuggagaugcaaaucgaaucucucacagaggaacuggcuuaucuuaaaaagaaccaugaggaagagaugaaggaucugcggaauguuuccaccggggacgugaacgucgagaugaaugccgcgccuggaguggaccucacacagcugcuuaacaacaugcgcagccaguacgaacagcuggccgagcaaaauagaaaagaugcugaagccugguuuaacgagaaguccaaagaacucaccacggagauugacaauaacaucgagcagauuucuagcuauaaguccgaaaucaccgagcugcggcgcaauguucaggcucuggaaauugagcuccagucucaacuggcccuuaaacagagccuggaagcgucccucgccgagacagagggcagauacugcgugcagcugagccaaauccaggcucagauuucugcccuugaggaacagcugcaacagauccgggcugaaaccgagugucagaacacagaguaucagcaacuccuggauaucaagauuagacuggaaaaugagauccagaccuaccgcucccuccuggaaggcgaggggagcucuggaggcgggggacggggcgggggauccuucggcggcggguacggaggcgggagcucuggaggcgggagcuccggaggcggccacgggggaggccaugggggaagcucuggcgggggauauggcggcggguccagcggaggcggguccucuggaggcggguacggaggcggcagcuccucugggggacacggcgggagcuccucuggaggcuaugggggaggcagcuccggcgggggaggcgggggauacggcgggggaagcucuggcggcggguccagcucuggaggcggguauggaggcggguccagcucuggcggacacaaauccagcuccagcggcucugucggggaaagcuccucuaagggaccgagauacuga

SEQ ID NO: 71299 - RNA, 1485 nt, Artificial Sequence
  derived and/or modified sequence opt5 from KRT12__Homo_sapiens__NP_000214
auggaccugagcaacaauaccaugucccucucugugagaacacccggccugagccggcgccuuuccucucagagcgucaucgggagaccucggggaauguccgccucuagcguuggcuccggguacggaggcagcgcuuucggguuuggagccucuugcggcggcggguucuccgcggcuagcauguuuggaucuuccagcggcuucgggggaggcucuggguccagcauggccggaggccugggcgccggguauggacgcgcucucggcgggggauccuuuggcgggcugggaaugggcuucggcgggucuccgggaggcgggagccuuggcauucuguccggaaacgaugggggccuccugagcggaucugagaaggaaacgaugcaaaaucugaacgacagacucgccuccuaccuggauaaagugcgggcucuugaggaagccaauaccgagcuggaaaacaagauccgcgagugguaugagacaagaggcaccgggacagcggacgccagccagucugauuacagcaaauauuacccccucauugaagaccugcggaauaagaucauuuccgcuucuaucggaaacgcccagcuucugcuccagaucgauaaugcucgccuggccgcggaggacuuuagaaugaaauaugaaaacgagcuggcccuccggcaaggcguggaggcugauauuaaugggcugcgcagaguccuugacgaacugacccucacacggaccgaucuggagaugcagaucgaaagccuuaacgaggaacuggccuacaugaagaagaaucacgaggacgagcuccaguccuuccgcgugggaggcccuggggaaguuagcguggagauggaugcugcccccggcgucgaccugacgagacugcucaacgacaugcgggcccaguacgaaaccauugcugagcaaaauagaaaagaugcggaagccugguuuaucgagaagucuggagagcugcgcaaagaaauuuccacaaacaccgagcagcuucagagcucuaaguccgaagugacagaccugcggagagcuuuccagaaccucgagaucgaacugcaaagccagcuugccaugaaaaagucccuggaggauucucucgccgaggcugaaggcgacuauugugcccagcugagccaaguucagcagcugauuuccaaucucgaggcgcagcugcuucaagugcgcgcugaugccgaacggcagaacgucgaccaucagagacugcucaaugugaaggcccgccuggagcuggagaucgaaaccuaccggagacuucucgauggggaggcucagggagacggccuggaagagucucuguuugugacggauagcaaaucccaagcccagagcacagacucuuccaaggauccuaccaaaacacgcaagaucaaaaccgucguucaggaaauggugaacggggagguggucagcucucaggugcaagagauugaggaacucauguga

SEQ ID NO: 71300 - RNA, 1263 nt, Artificial Sequence
  derived and/or modified sequence opt5 from KRT13__Homo_sapiens__NP_002265
augagccugagacuccaguccucuagcgccuccuacggcgggggauucggcgggggaucuugccaacugggcgggggacggggcgugagcaccuguuccacacgcuuugucucuggcgggagcgcuggaggcuaugggggaggcguuuccugcggguucggaggcggcgccgggagcggauuuggcgggggauacggcgggggacuuggcggcggguauggaggcgggcugggaggcggguucggcggaggcuuugcugggggauucguggacuuuggcgcuugugaugggggacuccugacgggcaacgagaagaucaccaugcagaaucuuaacgacagacuggccucuuaccucgaaaaagugcgggcccuggaggaagcuaaugccgaucuggaggucaagauucgcgacuggcaccucaaacagucccccgcuagcccugaaagagauuauucuccguacuauaagacaaucgaggagcugcgggacaaaauucuuaccgccacaaucgaaaacaaucgcgugauucuggagaucgauaacgcgagacucgccgcugacgauuuccggcugaaguacgaaaaugagcuugcccugcgccaguccguugaggcugacaucaacgggcucagacgggugcuggaugaacugacccucagcaagacagaccuggagaugcaaauugaaucucuuaaugaggaacuggccuacaugaaaaagaaccaugaggaggaaaugaaagaguuuuccaaucaggucgugggccagguuaacguggaaauggaugcgacccccggaaucgaccucacgcgcguccuggccgagaugagagaacaguaugaggcuauggccgagcggaaucgcagagacgcugaagagugguuccacgccaagagcgccgaacuuaacaaagagguguccaccaauacagcuaugauucaaaccucuaagacagaaaucaccgagcugcggagaacgcuccagggccuggagauugaacugcagagccagcucuccaugaaggcggggcuggagaacacaguggccgaaaccgagugccgcuacgcgcuucaacugcagcagauccaaggacucauuagcucuaucgaggcccagcuguccgaacuucggagcgagauggaaugucagaaccaggaguauaaaaugcugcucgauaucaagacaagacuggaacaagagauugccaccuaccgcucucugcucgagggccaggacgcuaaaaagcggcagccucccuga

SEQ ID NO: 71301 - RNA, 1419 nt, Artificial Sequence
  derived and/or modified sequence opt5 from KRT14__Homo_sapiens__NP_000517
augaccacaugcagcagacaguucacguccucuagcuccaugaagggcucuugugggaucggaggcgggauuggaggcgggagcucccggaucucuagcgugcuggccggaggcuccugccgcgcucccagcaccuacggcgggggacucucugucuccagcucuagauuuuccagcggcggggccuauggacugggcgggggauacggcggcggguucucuuccagcuccucuagcuuuggauccggcuucgggggaggcuaugggggaggccuuggcgcggggcugggaggcggguuuggaggcggguucgcuggcggagacggccuccugguugggagcgagaaagugacaaugcaaaaccuuaaugaucggcuggccucuuaccucgacaaggugcgcgcccuggaagaggcuaacgccgaucuggaagucaaaauuagagacugguaucagcggcagcgcccugcugagaucaaggauuacuccccguauuuuaaaaccauugaagaccucagaaauaagauccugacagccaccguggauaacgcgaauguucuucugcagaucgacaacgcccggcucgcugccgaugacuuccgcacaaaguacgagaccgagcugaaucuuagaaugagcguggaagcugauauuaacggacugcggcgcguccucgacgagcugacgcuggccagagcggaucucgaaaugcaaaucgagucucugaaagaggaacuugccuaccugaagaaaaaucacgaggaagagaugaacgcucuccggggccagguugggggagacgugaauguggaaauggacgccgcucccggcgucgaucugagccgcauucuuaacgagaugagagaccaguaugagaagauggccgagaaaaaucggaaggaugccgaagaaugguuuuucaccaagacagaggaacugaacagagagguggcuaccaauuccgagcucgugcagucugggaaaagcgaaaucuccgagcugcgccggacaaugcaaaaccuggaaauugagcuccagagccagcugucuaugaaggcgucccuugaaaacagccuggaggagaccaaaggcagauacuguaugcagcucgcccaaauccaggaaaugauuggaucugucgaggaacagcuggcucaacuucgcugcgagauggagcagcagaaucaggaauauaagauccugcucgacguuaaaacgcggcuggagcaagaaaucgccacauacagacgccugcucgagggcgaagaugcccaucuguccagcucccaguuuucuagcgggucccagucuagccgggacgugaccuccagcucuagacagauucgcacaaaggugauggauguccacgacggaaaagugguuuccacccaugagcaagugcuucggaccaagaacuga

SEQ ID NO: 71302 - RNA, 1371 nt, Artificial Sequence
  derived and/or modified sequence opt5 from KRT15__Homo_sapiens__NP_002266
augaccacaacguuccugcagaccagcuccucuacauuuggcgggggaagcaccagaggcgggucccuccuggccggaggcgggggauucggcggcgggucucuuagcggaggcgggggaucccggucuaucagcgcuuccagcgcccgcuuugugucuuccggcagcgggggaggcuacggcgggggaaugagagucugcggcuucgggggaggcgcggggucuguuuuuggaggcggcuucgggggaggcgucgggggaggcuuugggggcggauucggcgggggagacggcgggcugcucuccggaaacgagaagauuacaaugcaaaaucugaacgaucggcuugcuagcuaucuggacaaagugcgcgcccucgaagaggccaaugcugaucuggaagugaagauccacgacugguaccagaaacagacccccacaucuccugagugugauuauucccaguacuuuaagaccauugaagaacugagagacaaaaucauggccacgaccauugauaacagccgggugauccucgagaucgacaaugcucgccuggccgcggaugacuucagacuuaaguaugaaaacgagcuggcccuccggcaaggcguugaagcugauauuaaugggcugcgcagagugcuugacgagcugacacucgcccggaccgaucuggagaugcagaucgaaggccugaacgaggaacucgcuuaccugaagaaaaaucaugaggaagagaugaaggaguuuuccucucagcuugccggacaggucaacguggaaauggacgcggccccgggcguugaccugacacgcgugcucgcugagaugagagaacaauaugaggccauggcugagaaaaaucggcgcgaugucgaggccugguucuuuagcaagaccgaggaacugaacaaagagguggccuccaauacggaaaugauucagacaagcaagaccgagaucacagaccuuagacggaccaugcaggaacuggagauugagcuccagucucaacuguccaugaaggcugggcuggaaaacagccucgcggagaccgaaugcagauacgccacacagcugcagcaaauccagggacuuauuggcgggcuggaggcucagcucucugagcugcgcugugaaauggaggcccagaaucaagaauacaaaaugcuucuggauaucaagacgcggcucgagcaggaaaucgccaccuauagaagccugcuggagggacaggacgcuaaaauggccggcauugggauccgcgaggcguccucuggcggaggcgggagcuccagcaacuuccacauuaacguggaagagucugucgauggacagguuguguccagccauaagcgggaaaucuga

SEQ ID NO: 71303 - RNA, 1422 nt, Artificial Sequence
  derived and/or modified sequence opt5 from KRT16__Homo_sapiens__NP_005548
augaccacaugcagcagacaguucacguccucuagcuccaugaagggcucuugugggaucggaggcgggauuggaggcgggagcucccggaucucuagcgugcuggccggaggcuccugccgcgcucccagcaccuacggcgggggacucucugucuccagcagauuuucuuccggcggggccuguggacugggcgggggauauggcggcggguucagcagcuccagcuccuuuggaucuggcuucgggggaggcuacgggggaggccuuggcgcgggguuuggaggcgggcugggagcuggcuucgggggcggauuugccggcggggacggacuccugguuggcagcgagaaagugacaaugcaaaaccuuaaugaucggcuggccuccuaucucgacaaggugcgcgcucuggaagaggccaacgcugaucuggaagucaaaauuagagacugguaccagcggcagcgcccuagcgagaucaaggauuauucuccguacuucaaaaccauugaagaccucagaaauaagaucaucgccgcgacaauugagaacgcccagcccauccugcaaauugauaaugcucggcuugccgcugacgauuuucgcaccaaguaugagcacgaacuggcccucagacagacaguggaggcggacguuaacgggcugcggcgcgugcuugaugaacugacccucgccagaacggaccuggagaugcagaucgagggacugaaagaagaacucgcuuaccugcggaagaaucaugaagaggaaaugcuugcccugcgcggccagaccgggggcgaugucaacguggagauggacgcugccccuggaguugaccucucccggauucugaaugagaugagagaucaauacgaacagauggccgagaaaaacagacgcgacgcugaaacaugguuccuuagcaagaccgaggaacugaauaaagagguggcgucuaacagcgagcucguccaguccucucggagcgaagugacagagcugagacgcgugcugcagggccucgaaaucgagcugcaaucccagcuuagcaugaaggccucucuggaaaauucccucgaggagaccaaggggcgguauugcaugcagcugagccaaauucagggacuuaucggcucugucgaggagcagcuggcucagcucagaugugaaauggagcaacagucccaggaguaccagauccugcuggauguuaaaacgcgccucgaacaagagauugccacauaucggagacugcuugaaggggaggacgcccaccugagcucccagcaggcuucuggacagagcuacuccucucgcgaaguguuuaccagcuccucuucuuccagcucucggcaaacaagacccauccucaaggagcaguccagcucuagcuucucccagggccagagcucuuga

SEQ ID NO: 71304 - RNA, 1299 nt, Artificial Sequence
  derived and/or modified sequence opt5 from KRT17__Homo_sapiens__NP_000413
augaccacaagcaucagacaguucacguccucuagcuccauuaagggcucuagcgggcugggaggcggguccucucggaccagcugccgccucuccggaggccugggggccggaagcuguagacuuggcucugcuggcgggcugggauccacacucggcgggagcucuuacuccagcugcuauucuuuuggauccggcgggggauacggcagcuccuucggcgggguggacggacugcuugccggcggggagaaagcgaccaugcaaaaccugaaugaucggcucgcuucuuaucuggacaagguccgcgcccuggaagaggccaacacagaacucgagguuaaaaucagagauugguaccagcggcaggcucccggaccugcccgcgacuauagccaguacuauagaaccauugaagaacugcaaaauaagauccuuacagcuaccguggauaacgccaauauucugcuccagaucgacaacgcgcggcuggccgcugaugacuuucgcacgaaauucgagaccgaacaggcccuuagacuguccguggaggcugauaucaauggccuccggcgcguccuggacgaacugacacucgccagagcggaucuggagaugcagauugagaaccuuaaggaggagcuggccuaccucaagaaaaaucacgaagaggaaaugaacgcucugcgggggcaagugggaggcgagaucaauguugagauggacgccgcuccgggcguggaucuuagccgcauucugaacgaaaugagagaccaguacgagaagauggccgagaaaaaucggaaggacgccgaggauugguuuuucucuaaaaccgaggaacucaacagagaggucgcuacaaauuccgaacuggugcagagcgggaagucugagaucagcgaacugcgccggaccaugcaggcgcucgagauugaacugcaaucccagcuuucuaugaaggccagccuggagggaaaccucgcugagacggaaaacagauauuguguucagcugucccaaauccagggccuuauugggagcguggaggaacagcuggcccagcuccgcugcgagauggagcaacagaaucaggaauacaaaauccugcuggacgucaagacacggcucgagcaggaaaucgccaccuauagacgccugcuugagggagaagaugcucaucugacacaauacaaaaaggagcccgugaccaccagacaggugcggacaauugucgaggaaguucaggacggcaaagugaucucuucccgcgaacaggugcaccaaacgacccgguga

SEQ ID NO: 71305 - RNA, 1293 nt, Artificial Sequence
  derived and/or modified sequence opt5 from KRT18__Homo_sapiens__NP_000215
augagcuucaccacaagauccacguuuucuaccaacuaccggagccugggcuccgugcaggcccccucuuauggggcucgcccugucagcuccgccgcgucuguuuacgcuggagccggcgggagcggauccagaaucagcgugucucgguccaccagcuuccgcggcgggaugggaucuggcggccucgccacagggauugcuggaggccuggccgggaugggaggcauccaaaaugagaaggaaacaaugcagucccuuaacgacagacuggcuagcuaucucgaucgggugcgcucucuggagaccgaaaauagacggcuugaguccaaaauucgcgaacaccuggagaagaaagggccgcaggucagagacuggagccauuacuuuaagaucauugaggaucuccgggcccagaucuucgcgaacacaguggacaaugcccgcaucguucugcaaauugauaacgcuagacuggccgcugacgauuuucgggugaaauaugaaaccgagcucgccaugcgccaguccgucgaaaaugacauccacggacugagaaaggugauugaugacacgaacaucacccggcuucagcuggagacagagauugaagcgcucaaggaggaacugcuuuucaugaaaaagaaucaugaggaagagguuaaaggccugcaggcccaaaucgcuucuagcggccucaccguggaggucgaugcccccaagucccaggaccuggcuaaaauuauggccgauaucagagcccaguacgacgaacuggcucgcaagaaccgggaggaacucgacaaguauuggagccagcaaaucgaggaaucuacaaccguggugacgacacaguccgcggaggucggggccgcugagaccacacugaccgaacuuagacgcaccguucagagccuggagauugaucucgacucuaugcggaaucugaaagccagccuugaaaacucccugagagagguggaagcccgcuacgcucuccaaauggagcagcugaauggaauccugcuccaccuggagucugaacuugcccagacacgggcggagggccagagacaagcucaggaauacgaggcccugcucaacauuaaggugaaacuggaggccgaaaucgcuacguaucgccggcuucuggaggauggggaagacuuuaaucucggagaugcccuggacagcuccaacagcaugcagaccauucagaagacaaccacaagacgcaucgucgauggcaaagugguuucugagaccaacgacacgaaggugcugcggcauuga

SEQ ID NO: 71306 - RNA, 1203 nt, Artificial Sequence
  derived and/or modified sequence opt5 from KRT19__Homo_sapiens__NP_002267
augaccagcuacuccuauagacagucuagcgccacauccucuuucggcgggcugggaggcgggagcgugcgguuuggacccggcgucgcuuuccgcgccccuuccauccacgggggaucuggcggcagagggguuagcguguccagcgcgcgguuugugucuuccucuagcuccggagcuuacggcgggggauauggcgggguccucacggccagcgacggacugcuugccggcaacgagaagcugaccaugcaaaaucucaacgaucgccuggcuucuuaccuugacaaagugagagcccuggaagcugccaauggcgagcucgaaguuaagauucgggauugguaucagaaacaggggccgggacccucccgcgacuacagccauuauuacacaaccauccaggaucugagagacaagauucugggcgcgacaaucgagaacucccggauugugcuccaaaucgauaaugcccgccuggcugccgacgauuucagaaccaaauuugaaacagagcaggcccuucggaugucugucgaggcugacaucaacgggcugcgcagagugcucgaugaacugacccuugcgcggacggaccuggagaugcagauugaaggacucaaggaggagcuggccuaccugaagaaaaaucacgaagaggaaaucagcacccuccgcggccagguugggggacaaguguccgucgagguggauagcgcuccuggcacagaccuggccaagauucuuucugacaugagaucccaguaugaagugauggcugagcagaaccggaaagaugccgaggccugguucaccagcagaacagaggaacugaaucgcgaagucgcuggccauaccgagcagcuccaaaugucucggagcgaaguuacggaccugagacgcacacuucaggggcuggagaucgagcuccagucccaacugucuaugaaggcggcccuggaagauacccucgcugagacagaagcccgguuuggagcccagcuggcucacauucaggcccuuaucagcggcauugaggcgcagcugggggacgugagagcugauuccgaacgccaaaaccaggaguaccagcggcucauggacaucaaaagcagacuggagcaggaaaucgccaccuaucgcucucuucuggagggacaagaagaucauuacaauaaccucuccgccagcaaggugcuguga

SEQ ID NO: 71307 - RNA, 1935 nt, Artificial Sequence
  derived and/or modified sequence opt5 from KRT1__Homo_sapiens__NP_006112
augagcagacaguucuccucucggagcggcuaccgcuccgggggaggcuuuucuagcggguccgccggaaucauuaacuaucaaagacggaccacaucuagcuccacgcgcagaagcggcgggggaggcggccgguucucuuccugcgggggaggcgggggcagcuuuggcgcugggggaggcuucggcucucgcucccuggugaaucucgggggaagcaagucuaucuccauuagcgucgccagaggcgggggacggggcuccggguuuggaggcggcuacgggggaggcggguucggaggcgggggcuuuggaggcgggggauucggcgggggaggcaucgggggcggaggcuuugggggauucggcucugggggaggcggguuuggcggaggcggguucggaggcgggggauauggcgggggcuacggacccguuuguccuccgggcgggauucaggaggugaccaucaaccagagccugcuucagccccugaauguggaaaucgacccugagauucaaaaagucaagucccgcgaaagagagcagaucaaaagccucaacaaucaguuugcgucuuucauugauaaggugcgguuccuggaacagcaaaaccagguucuucagacaaaaugggagcugcuccagcaaguggacaccuccacacgcacccacaaucuggagcccuauuuugagagcuucaucaacaaucugagacggcgcgucgaucagcucaagucugaccagagcagacuggauuccgagcuuaagaacaugcaagacaugguggaagauuaccggaauaaauaugaggacgagauuaacaagagaacaaaugcugaaaacgaguuuguuaccaucaaaaaggauguggacggagccuacaugacgaaagucgaucugcaggccaagcucgacaaucugcagcaggaaauugauuuccuuaccgcucuguaccaagccgagcucucucagaugcagacacagaucagcgaaaccaacgugauccuguccauggacaacaaucgcagccuggaccucgauucuauuaucgcugaggugaaggcccaauaugaggacauugcgcagaaauccaaggccgaagcugagagccuguaccagucuaaauaugaagaacuucagaucacagccggccggcauggggauuccgucagaaacagcaagauugaaaucuccgagcugaaucgcguuauccaacggcucagaucugagauugacaacgugaaaaagcagaucagcaaucugcagcaguccauuucugaugcugaacaacgcggagagaacgcccuuaaagacgcgaagaauaagcugaacgaucucgaagacgcccugcagcaggcuaaagaggaucuggcccggcuccugagagacuaccaagaacuuaugaauaccaagcuggcucucgaucuggagaucgccacguaucgcacacuucuggagggcgaagagagccggauguccggcgaaugcgccccuaacgugagcgucucuguguccaccagccacacaaccauuucugggggaggcuccagagggggaggcgggggaggcuacggcagcgggggaucuagcuauggcuccgggggaggcagcuacgggucuggaggcggcgggggaggcgggcgcggauccuacggcagcgggggauccucuuauggcagcggcgggggauccuacggcucugggggaggcgggggaggccauggcagcuauggguccggaucuagcuccggcggguaccggggaggcagcgggggaggcggcgggggaucuuccggcgggagaggaagcggcgggggaucuuccggcggcagcaucgggggacggggaucuuccagcgggggaguuaaauccagcggcgggucuagcuccgugaaguuugucucuaccacauauagcggcgugacgcgcuga

SEQ ID NO: 71308 - RNA, 1275 nt, Artificial Sequence
  derived and/or modified sequence opt5 from KRT20__Homo_sapiens__NP_061883
auggacuucagcagacgguccuuucaccgcucucugagcuccucucuccaggcccccguggucagcaccguuggcaugcaaagacuggggacaacgccuuccguguacggaggcgcugggggacggggcauccgcauuucuaacagcagacauaccgugaauuauggguccgaucuuacaggaggcggcgaccuguucgucgggaacgagaagauggccaugcagaaucucaacgaucggcuggcgagcuaccuugaaaaagugcgcacccuggagcagucuaauuccaagcucgaaguucagaucaaacaaugguaugagacaaacgcuccgagagccggacgggacuacagcgccuauuaccgccagauugaagaacugagaucucagaucaaggaugcucagcugcaaaaugcccggugcgugcuccagauugacaacgcuaaacuggccgcggaggauuuucgccuuaaguaugaaaccgagagaggcauccggcugacagucgaagccgaccuccaggggcugaauaagguguucgaugaccuuacccugcacaaaacggaucucgagauccagauugaggaacugaacaaggaccuggcucuccugaaaaaggagcaucaagaagagguugauggacuucacaaacaucugggcaauaccgugaacgucgaaguggacgccgcucccgggcucaaucugggagugaucaugaacgagaugcgccagaaguacgaggucauggcccagaagaaucuucaagaagcgaaagagcaguuugaaagacagacagccguucugcagcaacaggugaccgugaacacagaggaacucaagggcaccgagguccagcugacggagcugcggagaacaucccagagccucgaaauugagcugcaaucucaccuuuccaugaaagaaagccuggagcacacccucgaagagacaaaggcucgcuacuccucucagcuggccaaccuucagagccugcucuccagccuggaggcucagcugaugcaaauccggucuaauauggaaagacagaacaaugaguaucauauucuccuggacaucaaaacccgccuugaacaggagauugccaccuaccggagacugcucgagggcgaagaugugaagacaacggaguaucagcuguccacccuggaggagcgcgacaucaaaaagacacggaagaucaaaaccguugugcaagaagucguggaugggaagguugugagcucugaggucaaagagguggaagagaacauuuga

SEQ ID NO: 71309 - RNA, 1269 nt, Artificial Sequence
  derived and/or modified sequence opt5 from KRT23__Homo_sapiens__NP_056330
augaacagcggccacuccuucucucagacccccagcgccuccuuucauggggcuggaggcggguggggaagaccucggucuuucccgcgcgcccccacagugcacggcggggcgggaggcgcuagaaucagccuguccuuuacgacccggucuugcccucccccuggcgggagcuggggauccggccgcagcucuccccuccuugggggaaauggcaaggccacaaugcaaaaccuuaaugacagacuggccuccuaccucgagaaaguccgggcucuggaagaggccaacaugaagcuggaaagccgcauucugaaauggcaucagcagagagauccugggucuaagaaagacuauucccaguacgaggaaaauaucacccaccuccaagagcagauuguugauggaaagaugacaaacgcucagaucauucugcugaucgacaaugcccggauggcgguggaugacuucaaccucaaguaugagaaugaacauagcuuuaaaaaggaucuggagaucgaaguggagggccuucgcagaacccuggacaaccucacaauugucaccacggaucuggagcaggaaguggagggcaugcggaaagaacuuauccugaugaagaaacaccacgagcaagaaauggagaagcaucacguuccgucugacuucaaugugaacgucaagguggauaccgggccccgcgaggaccucauuaaaguucuggaagauaugagacaggaguacgaacugaucauuaagaaaaagcaucgggaccucgacacaugguauaaagagcaguccgccgcuaugagccaggaagccgcuuccccugccaccgugcaaucucgccagggagauauccacgagcugaagagaacauuucaggcgcuugagauugaccugcaaacccaguacagcacgaaauccgcccucgaaaauaugcugagcgagacacagucucgguauuccuguaaacuucaggauaugcaagaaaucaucagccacuacgaggaggaacugacccagcucagacaugagcuggaacgccagaacaaugaguaccagguccugcucggcauuaagacacaccuggaaaaggagaucaccaccuaucggagacuucuggagggggaaucugagggaacacgcgaagagagcaaguccucuaugaaagugagcgcuacgcccaagauuaaagccaucacccaagaaacaauuaacggccggcucgugcugugccaggucaacgagauccagaagcaugcuuga

SEQ ID NO: 71310 - RNA, 1920 nt, Artificial Sequence
  derived and/or modified sequence opt5 from KRT2__Homo_sapiens__NP_000414
augagcugccagaucuccuguaagucuagaggccggggcggaggcgggggaggcuuccgcggguuuagcuccggaucugccguggucagcggcggcuccagacggucuaccagcuccuucagcugccugucucgccacgggggaggcgggggaggcuuugggggaggcggcuucggguccagaagccucguuggacugggcgggacaaaaucuauuuccaucagcguggcuggaggcgggggaggcuuuggcgccgcugggggauucggcgggcggggaggcggguuuggcggagggucuuccuucgggggaggcagcggguuuuccggaggcggguucggcggaggcggguuuggaggcgggcgcuucggaggcuuugggggccccggaggcgucgggggacuuggcgggccuggaggcuucgggccgggcggauaccccggcgggauucaugaggugucugugaaccaaagccugcuccagccucugaauguuaagguggaccccgaaauccagaacgucaaagcucaggagagagaacaaauuaagacgcuuaauaacaaauucgccuccuuuaucgauaaggugcgguuccuggagcagcagaaucagguucuccaaaccaagugggaacugcugcagcagaugaacgugggaacacgcccuaucaaucucgagcccauuuuucagggcuauaucgacagccugaaaagauaccuugaugggcugaccgccgagcggacaucucaaaacuccgaacucaauaacaugcaggaccuggucgaggauuauaagaaaaaguacgaagacgagauuaauaaacgcaccgcugccgagaacgauuucgugacacuuaagaaggacguggauaaugcuuauaugaucaaagucgaacugcagagcaagguugaccuccugaaccaagagauugaauuucugaaagugcucuacgaugccgagaucucucagauucaccagagcgugaccgacacgaaugucauccuguccauggauaacucuagaaaccuugaccuggacagcaucauugcggaagugaaggcccaguaugaggagaucgcucaacgguccaaagaagaggccgaagcucucuaccauagcaaguacgaggaacugcagguuaccgugggacgccacggcgauucucuuaaagagauuaagaucgagauuuccgaacugaauagagucauccagcggcuccagggcgagaucgcccaugugaagaaacaauguaagaacguucaggacgcgauugccgaugcugaacagagaggggagcacgcccugaaagacgcucgcaauaagcugaacgaucucgaagaggcccugcagcaagccaaagaggaccuugcucggcugcucagagauuaucaggaacugaugaaugugaaacuugcgcuggacgucgagaucgccacauaccgcaagcuccuggaaggagaggagugccggaugagcggcgaucugucuuccaacgugaccgucagcgugacauccucuaccauuagcuccaauguugcuucuaaggccgccuucgggggaagcggcgggagaggauccagcucuggcggcggguauuccagcggaucuuccagcuacggcucugggggacgccagagcggcuccagagggggaagcggcggcgggggaucuaucuccggcgggggauauggcagcgggggaggcuccggcgggcgguacggaucuggcgggggaagcaagggcggguccauuucuggaggcggcuaugggagcggaggcgggaaacacuccucuggaggcgggagccgcggaggcuccagcucuggcgggggauacggcuccgggggaggcgggucuagcuccgugaagggaagcucuggcgaagcguuuggcuccagcgucacguucuccuuucgguga

SEQ ID NO: 71311 - RNA, 1251 nt, Artificial Sequence
  derived and/or modified sequence opt5 from KRT31__Homo_sapiens__NP_002268
augcccuacaacuucugccugccuagccucuccuguagaaccucuugcagcucccggccgugugugcccccuucuugccacagcuguacacugcccggcgccugcaauaucccugcuaacgucuccaauuguaacugguuuugcgaggggucuuucaauggaagcgaaaaggagacgaugcaguuucuuaacgaccgccuggccuccuaucucgaaaaaguuagacaacuggagcgggauaaugcggaacuugagaaccugauucgcgagagaagccagcagcaggaaccccuccuguguccuucuuaccaauccuauuucaagaccaucgaggaacugcagcagaaaauucucugcacaaagagcgagaaugcucggcugguggugcagaucgacaacgccaaacuugccgcugaugacuuucgcaccaaguaccaaacagagcugucucucagacagcuggucgaauccgauauuaauggccuucggcgcauccuggacgagcucacccuguguaagagcgaucuggaagcccagguggagucucucaaagaagaacugcuuugccugaaguccaaccaugagcaggaaguuaauacacucagaugccaacugggggaccggcuuaacguggaggucgaugcugccccgaccguggaccugaaucgcguucucaacgaaacgagaagccaguaugaggcgcugguggaaaccaaccggcgcgaggucgagcagugguucacaacccaaacagaggagcugaauaaacaggugguguccucuagcgaacagcuccaguccuaccaagccgagaucauugaacugagacggaccgucaacgcucuugagaucgagcugcaggcccagcacaaucucagagauagccuggaaaacacgcuuacagagucugaagcucgcuauuccagccagcugucucaaguucagagccucauuaccaauguggagucccagcuggccgagauccggucugaccuggaaagacagaaccaagaguaccaggugcuccuggauguccgcgcgcggcuugaaugugagauuaauacauacagaagccugcucgaauccgaggacugcaaccugcccagcaauccuugugccaccaccaacgcuugcucuaagcccaucggaccuugucuguccaaucccugcacaagcugugugccgccugcccccugcacgccuugugcuccccgcccccggugcggcccuuguaacucuuuuguuagauga

SEQ ID NO: 71312 - RNA, 1347 nt, Artificial Sequence
  derived and/or modified sequence opt5 from KRT32__Homo_sapiens__NP_002269
augaccagcuccugcugugugacaaacaaucugcaggccucucucaagagcugccccagaccugcuuccgucuguucuagcggcguuaacugccggccggagcugugucuuggguacgugugccaacccauggccugucugccuuccgugugccuccccacgaccuuccgcccugcgucuugucugagcaaaacauaucuuuccagcucuugccaggcugccuccggaaucagcggcucuauggggcccggauccugguacagcgaaggcgccuuuaaugggaacgagaaggaaaccaugcaguuccugaaugacagacucgcuucuuaucugacacggguccgccagcuggagcaagaaaacgccgagcucgagucccggauucaggaagcuagccacucccaggugcugaccaugacaccugauuaccagucucauuuuagaaccaucgaggaacuucaacagaaaauucuguguacgaaggccgagaaugcgcgcaugguugugaacaucgacaaugccaaacucgcugccgaugacuucagagcuaaguaugaggccgaacuggcgaugcggcagcuugucgaggccgauauuaacggacugcgcagaauccucgacgaucugacccugugcaaggcugaccucgaagcccagguggagagccugaaagaagaacuuaugugccugaagaaaaaucacgaggaagagguuggcucccuccggugucaacugggcgaucgccuuaacaucgaaguggacgcugccccgcccgucgaucugacaagagugcucgaggaaaugcggugccaguacgaggccaugguggaggcuaaucgcagagacgucgaagagugguuuaacaugcagauggaggagcugaaucaacagguugcgaccagcucugaacagcugcagaacuaucaauccgauauuaucgaccuccggagaacagugaacacccuggagauugagcuucaggcccagcauagccugcgcgacucucucgaaaauacgcugacagagagcgaagcucgguacuccucucagcuugcccaaaugcaguguaugaucaccaacguggaggcccagcuggcugagauuagagccgaucucgaacgccagaaucaagaguaccagguccugcuggacgugcgggcgagacucgaaggggagaucaacacauaucgcagccugcuugaaaaugaggauugcaagcugccuuguaaccccugcuccaccccuagcuguaccacaugcguucccucuccgugugugccucggacggucugcgugcccagaaccguuggaaugccuuguucccccugcccccagggccgcuacuga

SEQ ID NO: 71313 - RNA, 1311 nt, Artificial Sequence
  derived and/or modified sequence opt5 from KRT34__Homo_sapiens__NP_066293
augcuguacgccaagcccccuccgaccaucaacggcauuaaagggcuccagagaaaggagcggcugaaacccgcucacauccaucuucaacagcugacaugcuucagcauuacguguuccucuaccaugagcuauuccugcugucucccuucucugggaugccgcacaagcuguuccucuagacccugcgugccucccagcugucacggcuacacccuuccuggggccugcaauaucccggcgaacgucuccaauuguaacugguuuugcgaaggcagcuucaauggaucugagaaggaaacaaugcaguuucugaacgaccggcucgcuuccuaucuggagaaaguucgccagcuggaaagagauaaugccgagcucgagaagcugauucaagaacggagccagcagcaggagccccuucuguguccuucuuaccaauccuauuucaagaccaucgaagaacuccagcagaaaauccugugcgccaaggcugagaacgcccgccuuguggugaauauugacaacgcuaaacuggccagcgaugacuuuagaucuaaguaccagacagaacaaucccuccggcugcuggucgagagcgauaucaauuccauucgcagaauccucgacgaacugacccuuugcaaaucugaucuggagagccagguggaaucccuccgggaggagcugauuugucuuaagaagaaccaugaagaggaaguuaauacgcugcgcagccagcucggggacagacugaacguggaggucgauaccgcgcccacaguggaccugaaucaaguucucaacgaaacccggucucaguaugaggcccugguggagaucaaccgcagagaagucgagcagugguucgcuacacagaccgaggagcuuaauaaacaagugguguccagcucugaacagcugcagagcugccaggccgagauuaucgagcuccggagaacggucaacgcucuggaaaucgagcuucaagcccagcacaaucugcgcgauucccucgaaaacacacugaccgagucugaggcgcauuacagcucccagcugagccagguucaaucucucauuacaaauguggaaucccagcuggccgagauccggugugaccuugaaagacagaaccaggaguaccaagugcugcucgauguccgcgcucggcuggaaugcgagauuaauaccuauagaagccugcuugagucugaagacuguaagcucccuugcaaccccugugccaccacaaaugcuuccggaaacagcugcggcccguguggcacgucccagaaagggugcuguaauuga

SEQ ID NO: 71314 - RNA, 1368 nt, Artificial Sequence
  derived and/or modified sequence opt5 from KRT35__Homo_sapiens__NP_002271
auggccagcaagugccugaaagcuggcuucuccucugggagccucaagucccccggaggcgccucugggggaagcaccagaguguccgcgauguacucuagcuccagcuguaaacugccuucucuuuccccggucgcucggagcuuuucugccugcuccguuggccuggggcgcagcucuuauagagccacauccugucuccccgcucugugccuuccugccggaggcuucgcuacgagcuacuccggcgggggaggcugguuuggggagggaauccugaccggcaacgaaaaggagacaaugcagucucucaaugaccggcuggccggguaucuggaaaaagugcgccaacucgagcaggaaaacgcgagccuggagucccggauuagagaguggugugaacaacaggugcccuacaugugcccugauuaucagagcuacuuccgcaccaucgaggaacuucagaagaagacacuguguucuaaagccgagaaugcuagacucgucguggagauugacaacgccaagcuggcugccgaugacuuucggaccaaauaugaaacagagguuucccuucgccagcugguggaaagcgauaucaauggacucagacggauucuggacgaucugacccucugcaagucugaccuggaggcgcaggucgaaagccuuaaagaggagcugcucugucugaagaagaaccacgaagaggaaguuaauucccuucgcugccaacugggcgauagacucaacguggagguggacgccgcucccccugucgaucugaaucgggugcuggaagagaugcgcugucaguacgagacgcucguggaaaacaauagacgggacgccgaggauuggcuggacacccagucugaggaacuuaaccagcaagucguuagcuccagcgaacagcugcagucuugccaagcugagaucaucgagcucagacgcacagugaaugcccuggaaauugagcuucaggcccagcauuccaugcgggacgcucuggaaagcacccucgcggagacagaggccagauacucuucccagcuggcucaaaugcagugcaugaucaccaacguggaagcccagcuggccgagauucgcgcugaucucgaacggcagaaucaagaguaucagguccugcuugacgugagagcccgccuggaaugugagaucaacacguaccggggccuccuggagagcgaagauuccaaacugccgugcaaccccugugcgccugacuauucucccagcaaguccugccuuccuugucuccccgcugccucuugcgggccgagcgccgcuagaacaaauuguuccccucgccccauuugcguuccuugucccggaggccgguucuga

SEQ ID NO: 71315 - RNA, 1887 nt, Artificial Sequence
  derived and/or modified sequence opt5 from KRT3__Homo_sapiens__NP_476429
augagcagacaggccuccaagaccucuggcgggggaagccaaggcuucuccgggcggucugcuguggucagcggauccucucgcaugagcugcguugcccacuccggcggggcgggaggcggcgcuuacggguuuagaagcggagccggcggguucggaucucggucccuguauaaccucggcgggaauaaaagcaucucuauuuccguggccgcuggaggcagccgcgccggcggguuuggaggcgggagaucuuccugugcuuucgccggaggcuacgggggaggcuuuggcagcggguauggaggcggguucggaggcggguuuggcggaggccgggggaugggaggcggguucggaggcgcgggcggguuuggaggcgccgggggauucggcggggcuggaggcuuugggggccccggaggcuucgggggauccggcggguuuggaggcccugggucucugggcagcccgggaggcuucgggcccggaggcuucccugggggaauccaggaggugacaauuaaccagucccuucugcagccccucaaugucgaaaucgacccucaaauuggccaggugaaggcccaggagcgcgaacagaucaaaacgcugaacaauaaguuugcuagcuucaucgauaaaguuagauuucuugagcaacagaacaaggugcuggaaaccaaguggaaucuccugcagcagcaaggcacaucuuccauuagcgggaccaacaaucuggagccccucuucgagaaccauaucaauuaccugcggucuuaucuugacaacauucugggagaacgcggcagacucgauagcgagcugaaaaauauggaagaccuugucgaggauuuuaagaaaaaguacgaggacgaaaucaacaaacggacagccgcggagaaugaguucgugacccugaagaaggauguugacuccgccuauaugaacaaaguggaacuccaggcuaaggucgaugcccugauugacgaaaucgauuuucugcgcacacucuacgacgcugagcugucucagaugcaaagccacauuuccgauaccagcguggugcuuucuauggacaacaauagaucccuggaccucgauagcaucaucgccgagguccgggcccaguacgaagacauugcucagcgcucuaaagcggaggccgaagcucuguaucagacgaaacuuggggagcugcaaaccacagccggaagacauggcgaugaccuccggaacaccaaguccgaaaucauugagcugaauagaaugauccagcgccugcgggccgagauugaagggguuaagaaacagaacgcuaaucuccagacagccaucgcggaggcugaacaacacggagagauggcccugaaggaugccaacgcuaaacuucaggaacugcaggccgcucuccagcaagccaaggacgaucuggcgagacuucugcgcgacuaccaggagcucaugaaugugaagcuggcccuggauguggagaucgcuaccuaucggaaacuccuggaaggcgaggaauacagaaugagcggcgagugcccuuccgccgucucuauuagcgugguuuccucuagcacgacauccgcuagcgccgggggauauggcgggggauacggcgggggaaugggcggcgggcuuggaggcggguucucugcgggaggcggguccggaagcggcuuuggccgcgggggaggcgggggaaucggcgggggauucggcggcgggucuuccggauuuagcggcgggucuggauucggcagcauuuccggggcccgguauggagugagcggcggcggguuuucuuccgcuagcaacagaggaggcuccaucaaguucucucagagcucccagucuagccaacgcuacucccgguga

SEQ ID NO: 71316 - RNA, 1563 nt, Artificial Sequence
  derived and/or modified sequence opt5 from KRT4__Homo_sapiens__NP_002263
augaucgccagacagcaaugcgugcggggcgggccccgcggauucagcuguggcuccgcuauugucgggggaggcaagagaggggccuuuucuagcguuuccaugucuggaggcgcgggccggugcagcuccgggggauucggcucucgcagccuguacaaccucagagggaauaaauccaucagcaugucuguggcuggaucccggcagggcgccuguuuugggggagccggcggcuucgggaccggaggcuuugggggaggcuucgggggaucuuuuucuggcaagggcgggccuggauucccggugugccccgcuggcgggauucaggaggucacaaucaaccagucccugcuuacgccucugcacguggaaauugaccccgagauccaaaaaguucgcaccgaagagagagaacagaucaagcuccugaauaacaaauuugccagcuucauugauaaggugcaguuucuugagcagcaaaauaagguccuggagacaaaauggaaccuccugcagcagcagaccacaaccacaucuuccaagaaucuggaaccucucuucgagaccuaucugagcgugcuucggaaacaacuggacacgcucggaaacgauaagggccgccugcaguccgaacuuaaaaccaugcaggacucuguugaggauuuuaagacaaaguacgaggaagagaucaauaaaagaaccgcugccgaaaacgacuucgugguccugaagaaagauguggacgcggccuaucucaauaagguggagcuggaagcuaaagucgauagccugaacgacgagauuaauuuccucaagguucuguacgaugccgagcuuucccaaaugcagacacaugugagcgacaccucugugguccuguccauggauaacaaucggaaccucgaccuggacagcaucauugcugaagugcgcgcccaguaugaggaaaucgcgcagagaucuaaagccgaggcugaagcccuuuaccaaacgaagguucagcagcugcagauuagcguggaucaacacggggacaaccucaagaauacaaaauccgagaucgcugagcugaaccggaugauccagcgccugagagccgaaauugagaauaucaagaaacagugucagacccuccaagucucuguggccgaugcugaacagcggggcgagaacgcgcugaaggacgcccauagcaaaagaguugaacuugaggcugcccugcagcaggccaaggaggaacucgcucgcaugcugcgggaguaucaagaacuuauguccgugaagcuggcccucgauauugagaucgcgacauacagaaaacugcuggagggagaagaguaccgcaugagcggcgaaugccagucugcugucuccauuagcguggucucuggguccaccagcaccggaggcaucuccgggggacucggcucugggagcggcuuuggacuguccucuggcuucgggagcggauccggcagcggguuuggauucggcgggucuguguccggcagcagcuccagcaagaucauuucuacaacgacccuuaauaaacggagauga

SEQ ID NO: 71317 - RNA, 1773 nt, Artificial Sequence
  derived and/or modified sequence opt5 from KRT5__Homo_sapiens__NP_000415
augagcagacaguccucugugagcuuccgguccggcgggucucgcagcuuuuccaccgccucugcuaucacacccagcgucuccagaacgagcuucaccucuguuucccggagcggaggcgggggaggcgggggauuuggccgcgugucucuggccggcgcgugcggggugggaggcuacggguccagaagccucuauaaccugggaggcucuaagcggauuuccaucagcacauccgggggaucuuuccgcaauagauuuggcgcuggcgccgggggaggcuacggguucggaggcggggccggaagcggcuuuggcuucgggggaggcgcugggggaggcuuugggcuuggcggaggcgccggguucggaggcggguuuggaggcccuggguucccggucugucccccuggcgggauucaagaggugaccguuaaccagucccugcucacaccccugaaucuucagaucgacccuagcauucagcgggugcgcaccgaagagagagaacaaaucaaaacacugaacaauaaguuugcuucuuucaucgauaaaguccgguuccucgagcagcagaacaaggugcuggacaccaaauggacgcugcuccaggaacaaggcaccaagacaguucgccagaaucuggagccccuuuuugagcaguauauuaacaaucugagacggcagcucgauuccaucgugggggaacgcggaagacuggacagcgagcuucggaacaugcaagaucuggucgaagacuucaagaauaaauacgaggaugagauuaacaagagaaccacagccgaaaaugaguuugugaugcucaaaaaggacguggaugcggccuauaugaacaaagucgaacuggaggcuaagguugacgcccugauggaugaaaucaauuucaugaagauguuuuucgacgcugagcucucucagaugcagacccacgugagcgauacguccgugguccugucuauggacaacaaccgcaaucuugaccuggauagcauuaucgccgaggugaaagcgcaauacgaagagauugccaaccgguccagaacagaagcugagagcugguaucagaccaaguacgaggaacuccagcagacagccggccgccauggggacgaucugcggaauaccaaacacgagaucucugaaaugaacagaaugauccaacgccuucgggcugagauugacaauguuaagaaacagugcgccaaccugcagaaugccaucgcugaugcggaacagagaggagagcucgcccugaaggacgcucgcaacaaacuggccgaacucgaggaggcccugcaaaaggcuaagcaggauauggcccggcuucugagagaauaccaggagcucaugaauaccaaacuggcgcuugacguggaaauugcuacauaucgcaagcugcucgagggcgaggaaugucggcuguccggggagggcgucggaccugugaacaucagcguugugacgucuuccgucagcuccggcuacgggucuggaagcggcuaugggggaggccugggaggcggacucggcgggggacugggcgggggacuugccggcggcuccucugggagcuacuauuccagcagcuccggaggcguggggcugggaggcgggcucagcgucggaggcucuggcuuuuccgccagcucugggagaggacugggcgugggguucggaagcggcgggggauccucuucuuccguuaaauuugugagcaccacauccucuagccggaaguccuucaaaucuuga

SEQ ID NO: 71318 - RNA, 1695 nt, Artificial Sequence
  derived and/or modified sequence opt5 from KRT6A__Homo_sapiens__NP_005545
auggccagcaccuccacaacgaucagaucucacagcuccucucggcgcggcuucagcgcuaacuccgccagacugcccggggugucucggagcggauuuuccagcgugucuguuucccgcagcagaggcucugggggacucggcggggcgugcggaggcgcuggcuucgggucccggagccuguacggacuuggcgggucuaagcgcauuuccaucggaggcgggagcugugccauuuccggaggcuauggcucuagagccgggggaagcuacggcuuugggggagcuggcuccggguucggauuuggcggcggggccggaaucggcuucgggcugggaggcggggcuggccucgccggaggcuuugggggaccuggcuucccggugugucccccugggggcauucaggaggugaccgucaaucaaagccugcuuacaccccugaaccuccagaucgacccuaccauccagcgggugcgcgcggaagagagagaacagauuaaaacacugaauaacaaguuugccucuuucaucgauaaaguucgguuucuggagcaacagaauaaggugcucgaaaccaaauggacacugcuucaggagcagggcaccaagacgguccgccaaaaccuggagccccucuucgaacaguauauuaauaaccugagacggcagcuugacuccaucgugggggagcgcggcagacuggauagcgaacuccggggaaugcaggaccugguugaggauuuuaagaauaaauacgaggacgaaauuaacaagagaaccgcugccgagaaugaguucgugacacugaaaaaggaugucgacgcugccuauaugaacaaaguggagcuccaagcgaaggccgauacccugacagacgaaaucaauuuccuucgcgcucuguacgaugccgagcucucucagaugcagacccauauuagcgacacguccgugguccugucuauggauaacaaucggaaccuugaccuggacagcaucaucgcugagguuaaggcccaauaugaagagauugcccagagaucccgcgcugaagcggagagcugguaccagacaaaauacgaagaacuccaggugaccgccggccggcacggggaugaccugagaaacacaaagcaagagaucgcugaaauuaaucgcaugauccagcggcugagaucugagauugaucaugugaaaaagcagugcgccaaccuccaggccgcuaucgccgacgcggaacaacgcggagagauggcucugaaagaugccaagaauaaacuugaaggccuggaggacgcccuccagaaggcuaagcaggaucuggcccggcuucugaaagaguaucaggaacucaugaacgucaagcuggcucuggacguggagaucgccaccuacagaaaacuccuggaaggggaggagugccgccuuaauggagaaggcguugggcaagugaacauuuccgucgugcagagcaccguuucuuccggcuauggaggcgcgagcggggugggauccggccuggggcucggaggcgggucuagcuacuccuauggcucuggacugggcgucgggggaggcuuuagcuccagcucugggcgggccaucggaggcggccuguccagcgucgggggaggaucuuccacaauuaaguacacgaccacaagcucuagcuccagaaaaagcuauaagcacuga

SEQ ID NO: 71319 - RNA, 1695 nt, Artificial Sequence
  derived and/or modified sequence opt5 from KRT6B__Homo_sapiens__NP_005546
auggccagcaccuccacaacgaucagaucucacagcuccucucggcgcggcuucagcgcuaacuccgccagacugcccggggugucucggagcggauuuuccagcauuucugucucccgcagcagaggcucugggggacucggcggggcgugcggaggcgcuggcuucgggucccggagccuguacggacuuggcgggucuaagcgcaucuccauuggaggcgggagcugugccaucuccggaggcuauggcucuagagccgggggaagcuacggcuuugggggagcuggcuccggguucggauuuggcggcggggccggaauuggcuucgggcugggaggcggggcuggccucgccggaggcuuugggggaccuggcuucccgguuugucccccugggggaauccaggaggugaccgugaaucaaagccugcuuacaccccugaaccuccagaucgacccugcgauucagcggguccgcgccgaagagagagaacagaucaaaacccugaauaacaaguuugcuucuuucauugauaaagugcgguuucuggagcaacagaauaagguucucgacacaaaauggacccugcuucaggaacagggcacaaagaccgugcgccaaaaccuggagccccucuucgagcaguauaucaauaaccugagacggcagcuugauaauauugucggggaacgcggcagacuggacuccgagcuccggaacaugcaggaucugguggaagaccugaagaauaaauacgaggaugagaucaacaagagaacggccgcugaaaaugaguuuguuacccucaaaaaggacguggaugccgcguauaugaacaaagucgaacugcaagccaaggcugacacacuuaccgaugagauuaauuuccugcgcgcccucuacgacgcugaacugagccagaugcagacacauaucucugauaccagcguggugcuuuccauggacaacaaccggaaucuggaccucgauucuaucauugccgaggucaaggcccaauaugaggaaaucgcucagagaagccgcgcggaggccgaauccugguaccagacgaaauacgaggaacugcagauuacagcuggacggcacggcgacgaucugagaaacaccaagcaagagaucgccgagauuaaucgcaugauccagcggcucagaagcgaaaucgaccauguuaaaaagcagugcgccaaccugcaggcugccauugcggaugcugagcaacgcggggaaauggcccuuaaagacgccaagaauaaacuggagggacucgaagaugcucugcagaaggccaagcaggaccuugcucggcugcucaaagaguaucaggagcugaugaacgugaagcuggcccucgauguggaaaucgcgacauacagaaaacugcuugagggcgaagagugccgccugaauggggagggagucggccaagugaacauuucuguugugcaguccaccgucagcucuggguauggcggagccuccggcguggggagcggacucggccuugggggaggcuccucuuacagcuauggguccggccugggaguuggcgggggauucucuagcuccagcggccgggcuaccgggggaggccugucuuccgugggcgggggaagcucuacaaucaaguacacgaccacauccagcucuagcagaaaauccuauaagcacuga

SEQ ID NO: 71320 - RNA, 1695 nt, Artificial Sequence
  derived and/or modified sequence opt5 from KRT6C__Homo_sapiens__NP_775109
auggccagcaccuccacaacgaucagaucucacagcuccucucggcgcggcuucagcgcuaacuccgccagacugcccggggugucucggagcggauuuuccagcauuucugucucccgcagcagaggcucugggggacucggcggggcgugcggaggcgcuggcuucgggucccggagccuguacggacuuggcgggucuaagcgcaucuccauuggaggcgggagcugugccaucuccggaggcuauggcucuagagccgggggaagcuacggcuuugggggagcuggcuccggguucggauuuggcggcggggccggaauuggcuucgggcugggaggcggggcuggccucgccggaggcuuugggggaccuggcuucccgguuugucccccugggggaauccaggaggugaccgugaaucaaagccugcuuacaccccugaaccuccagaucgacccugcgauucagcggguccgcgccgaagagagagaacagaucaaaacccugaauaacaaguuugcuucuuucauugauaaagugcgguuucuggagcaacagaauaagguucucgacacaaaauggacccugcuucaggaacagggcacaaagaccgugcgccaaaaccuggagccccucuucgagcaguauaucaauaaccugagacggcagcuugauuccauugucggggaacgcggcagacuggacagcgagcuccggaauaugcaggaucugguggaagaccugaagaacaaauacgaggaugagaucaauaagagaacggccgcugaaaacgaguuuguuacccucaaaaaggacguggaugccgcguauaugaauaaagucgaacugcaagccaaggcugacacacuuaccgaugagauuaacuuccugcgcgcccucuacgacgcugaacugucucagaugcagacacauaucagcgauaccuccguggugcuuucuauggacaauaaccggaaccuggaccucgauagcaucauugccgaggucaaggcccaauaugaggaaaucgcucagagaucccgcgcggaggccgaaagcugguaccagacgaaauacgaggaacugcagguuacagcuggacggcacggcgacgaucugagaaauaccaagcaagagauugccgagaucaaccgcaugauucagcggcucagaucugaaaucgaccaugugaaaaagcagugcgccucccugcaggcugccaucgcggaugcugagcaacgcggggaaauggcccuuaaagacgccaagaauaaacuggagggacucgaagaugcucugcagaaggccaagcaggaccuugcucggcugcucaaagaguaucaggagcugaugaacgugaagcuggcccucgaugucgaaauugcgacauacagaaaacugcuugagggcgaagagugccgccugaauggggagggagugggccaaguuaacgugagcgucgugcagucuaccaucuccagcggguauggcggagccuccggcguugggucuggacucggccuugggggaggcagcuccuacucuuaugggagcggccugggaauuggcgggggauucuccucuagcuccggccgggcuaucgggggaggccugagcucugugggcgggggauccagcaccauuaaguacacaacgaccucuagcuccagcagaaaaucuuauaagcacuga

SEQ ID NO: 71321 - RNA, 1572 nt, Artificial Sequence
  derived and/or modified sequence opt5 from KRT71__Homo_sapiens__NP_258259
augagcagacaguuuaccugcaaguccggcgccgcugccaaagggggauucucuggcuguagcgcggugcuguccgggggaucuagcuccucuuuccgggcuggcagcaaggggcucuccggaggcuuuggcagccgcucucuguacucccuugggggagucagaagccugaacguugccucuggcuccgggaaaagcggaggcuauggguucggacggggccgcgccucuggcuuugcuggguccauguucggaagcguggcccucggccccgugugcccuacagucuguccgcccgggggaauccaccaagugacgguuaaugagucccugcuugcuccucugaacguggaacucgaccccgagauucagaaggucagagcccaggaacgggagcagaucaaagcgcugaauaacaaguuugccucuuucauugauaaggugcgcuuucuggaacaacagaaucagguucucgagaccaaaugggagcugcuucagcaacuggaccucaacaauugcaagaacaaucuggaaccuauccuugagggcuacauuagcaaccugagaaaacagcucgaaacacuguccggggaucgggugcgccuggacagcgagcucagaaauguccgggaugugguggaggacuauaagaaacgcuacgaagaggaaaucaacaagagaaccgcugccgagaaugaguucguccugcuuaagaaagauguugacgcugccuaugcgaacaagguggaacugcaggccaaaguggagucuauggaucaggaaaucaaguuuuuccggugucucuuugaggcugaaauuacacaaauccagucccauauuagcgacaugucugucauccugagcauggauaauaaccgcaaccuugaccuggauuccauuaucgacgaggugagaacccaguacgaagagauugcccucaaaucuaaggcugaggccgaagcccuguaucaaacaaaauuccaggagcugcagcucgcugcgggacggcacggcgacgaucugaagaauaccaagaacgaaaucagcgagcuuacgagacugauccagcgcauucgguccgaaaucgagaauguuaaaaagcaagccagcaaccucgagaccgcuauugccgacgccgaacagagaggcgauaaugcucugaaagacgcccgcgcgaaacuugaugagcuggaaggggcucuccaucaggccaaggaggagcuggcccggaugcugagagaauaccaggagcucaugucucugaaacuugcucuggacauggaaaucgccacauaccgcaagcuccuggaguccgaagagugccggaugagcggagaguuccccucuccuguguccauuagcaucaucuccucuaccagcggcggguccgucuauggauuuagaccgucuauggugagcggcggguacguugcuaacuccagcaauuguauuucuggcgugugcuccguccgcggaggcgaagggcggagcagaggaucugccaacgauuauaaggacacacugggcaagggguccagccuuucugcgcccagcaaaaagaccucccgcuga

SEQ ID NO: 71322 - RNA, 1410 nt, Artificial Sequence
  derived and/or modified sequence opt5 from KRT72__Homo_sapiens__NP_001139698
augagcagacagcugacccacuucccccggggcgagcgccucggguuuuccggaugcucugccgugcugagcggcgggaucggauccucuagcgcuuccuucagagcccgggucaagggcucugcgagcuuuggguccaaaagccuuucuugucugggaggcucccgcagccucgcucugucugccgccgcuagacggggcgggggacgccuuggcggguucguuggaacagccuuuggcuccgcugggcugggaccuaagugcccgagcgugugucccccuggcggcauuccccaagugacggucaacaaaucucuccuggccccucugaauguggaaauggaccccgagauccagagaguucgggcgcaggaacgcgagcagauuaaggcccucaacaauaaauucgcuuccuuuaucgauaaggugagauuccuggaacaacagaaccagguccuugagaccaaguggaaucugcuccagcaacuggaccuuaacaauugccggaaaaaccuggagccuauuuacgaaggguauaucagcaaucuccagaagcagcuggagaugcuguccggagauggcgugcgccucgacucugaacugagaaacaugcaggaucuuguugaggacuacaaaaagcgguaugagguggaaaucaaucgcagaacagccgcugagaacgaauuugucgugcugaaaaaggauguggacgccgcguacaugaauaaggucgagcuccaagccaaaguugauagccugaccgacgaaauuaaguucuuuaaaugucuuuaugagggggagaucacacagauucagucccauaucagcgauaccucuauugugcuguccauggacaacaaucgggaucucgaccuggacagcaucauugcugaagugagagcccaauacgaggaaaucgcucugaagucuaaagccgaggccgaaacacucuaucagaccaagugcgcugaucuggagacggcgaucgccgacgcugagcagcgcggagauugugcccuuaaagacgcccgggcuaagcuggaugaacucgagggcgcccugcaccaggcgaaggaggaacuugcuagaaugcugcgcgaauaccaagagcucgucagccugaaacuggcccucgacauggagauugccaccuaccggaagcugcuugaauccgaggaaugcagaaugucuggggaguauccgaacagcguguccaucagcguuauuucuuccacaaacgcuggagccggcggcgcuggguucagcaugggauuuggcgccucuuccagcuacuccuauaaaaccgcggccgcugaugugaagacaaaagggucuuguggaagcgagcugaaggacccccucgccaagaccuccggcucuagcugcgcuacgaaaaaggccucccgcuga

SEQ ID NO: 71323 - RNA, 1590 nt, Artificial Sequence
  derived and/or modified sequence opt5 from KRT74__Homo_sapiens__XP_011536204
augagcagacagcugaacaucaaguccucuggcgacaaagggaauuucagcgugcacuccgccgucguuccccggaaggcugugggaucucucgccagcuacugcgcggcuggccgcggggccggagccggcuuuggguccagaucucuguauagccuuggaggcaaccggcgcauuuccuucaauguggcuggcgggggagucagagccggcggguacggauuucggccuggcagcggguauggaggcggccgcgcuucuggguucgccggauccauguuuggcagcguggcgcuggggccggccugucucucuguuugucccccuggaggcauccaucaagugaccgucaacaaaucccugcuugcuccccugaauguggagcucgauccugaaauucagaagguuagagcccaggagcgggaacagaucaaagugcugaacgacaaguucgcuagcuuuauugauaagguccgcuuccuggagcaacagaaucaggugcucgaaacaaaaugggagcugcuucagcaacuggaccucaacaauugcaagaaaaaccuggagcccauccuugaaggguacaucucuaaucugagaaagcagcucgagacgcuguccggagaucgggugcgccuggacagcgaacucagauccaugcgggaucuggucgaggacuauaaaaagcgcuacgagguugaaauuaacagacggaccacagccgagaaugaauuuguggugcuuaagaaagaugcggacgccgcuuaugccgucaagguggagcugcaggcuaaaguugauucucucgacaaggaaaucaaauuccugaagugccuuuacgaugccgagauugcccagauccaaacccacgcuagcgagacauccgugauucugagcauggacaacaauagagaccucgaucuggacucuaucauugcggaaguccgcaugcauuacgaggaaaucgcccugaaauccaaggcugaggccgaagcccucuaucagaccaagauccaggagcugcaacuugcugccagccggcacggcgaugaccugaaacauacaagaucugagaugguggaacucaaccgccugauucagcggaucagaugugagauuggcaacguuaagaaacagcgcgcgagccuugaaaccgcuaucgccgaugccgagcagagaggggacaaugcucugaaggaugcccaagcuaaacucgacgaacuggagggagcccugcaccaggcgaaggaggaacucgcccggaugcugcgcgaguaccaggaacuuaugucccugaagcucgcucuggauauggagauugccacguaucggaaacugcuugagggcgaagagugcagaaugucuggggaaaacccuagcuccgugagcaucucugucaucuccucuagcuccuacagcuaucaccauccguccucugcuggaguggaccucggcgccagcgcggucgccggguccucuggcagcacccaguccggacaaacaaagaccacagaggcucgcggcggggaucugaaagacacccagggaaagagcacgcccgccucuauuccugcucggaaagccacaagauga

SEQ ID NO: 71324 - RNA, 1656 nt, Artificial Sequence
  derived and/or modified sequence opt5 from KRT75__Homo_sapiens__NP_004684
augagcagacaguccucuaucaccuuccaaagcggcucccggcgcggguuuucuacaacgagcgccauuacccccgcugccggaagaucccgguucucuagcguguccgucgcgcgcagcgcugccggcucugggggacugggcagaaucuccagcgccggggcuucuuuuggaucccggagccucuacaaccugggcggcgccaagcgcguuucuauuaaugggugcggauccagcuguagauccggcuucgggggacgggcuucuaaccgcuuuggcgugaauagcggguucggauauggcggcggggugggaggcggguuuuccggaccuagcuucccggucugucccccuggcgggauccaggaggugacaguuaaccagucucuucugacaccccuccaccuucagauugacccuaccauccaaagagugcgggccgaagaacgcgaacagaucaaaacccuuaauaacaaguuugcguccuucauugauaaagucagauuucuggagcagcagaauaaggugcucgaaacaaaaugggcccugcugcaagagcagggaagccggaccguucgccagaaccucgagccccuguucgacucuuacacgagcgaacuuagacggcagcuggaguccaucaccacagaaagaggccgccucgaggcugagcugcggaauaugcaagauguggucgaagacuuuaaggugagauaugaggaugaaauuaacaagcgcaccgccgcugagaaugaguucguggcccuuaaaaaggacgucgaugcggccuacaugaacaaaguugagcuggaggcuaaggugaaaucucucccugaagagaucaauuucauucauagcguguuugacgccgaacugucccagcugcagacacaagucggcgauaccagcgugguucucucuauggacaacaaucggaaccuggaucuugacuccaucauugcugaggugaaggcccaguaugaagauaucgccaacagaagccgcgcugaggcggagucuugguaccagacgaaguaugaggaacugcaggucacagccgggcggcacggagacgaccucagaaauaccaaacaagaaaucuccgagaugaaccgcaugauucagcggcugagagcugaaaucgauagcgugaagaaacagugcuccucucuucagacagccauugccgacgcugagcaacgcggcgagcuggcccucaaggaugcgcgggcuaaacugguugaccuggaagaggcccuccagaaggccaaacaggauauggcuagacugcuucgggaauaccaggagcugaugaauaucaagcucgcccuggacguggagauugcuaccuaccgcaagcugcuggaaggggaggaaugcagacucagcggagagggcgucuccccggugaacaucucugucgugaccagcacacuguccagcggguauggcucuggauccagcaucggcgggggaaaucugggccucgggggaggcucuggguacuccuucacgaccagcggcggacauucucugggcgccgggcuuggaggcagcggguuuuccgcgacaagcaaccggggacugggcgggucuggcuccagcguuaaauucguguccaccacaucuagcucccaaaagucuuauacccacuga

SEQ ID NO: 71325 - RNA, 1917 nt, Artificial Sequence
  derived and/or modified sequence opt5 from KRT76__Homo_sapiens__NP_056932
augaacagacaggugugcaagaaaucuuucuccggccggucucaaggguuuagcggacgcuccgccgucguuucuggcagcuccagaaugucuuguguggcucggagcgggggagccggcgggggagcgugcggcuuccgcuccggcgcugggagcuuuggaucuagaucccuguacaaucucggcagcaacaagucuaucuccauuagcguggccgccgggucuucccgggcuggaggcuucgggggaggccgcagcuccuguggcuuugccgggggauauggcgggggauucggcgggucuuacggaggcggcuuugggggaggcagaggggucggaagcggcuucgggggcgcuggaggcuuugggggagccggcggguucggaggccccgggguguuuggcggaccuggcuccuucgggggaccgggcggguuuggacccggcggguucccuggcggaauccaggagguuauugugaaucagagccugcuucagccccugaacgucgaaaucgacccucaaauuggccaggugaaagcgcaggagcgggaacagaucaagacccucaauaacaaauucgccucuuuuaucgauaagguucgcuuccuggagcaacagaauaaggugcuugaaacaaaaugggagcugcuccagcagcaaacgaccggguccggacccagcucucuggagccuugcuuugaaagcuauauuuccuuccuguguaagcagcucgacucucugcuuggcgagagagggaaccuggaaggagagcucaaaagcaugcaggaucuggucgaggacuuuaagaaaaaguacgaagaugagaucaauaagcggacagcugccgaaaacgaguucgugggccuuaaaaaggacguggaugcugccuuuaugaauaaagucgaacugcaagcgaagguugacucccucaccgaugaggugagcuuccugcgcacacuguaugagauggaacucucucagaugcagucccacgccagcgacaccucugugguccuguccauggauaacaauagaugccuugaccuggggagcauuaucgcugaggugcgggcccaguacgaagagauugcucaacgcuccaaaucugaagccgaggcccucuaucagacaaagcugggcgagcuucagaccacggcuggaagacauggcgaugaccugcggaacaccaaaagcgaaaucauggagcucaauagaaugauucagcgccugcgggcggaaaucgagaacguuaagaagcaaaacgccaaucugcagacagcuaucgccgaagccgagcagagaggggagauggcucucaaagacgccaacgcgaagcugcaggaucuucaaaccgcucugcagaaagccaaggacgaucucgcccgccugcuucgggacuaccaggaacugaugaaugugaaacucgcucuggaugucgagauugccacauacagaaagcugcucgaaggagaggagugucgcauguccggcgaaugccagucugcuguguguaucagcguuguguccaacgucaccagcacgucuggguccagcggaucuucccggggcguguuuggcggggucagcggaucuggcagcgggggauauaagggcggguccagcagcuccagcuccucuggauacggcgugagcggcggguccggaucuggcuaugggggaguuagcuccggcucuacagggggaagaggcagcuccggcagcuaccaaucuuccagcucugggucccgccugggaggcgccgggagcauuucugugucccacagcggaaugggcuccagcucugggagcauccagaccuccggaggcucuggcuauaaaagcgggggaggcggguccacaucuauucgguucagccagaccaccuccucuagccaacauuccagcacaaaguga

SEQ ID NO: 71326 - RNA, 1233 nt, Artificial Sequence
  derived and/or modified sequence opt5 from KRT78__Homo_sapiens__NP_001287743
auggagggccacgaagccagccccgcucagguggggcaaggagacagaggcaagguccgguuccuggagcagcagaacaaaguucucgaaaccaaguggcaucugcuucagcaacaggggcuguccggaucucagcagggccucgagccuguguuugaagccugccuggaucaacuucgcaaacagcuggagcagcuccagggggagagaggagcgcuggacgcugaacugaaggccugucgggaucaagaggaagaguacaaaagcaaguaugaggaagaggcccaccgcagagcuacacucgaaaaugacuucgugguccugaagaaagauguggacggcguuuuucuuuccaagauggagcuggaaggcaaacucgaggcccugcgggaguaccuuuauuuccugaagcaucucaacgaagaggaacuggggcagcugcagacgcaggcuucugauaccagcgugguccucuccauggacaauaaccgcuaccuggauuuuucuagcaucauuacagaggugagagcccgguaugaagagaucgcgcgcuccagcaaagccgaggcugaagcccuuuaccaaaccaaguaucaggagcugcagguuucugcucaacuccacggagacagaaugcaggaaacaaaggugcagauuucccagcugcaucaagagauccagcggcuucagagccagaccgaaaaucugaaaaagcaaaacgccucucuccaggcggccauuacagaugcugagcagcgcggcgagcuggcccugaaagacgcucaggccaaggucgaugaacucgaggccgcucugagaauggcgaaacaaaaucuugcccggcugcucugcgaauaccaggagcugaccuccacgaaacuuagccuggacguggagaucgcuaccuaccgcagacuccuggaaggggaggaaugucggaugucuggagagugcacaucccaggugaccaucagcuccgucggcgggucugccguuaugagcggaggcgugggcgggggacugggcuccacaugugggcucggaagcggcaaggggucuccgggauccugcuguaccagcauugugacgggcggcucuaacaucauucuggggagcggaaaggaccccguccuugauuccugcucugugagcggcuccagcgccgggucuuccugucacacaauccugaagaaaaccguugaaagcucucucaagacauccauuaccuauuga

SEQ ID NO: 71327 - RNA, 1410 nt, Artificial Sequence
  derived and/or modified sequence opt5 from KRT7__Homo_sapiens__NP_005547
augagcauccacuucuccucucccguguuuaccagcagauccgccgcuuucucuggccgcggggcccagguccggcugagcuccgcgagaccuggaggccucgggucuagcucccuguacggacuuggcgcuagccggccgcgcguugccgugagaucugccuaugggggacccgugggcgcuggcauucgggaggucacaaucaaccaaucccugcucgccccucugcgccuugacgcugaucccagccugcagagagugcggcaggaagagucugaacagauuaagacgcucaauaacaaauuugccuccuucaucgacaagguucgcuuucuggagcaacagaauaaacugcucgaaaccaaguggacacugcuucaggagcagaaaagcgcgaagucuuccagacugccugauauuuucgaggcccaaaucgcugggcuccggggacagcuggaagcccuucagguggacggcgggcgccuggaggcugaacucagaagcaugcaggaugucguggaggacuuuaagaacaaauacgaggaugaaaucaaucaucggaccgccgcggagaacgaguucguugugcugaagaaagacgucgaugccgcuuauauguccaagguggagcuggaagccaaaguggacgcucucaaugaugagauuaacuuucugcgcacacuuaaugagaccgaacugacagagcuccaaucucagaucagcgacaccuccgucguucugagcauggauaacucuagaucccuugaccuggacggaauuaucgccgaagugaaggcccaguacgaggaaauggcuaagugcagccgggcggaggccgaggcuugguaucaaacgaaauucgaaacccuccaggcccaggccggcaagcacggggaugaccugagaaauacacgcaacgagauuucugaaaugaaucgggcuauccagagacugcaagccgagauugauaacaucaaaaaucagcgcgcgaagcucgaagcugccaucgccgaggcugaggaacggggagagcuggcccuuaaagacgcuagagccaagcaggaagaacuggaggcggcccuccagcgcggcaaacaagauauggcucggcagcugagagaauaccaggagcuuaugagcgugaagcuggcccucgacauugaaaucgcuaccuaucgcaagcugcuggagggcgaagagucccggcucgccggggauggagucggcgcggugaacauuucuguuaugaacagcacagggggauccagcucuggcgggggaaucggccugacccuuggcgggacgaugggauccaaugcccugagcuuuucuuccagcgcuggccccgggcuccugaaagccuacuccauuagaacagcuucugccagccgccgguccgccagagacuga

SEQ ID NO: 71328 - RNA, 1269 nt, Artificial Sequence
  derived and/or modified sequence opt5 from KRT80__Homo_sapiens__NP_001074961
auggccugcagaagcuguguggucggcuucuccucucugagcuccugcgagguuacccccguggggucuccucggccgggaacaagcggcugggacuccugucgcgcucccgggccuggauuuucuagcagaucccucacgggcugcuggagcgccgggaccaucucuaaggugacagucaaccccggacugcuugugccucuggauguuaaacucgaccccgcggugcagcaacugaagaaucaggaaaaagaggaaaugaaggcucuuaacgauaaauucgccucccugauuggcaagguccaggcccucgagcagcggaaucaacugcuggaaacccgcuggagcuuucuccagggccaggacucugcuaucuucgaucuggggcaccuuuacgaggaguaucagggaagacugcaagaagaacuccggaaggugucccaggaacgcggccagcuggaggccaaccuucugcagguucucgagaaaguggaagaguuucggauuagauacgaagacgagaucagcaagcgcacagauauggaguucaccuuuguccaacugaaaaaggaccuggaugcugagugucuccauagaacagagcuggaaaccaaacuuaagucucuggaguccuucguggaacucaugaagacgauuuaugagcaggaacugaaagaccuugccgcccaggugaaggaugucagcguuaccguggggauggacucccggugccacaucgaucugucuggaaucguggaggaggucaaagcgcaauacgacgcuguggccgcucgcagccucgaagaggccgaagcguauuccagaagccagcuggaggaacaggccgcucggucugccgaguacggcuccagccugcagucuagccgcuccgagauugcugaccucaauguuagaauccaaaagcugcggucucagauucuuagcgugaaaucccauugucugaagcucgaagagaacaucaaaacagccgaggaacagggggagcuggccuuucaggaugcuaagaccaaacuugcgcaacuggaagccgcucuccagcaggccaagcaggacauggccagacaacugcgcaaguaucaggagcugaugaaugucaaacucgcucuggauauugaaaucgccacauaccggaaacuuguggagggagaagagggcagaauggacagcccuucugcgaccguuguguccgcuguccagagccgcugcaagacggccccgucucugcccuacccucucuguucccuguga

SEQ ID NO: 71329 - RNA, 1518 nt, Artificial Sequence
  derived and/or modified sequence opt5 from KRT81__Homo_sapiens__XP_011536636
augaccugcggcagcggguucggaggcagagccuuuuccuguaucucugcuugcgggccccggccuggacgcuguugcauuacagccgcgccguacagaggcaucagcuguuaucgggggcugacgggaggcuucggcucccacucugugugcgggggauuucgcgcuggcagcugugggagauccuucggauaccggucuggcggggucugcggacccagcccucccuguauuaccacaguuuccgugaacgagagccuccugaccccucuuaaucuggaaaucgaccccaacgcccagugcgugaagcaagaggaaaaggagcagauuaagucucucaauucccgcuuugccgcuuucaucgauaaagucagauuucuggaacagcagaacaaacuucuggagacaaagcuccaauucuaucagaaucgggaguguugccagagcaaccuggaaccucuguuugagggcuacaucgaaacccuccgcagagaggccgagugcguggaagcugacucuggccggcuggccuccgagcuuaaucauguucaggaagugcuggagggguauaagaagaaauacgaagaggaggucagccuccgcgcgacagccgaaaacgaguucguggcucugaagaaagauguugacugugccuaucuuagaaagucugaucuggaagcuaauguggaggcccucauucaagaaaucgacuuucugcggcgccuguacgaggaggaaauucucauccugcagucccacauuagcgauaccuccgucguggugaaacuugacaacucuagagaucugaauauggacugcaucauugcggagaucaaggcccaguacgaugacaucgucacgcggagcagagcugaagccgaguccugguaucgcagcaagugugaagagaugaaagcuaccguuauucggcauggagagacacucagacgcaccaaggaagagaucaacgaacugaaucggaugauucagagacuuacagccgagguggagaacgccaaaugccaaaauucuaagcuggaagcugcgguggcccaguccgagcagcaaggcgaagcugcccucagcgaugcccgcuguaaacuggcugagcuggaaggggcccuccagaaggcgaaacaggacauggcuugccugauccgggaguaccaggaggucaugaacucuaaacuuggacuggacauugaaaucgccaccuauagacgccuccuggagggcgaggaacaacggcuuugugaagggaucggagccgugaacguuugcgugagcuccucuagaggcggcgucguguguggggaucugugcguuagcggaucccgcccggugacgggcagcgucuguucugcucccugcaaugggaacguggccgucuccacaggacucugcgcuccuuguggccagcugaauaccacaugcgggggcggaagcuguggcguggggucuugcggaauuuccagccugggcguuggguccuguggaucuagcugccggaaguguuga

SEQ ID NO: 71330 - RNA, 1542 nt, Artificial Sequence
  derived and/or modified sequence opt5 from KRT82__Homo_sapiens__NP_149022
augagcuaccacuccuuccagcccggcucuagaugcgggagccaauccuuuucuagcuauuccgccgugaugccucggauggucacccauuacgcuguuucuaagggaccgugucgccccggcgggggaagaggccugcgggcccucgggugccugggaagccgcucccuuuguaacgugggcuucggcagaccucggguggcgagccgcugcgggggaacacugcccggcuuuggguauagacucggagcuacguguggcccuucugccugcaucacccccgucacaauuaaugagucccugcuugugccucuggcccucgaaaucgacccgaccguucagcgggugaaacgcgaugagaaggaacagauuaaaugucugaacaauagauucgcuagcuuuaucaacaagguccgguuccuggagcagaaaaauaagcuccuggaaacaaaguggaacuuuaugcaacagcagcgcugcugucagaccaauauugagcccaucuucgagggguacaucucugcccuuagacggcaacuggacugcguguccggagaucgcguuagacucgaaagcgagcuguguucucuucaggcugcccuggaaggcuauaaaaagaaauacgaggaggaacucucccugcggccuugcguggagaacgaauuugucgcgcugaagaaagacguggauacagccuuccucaugaaggcugaccuggagaccaaugccgaagcucuugugcaggagauugauuuucugaagucccucuaugaggaagagaucugccugcuucagucccaaauuucugaaacgagcgucaucguuaaaauggacaacuccagagagcuggauguggacggcauuaucgccgaaauuaaggcgcaguacgaugacaucgccagccgcucuaaagcugaggccgaggcuugguaccagugucgguaugaagaacucagagugaccgccgggaaucacugcgauaaccugcgcaaucggaagaacgaaauccuggagaugaauaaacucauucaaagacugcagcaggaaacagagaacgucaaggcccagcgcuguaaacuugagggagcuaucgcggaagccgagcaacagggcgaagcugcccugaacgacgccaagugcaagcucgcugggcuggaggaggcccuucagaaagcgaagcaggacauggcuugucugcucaaagaauaccaagaggugaugaauagcaagcugggacuggauauugaaaucgccaccuaucggagacuccuggagggcgaggagcaucgccuuugcgaggggauuggacccguuaacaucagcgugucuagcuccaaaggcgccuuccuguacgaaccuuguggcgucucuacacccgugcucagcaccgggguucugcgguccaauggaggcugcagcaucguggggacgggagagcuguaugucccgugugaaccucagggccuucucucuugcggguccggcagaaagagcucuaugacacugggagcuggcggguccagccccucccacaagcauuga

SEQ ID NO: 71331 - RNA, 1482 nt, Artificial Sequence
  derived and/or modified sequence opt5 from KRT83__Homo_sapiens__NP_002273
augaccugcggcuucaacagcaucggguguggauuuagacccggcaauuucuccugcgugucugccugugggccucggccgagccgcugcuguauuacagcugcccccuacagaggaaucuccugcuaucggggccugaccgggggauuuggcucucacagcgucuguggcggguuccgcgcgggauccugcggcagaucuuuuggguaccggagcggaggcguuugugggccuuccccucccugcauuaccacagugagcgugaacgagucucuccugacgccccuuaaucuggaaaucgacccuaacgcucagugugucaagcaagaggaaaaagagcagauuaagucccucaauagccgcuucgccgccuuuaucgauaaagugagauuccuggaacagcagaacaaacuucuggagacaaagcuccaauuuuaucagaaucgggagugcugccagucuaaccuggaaccgcuguucgcuggauacaucgagacccuccgcagagaagccgaguguguugaggcugacuccggccggcuggccagcgaacuuaaucaugugcaggagguccuggaaggcuauaagaagaaauacgaggaagagguggcgcuccgcgccacagcugagaacgaauuuguugcccugaagaaagauguggacugcgcuuaucuuagaaagucugaucuggaggccaaugucgaagcgcucauucaagagaucgacuuccugcggcgccuguacgaagaggagauuagaauccuccagucccacauuagcgauaccuccgugguggucaaacuggacaacucucgggaucuuaauauggacuguaucguugccgaaauuaaggcucaguacgaugacaucgccacgagaagccgcgcugaggccgaauccugguaucggagcaagugcgaggaaaugaaagccaccgugaucagacauggggagacacugcgccggaccaaggaggaaauuaacgagcucaauagaaugauccagcgccugacagcugaaguggagaacgcgaaaugucaaaacucuaaacuugaggccgcugucgcccaguccgaacagcaaggagaggccgcucugagcgaugcccggugcaagcucgcggaacuggagggcgcucugcagaaggccaaacaggacauggccugucucauuagagaauaccaggaggugaugaacucuaagcuggggcuugacaucgagauugcuaccuaucgccggcugcucgaaggagaggaacaaagacugugcgagggcguugaagccgugaaugucugugugagcuccucucgcgggggaguugugugcggcgaucuuugugucagcggcucccggcccgugacggggagcgucugcucugcuccuugcaauggaaaccuggugguuuccacaggccucuguaagcccugcgggcagcugaauaccacauguggaggcgggagcugcggccagggaagacacuga

SEQ ID NO: 71332 - RNA, 888 nt, Artificial Sequence
  derived and/or modified sequence opt5 from KRT85__Homo_sapiens__NP_001287739
augguguucaagguccaguuucugagcuccagacccucucucagccacacccaagacguugauugcgccuaccugcggaaauccgaccuugaggcuaacguggaagcccugguggaggaaucuagcuuccuccgcagacuguaugaggaagagauccggguccuucaggcgcauauuuccgauacaucugugaucguuaagauggacaauagccgcgaucugaacauggacuguauuaucgcugagauuaaagcccaguacgaugacguggccuccagaagccgggcugaagccgagucuugguaucgcuccaagugcgaagagaugaaagcuacggucaucagacacggcgagacccuccggcgcacaaaggaagagaucaaugaacugaacagaaugauucagcggcugaccgccgagaucgaaaaugcgaagugucaacgcgccaaacucgaggcugccguggcugaggccgaacagcagggggaggcggcccugagcgaugcuagaugcaaacuugccgaacuggagggagcucuccagaaggccaagcaagacauggccugucugcuuaaagaauaccaggagguuaugaacucuaagcugggccucgauauugagaucgcuacauaucggcgccugcuggaaggggaggaacauagacucugcgagggagugggcuccgucaaugugugugugucuagcuccagagggggagucagcugcggcggccuguccuacucuaccacaccugggcggcagauuaccagcggaccguccgcgaucggcgggagcauuacgguuguggcccccgacucuugugcuccuugccagccccgcuccagcucuuuuagcuguggauccucucggagcgugagauucgccuga

SEQ ID NO: 71333 - RNA, 1692 nt, Artificial Sequence
  derived and/or modified sequence opt5 from KRT86__Homo_sapiens__XP_005268923
augugcgaggaacugaaggccaccgugcagaaacacacacaaagccucaagcccuccaaagaggaccugaacagacuuaaucaggcuauccaguggcugacggucgaaguuggcucugccgagagccaggcguaccgcggggcuuccucugaacggcucaccccuagaccgcuguguagccccuucggacggcuucauccucaaaaccugcucuccucucccaagagcacaaugaccugcggcuccuauugugggggacgcgccuuuagcugcauuucugccuguggcccuagacccgggcggugcuguaucacagcugccccuuaccgcggaauuuccugcuauagaggccugaccggcggguucggaagccacucuguguguggcggguuucgggcuggauccugcggccgcagcuucggguacagaucuggaggcguguguggcccguccccucccugcaucacaaccgucagcgugaaugagucccugcucacgccccugaaccuugagauugauccuaaugcccagugcguuaaacaggaagagaaggaacagaucaagucucugaacagccgguuugcggccuucaucgacaaagugcgcuuucucgagcaacagaauaagcugcuugagaccaaacugcaguucuaucagaacagagaauguugccaauccaaucucgagccccuguuugaaggguacauugagacacugcggcgcgaagcugagugugucgaggccgauagcggaagacucgcuucugaacugaaccaugugcaggagguucuugaaggcuauaagaaaaaguacgaggaagaggugucccugcgggccaccgcggagaaugaguucgucgcccucaagaaagacguggauugcgcuuaccugagaaagagcgaccuugaagccaacguggaagcucugauccaggagauugauuuucuccgccggcuguaugaagaggagaucagaguccugcaaucucacauuagcgacacauccguuguggugaaacucgauaauucucgcgaccugaacauggauuguaucauugccgaaaucaaggcccaguacgacgauaucgucacccggagcagagcugaggcggaauccugguaucgcagcaaaugcgaggagaugaaggccacggugauucggcauggggaaacacuuagacgcaccaaagaggaaaucaaugagcugaaccggaugauucagagacucacagcugaaguugagaacgccaagugucaaaauucuaagcuggaggccgcuguggcccaguccgaacagcagggagaggcggcucuuagcgacgcccgcugcaaacuggccgaacucgagggcgcucugcagaaggccaaacaagacauggcuugucugauccgggaauaccaggaggucaugaacucuaagcucgggcuggauauugagaucgccaccuauagacggcuucuggaaggagaggaacagcgccucugcgagggcgugggcuccguuaaugugugugucagcuccucuagagggggaguggucugcggcgaccugugcgcgagcaccacagccccggugguuuccacgcgggugucuagcgucccuuccaacagcaaugugguuguggggaccacaaacgcuugugcccccucugcuagagucggagugugcggcggguccuguaaacgcugcuga

SEQ ID NO: 71334 - RNA, 1536 nt, Artificial Sequence
  derived and/or modified sequence opt5 from KRT8__Homo_sapiens__NP_001243211
augaacggcgugagcuggucccaggaccugcaagaggggaucucugccugguucggacccccugcuagcaccccggccuccacaaugucuauuagagucacgcaaaagagcuacaaaguuuccaccucuggcccccgggcguuuagcucccgcagcuauacaucugggccuggauccagaaucagcagcuccagcuucucucgggugggcuccagcaauuuucgcgggggacucggcggcggguacggaggcgcuuccgggaugggaggcauuaccgccgugacagucaaccagucucugcuuagcccccuggugcucgaaguugauccuaauauccaggccgugagaacccaggagaaggaacagauuaaaacacugaacaauaaguucgcuuccuuuaucgacaaaguccgguuccuugagcagcagaacaagaugcuggaaaccaaguggagccuccugcaacagcagaaaacggcccgcucuaauauggauaacauguuugaguccuauaucaauaaccugagacggcagcucgagacccuggggcaagaaaaacuuaagcuggaggcugaacucggaaauaugcagggccugguggaggacuucaagaacaaauacgaggaugaaauuaauaagcgcacagagauggaaaacgaguuuguucuuaucaagaaagacguggaugaagccuauaugaauaaggucgagcuggagagcagacucgaaggccugaccgacgagauuaacuuccugcggcagcucuacgaagaggaaauccgcgagcugcaaucucagauuagcgauacauccguggugcuuucuauggacaacagcagaucccuggauauggacagcaucauugcggaggucaaagcccaguaugaagauaucgcuaaucggucucgcgccgaggcugaauccauguaccagaucaaguacgaggaacuccaaagccuggccgggaaacacggagacgaccuuagacggaccaagacggagauuucugagaugaacagaaauaucucccgccugcaggcggaaauugagggccucaaagggcagcgggccagccuggaagcugccaucgcugaugccgagcagagaggagagcuggccauuaaggacgcuaacgcgaagcucuccgaacuggaggccgcccuucaacgcgcuaaacaggauauggcccggcagcugagagaauaucaggagcucaugaauguuaagcuggcucuugacaucgaaaucgccacauaccgcaaacugcucgagggcgaggaaucucggcuggagagcgggaugcaaaacauguccauucauaccaagacaaccucuggauaugcgggcggccugagcuccgcuuacgggggacucaccagccccggccugucuuauucccuugggagcucuuuuggauccggcgccgggagcucuagcuucuccagaacaucuucuucccgcgccgugguggucaaaaagaucgaaacgcgggauggcaagcuggugagcgaguccucugacguucucccuaaauga

SEQ ID NO: 71335 - RNA, 1872 nt, Artificial Sequence
  derived and/or modified sequence opt5 from KRT9__Homo_sapiens__NP_000217
augagcugcagacaguucuccucuagcuaccugucccggucuggcgggggaggcgggggaggccucgggagcggaggcuccauccgcucuagcuauuccagauuuagcagcuccggcgggggaggcgggggaggccgguucucuucuuccagcggguacggaggcggaucuucccgcgugugugggagaggaggcgggggauccuuuggcuauuccuacgggggaggcucuggcgggggauucagcgccuccagccugggcgggggauuuggcgggggcucucggggauucggcggggcuuccggaggcggguauagcucuagcggaggcuuugggggcggauucggcgggggauccggcgggggauuuggcgggggcuacggaucuggcuucgggggauuuggcggguucggaggcggggccggcggaggcgacgggggcauucuuaccgcgaacgaaaagagcacaaugcaagaacugaauagccgccucgcuagcuaucuggauaaaguccaggcccuugaggaagccaacaaugaccuggagaacaagauccaggauugguacgacaaaaagggccccgcugccauucagaaaaauuacucuccuuauuacaacacgaucgaugaccucaaggaucaaauuguugaccugaccguggggaauaacaagacacugcucgauaucgacaauaccagaaugacacuggaugacuuucggaucaaauucgaaauggagcagaaccuucgccagggaguggaugcugacauuaauggccugagacagguccucgacaaccugaccauggagaaguccgaucuugaaaugcaauaugagacacugcaggaggagcucauggcccugaaaaagaaucacaaagaggaaaugagccagcugaccggccagaacucuggggacgugaauguugagaucaacguggcgccgggaaaggaucucacgaagacccugaacgacaugcggcaagaauacgagcagcuuauugccaaaaaucgcaaggauaucgaaaaccaguaugagacacaaauuacccagaucgagcaugaagucuccagcuccggccaggaggugcagucuagcgcuaaagaaguuacacaacugagacacggggugcaggagcucgaaauugagcugcagucccagcuuucuaagaaagccgcucuggaaaagagccucgaggacaccaaaaaucgguacugcggacaacugcagaugauccaggagcagaucuccaaccuggaagcccaaauuacggauguccgccaggagaucgaaugucagaaucaggaguauagccuccugcuuucuauuaagaugagacuggagaaggaaaucgagacauaccauaaccuccuggaaggcgggcaagaggacuucgaguccagcggagcgggcaaaauuggccuugggggacggggcgggucuggaggcuccuacgggagaggaagccgcggcggcucugggggaagcuauggcgggggaggcuccgggggaggcuacggcgggggaagcggcucucggggaggguccggcgggagcuauggaggcggcuccgggucuggaggcgggagcggaggcggguacggaggcggcuccgggggaggccacucugggggaagcggcgggggacauuccggcggcucugggggaaauuauggcgggggaagcggcuccgggggcggaagcggcgggggauacggcgggggaucuggcuccagagggggcagcggaggcucucacgggggaggcuccggguuuggaggcgaaagcgggggcucuuauggaggcggggaggaagccuccggaagcggcgggggauacggcggcggguccggaaagagcucucacagcuga

SEQ ID NO: 71336 - RNA, 492 nt, Artificial Sequence
  derived and/or modified sequence opt5 from KRTAP11-1__Homo_sapiens__NP_787054
augagcuucaacugcuccaccagaaauuguucuagccggcccaucggcgggcgcugcauugugccugucgcccagguuacaacgaccuccacaaccgacgcugauugucugggaggcaucugccucccgucuagcuuucaaacaggguccuggcugcuugaccacugucaggagaccugcugugaacccacagccugccagccuaccuguuacagacggacgucuugcgugagcaaccccugucaggugaccugcucccgccaaacaaccugcauuagcaauccuuguucuacaaccuauuccagaccccugacguucgucagcucuggaugccagccucucggcgggaucuccagcgugugucagccgguuggaggcauuucuacagugugccagcccgucggcgggguguccaccguuugucaaccugcgugcggagugagccggacauaccagcaguccugugucucuagcugccgcagaaccuguuga

SEQ ID NO: 71337 - RNA, 837 nt, Artificial Sequence
  derived and/or modified sequence opt5 from KRTAP5-1__Homo_sapiens__NP_001005922
augggcugcugugggugcagcggaggcuguggguccucuugcggaggcugugggagcggaugcggcggcuguggguccggaugcggcggguguggaucuggcugcgggggaagcggcuccucuuguugcgugcccgucugcuguugcaagccuguuuguugcagagugccgaccuguagcugcuccagcuguggcaaagggggaugcgggucuuccgggggaagcaagggcggguguggaucuugcggcggcuguaaagggggaugcggcuccugcgggggaagcaagggcggguguggcucuugcggaggcuccaaagggggauguggcagcugcgggggauccaagggcggguguggcucuggaugcggcggguguggaagcuccugcugugugcccgucugcuguugcaagccuaugugcuguugcgugcccgccuguagcuguucuuccugcggcaaagggggaugcggcagcugugggugcucuaagggcgcuuguggaagcugcggcggguccaaaggaggcugugggucuugcggaggcugcaagggcggcuguggaagcugcggcggguccaaaggaggcugugggagcggaugcggcggcugugggucuggaugcggcguuccuguguguugcuguuccugcagcucuuguggguccugcgccggaagcaagggcgggugcggauccucuuguagccagugcuccuguugcaagcccuguugcuguucuagcggcugcggcuccagcuguugccaaucuuccuguugcaaaccuugcuguagccagucuuccugcugugucccggugugcugucagugcaagaucuga

SEQ ID NO: 71338 - RNA, 510 nt, Artificial Sequence
  derived and/or modified sequence opt5 from KRTAP5-9__Homo_sapiens__NP_005544
augggcugcugugggugcagcggaggcuguggguccucuugcggaggcugugacagcuccugcgggucuuguggaagcggcugcagaggcugugggcccuccugcugugccccuguguacugcugcaagccggucuguugcuguguucccgcuugcucuuguagcuccugcggaaaacggggcugugggagcugcggaggcucuaaagggggauguggcuccugcggcuguagccagugcucuugcuguaagccuugcuguugcuccagcggguguggaucuuccugcugucaaugcagcuguugcaagcccuauuguucccagugcucuugcuguaaaccuugcuguagcuccagcggccgcgggucuuccugcugucagagcucuugcuguaagcccugcuguagcuccucuggaugcggcagcuccuguugccagagcucuugcuguaagccuugcuguucccaaagcagaugcugugugccggugugcuaccaguguaaaaucuga

SEQ ID NO: 71339 - RNA, 2787 nt, Artificial Sequence
  derived and/or modified sequence opt5 from KSR1__Homo_sapiens__XP_006722214
auggacagagccgcucugcgggccgcggcuaugggcgagaagaaagaagggggaggcgggggagaugccgccgcugccgagggcggggcuggagccgcggccagccgcgcucuccagcaaugcggccagcugcagaagcugaucgacauuuccaucggcucucugagagggcuccggaccaaaugugccgugagcaacgaucugacacagcaagaaauucgcacgcuugaggcuaagcuggucagauacaucugcaaacagcggcaguguaagcucuccguugcccccggagaacgcaccccugagcuuaauucuuauccgagauucagcgacuggcuguacacauuuaacgugcggcccgaggugguccaggaaauuccucgcgaucucacccuggacgcgcuucuggagaugaaugaagccaaggugaaagagacacucagacggugcggcgcuuccggggaugaguguggacgccugcaauaugcccuuaccugccugagaaagguuacaggccucgggggagaacacaaagaggacucuagcugguccagccuggaugcucggcgcgaaucuggcuccggccccagcaccgacacgcugucugccgccucccucccuuggcccccugggagcucucagcugggacgcgcuggcaacuccgcgcaggggccgcggagcaucuccgugucugcccuucccgcuagcgauuccccuacccccagcuucucugagggacuguccgacacauguaucccucuccaugccagcggcagacugacccccagagcccuucacucuuuuauuacaccgccuaccacgccccagcugcggagacauacaaagcucaaaccuccccgcacacccccuccgcccagccggaaggucuuccaacugcugccuuccuuucccacccucaccagaucuaagagccacgaaucccagcuggggaaucgcaucgaugacgugagcucuaugcgguucgaccuuucccauggaagcccucagaugguuagacgcgauauuggccugucugugacccaccgguuuuccacaaaaagcuggcucucccaagucugccacgugugucagaagucuaugaucuucggcgugaaaugcaagcauuguagacugaaaugccacaacaagugcacgaaagaggcucccgccugucgcauuagcuuucuuccgcugacccggcucagacggacagaguccgucccuucugacaucaauaaccccguugaucgcgcggcugaaccucauuucgggacccugcccaaggcccugacaaagaaagagcacccucccgccaugaaucaccucgacagcuccagcaacccgucuuccaccacgagcucuacaccuuccagccccgcucccuuuccuaccucuagcaauccguccagcgccaccacacccccuaaccccucuccuggacagagagauucccgguucaauuuucccgcugccuacuucauucaucacagacagcaauucaucuuuccugacaucagcgcguucgcccaugcugcuccccugccggaagccgccgauggcacccgccuugacgaucagccuaaggcggacgugcuggaggcccacgaagcugaggccgaggaacccgaggcugggaaauccgaagccgaggaugacgaagacgagguggaugaccucccuucuagccggagacccuggcgcggaccgauuuccagaaaggccucucagacaagcgucuaucugcaggagugggauaucccuuuugaacaaguggagcugggcgaacccauugggcagggccgguggggacgcguucauagaggccgguggcacggggagguggcuauccgccuucucgagauggacggacacaaccaggaucaucugaaacuguucaagaaggaagucaugaauuacagacagacgcggcacgagaacgugguucucuuuaugggcgcgugcaugaacccuccccaucuggccauuaucaccuccuucuguaaagggcgcacacuucacucuuuugugagagaccccaagaccagccuggauaucaauaaaacacggcaaauugcucaggaaaucauuaagggaaugggcuaucuccacgccaaagggaucguccauaaggaccugaaguccaaaaacguguucuacgauaauggcaaggucgugauuaccgacuuuggacuguucggcaucagcgggguugugcgcgagggaagacgggaaaaccagcuuaaacucucucacgauuggcugugcuaccuggccccugagaucgucagagagaugacgccgggcaaggacgaagaucagcuccccuuuuccaaagcugccgacguguaugcguucgggaccguuugguacgagcugcaagcucgcgacuggccucuuaagaaucaggccgccgaagcuagcauuuggcagaucggaucuggcgaggggaugaagcgggugcugacauccgucagccucggcaaagaagugucugagauucuguccgccuguugggcguuugaucugcaagagagacccagcuucucccuucucauggacaugcuggaaaagcugccuaaacucaaccgccggcugagccaucccggacacuucuggaagucugcugauagauggcgcagccgguauuacggcaaagggagauauggacauccugacuuuaaguccucuugcccgauccuugaggaauacauuaauagcuccaaagugguuccccgcuucgagcgguuuggccuggggguccucgaaucuagcaacccuaagauguga

SEQ ID NO: 71340 - RNA, 2766 nt, Artificial Sequence
  derived and/or modified sequence opt5 from KSR2__Homo_sapiens__NP_775869
augaucgaccugagcauuuccaaccucgagggccugagaaccaagugcgccacaucuaaugaucuuacgcagaaagaaauccggacccuggagagcaagcucgugaaauacuucucccgccaacugucuuguaagaaaaaggucgcccuucaggaaagaaacgcugagcuggacggguuuccccagcuccggcacugguuccgcauuguugaugugagaaaggaagugcuggaggagaucagcccuggacagcugucccucgaagaccugcuugagaugacagaugaacaagucugcgagaccguggagaaauauggcgcgaaucgggaagagugugcucgccugaacgccucucucagcugccugagaaauguucauauguccgggggaaaccuuagcaagcaggacuggacaauucaguggccgaccacagaaaccggcaaagagaauaaccccguguguccucccgaaccuacgcccuggauccggacccaccugucucaguccccucgcgucccgagcaagugcgugcaacauuacugucacacaucucccaccccuggggcccccguuuauacacauguggauagacucaccgucgacgcuuacccuggacugugucccccgccuccccuggaguccggccaccggagccucccucccucuccccgccagagacacgccgugcggacgccuccgcgcacacccaauaucgugaccacagucaccccucccggcaccccucccaugagaaagaagaacaagcugaaaccgccugggacacccccucccuccagccggaaacuuauucaucugaucccuggauuuacggcucuccacagauccaaaucucaugaguuccagcugggccaccgcguugaugaagcccacacccccaaggcgaaaaagaaaagcaagccgcuuaaucugaagauucauuccagcguggggucuugcgagaacaucccuucccagcaacggagcccccuccugucugaaagaagccugcgcuccuuuuucgugggacacgcccccuuucucccuucuacaccgcccguccauaccgaggcuaauuucagcgccaacacacuguccgugccucgguggagcccccagauuccuagacgcgaccuuggcaauucuaucaaacaccgguuuuccaccaaguauuggaugagccagacgugcacaguuugugggaaaggaaugcuguucggccucaagugcaaaaacugcaagcugaagugucauaacaaaugcaccaaggaagcucccccuugucaccuucugauuauccacagaggcgaucccgcccgccucgugcggaccgagucugucccgugcgacaucaauaacccucugagaaaacccccucgcuacuccgaucugcauauuagccaaacacuccccaagaccaauaaaaucaacaaggaccacauuccggugccuuaucagcccgacuccucuagcaauccuuccucuacaacgagcuccacccccagcucucccgcgccuccgcugcccccuuccgccacacccccuagcccccuucauccuucuccgcaguguacccggcagcaaaagaacuuuaaucugcccgcuucccacuacuacaaauauaagcagcaguucaucuuuccugauguugugcccgucccugagacacccaccagagccccucaggugauucuccacccggucacgagcaaccccauccuggaagggaauccccugcuucaaaucgagguggaaccuaccucugagaacgaagagguucaugacgaggcugaagagagcgaagaugacuucgaggagaugaaucucucccugcugagcgcccggucuuucccccgcaaagccucccagacaagcauuuuucuccaggaaugggauaucccuuucgagcagcuggaaauuggagagcuuaucggcaaggggagauuuggacaaguguaccacggccgguggcauggggaagucgcuauuagacugaucgacaucgagcgcgauaacgaggaccagcucaaagcguucaagcgggaagugauggccuauagacagacccgccacgagaauguugugcuguuuaugggagcuugcauguccccgccccaucuggccauuaucacaucucuuuguaagggcagaacccucuacagcgucgugcgggaugccaaaauugugcuggacguuaacaagacgcgccagaucgcucaagaaauugucaaaggcaugggguaucugcacgccaagggaauccuccacaaagaucugaaguccaaaaauguguucuacgacaacggcaagguggucauuacagacuuugggcuuuucucuaucagcggagugcugcaggcgggcagacgggaggauaagcuccgcauccagaacggguggcugugccaucuggcuccugaaauuaucagacaacuuucccccgacaccgaggaggauaaacucccuuuuucuaagcacagcgacguuuucgcccugggcacaauuugguaugaacugcaugcccgggaguggcccuuuaaaacccagccggcugaagccaucauuuggcagaugggaaccggcaugaagccuaaucucucccagaucgggaugggaaaagagaucagcgauauucugcuuuucuguugggcuuuugaacaagaggagcgccccacauucacgaagcugauggacaugcucgaaaagcugccuaaaagaaaccggcgccugucucaccccggccauuucuggaaguccgccgagcuuuga

SEQ ID NO: 71341 - RNA, 4074 nt, Artificial Sequence
  derived and/or modified sequence opt5 from KTN1__Homo_sapiens__NP_001072989
auggaguucuacgaaagcgccuauuuuaucgugcugauucccuccaucgucauuaccguuaucuuccucuuuuucuggcuguuuaugaaggagacacuuuacgacgaagugcuggcuaaacagaagagagagcaaaaacucauuccuacgaagaccgauaaaaagaaggccgaaaagaagaaaaacaagaaaaaggagauccagaauggcaaccugcacgagucugacagcgaauccgugccgcgggauuucaaacuuucugacgcgcuggcugucgaggaugaccagguggcccccguuccucucaauguggucgaaacaagcuccucugugcgcgagagaaagaagaaagagaagaaacagaagcccguucuggaggagcaagugaucaaagaaagcgaugccuccaagauuccugggaagaaagucgagcccgugccugugaccaagcagccgacacccccuagcgaagcugccgcuucuaaaaagaaacccggacagaagaaguccaaaaacggcagcgacgaucaggacaagaaagucgagacccugaugguuccuucuaagcggcaagaggcccucccccugcaucaggaaacaaaacaggaguccgggagcggaaagaagaaagcgucuuccaagaaacagaagaccgaaaauguguuuguggaugagccgcuuauccacgccacgaccuauauuccucugauggacaacgcugauagcucccccgucguggacaaacgcgaaguuaucgaccuccugaagccugaucaaguggagggcauucagaagucugggacaaagaaacuuaaaaccgagacagacaaggaaaaugccgaggucaaauucaaggauuuucugcucagccugaaaaccaugauguucuccgaagacgaggcucugugcgugguugaucuccugaaggaaaagagcggagugauccaggacgcccuuaaaaagucuuccaaaggcgagcugacgacacucauucaucaacugcaggagaaggauaaacuucuggcggccgucaaggaagacgcugccgcuaccaaggauagauguaaacagcucacacaggagaugaugaccgaaaaggagcggagcaacguggucaucacccgcaugaaagacagaaucggcacacuggagaaggaacacaauguguuucaaaacaaaauucauguuucuuaccaggagacgcagcagaugcaaaugaaguuccaacaggugcgggaacagauggaggccgaaaucgcccaccugaagcaggagaaugggauucuccgcgaugcugucagcaacaccacaaaucagcuggaguccaaacagucugcggaacuuaacaagcugagacaggacuaugcccggcucgugaaugagcugaccgaaaagacaggaaaacuucaacaggaggaaguucagaaaaagaacgcugagcaagccgccacccagcugaaggugcagcuccaggaggcugaacgcagaugggaggaaguccaaagcuacauccggaaacgcacggccgagcacgaagcggcucagcaggaccugcaguccaaguuuguggccaaagagaacgaggugcaaagccugcauucuaagcucacagauacccugguuuccaaacagcagcuugaacagagacugaugcaacucauggagagcgaacagaagcgggucaauaaagaggagucucugcagaugcaagugcaggacauucuggaacagaacgaggcccuuaaggcucagauccaacaguuccacucccagaucgccgcucagaccagcgccuccgugcucgcggaggaacugcauaaggucauugccgaaaaagauaagcaaaucaaacagacagaggacucucuggcuagcgagagagaucgccucaccuccaaggaagaggaacugaaagacauucagaauaugaacuuccuucugaaggccgaggugcagaagcuccaagcucuggccaaugaacaggcggccgcugcccacgagcuggagaaaaugcagcagucuguuuaugugaaggaugacaaaauccggcuucucgaggaacaacugcagcacgaaauuagcaacaagauggaggaauuuaaaauccugaaugaucagaacaaggcucucaaguccgagguccaaaaacugcagacacuugugagcgagcagcccaauaaggacguuguggaacagauggagaaaugcauccaagaaaaggaugagaaacugaagacggucgaggaacuccuggagaccggccugauucagguggccacaaaggaagaggaacuuaacgccaucagaaccgaaaauucuucccucacaaaagagguucaggaccugaaggcuaaacagaacgaucaagugagcuucgcgucucuggucgaggaacucaagaaagugauucaugaaaaggacgggaagaucaaauccguggaggaacugcuugaggccgagcugcucaaggucgcuaauaaagaaaagaccguucaggaccugaaacaggagauuaaggcccugaaagaagagaucggaaacgugcagcuugaaaaggcccaacagcucagcauuacgucuaaggugcaggagcugcaaaaucugcucaaaggcaaggaggaacagaugaacaccaugaaagcuguccuggaggaaaaggagaaagaucuugccaacacagggaaguggcugcaggaccuccaggaggaaaaugagagccugaaggcgcacgugcaagaaguugcucagcauaaccugaaagaggccuccagcgccucucaguuugaggaacuugagaucgugcugaaggaaaaagagaaugaacucaagcgccuggaggcuaugcucaaagaacgggaguccgaucugagcuccaagacccagcuucugcaagacguccaggaugagaacaaacucuucaaaucucagaucgaacagcugaagcaacagaauuaccagcaggccagcuccuuucccccucacgaggaacugcuuaaagugauuucugagagagaaaaggagaucagcggacuguggaacgagcucgacucccugaaagaugcgguugaacaucaacgcaagaagaauaacgaccuccgggagaaaaauugggaagcuauggaggcccuggccucuacagagaagaugcuucaggauaaagugaacaagaccagcaaagaaagacagcaacaggucgaggcuguggaacuggaggccaaggaaguucucaaaaagcuguucccgaagguguccguccccagcaaucugucuuacggcgaguggcuucacggcuuugagaaaaaggcuaaagaauguauggccgggacguccggaagcgaggaagugaaggugcuggagcacaaacucaaggaagcggacgagaugcauacacugcuccagcuggagugcgaaaaguauaaaucuguccuugccgagaccgaaggcauucugcagaagcugcaacgcuccguugagcaggaagagaacaaauggaaggugaaaguggaugagagccacaagacaaucaagcagaugcagucuuccuucaccagcuccgaacaagagcucgaacggcugagaagcgagaauaaagacauugagaaccuucgccgggaaagagagcaucuggaaauggagcucgaaaaggcugagauggagcggucuaccuacgucacagaagugcgcgagcugaaagaucuccugacggaacuucagaagaaacuggacgacagcuauuccgaggccguuagacagaaugaggaacugaaccuccugaaggcucagcuuaacgagacccugacaaagcuccggaccgaacaaaaugagagacagaaaguggccggggaucugcacaaggcccagcaaucucucgaacugauccagagcaaaaucgucaaggcugcgggagacacaaccgugauugagaacuccgauguuucuccugaaacggagagcuccgagaaagaaacaaugucugugagccuuaaucagaccgucacccagcugcaacagcugcuccaggccgugaaccagcaacugacaaaggagaaagaacacuaccagguccuugaguga

SEQ ID NO: 71342 - RNA, 924 nt, Artificial Sequence
  derived and/or modified sequence opt5 from KYNU__Homo_sapiens__NP_001028170
auggagcccagcucccuggaacucccugccgacaccgugcagagaaucgcugccgagcugaagugccacccgacagaugaacgggucgcgcuucaucuggacgaggaagauaaacuccgccacuucagagaguguuuuuacauucccaagauccaagaccugccucccguugaucuuucucuggugaacaaagacgagaaugcuauuuauuuccucggcaacagccuggggcugcagccuaagauggugaaaacguaccucgaagaggaacuggauaagugggccaagaucgccgcuuauggacaugaggucggcaaacggcccuggauuaccggggacgaguccaucgugggacuuaugaaggauaucguuggcgccaaugaaaaagagauugcucugaugaacgcccucacagugaaucugcaccuucugaugcucagcuuuuucaagccuaccccgaaacgcuacaagauccugcuggaagcgaaggccuuucccucugaccauuaugcuauugagucccagcuccagcugcacgggcuuaacaucgaagagucuaugagaaugauuaaaccucgggagggagaagagacacugcgcaucgaagauauucucgaggucaucgaaaaggagggcgacagcaucgccgugauucuguucuccggcguucacuuuuacaccgggcaacauuucaauauccccgcuauuacaaaagccggacaggcgaagggcugcuaugugggguuugaucuugcccacgcugucggaaacguggagcuguaccuccaugacuggggcguggacuucgccuguuggugcagcuacaaauaucugaaugcuggggccggaggcaucgccggcgcuuuuauucacgaaaagcacgcgcauaccaucaaaccugccagaucugaguucuuuaacuga

SEQ ID NO: 71343 - RNA, 3774 nt, Artificial Sequence
  derived and/or modified sequence opt5 from L1CAM__Homo_sapiens__NP_000416
augguggucgcccugagauacguuuggccccuccugcuuugcagcccuugucugcucauccagauuccggaggaauaugagggccaccaugugauggaacccccugugaucaccgagcaaucuccccggcgccuggucguguucccuacagacgauauuucccuuaagugcgaagcuagcgggaaacccgagguucaguuuagauggacgcgggacggagugcacuucaagccuaaagaggaacugggcgucaccguguaccaguccccgcauucugggagcuuuacaaucaccggaaacaauuccaacuucgcccagcgcuuucaaggcauuuauagauguuucgcgucuaauaagcucgggacagcuaugagccacgagauccggcugauggccgaaggagcccccaaauggccuaaggagaccguuaagcccguggaggucgaagagggcgaauccguggugcugccuugcaaucccccgccuagcgcugagccccuccgcaucuacuggaugaacucuaaaauucugcauaucaagcaggaugaaagagucacaaugggccagaacgggaaucuuuauuuugccaacguucugaccuccgacaaucacagcgauuacauuugucacgcucauuucccuggaacgcggaccaucauucagaaagagcccaucgaccuccgcgugaaggccacaaacucuaugauugauagaaaaccccggcugcuuuuuccuaccaauuccagcucucaccugguggcgcuccaaggccagccgcugguccuggagugcaucgccgaaggguuccccacaccuaccaucaaguggcuccgccccuccggaccuaugcccgcugacagagugacguaucagaaccauaauaagacacugcagcuucugaaaguuggcgaggaagaugacggggaguaccggugucucgccgaaaacagccugggauccgcucgccacgccuacuaugugaccgucgaggcggccccguacuggcuucacaagccucaaucucaucuguauggccccggcgagacagcuagacucgauugccaggugcaggggcggccucaacccgaaguuaccuggagaauuaauggaaucccuguggaggaacuggccaaagaccagaaguaccgcauucagcggggcgcucugauccucagcaacguccagcccuccgauaccauggugacacaaugugaggccagaaaccgccacgggcugcuucuggccaaugcuuauauuuacgucgugcagcucccggcgaaaauccugacggccgacaaccagaccuauauggcuguucagggaagcacagccuaccuucugugcaaggccuuuggcgcuccugugcccucuguccaauggcucgacgaagaugggaccacagugcugcaggacgagcgguucuuucccuacgccaauggaacccugggcaucagagaucuccaggcgaacgacacgggccgcuauuucugucuggcugccaaugaucagaacaauguuacaauuauggccaaccuuaaagugaaggacgcuacccaaaucacccaggggccucgguccacaauugagaagaaaggaagcagagucaccuucacaugccaggccucuuuugauccgagccugcagcccuccaucacguggcgcggcgacgggcgggaucuccaagaacugggagacucugauaaguacuucauugaggacggcagacuggugauccauagccuugacuauuccgaucaggggaauuacagcugcguggcuucuaccgaacucgacguugucgagucccgcgcccagcugcugguggugggcagcccuggacccgucccucggcucgugcugucugaucuucaccuucucacacaaucccagguuagagugagcuggucccccgcggaggaccauaacgccccuaucgaaaaauaugauauugaguuugaagacaaggagauggcucccgaaaaaugguacucucugggcaaggucccggggaaucagaccagcacaacccugaagcuguccccuuaugugcacuacacguuccggguuaccgccaucaacaaauacggacccggcgagccuucucccgugagcgagacagucgugaccccggaagcugccccugagaagaaucccguugaugugaaaggggaaggaaacgagacaaccaauauggucauuacguggaagccucuccgcuggauggacuggaacgcgccccaggugcaauauagagugcaguggcggccccagggcacaagagggccuuggcaggaacaaaucgucuccgauccguuucugguugugagcaacaccucuacauucgugcccuacgagauuaaaguccaggccguuaauucccagggcaagggaccugagccccaggugaccaucggcuauagcggggaagacuacccucaagcuauucccgagcuggaaggaaucgagauccucaacucuuccgccgugcuggucaaguggcgcccuguggaucuugcucagguuaaaggccaucugcggggguauaaugugaccuacuggagagaaggaagccagcgcaagcacucuaaaagacacauucauaaggaccacgucgugguuccggccaacacaacgagcgugauccucuccggccugcggcccuauagcucuuaccaccuggagguccaagccuuuaaugggcgcggcuccggaccugcuagcgaguucaccuuuuccacacccgaaggcgugccugggcaucccgaggcgcuucaccucgaaugucagucuaacaccagccugcugcucagauggcagccgccucugucccauaauggagugcuuacaggcuacguccugucuuaucacccccucgaugaagggggaaaaggccagcugagcuucaaccugcgggaccccgagcuucgcacccauaaucucacggaccuguccccucaccugagauaccgguuucaacuccaggccacaaccaaggaggggcccggcgaggcuauuguucgcgaaggaggcaccauggcccugucugggaucagcgauuucggaaacauuuccgccacagcuggcgagaauuauagcguggugucuugggucccuaaggaagggcagugcaacuuuagauuccacauccuuuucaaagcccugggagaggagaagggcggcgcgucccucagcccgcaguacgugucuuauaaucaauccagcuacacccagugggaccugcagcccgauacagacuaugaaauccaucuguuuaaagagcggauguuccgccaccagauggcuguuaagacgaacgggaccggaagagugcggcuuccucccgccggcuuugccacagaagggugguucauuggauuugucucugcuaucauucugcuccugcucgugcugcuuauccuguguuucauuaaaagauccaagggcgggaaauacagcguuaaggauaaggaggacacccaaguggauuccgaagcccgcccuaugaaagacgagacauuuggagaguaccggagccucgaaucugauaaugaggaaaaggcguucggcagcucccagcccucucugaacggcgacaucaaaccgcuggggagcgaugacucccuugcugauuauggaggcucugucgacgugcaguuuaacgaggacgggagcuucaucggacaguacuccggcaagaaagaaaaggaggccgccgggggaaaugauucuagcggcgcuaccuccccuauuaaccccgccgucgcucuggaguga

SEQ ID NO: 71344 - RNA, 1392 nt, Artificial Sequence
  derived and/or modified sequence opt5 from L2HGDH__Homo_sapiens__XP_005268132
auggugcccgcccugagauaccucgucggcgcuugcgggcgggcccgcggacuguucgcgggcgggagcccuggagcuuguggcuuugccuccgggagaccgcggccccuuugcggaggcucucgcagcgccuccaccucuagcuucgacaucguuauugugggcgggggaaucgugggccuggcuuccgccagagcucucauucugcggcacccuucucuuagcaucgggguccuggagaaggaaaaagaucucgccgugcaucagacaggacacaacuccggcguuauucauagcgggaucuauuacaagcccgagucucugaaagcgaagcugugugugcaaggagccgcucuccuguaugaauacugccagcagaaaggcaucuccuauaagcaguguggcaaacuuauugucgccguggagcaagaagagaucccucgccugcaggcucucuacgagaaggggcugcagaauggaguucccggccuuagacugauucagcaagaagacaucaagaaaaaggagccuuauugccgggggcucauggccauugauuguccgcacacgggaaucguggacuaccgccaggucgcgcugagcuuugcccaggauuuccaggaagcuggcgggucugugcugaccaacuuugaggugaaaggaauugagauggccaaggaaucccccagcagaucuaucgacggcaugcaauacccuaucgucauuaagaauacaaaaggcgaggaaauccggugccaguauguugugaccugugcugggcucuacuccgaucgcauuagcgagcuguccggaugcacacccgacccuagaaucgugcccuuccggggcgauuaucuucugcucaagccggaaaaauguuaccuggucaaggggaacauuuauccugugcccgacucucgcuuuccuuuccuuggaguucauuuuacccccagaauggauggcagcaucuggcuggggcccaaugccgugcucgccuucaaacgggagggcuacagaccuuuugacuucuccgcuacagaugucauggacaucauuaucaacagcggacugauuaagcuggcgucucagaauuuuuccuauggcgugaccgagauguacaaagccugcuuccucggggcuacgguuaaguaccugcaaaaguucaucccggaaauuaccaucagcgacauccuucgcggacccgccggcgugcgggcccaggcucuggauagagacgggaaccucgucgaggauuuuguguucgacgccggagucggcgauauugggaaucgcauccugcacgugcggaacgcgccuucucccgcugccacaagcuccauugccaucucuggcaugauugcugacgaaguucagcagagauuugagcuuuga

SEQ ID NO: 71345 - RNA, 2319 nt, Artificial Sequence
  derived and/or modified sequence opt5 from L3MBTL1__Homo_sapiens__NP_056293
augagacggcgcgagggccacgggaccgacagcgaaaugggacagggccccgugagagagucccaaucuagcgauccuccggcccugcaguuccggaucuccgaauacaagccccucaacauggcuggggucgagcagccucccucuccugaacugcgccaggagggaguuacagaguaugaagacggcggggcccccgcgggagauggcgaggcuggcccucaacaggccgaagaccauccgcagaaucccccugaggaucccaaccaggacccucccgaggaugacagcacgugccaaugucaggccugcgggccgcaccaggcugccggaccugaucuuggcuccucuaaugacggguguccccagcuguuucaagaaagaagcgugauuguggagaacuccagcggaucuaccuccgcuagcgaacuccugaaaccuaugaagaaacggaagcgcagagaguaccagucucccuccgaagaggagagcgaacccgaggccauggaaaaacaggaggaaggcaaggauccugaggggcaaccgacagcgucuacccccgaguccgaagaguggagcuccucucagccugccacaggagaaaagaaagagugcuggagcugggaauccuaucuugaggagcagaaggcuaucaccgcccccgucagccuguuccaggacucucaagcugugacacauaauaaaaacggcuuuaagcucggcaugaaacuggaagggauugauccucagcaccccuccauguacuucauccugaccguugccgagguguguggauaucggcuccgccugcauuuugacggcuacagcgaaugccacgacuucugggucaaugcgaacucuccggauauucacccugccgggugguuugagaagacgggacauaagcuccagcccccuaaaggcuauaaggaggaagaguucagcuggucccaguaccugagaucuacccgggcucaagccgcucccaaacaccucuuugugagccagucccauagcccucccccgcugggguuccagguuggaaugaaacuugaagccguggaccgcaugaauccuucucuggucuguguggccuccgugacagaugucguugacagcagauuucucgugcacuucgauaacugggacgauaccuacgacuauuggugcgaucccucuucccccuacauccacccugugggcuggugucagaagcaaggcaagccgcugacacccccucaggacuaucccgauccugacaauuuuugcugggagaaauaccuggaagagaccggggcuagcgcgguccccacgugggccuucaaggugcggccuccccauuccuuccucguuaacaugaagcuggaggcuguggaccgcagaaauccggcccuuauccgggucgccucuguggaagauguugaggaccacagaauuaaaauccauuuugauggauggagccacggcuaugacuucuggauugaugcugaccauccugauauccaccccgccgggugguguuccaagacaggacacccucugcagcccccgcucggcccucgcgaacccucuagcgcguccccugggggcugcccuccccugagcuaccggucucuuccccauaccagaacauccaaauauagcuuucaccaucgcaagugcccgacccccggaugugacggcucugggcacgugaccggaaaauucacagcucaccauugccuguccggcuguccucucgccgagcggaaccagagcagacugaaggccgaacugucugauagcgaggcuuccgcccgcaagaaaaaucucagcggguuuucuccccggaagaaaccuagacaccauggacgcauuggccggcccccuaaguacagaaaaaucccgcaagaggacuuccagacgcugacccccgaugucgugcaccagucccuuuuuaugagcgcucuguccgcccauccugaccgcucucucagcgucugcugggaacaacacuguaagcugcuucccgggguggcgggcauuuccgccucuacaguugcuaaguggaccaucgaugagguguucggauuuguccagacacugaccggcugcgaagaccaggcccggcuuuucaaagacgaggcuagaaucgugcggguuacgcacgugagcgggaagacacuggucuggaccguggcccagcugggagaucucguguguuccgaccaucugcaagaaggcaaagggauucuugagaccggaguucacucucugcucugcagccugccuacacaucugcuugcgaagcucuccuuugccagcgauucucaguacuga

SEQ ID NO: 71346 - RNA, 2118 nt, Artificial Sequence
  derived and/or modified sequence opt5 from L3MBTL2__Homo_sapiens__NP_113676
auggagaagcccagaagcaucgaagagaccccuuccucugaaccgauggaggaagaggaggacgaugaccuggaacucuucggcggguacgauagcuuucgguccuauaacucuagcgugggauccgagucuagcuccuaccuggaagagagcucugaggccgaaaaugaggaccgcgaagcuggcgagcuucccacauccccucugcaccuccugagccccgggacgccuagaucucuugauggauccggcagcgaacccgccgucugcgagaugugugggauuguuggaacccgggaggcguucuuuucuaaaacaaagcgcuucugcuccgugagcuguuccagaucuuauagcuccaacagcaaaaaggcuucuauccuggcccggcuccagggcaaaccuccgaccaagaaggccaaagugcugcauaaggcugccugguccgcuaaaauuggcgccuuucugcacagccaagggacaggacagcucgcggacggcacccccacagggcaggaugcccugguccuuggauucgacuggggcaaguuucugaaagaucauucuuacaaggcugccccugugagcugcuucaagcacguuccccucuaugaccagugggaagaugugaugaaagggaugaaggucgaggugcuuaauuccgacgcuguucugccuucucgcguguacuggaucgccagcgucauucaaaccgcgggauauagagugcugcuccgguacgaaggcuuugagaacgaugccucccaugacuucugguguaaucugggcacgguggacguccaccccaucggguggugcgcuaucaacagcaaaauucugguuccgccucgcaccauccacgccaaguuuacagauuggaaaggauaccucaugaagagacuggugggcucucggacccuucccguggacuuccauauuaaaauggucgaauccaugaaguauccuuuucgccaggggaugagacuggaggugguugauaagagccaggugucucggacacgcauggcugucguggacaccguuaucggaggcagacuccggcugcuuuacgaggauggggacuccgaugacgauuucuggugucacauguggagcccccugauucaucccgugggaugguccagacgcgucggccacggcaucaaaaugucugaacggagaagcgacauggcccaccauccuacguuccgcaagauuuauugcgaugccgugccguaccucuuuaaaaagguccgggcuguguauacagaagggggaugguucgaagagggcaugaaacuggaagcgaucgacccccugaaucucgggaacaucuguguugccaccgugugcaagguccugcuugacggauaccugaugauuuguguggauggcgggccuuccacagacggccucgauugguuuugcuaucacgcuucuagccaugccaucuuccccgccaccuuuugccagaagaaugacauugagcugaccccucccaaaggauacgaggcucaaacauucaacugggaaaauuaccuugagaagacgaaauccaaggccgcgccgagcagacuguuuaacauggauuguccuaaucacggcuucaaaguugggaugaagcucgaagcuguggaccugauggagccccgccugaucugcgucgccaccgugaagcgggugguucauagacuccugucuauucacuuugauggaugggacuccgaguaugaucagugggucgacugugaaagcccugauaucuaccccgugggcuggugcgagcuuacaggguaucagcugcagccucccguggccgcugaaccggccaccccucucaaagcuaaggaggccaccaaaaagaaaaagaagcaauucggcaaaaagcgcaaacggaucccucccacaaagacgagaccccugcgccagggaucuaaaaagccgcugcuugaagacgauccccagggggcgcggaaaauuuccagcgagccuguccccggcgagaucauugccgugagaguuaaggaggagcaccucgacguggcuucuccugacaaggccagcucccccgaacugccugucagcguggagaacaucaaacaagaaacagaugacuga

SEQ ID NO: 71347 - RNA, 2268 nt, Artificial Sequence
  derived and/or modified sequence opt5 from L3MBTL3__Homo_sapiens__NP_001007103
augaccgagagcgccuccucuacaagcggccaggaguucgacguguuuuccgucauggauuggaaggacgggguuggaacgcugcccggcucugaucucaaauucagagugaacgaauuuggggcucuggaagugaucaccgacgagaaugaaauggagaacgucaagaaagccacagcgaccacaaccuggauggugccuacagcucaagagguuuucagcgaaaagaccggaaugccguuucggcuuaaagaucccgugaaggucgagggccugcaguucugcgaaaauuguugccaguacgggaacguggacgagugucucuccggaggcaauuauugcucucagaacugugcccgccacauuaaggauaaagaccaaaaggaggaaagagauguugaggaagacaaugaggaagaggauccuaaaugcagccggaagaaaaagcccaagcugucccuuaaagccgacacgaaggaggauggcgaggaacgcgacgacgaaauggagaacaaacaggaugugagaauccugcgggggagccagcgcgcuagacggaagcgcagaggagacucugccguccucaaacagggccugccucccaaggggaaaaaggcuugguguugggccuccuaccuggaagaggagaaggcgguggccgugccugcuaaacucuuuaaggaacaucagagcuucccguauaauaaaaacggauuuaaggucggcaugaaacuggaggggguugaucccgaacaccaaucuguguacugcgugcuuaccgucgccgagguguguggauaucggauuaagcugcauuucgacggcuacuccgauugcuaugacuuuuggguuaaugcugaugcccucgacauccacccugugggcuggugugaaaagacagggcauaaacugcaucccccuaagggauacaaagaggaggaguucaacuggcagaccuaccuuaagacaugcaaagcgcaggccgcucccaagagccuguuugaaaaucaaaacauuaccgucaucccgucuggcuuccgcguggggaugaagcucgaagccguugauaaaaagaauccuuccuucaucugcguggcuacggucacagacaugguggauaacagauuucugguccacuucgacaacugggacgagagcuaugauuacuggugugaggccuccucuccccacauucacccugugggauggugcaaagaacaucggcgcacccugaucacaccucccggcuaucccaauguuaagcacuuuagcugggacaaauaccucgaggaaaccaacucccugccggcccccgcuagagcguucaaggugaagccuccccacggguuucagaaaaagaugaaacuugaggucguggauaagcggaauccuauguucauuagaguugccaccguggcugacacagaugaccaucgcgucaaagugcacuuugauggauggaacaauuguuaugacuacuggaucgaugccgacagccccgauauucauccggugggcuggugcucuaagacgggccacccucugcagcccccucucagcccccuggaacuuauggaggccagcgagcaugggggauguucuaccccuggcugcaaagggaucggacacuucaagcgggcuagacaccugggcccccauagcgccgcgaacuguccguauuccgaaauuaaucucaacaaggaccgcaucuuuccugaucggcugucuggggagaugccucccgcuagccccuccuucccgagaaauaaacgcacagacgccaacgaauccucuuccagccccgagauccgggaccaacacgccgaugacguuaaggaagauuuugaggagagaaccgaaucugagaugcgcacaucccaugaagcucggggcgccagagaggaaccuaccguccagcaggcucagcgccggagcgccguguuccuguccuuuaaaucucccauuccuugccucccccugagaugggagcaacagagcaaacuucugccuacgguggcgggaauccccgccuccaaggucucuaaguggagcacagacgagguguccgaguucauucagagccucccgggcugugaagaacacgggaagguuuucaaagaugagcagaucgacggagaggcuuuucugcuuaugacccaaaccgauauugugaagaucaugucuaucaaacugggcccugcccucaagauuuucaauuccauccugauguuuaaagcugccgaaaagaacagccacaaugagcuguga

SEQ ID NO: 71348 - RNA, 1872 nt, Artificial Sequence
  derived and/or modified sequence opt5 from L3MBTL4__Homo_sapiens__NP_775735
augaagcagcccaacagaaaacggaagcugaauauggacagcaaagagcgccucgaucaagacggcagacuggaacaggccgaggaagagaagaaaccuaaggauuccaccacaccgcuuucucacgugcccagcgcugccgcgcagggggcuugguccugggaaugguaccugaaggagcagaaagccgucgccgcuccuguugagcuuuucucuaaggaccaaucuuuucccgaacaugagaacggauuccagaucggcaugcggcuggaagggauugauccucgccaccccuccguguuuugcgugcuuucugucgccgagguguguggauauagacugcggcuccauuucgacggcuaccugagcugcuaugauuuuuggacgaaugcuggguccccugacauccacccgguuggauggugugagaaaaccaagcaugaacugcacauucccaaaggcuaccgcaaggauaaguucguguggauggacuaucucaaagccugcaagcugcagaacgcgccuaaaaagcucuuuagaaaucggagccccaacggcccuaugucuaaagaguuccaggucgggaugaagcuggaagccguggaucgcaaaaaucccucccucguuuguguggcuacaaucgccgacauugucgaggauagacugcuugugcacuuugacaacugggacgauagcuacgacuauuggugcgaugugaauagcccguacguccaaccuguuggauggugucaggaaaacggccggacccugaucgcuccccagggguacccuaaucccgagaacuucuccuggacagaguaucucgaagccacccagacaaaugcggugcccgccaagguguuuaagaugcgccugccucauggauuccugccgaacaugaaacucgaggucguggacaagagaaauccccggcugauccgcguugcuaccauuguggaugucgacgaucaaagagugaaaguucacuuugacggcugggaucauaaguacgacuauuggguggaagccgauagcccugacauccaccccauuggguggugcgacgucacgggacacccucuugaggugccccagcggaccaacgaucugaaaauccucccgggccaggcugucuguccuacacccggcugcagagggauuggacauauccgcggcccucgguacucugggcaccauuccgccuucggaugucccuauagcgacaugaaccugaagaaggaagccacccuucacgauagacugcgcgagcaaacacaggcuaaucucgaguccgacucuagccauuccaaaagcaagucucugugcucccugaacuucaauggcaaacacgaaaaggugaacagccagccucggcucguucagcaagcgaaaugccugaagauuaaggggaaagaggauaucgaccuugauaaucuguuuagagugcucguccugcacccccgcggacuugaauacucuguggagcaggcccagcagguucugcaucaaagcguguccaugucuaccgucagcgcucacccguuccgggaccucccucugggcagagaacagcauuguaagcugcuccccggcguggccgauauccgcgccucccagguggcucgguggacgguugacgaggucgccgaguuugugcagagccugcuugggugcgaggaacacgcgaaauguuucaagaaagaacaaauugauggaaaggcuuuucugcuccugacacagaccgacaucgugaaggucaugaaaauuaagcugggccccgcccuuaaaaucuauaacucuauucucauguucagacacucccaggagcugccugaggaagauaucgccagcgggcaggaggugcgcggauga

SEQ ID NO: 71349 - RNA, 1293 nt, Artificial Sequence
  derived and/or modified sequence opt5 from LACC1__Homo_sapiens__XP_006719829
auggccgaggcugugcugaucgaccucuucggccugaaacuuaacagccagaaaaauugccaccaaacccugcucaagacacugaacgccguccaguaccaucacgcggcuaaagccaaguuucuuuguauuaugugcuguuccaauaucucuuaugaaagagauggggagcaggacaacugcgaaauugagacgagcaauggacuguccgcccuccuggaagaguucgagaucguuucuugucccagcauggcugccacccuguacacaauuaaacagaagaucgaugaaaagaaccucuccucuaucaaagugauugugccucggcaucgcaagacccugaugaaggcuuuuaucgaccaacuuuucacagaugucuauaauuuugaguucgaagaccuccaggugaccuuuagaggcgggcuguucaagcagagcauugagaucaacguuauuacagcccaggagcugcggggaauccaaaaugaaauugagaccuuucuucgcucccugccggcgcucagaggcaaacugacgaucaucaccagcucucugauucccgauaucuucauucacggguuuacaacccggacaggaggcaucuccuacauuccuacccucagcucuuucaaccuguuuuccagcucuaagcgcagagaccccaagguggucgugcaggaaaaucuucggcgccuggccaacgcugccggcuucaauguugagaaauucuauagaaucaagacgcaucacuccaacgauaucuggauuauggggcggaaagaaccugacagcuacgauggaaucacaaccaaucagcgcggcgugacaauugcugcccucggggcggacugcauccccauugucuuugccgauccugugaagaaggcuuguggaguggcccacgcuggcuggaaagggacccugcuuggagucgccauggccaccguuaacgcuaugaucgcggaguauggcugcucccuggaggacaucguggugguccucggcccgucuguggggcccuguugcuucacacugccuagagaaagcgccgaggcuuuucauaaccugcaccccgccuguguucaacucuucgacuccccuaaucccugcauugauauccggaaagccacgcgcauucugcuugaacagggaggcauccugccgcagaacauucaggaccaaaaucaggaucucaaccugugcaccagcugucauccugacaaguuuuucucucacgugagagaugggcuuaauuuuggaacacagaucggcuucauuuccaucaaggaguga

SEQ ID NO: 71350 - RNA, 1446 nt, Artificial Sequence
  derived and/or modified sequence opt5 from LACE1__Homo_sapiens__NP_660358
auggccgcuagcuggucccugcucgugacccugagaccccuugcccagucuccucugcggggccgcugcgucggguguggagcgugggcugccgcccucgcuccgcuggccacagcucccggcaagccuuucuggaaagccuacacgguucaaaccagcgaguccaugacacccaccgcgacaucugaaaccuaucuuaaggcccuggcugugugccacgggccucucgaccauuacgauuuucugaucaaagcccacgagcugaaggacgaugaacaucagagacgggugauucagugucuccagaaacugcacgaggaccuuaagggauauaacaucgaagcugagggccuguucagcaagcucuuuucccgcucuaaacccccuagagggcuguacgucuauggagaugugggcacaggcaagaccaugguuauggacauguucuacgccuauguggagaugaaacggaagaaacgcguccauuuucacggguucaugcuugaugugcacaagcggauucauagacugaagcaaagccucccgaaacgcaagcccggauuuauggcgaaauccuacgacccuaucgcccccauugcugaagagaucagcgaagaggccugccugcuguguuucgaugaguuucagguuacggacaucgcugaugccaugauucucaagcagcuguucgaaaaucuuuuuaaaaacggcguggucgugguggccaccucuaauagaccucccgaggaccuguacaagaacgggcuccagcgggcuaauuucgucccguuuaucgcgguucugaaagaauauugcaacacagugcaacuugauuccggaauugacuaccgcaagagagagcugccugccgcuggcaagcucuauuaccugaccagcgaagccgacguggaggccgucauggauaaacuguucgacgagcucgcucagaagcagaaugaucugacacggccccgcauccuuaaagugcaggggagagaacugcggcucaacaaggccuguggaaccguugcggacugcacguucgaggaacugugugagagaccucuuggcgcuucugauuaucuggaacucuccaaaaauuuugacacaauuuuccugcgcaacaucccccaauuuacccuggccaaucggacacagggcagacgcuucauuacccucaucgauaacuuuuacgaccugaaggugcggaucauuugcagcgccucuacccccaucuccagccuuuuccugcaccagcaucacgauuccgagcucgagcaaucucgcauucugauggacgaucuggggcuuagccaggacuccgcugaaggacucagcauguuuacaggcgaggaagagaucuucgccuuucagagaacgauuucucggcugaccgaaaugcagacagagcaauauuggaaugagggggacagaaccaagaaauga

SEQ ID NO: 71351 - RNA, 417 nt, Artificial Sequence
  derived and/or modified sequence opt5 from LACRT__Homo_sapiens__NP_150593
augaaguucaccacacugcucuuucuggccgcuguggccggcgcgcuugucuacgcugaggacgccagcuccgauucuacgggggccgaccccgcucaggaagccggaaccagcaaaccuaacgaggaaaucuccggcccggcugagcccgccucuccucccgaaacaaccacaaccgcgcaagagacaagcgccgcugccguucaggggaccgcuaaggugacguccucuagacaggagcugaauccucucaaaagcauuguggaaaaguccauccugcuuaccgagcaggcccuggcgaaagccggaaagggcaugcacgggggaguccccggcggcaagcaauucauugaaaacgggagcgaguuugcucagaaacuccugaagaaauucucucugcucaagccuugggccuga

SEQ ID NO: 71352 - RNA, 1644 nt, Artificial Sequence
  derived and/or modified sequence opt5 from LACTB__Homo_sapiens__NP_116246
auguacagacugaugagcgccgugaccgcucgggccgcggcucccggcgggcucgccuccucuugcggacgcagaggcguccaccagcgggccgggcugccuccgcuuggacauggcuggguugggggacugggccucggccuggggcuugcucugggagugaagcucgccggcgggcugcgcggagcugcccccgcgcaaagcccugccgcucccgacccugaagccucuccccuggcugaaccuccgcaggagcagucccucgcccccuggagcccucagacacccgcgccucccuguuccagaugcuucgcccgggcuaucgaaucuagccgcgaucugcuucacagaauuaaagacgaggugggcgccccggggaucgucgugggaguuuccguggauggcaaggaagucuggagcgagggccugggguaugcugacguggagaaccggguuccuuguaaacccgaaacggugaugcgcauugccucuaucuccaagagccucaccauggucgcccuggcuaaacuuugggaggcgggaaagcuggaucucgacauuccugugcaacauuacgugcccgaauuucccgagaaggaguaugaaggcgagaaagucucuguuacaaccagacugcugaucucccaccucagcgggauccggcauuacgaaaaggauauuaaaaaggugaaagaggaaaaggccuauaaggcucugaaaaugaugaaggagaauguggccuucgagcaggaaaaagagggaaagucuaacgaaaagaaugacuuuacaaaguucaaaaccgagcaggaaaacgaggccaagugccgcaauuccaagccuggcaaaaagaaaaacgauuuugagcagggggaacuuuaccugagagagaaguucgaaaauagcaucgagucccuccggcuguuuaaaaacgacccgcuuuucuuuaagcccggaucucaauuccuguauagcacauuuggcuacacccuccuggcugccauugucgaacgcgcguccggcuguaaguaccuggauuauaugcagaaaaucuuccacgaccucgauaugcugacgaccgugcaggaggagaaugaaccuguuauuuacaacagagcucgguuuuauguguacaauaagaaaaagagacuugucaacacacccuauguggacaauagcuacaaaugggccgggggaggcuuccugucuaccguuggggaccuccugaaguucggaaacgccaugcuuuauggcuaccagguggggcuguuuaaaaauuccaacgagaaccuccugccuggcuaccugaaacccgaaacaauggucaugauguggaccccggugccuaauacggagaugagcugggauaaggagggaaaauaugcuauggccuggggcgucguggaacgcaagcaaacauacgggucuugccggaaacagagacacuaugcuagccauaccggaggcgccguuggggcguccucugugcuccugguccuucccgaggaacuggacacagagaccaucaacaauaaggugccuccccgcggaauuaucguuagcaucauuuguaacaugcaguccgugggccucaauagcaccgcccugaagaucgcucuggaguucgauaaagaccggucugauuga

SEQ ID NO: 71353 - RNA, 1554 nt, Artificial Sequence
  derived and/or modified sequence opt5 from LAD1__Homo_sapiens__NP_005549
auggccgugagcagaaaggacugguccgcucugucuagccucgcccggcagcgcacccuggaggaugaagaggaacaagagagagaacggcgcagacggcaccgcaaccuuuccucuacaacggacgaugaggcgcccagacugagccagaauggcgaccggcaggcuuccgccucugagcgccucccuagcgucgaagaggccgaaguuccgaaaccccugccucccgcuuccaaggaugaggacgaggauauccagagcauucuuagaacccggcaagaacgcagacagcggcgccaggugguggaggccgcucaggccccuauccaagaaagacuggaggcggaagaggggcggaacucucucucccccguccaggccacacagaaaccucuggugagcaagaaagagcuggaaauuccgcccagacgccggcucucuagagagcagcgcggaccuugggcucuggaagaggaaucccuuguuggccgggagcccgaggaaagaaagaagggggugccugagaaaagccccguccuggaaaagucuuccaugccgaaaaagaccgccccugagaaaagccucguguccgacaagacaucuaucagcgaaaagguucuggcuuccgagaaaaccagccuuucugagaagauugccguguccgaaaaacgcaauagcucugagaagaaaagcguccuggaaaagacauccgugucugagaaaagccucgcgcccggaauggcccugggcuccgggcggagacuggugagcgagaaggcuucuaucuucgaaaaggcccucgcuuccgagaaaagcccuaccgccgaugccaagcccgcucccaaacgcgcgacggccucugaacaaccucuggcucaggagccgcccgccuccggaggcagcccugccaccacaaaggaacagcggggcagagcccuucccgggaaaaaccugccuucccucgcuaagcaaggagcgucugaucccccgaccgucgcuagccgccugccucccguuacacuucaggugaagaucccuuccaaagaggaggaagccgacaugucuagccccacccagcggacguacuccagcucucugaagagauccagcccucggacaauuucuuuucgcaugaaacccaagaaagaaaauuccgagaccacacucaccagaagcgccucuaugaagcugccggacaacaccgugaagcugggcgagaaacucgaacgguaucauacagcuaucagacgcagcgaguccgucaagagccgggggcugccuugcacggagcuuuucguggcccccguuggaguggcuucuaaaagacaccuguuugaaaaggagcucgccggccagucccgcgcggaacccgccagcuccagaaaagagaaucugcggcuuucuggggucgugaccagccgccugaaccucuggauuuccagaacacaagaaucuggagaucaggacccucaggaggcucagaaggccagcuccgcuaccgagcggacacaauggggccagaagucugacagcucccuggaugccgaaguuuga

SEQ ID NO: 71354 - RNA, 1578 nt, Artificial Sequence
  derived and/or modified sequence opt5 from LAG3__Homo_sapiens__NP_002277
augugggaggcccaguuccugggccuccuguuucuucaaccccuguggguggcuccugucaagccgcuccagcccggggccgaaguuccuguggugugggcgcaggagggagcucccgcccagcugccuugcagccccaccaucccucuucaagaccugucccuccugagacgggccggcgucacauggcagcaccagccggauucugggcccccugcugccgcucccggacauccucuggcccccggcccgcacccugcggcccccagcuccugggggccucgccccagacgguacacggugcucucuguuggacccggcggccugcgcagcgggagacuuccucugcagccgcgggugcaacucgacgaacgcggaagacagcggggcgauuucucccuguggcuucgccccgcuagacgggccgacgcuggggaguaucgcgccgcgguccaucugagagaucgggcccucucuugucgccugagacugcggcucggacaggcuagcaugaccgccuccccucccggcagccugagagcuucugacugggugauucuuaacugcuccuuuagccgcccugaucggcccgccucuguucacugguucagaaaucgcgggcagggacgggugccggucagagaauccccucaucaccaccuggccgagagcuuucucuuccugccccaagugucuccuauggacuccggccccuggggcuguauccuuacauaccgcgauggguuuaacgugagcauuauguauaaucugaccguccucggacuggagccucccacaccgcugaccguuuacgcuggcgcggggucccgggugggacucccuugcagacugcccgccggcguggggacacgcucuuuccuuaccgcuaaauggacgcccccuggaggcggcccggaccugcucgucaccggggauaacggagacuuuacacugcggcuugaagaugugagccaggcccaggccggcaccuauacaugucauauccaucugcaagagcagcagcucaaugcuaccguuacgcuggccauuaucacagugacccccaaguccuucgggagcccuggaucucugggcaaacuccugugcgaagucacacccguguccgggcaggagagauuuguuuggagcucucuugacaccccuagccaacgcuccuucucuggccccuggcuggaggcgcaggaagcucagcuccugagccagccuuggcaaugucagcuguaccagggagagcggcuucucggcgccgccguguauuuuaccgaacuguccagccccggggcucagagaucuggacgggccccgggcgcucugccugccgggcaccuccugcuuuuccugauccucggaguccugucccugcuucuccuggugacaggcgcguucggguuucaccuguggcgcagacaauggcggcccagacgcuucagcgcccucgagcagggcauucacccuccccaggcucagucuaagaucgaggaacuggagcaagaaccggagccugaacccgagccugaacccgagcccgagccugaaccggagcccgaacagcuuuga

SEQ ID NO: 71355 - RNA, 843 nt, Artificial Sequence
  derived and/or modified sequence opt5 from LAIR1__Homo_sapiens__NP_001275955
auggagagagaaauggugcugugccucgcccagaccauccacacacaagaggaccugccccggccuagcauuuccgcugaaccgggcacggucaucccccuugggucucauguuaccuucgugugucgcggaccugugggcguccagacauuuagacuggagcgggauagccgcuccaccuacaacgacacagaagaugugucucaggccagccccuccgagucugaggcgagauuccggauugacagcguucgcgaagggaaugcuggacucuauagaugcaucuacuauaagccucccaaaugguccgagcagagcgauuaccuggaacuucuggugaaggagucuuccggcgggccugacagcccggauaccgagcccggaucuuccgccggcccuacacaacggcccagcgacaacucucacaaugaacaugccccugcuucccagggccucaaagccgagcaccuguauauucugaucggggucagcgugguuuuucucuucugucugcuucugcucgugcuguuuugccuucaucgccagaaccagaucaagcaaggacccccgagauccaaagaugaggaacagaagccucagcagcggcccgaccuggcugucgaugugcucgaacgcaccgccgacaaggcgacggugaauggccugccugagaaagauagagagaccgacacaucugcccuggcugccgggagcucccaagaagucaccuacgcucagcucgaccacugggcccugacacagcggaccgcgcgcgccguuagcccccaaucuacgaagcccauggcugaguccauuacauaugccgcuguggccagacacuga

SEQ ID NO: 71356 - RNA, 459 nt, Artificial Sequence
  derived and/or modified sequence opt5 from LAIR2__Homo_sapiens__NP_002279
augagcccccaccugaccgcccuccugggccuugugcugugccucgcucagacaauccauacgcaagagggggcccugccuagaccguccauuucugcggaacccggaaccgucaucagcccuggcucccacguuacauucaugugucgggggcccgugggagugcagaccuuucgccuugagagagaagaccgggcuaaguacaaagauucuuauaacgucuuccgccugggcccuagcgaguccgaagccagauuucauauugacucugugagcgaggggaaugccggacucuaccggugccuguauuacaagcccccuggcugguccgagcacagcgauuuccuggaacuccugguuaaagagucuuccggcgggccggacagccccgauacagaaccuggaucuuccgcuggcaccgugcccgggacagaggccagcggauuugacgcuccuuga

SEQ ID NO: 71357 - RNA, 462 nt, Artificial Sequence
  derived and/or modified sequence opt5 from LALBA__Homo_sapiens__XP_011536644
auggaggaccugcaguuccucggcguggccaagaugagauuuuucgucccccuguuucuuguugggauccuguucccugcuauucucgccaaacaauuuaccaagugcgaacugagccagcuucugaaagauaucgacggauacggcgggauugcgcucccggagcugaucuguacaauguuccacacguccggauaugauacccaggcuauuguggaaaacaaugagucuacagaauacggccuguuucagaucagcaacaagcucuggugcaaauccucucaagugccccagagccggaauaucugugacauuuccugcgauaaguuccuggacgaugacaucaccgaugacauuaugugugccaagaaaauccuugauauuaaggggaucgacuauuggcuggcccauaaagcucucugcacagagaagcuggagcaguggcuuugugaaaaacuguga

SEQ ID NO: 71358 - RNA, 9228 nt, Artificial Sequence
  derived and/or modified sequence opt5 from LAMA1__Homo_sapiens__NP_005550
augagaggaggggugcugcucgugcugcuucugugcguugccgcucaaugucggcaacgcggacucuuccccgccauccugaaccuugcgagcaaugcucacauuuccaccaacgccacaugcggcgaaaaggggccugaaauguuuuguaaacugguggaacacgugccgggaagacccguccggaauccucagugccgcaucugugacggcaacucugccaaucccagagaacggcacccuauuagccaugcuaucgaugggacgaacaauugguggcagucccccucuauucagaacggacgcgaauaccacugggugaccaucacacucgaccugagacaaguuuuccagguggccuaugucaucauuaaggcugccaaugcgccucggccgggcaacuggauccuggaacgcagccucgauggcaccacauuuucccccuggcaguacuaugccgugucugacagcgagugccuguccagauacaauauuaccccucggcgcgggcccccuacauauagagcugaugacgagguuaucuguaccagcuacuauucucggcuugugccccuggaacauggagagauucacacgucccucaucaacggccgcccgagcgccgaugaccugucuccuaaacuucuggaguucaccuccgcuagauacauucggcucagacugcagcgcauccggacacugaaugccgaucucaugacccugagccacagagagcccaaggagcuugacccuaucgucacacgccgguacuauuacucuauuaaagauaucuccgucgggggaaugugcauuuguuauggccaugcgagcuccugccccugggacgaaaccacgaagaagcugcaaugucagugcgagcacaacacaugcggggaaucuuguaauagaugcugucccggauaccaucagcagccuuggcgcccgggcaccgugagcuccggcaacacaugcgaggccuguaacugccacaauaaagcuaaggauuguuauuacgacgaaagcgucgccaaacaaaagaaaucucucaacaccgcugggcaguuucggggaggcgggguuugcaucaauugucugcagaacaccaugggaauuaauugcgagacauguaucgacggcuauuacagaccccacaagguguccccuuacgaggaugaacccugccgcccuugcaacugugaccccguggggagccuuucuagcgucugcaucaaggaugaccugcauuccgaucuccacaauggaaaacaaccgggccaguguccuugcaaggagggcuauacgggggaaaaaugugaccggugccagcugggauacaaggauuaucccaccugugugucuugcggcuguaacccuguugggagcgccuccgacgagcccugcacaggaccuugugugugcaaagaaaaugucgagggcaaggccugcgauagauguaaacccggguucuacaaccugaaggagaagaauccgcgcggcugcagcgaauguuuuugcuucggagugucugacguuuguuccagccucucuuggccugugggccaggucaacuccaugagcggguggcuggugaccgaucuuauuagcccccggaaaauccccucucaacaggacgcucugggaggcagacaucaggucagcauuaauaacacagcggugaugcagcggcucgccccuaaguauuacugggcugccccggaggccuaucuggggaauaaacuuaccgcuuuuggaggcuuccugaaguacacgguuuccuacgacauccccguggaaacagucgauucuaaccucaugagccacgccgacgugauuaucaaagggaacggccugacccuguccacccaagcggagggacucagccugcagccuuaugaagaguaccuuaauguugugcgccugguccccgagaacuuucaggauuuccauucuaagagacagaucgaccgggaucaacucaugacagugcuggcuaaugugacccaucugcuuauuagagccaacuauaauuccgccaagauggcucucuaccgccuggaaagcguuucucuggacaucgccuccagcaacgcuauugaucucgucguggccgcggacguggagcacugcgaauguccucagggcuauacagggacgucuugcgagagcugucuguccggauacuaucgggucgauggcauccuuuuugggggaauuugccagcccugugagugccauggccacgccgcugaaugcaaugugcaugggguuuguaucgccugcgcucacaacaccacaggcgugcacugugagcagugccugccuggauucuacggcgaacccagcagagggaccccgggagacugucaaccuugcgccuguccccucacaauugcgucuaauaacuucuccccuaccugccaucugaaugauggcgacgaggucgugugugauuggugcgcccccggguacagcggagcuuggugugaacgcugcgccgacggcuauuacgggaacccgacgguuccuggcgaguccugcgugcccugugacugcucuggaaaugucgauccuagcgaggcuggccacugugacuccgugaccggggaaugccugaaaugucuuggaaacacagauggcgcccauugcgagagaugugccgacggguuuuauggagaugcuguuaccgcgaagaauugccgggccugugaaugccacgugaaaggcucucauagcgcugucugucaccucgagacaggccugugcgacugcaagcccaacgugaccgggcagcagugugaucaaugccugcacggauacuauggccucgacuccgggcauggaugucgccccugcaacuguucuguggccggcagcgucuccgaugggugcacggacgaaggacagugucacugcguuccuggcguggccggcaaaagaugugaucggugcgcucauggguucuacgccuaucaggacggaagcuguacaccgugcgauuguccccacacccagaauacaugcgacccugagaccggcgagugcgugugucccccucauacccaaggggucaagugcgaagagugugaagacggacacuggggcuacgaugcggagguggggugccaggcuuguaacugcucucugguuggauccacacaccaucgcugugacguggucacgggccacugccaguguaagagcaaauuuggcgggagagccugcgaucaguguucucuuggauaccgggacuuccccgauugcgugccuugcgacugugaucugcgcggcaccuccggggacgccugcaaucucgaacaaggacuguguggcugcguugaggagacaggggcuuguccgugcaaggaaaacguguuuggaccccaguguaaugagugcagagaaggcaccuucgcccugcgggcggauaacccucuuggcuguagccccugcuuuuguucugggcucucccaucugugcagcgagcuggaggacuauguccgcacaccugugacccucggauccgaucagccccugcuuagaguugugagccagucuaaucugcggggcacgacagaaggggucuacuaucaagcuccggacuuccuccuggacgccgccaccgugagacagcacauccgcgcugagccuuuuuacuggcggcugccccagcaauuccagggagaucagcuuauggccuauggcgggaaacucaaguacagcguggcuuuuuauucccuggacggagucggcaccucuaacuucgaaccccagguucugaucaaaggcgggcgcauuagaaagcaagugaucuacauggaugccccugcgcccgagaauggagugcggcaggaacaggaggucgccaugagagagaacuuuuggaaguacuucaauagcguguccgaaaaaccuguuacacgcgaggacuucaugucugugcucagcgauauugaauauauccugauuaaggcuuccuacggccaggggcuucaacagucucggaucagcgacaucuccauggaggucggaagaaaagccgaaaagcugcacccggaggaggaaguggcuagccuccuggagaacugcguuugucccccuggcaccgugggguuuucuugccaggauugugcccccggauaucaucgcggcaaacugccugccggcuccgaccgggggcccagaccgcuugucgcuccuugcgugcccuguagcugcaauaaccacucugauacaugugacccuaauacgggaaagugccugaacuguggcgauaacaccgcgggggaccauugcgaugucuguacauccggauacuauggcaaagugaccgggagcgccuccgacugcgcucucugcgccuguccccacucuccucccgccagcuucuccccgacaugcguucuggaaggagaccaugauuuucggugugacgcuugccuccugggcuacgagggcaagcacugugaacgcugcuccucuuccuauuacgggaauccucagacccccggaggcagcugucaaaagugcgauuguaacccccacgggucugugcauggagacugcgauagaacgagcggccagugugucugccggcuuggggccuccggccugcgcugcgacgagugugagccuagacacauucucauggaaaccgauugcgugucuugugacgaugagugcguuggagugcugcugaaugaccuugaugaaaucggcgacgcgguccugagccucaaccugacagggauuaucccggugcccuacggcauucuguccaaucuggagaacaccacaaaauaucuucaggagucucugcucaaggaaaauaugcagaaagaucugggcaagaucaaacuggaggggguggcugaagagaccgacaaccuucaaaagaagcugacacggaugcucgccagcacccagaaaguuaauagagccacggaacgcaucuucaaggagucccaggaccuggcuauugccaucgagcggcuccaaaugagcauuacagaaaucauggagaaaaccacccugaaccagacacuugaugaagacuuucugcugccuaauucuacccuccagaacaugcagcaaaauggaacgucccugcuugagauuaugcagaucagagauuucacacagcugcaucagaacgcgacccucgaacugaaggcugccgaggaccuccugagccaaauccaggagaauuaccagaaaccccuugaagaacuggaaguccugaaggaggccgcuucccacgugcucucuaagcacaacaaugaacugaaagccgcugaggcccuugugcgcgaggcggaagccaagaugcaggagagcaaccaucugcuccugauggucaacgcuaaucuccgggaauuuuccgauaaaaagcugcacgugcaagaggagcagaaccuuacaucugaacugauuguucagggcagagggcugaucgacgccgcugccgcccaaaccgaugcugugcaggacgcgcucgagcaucuggaagaucaccaggacaaacuucugcucuggagcgccaagauucgccaucacaucgaugaccuggucaugcacaugucccagcggaaugcuguggaccucguuuauagagccgaggaucaugccgcugaguuccaacgccuggccgacgugcuuuacagcggccuggagaacauuagaaaugucucucugaacgcgacauccgcugccuaugugcacuacaauauccagagccucauugaggaaucugaggaacuggcccgggaugcucaucgcaccguuacggagaccucccuucugagcgaaucucucgugagcaacggaaaggccgcgguccagagauccucucgguuucugaaagagggcaauaaccugagccgcaagcucccugggaucgcccuugagcuguccgaacugagaaauaaaacaaaccgguuccaggagaaugcuguggaaaucaccagacaaacaaacgagagccuccugauucuucgcgccauccccaagggcauucgggacaaaggagcuaagaccaaagaacuggccacguccgcuucucagagcgccguguccacacucagagaugucgcggggcugucucaggagcugcucaauaccagcgccucccuuucucgcguuaacacaacccugcgggagacccaccagcugcuccaagacagcacaauggcuacgcugcuugccggaagaaaggugaaggauguggaaauccaggcuaaccugcucuuugaccggcugaaaccucugaagaugcucgaggaaaaucuuucccgcaaccugagcgagauuaaacugcucaucucucaggccagaaagcaggccgcuuccaucaaagucgcggugagcgccgaucgggacuguauucgcgcuuaucaaccgcagaucucuuccaccaauuacaacacacugacccuuaauguuaagacacaggagcccgauaaccuccucuucuaccugggcagcucuaccgccuccgacuuucuggccguggaaaugagacgggggcgcgucgcuuuccucugggaucuuggcagcggauccacgagacuggaguucccugacuuucccauugacgauaaucgguggcacagcauccauguggcccgcuucggcaacauugggucucugagcguuaaggaaauguccucuaaucagaaaagcccuacaaagaccuccaaaucucccggaaccgcgaacgugcucgacgucaauaacagcacacugauguuugugggcgggcuuggaggccagaucaagaaauccccggccgucaaggugacccacuucaagggcugccugggggaggcuuuucucaauggaaaaucuaucggccuguggaacuauauugaaagagaggggaagugucggggaugcuucggcagcucccagaaugaggauccuagcuuucauuucgacgggucuggauacuccguuguggagaaaagccugcccgccacagugacgcagaucauuaugcucuuuaacaccuucucucccaacggccuucugcuguaucucggcuccuacgggacaaaggauuuucugagcaucgagcuuuucagaggacgcgucaaaguuaugaccgaccugggcuccgggccuauuacacuccugaccgaucggagauauaauaacggaacgugguacaagaucgcuuuccaacgcaaucggaagcagggcgugcuggccgugauugacgcguauaacaccucuaauaaagaaacaaagcagggggagacccccggagccagcuccgaucucaacagacuugacaaagauccuaucuacgucggcggccugccgcgcagccgggugguuagacgcggggugacaaccaagucuuuugucggauguaucaaaaaucuggaaauuucccggagcacauucgaccuccugagaaacucuuacggcgugcgcaaggggugccuucuggagcccauccggagcgucuccuuucucaagggaggcuauauugagcugccucccaaaucucugagcccugaauccgaguggcucgugacguucgcuaccacaaauucuagcgggaucauucuugccgcucugggaggcgacguugaaaagagaggcgaucgcgaggaagcccacgugcccuuuuucuccgucaugcugaucgggggaaacaucgaggugcauguuaauccgggcgacgggaccggacucagaaaagcucugcuucacgccccuaccggcacauguagcgaugggcaggcgcacucuauuucccuggugcggaaccgcagaaucauuacgguccaacucgacgagaauaaccccguggaaaugaagcugggaacccugguggagagccggacaaucaauguuuccaaccucuacgucggcggcauuccugaaggggagggaaccucucuucugacaaugagacggagcuuucauggcugcaucaaaaaccugaucuucaaucucgagcugcuugauuuuaacuccgccguggggcacgaacagguggaccuggauaccugcuggcucucugagcgccccaagcuggcuccugacgccgaagauagcaaacugcuccccgagccgagagcuuucccugaacagugugucguugacgccgcccuugaguaugugcccggagcgcaucaguuuggccugacgcaaaauucccacuucauucugcccuuuaaccagagcgcugugcggaagaagcucucugucgagcuguccauccgcacauucgccagcucugggcuuauuuacuauauggcucaucagaaucaagccgauuacgccgugcugcagcuccacggaggcagacugcacuucauguuugaccugggcaaagggcggaccaagguuucccauccugcucuccugagcgauggaaaauggcacaccgugaagacagacuaugucaaacgcaagggcuucaucaccguggacgggagagaaucuccgaugguuacaguggucggagauggcaccaugcuugacguggaggggcuguuuuaccucggaggccugcccucccaguaccaggcccggaagauuggcaacaucacgcauagcauuccugcgugcaucggggaugugacagucaauucuaaacaacuugacaaggauagccccguuuccgccuucaccgugaaccgcuguuaugcuguggcccaggaaggaacauacuuugacggcagcggguaugcugcccuggucaaagagggauacaaggugcaguccgauguuaauaucacccucgaguucagaacgucuagccagaacggcgugcugcuggggauuuccaccgcgaaagucgacgccaucggccucgagcugguggauggaaagguucuuuuucacgugaauaacggcgcugggcggauuacagccgcuuaugagccuaagaccgccacaguccugugcgacggaaaauggcacacccuccaagcuaauaagucuaaacaucgcaucacacugauuguggauggcaacgccguuggggcggaaagcccccacacccaguccacgucuguggacacaaauaacccuaucuacgucggaggcuaucccgccggggugaagcagaaaugucuuagaagccagaccuccuuccggggcugccugcgcaagcucgcucugaucaagagcccgcaaguccagucuuuugauuucuccagagccuuugagcugcauggaguguuccuccacagcuguccuggcaccgaaucuuga

SEQ ID NO: 71359 - RNA, 9369 nt, Artificial Sequence
  derived and/or modified sequence opt5 from LAMA2__Homo_sapiens__NP_000417
augcccggcgcggcuggggugcugcuccugcuucugcucuccggaggccuugggggcgugcaggcucaaagaccucagcagcagcggcaaucccaggcgcaccagcagcgcggccuguucccggcuguucugaaccucgccucuaaugcccugaucaccacaaacgcuacgugcggggaaaagggacccgaaauguacugcaaacugguggagcaugugccuggccaacccgucagaaauccucagugccggauuuguaaccagaauagcuccaaccccaaucagcgccacccuaucacaaacgccauugacggcaagaauacaugguggcaaucuccgagcaucaaaaacgggauugaauaucauuacgugaccaucacacucgaucugcagcagguuuuucaaaucgcuuaugugauugucaaggccgccaauucccccagaccuggaaacuggauccuugagcggucucuggacgauguggaauacaaacccuggcaguaucacgccguuaccgacacagagugccucacccuguacaauauuuauccucgcacgggaccgccgagcuacgcuaaggaugacgaggugaucuguaccuccuucuacagcaagauucauccucuugaaaacggggagauccacauuucucugaucaauggaagacccuccgccgaugacccuagccccgaacuccuggaguuuacaucugcucgguauauccgccugagauuccagcggauucgcacccucaacgccgaucugaugauguuugcgcacaaagaccccagagagaucgauccuauugucacacggcgcuacuauuacuccgugaaggacaucagcgugggcgggaugugcauuuguuauggacaugccagagcuugcccgcuugaucccgccaccaacaaaucucggugugaaugcgagcacaauacguguggcgacuccugcgaccagugcuguccuggcuuccaucaaaagcccuggagagcugggacauuucugaccaaaacagaaugcgaggccuguaacugccacggaaaggccgaagaguguuacuaugaugagaaugucgcucgccggaaccucagccugaauaucagaggcaaguacaucgggggaggcguuugcauuaacuguacccagaauaccgcggggaucaacugcgaaacauguacggacggauucuuucgcccuaaaggcgugucccccaauuacccgcggccuugccagcccugucacugcgauccuauuggcucucuuaacgaggugugcgucaaggacgaaaaacaugccagacgcgggcuggcucccggaagcugucacugcaagaccggcuucgggggaguguccugugaucggugcgccagaggcuauacaggguacccugacuguaaagccugcaauuguagcggccucggaucuaagaacgaggaucccugcuuuggcccguguaucugcaaagaaaauguugaagggggagacuguucccgcugcaagagcggcuucuuuaaccugcaggaggauaauuggaaggggugcgacgaauguuucugcucuggagugagcaaccggugucaauccucuuauuggaccuacggcaaaauucaggauaugagcgggugguaucugacagaccucccuggcagaauccgcgucgcuccccagcaggacgaucuggacagcccccaacagaucuccauuucuaacgccgaggcgcggcaggcccuuccucauuccuacuauuggagcgccccggcccccuaccugggaaauaagcucccugcugugggcgggcagcugaccuucacgaucucuuacgaucuugaagaggaagaggaggacacagaaagaguucugcaacucaugauuauccuggagggaaacgaucuguccauuagcaccgcccaggacgaaguguaucuccaccccuccgaggagcauaccaauguccugcuucugaaagaagagucuuuuacaauccacggcacccacuucccugugcggcgcaaggaauuuaugacaguccucgcuaaccugaaaagagugcugcuucagauuacguacagcuucgggauggaugccaucuuucggcucuccucuguuaaucuggagagcgcgguguccuaucccaccgacggaagcaucgccgcugccgucgaagugugccaauguccucccggcuacacagggucuuccugcgagagcuguuggccgagacaucgccggguuaacggcaccauuuucggaggcaucugcgagccuugucagugcuuugggcacgcugaaucuugugaugacgugacaggagagugccugaauugcaaggaucauaccggcgggcccuauugugacaagugccucccuggauucuacggcgaacccacgaaagggaccuccgaggauugucagccgugcgccuguccucugaacauucccagcaauaacuuuucuccuacaugccaccuugacagaagccugggccucaucugugacggaugccccgucggcuauaccgggccccgcugugaaagaugcgcggagggauacuucggccagccuuccgugcccgggggaagcugucaacccugccagugcaaugauaaccuggacuuuucuauuccuggcuccugugauagccuguccggcucuugccuuaucuguaagcccgggacaaccggacgguacugcgagcucugugccgacggcuauuucggggaugcuguggacgccaaaaauugccagccuugucgcugcaacgcuggaggcagcuuuuccgaaguuugucacucucagacggggcaaugcgaguguagagccaauguccagggacagcggugcgauaagugcaaagccggcacauucggccugcagagcgcucgcgggugugugcccugcaacuguaacuccuucggaucuaagagcuuugacugcgaagaguccggccaauguuggugccagccuggggugaccggaaagaaaugugauagaugcgcgcauggcuacuucaauuuucaggaagggggauguacagccugcgaguguagccaccugggcaacaauugcgacccgaagaccggccgguguaucugucccccuaacaccauuggggagaaaugcucuaagugugcucccaauacauggggacauuccaucacgaccggcugcaaagccuguaacugcagcacagucgggucucucgauuuccaauguaaugugaacaccggacagugcaauugucacccuaaguuuuccggcgccaagugcacagaauguagccgcgggcauuggaacuaucccagaugcaaucugugugacugcuuccuuccgggaaccgaugcuacgacaugcgacucugagaccaaaaaguguuccugcagcgaccagaccggccaguguacaugcaaaguuaacguggaaggcauucacugugaucggugccgcccugggaaguuuggacuggacgccaaaaauccccucggcuguuccagcugcuacuguuucgggaccacaacgcaaugcucugaggcgaagggacugaucagaaccugggucacacugaaagcugagcagaccauucuuccccucguggaugaagcccugcagcacacaaccacgaagggcaucguuuuucagcauccugagaucguggcccacauggaccugaugcgggaagaucuccaucuggagcccuucuauuggaaacuuccugaacaauuugaggggaaaaagcugauggcuuacggaggcaaacucaaguaugccauuuacuucgaggcgagagaagagaccggcuuuagcacauacaacccgcaggucaucauucgcgggggaacccccacacacgcucggaucauugugagacauauggccgccccucugaucggccagcugacccgccacgaaaucgagaugacagaaaaagaguggaaguauuacggggacgauccccggguucacagaaccgugacgcgcgaggacuuccuugauauucucuaugacauccauuacauucugaucaaggcuacauauggaaauuucaugcggcaguccagaauuucugaaaucagcauggaggucgccgaacaaggccgcgggaccaccaugacaccucccgcugaucugauugagaaaugugacugcccgcucggauacuccggccugucuugcgaagccugucuuccuggcuuuuaucggcugagaagccagcccgggggacggaccccuggccccacgcucgggacaugcgugccuugucagugcaacggacacuccucucugugugaccccgagaccagcaucugccagaacugucaacaucacacagcgggcgauuucugcgagcgcugugcccugggguacuacggaaucgugaagggccuuccgaaugacugccagcagugugcuugcccucugauuuccagcucuaacaauuuuucccccagcugcgucgccgaaggccucgaugacuauagauguaccgcuugcccccggggguacgagggacaauauugugaacgcugcgccccuggcuacacagggucuccgggaaaccccggcggguccugucaggagugcgagugugauccuuauggcagccugcccguuccuugcgaccccgugaccggauucuguacgugcagaccuggcgccaccgggcggaaaugugauggaugcaagcacuggcaugcuagagaaggcugggagugcguguuuuguggggacgaaugcacaggacuccugcuuggcgaucuggcgcgccucgagcagauggucauguccaucaaucugaccgggccgcugcccgccccuuacaaaaugcuuuauggccuggaaaacaugacacaggagcucaagcaucugcugucuccccaacgggcuccugagagacugauucagcuugccgaaggaaaucugaacacccucgugacggagaugaaugaacugcugacacgcgccaccaagguuacagcugacggcgagcagaccgggcaggaugccgaacggaccaacacaagagcgaaaagccuuggagaguucaucaaggagcuggcucgcgacgccgaagccgugaaugagaaagcuauuaagcucaacgaaacgcugggcacccgggaugaggccuuugaaagaaaucucgaggggcugcaaaaagagaucgaccagaugaucaaggaacuucgcagaaagaaccuggagacacagaaagaaauugcggaggacgagcuggucgcugccgaagcccuccugaagaaagugaagaaacuuuucggagagucccggggcgaaaaugaggaaauggagaaggaucugcgcgagaaacucgcugacuacaagaacaagguugaugacgccugggaucugcucagagaagcuaccgacaaaauccgggaggccaaucgccuguuugcggugaaccagaagaacaugacagcccuugagaagaagaaagaggcugucgaaagcgggaagagacaaauugagaauacccugaaggagggcaacgauauccuggacgaagccaaucggcucgcugaugagauuaacucuaucaucgacuacguggaagauauucagacgaaacugcccccgauguccgaggaacuuaaugacaagaucgaugaccugagccaggagauuaaagacagaaagcucgccgagaaaguuucucaagccgaaagccacgcugcgcagcugaacgauuccucugccgugcucgacggaauccuggaugaggcuaagaauauuagcuucaacgccacagccgcuuuuaaggccuauuccaauaucaaagacuacauugaugaagcggagaaggucgcuaaagaggccaaggaccuugcccacgaagcuaccaaacuggccaccggcccucgcgggcugcucaaggaggaugcgaagggaugucugcagaaaucuuuccggauccuuaacgaagccaagaaacuggcuaaugacgugaaggagaacgaagaucaucucaauggccugaaaacaagaaucgagaacgccgacgcucgcaauggggaucuccugcggacccuuaacgacacacugggaaagcugagcgccauucccaacgacacggcugccaagcuccaggcggugaaagauaaggccagacaagcuaaugacaccgccaaagauguccuggcucagaucacagagcuucaccagaaccuggacggccucaagaaaaauuauaacaagcuggccgauuccguugccaaaaccaaugcuguggugaaggaccccagcaagaacaaaauuaucgcggaugccgacgcuacagucaagaaucuggaacaggaggccgaucggcucauugacaaacuuaagccuaucaaagaacuggaggauaaccugaagaagaauaucucugaaauuaaagagcucaucaaccaagcccgcaagcaggcuaauuccauuaaagugagcguuuccucuggcggggacugcaucagaaccuacaagcccgagauuaaaaagggaagcuauaacaauaucguggucaacgugaagacggccguugcggauaaucugcuuuucuaccugggcuccgccaaauuuaucgacuuccucgcuauugaaaugcggaaggggaaagugucuuuucugugggacgucggaagcggcguggggcgcgucgaguauccugaucugaccaucgacgauuccuacugguacagaauuguggccagccggacaggacgcaacggcaccaucucuguuagagcucucgacggcccgaaggccuccauugugcccagcacacaccauucuaccuccccucccggguauacaauccuugaugucgacgcgaacgccaugcuguucgugggaggccugacggggaaacucaagaaggcugaugccguucgggugauuaccuuuacaggauguaugggcgaaaccuacuucgacaauaaaccuaucgggcuguggaacuuucgcgagaaggaaggagauugcaaaggcuguaccgucagcccccagguggaggacucugagggcacaauccaguucgauggggaaggauaugcucuugugagcagaccgauucggugguacccuaauaucuccacgguuauguuuaaguucagaaccuuuucuagcuccgcccugcucauguaucuggcuacacgcgaccugcgggacuucaugagcgucgagcucaccgauggccacauuaaaguguccuacgaccuugggucuggaauggccagcguggucuccaaccaaaaucauaacgauggcaaguggaaaucuuuuacacugagcagaauccagaagcaggcgaauauuuccaucguggacaucgauaccaaccaggaagagaauauugccacgucuagcuccgggaacaauuucggacuggaccucaaggcugaugacaaaaucuauuucggcggccugcccacacuucgcaaccugagcaugaaggcccggccugagguuaaucucaaaaaguacucugggugccugaaagauauugaaaucuccagaacccccuacaacauucugagcucuccugacuaugugggagucaccaagggcuguucccucgagaauguguacacaguuagcuuucccaagccgggguucguggaacuuucuccuguccccaucgaugugggaaccgagaucaaccuguccuuuagcaccaaaaacgaauccggcauuauccugcucgggagcggaggcacccccgcuccuccgcgccggaagagacgccaaacgggccaggccuauuacguuauucugcuuaaucgggggagacuggaggugcaccucucuacaggagcccgcaccaugcggaaaaucgucauuagacccgagccuaaccuguuccacgacggccgcgaacauagcgugcacguggagagaacacgggggaucuuuaccguccagguugaugaaaaucgcagauauaugcaaaaccugacgguggagcagcccauugaagugaagaaacucuucgucggaggcgcgccucccgaguuucagccuagcccccuucggaauaucccgccuuucgaggggugcaucuggaaccuggugauuaauucuguucccauggacuuugcuagaccugugagcuucaagaacgccgacaucggacggugugcucaucagaagcugcgcgaagaugaggacggcgccgcccccgcugaaauugucauccaaccggagccugugcccacccccgccuuuccuacacccaccccuguucucacacacggcccgugcgcggccgaauccgagcccgcucugcuuauugggucuaaacaguucggacugagcagaaauucccauaucgccaucgcuuuugaugacaccaaggugaaaaaccggcucacaauugagcuggaaguccgcaccgaggccgaaucuggccuccucuucuacauggcgagaaucaaucacgccgauuucgcuacggugcagcuucggaacgggcugccuuauuuuagcuacgaccugggauccggcgauacacacaccaugauucccaccaagaucaaugacgggcaguggcauaaaauuaagaucaugcgcagcaagcaagagggaauccucuacgucgauggcgccucuaacagaacaauuuccccuaaaaaggcugacauccuggaugugguuggcaugcuuuaugucgggggacugcccauuaauuacaccacacggcgcaucggcccugugacguauagcauugacgggugcgucagaaaccuccacauggccgaggcuccggccgaucuggaacagcccaccucuuccuuccauguuggaacauguuuugcgaacgcccagcggggcaccuacuucgacgggacaggcuuugcuaaagccgugggaggcuucaagguggggcuggaccuccuugucgaguuugaguuccgcaccacgaccacaaccggagugcugcugggcaucagcucccagaaaauggaugggaugggaauugagaugaucgacgaaaagcucauguuucacguugauaauggcgcugggagauucacagccguguaugacgccggcgucccuggacaccugugcgauggccaauggcauaaagugaccgcgaacaagaucaagcaccggauugagcuuacggucgacgggaaucagguggaggcucagucucccaacccugccagcacauccgccgauaccaaugaccccguuuuugugggaggcuucccggaugaccugaaacaauuugggcucacaaccagcaucccuuuccgcggauguauuagaucucugaagcugaccaaaggcacagggaagccccucgaagucaacuucgcuaaagcccuugagcugcggggcgugcagcccguuuccugcccugcuaauuga

SEQ ID NO: 71360 - RNA, 5175 nt, Artificial Sequence
  derived and/or modified sequence opt5 from LAMA3__Homo_sapiens__NP_000218
augcccccugccgugcggcggagcgcuugcuccaugggcuggcuguggaucuucggggccgcgcucggacagugucugggcuacucuagccaacagcagcgcgugccguuucuucagcccccugggcaaucccagcugcaggcuucuuauguugaguuccggcccagccagggaugcuccccuggcuacuaucgggaccacaaggggcucuacaccggacgcugugugcccugcaacuguaauggccacucuaaccaaugccaggauggcagcgggauuugugugaauugccagcacaacacagccggagaacauugugagcggugccaggaaggcuauuacgggaaugccguccacggauccugucgggcuugcccuugcccgcauacgaacagcuuugccaccggcugugugguuaaugggggagacgugcgcugcucuuguaaggcuggcuauacaggcacccaaugcgagagaugugcccccggguacuucggaaacccucagaaguuuggcggguccugccagcccuguagcugcaauucuaacggacaacugggcuccugucacccucuuacaggggauugcaucaaucaggaacccaaggacagcucuccggcggaggagugugaugacugcgauuccugcgucaugacccugcucaacgaccuggccacaaugggagaacagcugcggcucgucaagagccagcugcaaggccuuuccgcuucugccggccugcucgagcagaugcgccacauggaaacccaggcuaaggaucugagaaaucagcuucugaacuaccggagcgccauuuccaaucaugggagcaagaucgagggacucgagcgcgaacugacggaccugaaccaagaguucgaaacccuccaggagaaggcgcagguuaacucuagaaaagcccagacacugaauaacaaugugaaccgggcuacccaauccgccaaggaacuugaugucaaaauuaagaaugugauccgcaacgugcacauccugcucaaacagauuagcggcacagacggggagggaaauaacgucccuucuggcgauuuuagcagagagugggcugaagcccagcggaugaugagagagcugcgcaaucggaacuucgggaagcaucuuagagaagccgaggcugacaagcgcgaaucccagcugcuccugaaucggaucagaaccuggcagaagacgcaccagggcgagaacaauggacuggcgaacucuauucgcgacagccucaaugaguaugaagccaagcuguccgaucuucgggcuagacugcaggaggccgccgcucaagccaaacaggcgaacggccucaaccaggaaaaugagcgcgcucugggggccauccagcggcaaguuaaggaaauuaacagccuucagucugacuuuacaaaauaccugaccacagccgauuccagccuccugcagaccaauaucgcucugcagcucauggagaagucucaaaaagaguaugaaaagcuggccgcuucccuuaacgaggccagacaggaacugagcgacaaggugcgcgagcucucccggucugcgggaaaaaccagccugguggaggaagccgagaagcacgcuagaucccugcaggaacuugccaaacagcucgaggaaauuaagcggaaugcuucuggcgaugagcugguccgcugugccguggacgcggccacagcuuacgagaacauccugaaugccaucaaagcugccgaagaugccgcuaacagagcggccagcgcuuccgagagcgcccuccaaacgguuauuaaggaagaccugccccggaaggccaaaacccuuucuuccaauagcgauaagcugcucaacgaggcuaaaaugacacagaagaaacugaagcaggaagugucuccugcccugaauaaccuucaacagacccucaauaucgucacagugcagaaggagguuauugacaccaaccugacgacacugagagaugggcuccauggaauccagcgcggcgacauugacgcgaugaucuccagcgcuaaaucuauggugcggaaggccaaugauaucaccgacgagguccuggaugggcuuaaccccauucaaaccgacguggaaagaaucaaagauacauauggccgcacccagaacgaggacuucaagaaagcccugacagaugcugacaauagcgucaacaagcucacgaauaagcugcccgaucuguggagaaaaauugaauccaucaaccagcagcuucucccucugggaaauauuagcgacaacauggaucggauccgcgagcugauccaacaggccagagacgcggcuucuaagguggccguuccgaugcgguuuaauggcaaauccgggguggaaguccgccuccccaacgaucuggaggaccuuaagggauacaccagccugucccucuuccugcagagaccuaauucucgggagaacggcgggacagaaaauauguuugugauguaucugggaaacaaagacgccagccgcgauuacauuggcauggcuguuguggacgggcagcuuaccugcgucuacaaucucggcgauagagaggccgaacugcaaguggaccagauccugacaaaguccgagaccaaagaggcugugauggaucggguuaaguuccagcgcauuuaucaguucgccagacucaacuacacgaagggagcgaccucuagcaaacccgaaacaccuggcgucuaugacauggaugggcggaauagcaacacccugcuuaaccuggaccccgagaaugugguguuuuacgucggaggcuauccgccugauuucaagcuccccucuagacugagcuuuccucccuacaaaggguguaucgaacuggacgaucuuaacgagaaugugcugucccucuauaacuucaagaaaacauuuaaucugaacaccacggaaguugagccuugccgccggagaaaggaggaaagcgacaagaauuacuucgagggaacaggcuacgcccgcgugcccacccaaccgcacgcuccuauucccacauuugggcagaccauccagaccacagucgaucggggccuccuguucuuugccgaaaacggagacagauucauuucucuuaauaucgaggacggcaaacugauggugcgcuauaagcucaacuccgaacugcccaaagagagagggguuggagaugcuaucaauaacggcagagaccauagcauucaaaucaagauugggaaacugcagaagcgcauguggaucaauguggauguccagaacacgauuaucgacggagagguguuugauuucucuaccuacuaucuuggcggcaucccuauugccauccgggaaagauuuaauauuuccacaccggccuuccggggguguaugaagaaccugaaaaagaccagcggaguugugcgccucaaugacacagucggcgugaccaaaaagugcucugaggauuggaaacuggugagauccgcuagcuucuccagagggggacagcucagcuuuacggaccugggccuucccccuacagaucaucugcaagcgucuuucggguuucagaccuuccagcccagcggaauccuccuggaccaucagaccuggacacgcaaccugcaagucacccuugaagauggcuacauugagcuguccacaucugacagcggcgggccuaucuuuaagagcccccaaacguauauggacggacuccugcacuacguuucugugaucagcgauaacuccggccucagacugcuuauugacgaucagcugcugagaaauucuaagagacucaaacacaucagcuccagccgccagucucugcggcuugggggauccaacuucgaaggcuguauuagcaauguguuuguccaaagacugucucucuccccugaggugcuggaccucaccagcaacucccugaagcgcgauguuucucuugggggaugcagccugaauaaacccccguuccugaugcuccugaagggcuccacacgguuuaacaaaaccaagacauucagaaucaaucagcuucugcaggacaccccuguggccagcccccgcucugucaaaguguggcaagaugcuuguuccccucuccccaagacgcaggccaaccauggcgcccugcaguuuggggacauuccgaccagccaccuccuguucaaacuuccucaggagcugcugaaaccccggucucaauuugcuguugauaugcagacaaccagcuccagaggacucguguuccauacaggcaccaaaaauucuuucauggcccuguaucuuagcaaagggcgccuggucuuugcgcucggaacagacggcaagaaacugagaaucaaguccaaggaaaaaugcaacgaugggaaguggcacaccgugguuuucggacacgacggcgagaaaggccggcucguggucgaugggcugcgcgcuagagaaggaucucuuccuggcaauagcacgaucuccauucgggcccccguguaccuggggucucccccuuccggaaagccgaaaucccugcccacaaacagcuuugugggcugucucaagaauuuccagcuggacuccaagccucuuuacacccccucuagcuccuuuggggucucuagcugccugggaggcccucucgagaaaggcaucuauuucuccgaggaagggggacauguugugcuggcccacagcgugcugcucggccccgaguuuaaacuugucuucucuauucgcccuagaucccugaccgggauccugauucauaucggaagccagccgggcaaacaccucugcguguaccuggaagcugggaagguuacagccucuauggacuccggagcgggcggcaccagcacgucugugacacccaaacaaagccuuugugaugggcaguggcauuccgucgcugugaccauuaagcagcacauccugcaccucgagcuggacacagauucuagcuauaccgccggacagaucccuuuucccccugccuccacacaagaaccccugcaucucggcggggcuccggccaaccuuaccacgcugcggauuccuguuuggaaauccuucuuuggaugccugagaaauauccacgugaaccauauucccguccccgugaccgaggcucucgagguccagggcccugugucccugaacgggugucccgaccaguga

SEQ ID NO: 71361 - RNA, 5472 nt, Artificial Sequence
  derived and/or modified sequence opt5 from LAMA4__Homo_sapiens__NP_001098676
auggcgcugagcuccgcuuggagaucugugcucccccuguggcuucuguggagcgccgcgugcucccgggcugccucuggcgacgauaacgccuucccuuuugacaucgaggggagcuccgcugucggacgccaggauccucccgaaaccucugagcccagaguugcccucggccggcugcccccugcugccgaaaaauguaaugcgggguucuuucacacacuuagcggagagugcgugcccugugacugcaacggcaauuccaacgaaugucuggaugggagcggauauugcgugcauugucaacgcaauacgaccggcgagcacugcgagaaaugucucgacggcuauauuggggauucuaucagaggagccccucaguucugccagccgugucccugcccucugccccaucuggcuaacuuugccgaauccugcuaccggaagaauggcgcuguccgcuguauuugcaacgagaauuaugccgggccuaacugugaaagaugcgcgcccggauacuauggcaauccgcuccugaucgggagcacauguaaaaagugcgacuguucuggaaacuccgauccuaaucuuauuuucgaggacugcgaugaggugaccggccagugucggaacugccugcgcaauacaaccggcuuuaaaugugaaagaugcgcccccggguacuauggagacgcucggaucgccaagaacugcgcuguuuguaacugcggcgggggaccuugugauagcgugacaggcgagugccucgaagagggguucgaaccgcccaccggaauggacuguccuacgaucucuugcgacaagugugucugggaucugaccgacgaucuucgccuggccgcccucuccauugaggagggcaaaagcggcgugcuguccguuucuagcggggcugcggcccacagacaugugaaugaaaucaacgcuacaauuuaccugcucaagaccaaacuguccgagcgggaaaaucaauacgcccuucgcaagauccagauuaacaaugccgagaacacaaugaaaagccugcucucugacgucgaagaacucguggagaaggaaaaucaggcuuccagaaagggacagcuugugcaaaaagagagcauggauaccaucaaccacgccucucagcuggucgaacaggcgcacgacaugcgggauaagauucaggagaucaauaacaaaaugcucuauuacggcgaggagcacgagcugagcccgaaggaaaucuccgagaaacugguucucgcucaaaagaugcuggaagagauuagaucucgccagcccuuuuucacgcagcgggagcuuguggacgaagaggccgaugaagccuaugagcugcucagccaagcugaauccuggcagagacugcacaaugagacacgcacccuuuuuccugugguccuggagcagcucgacgauuacaacgccaaacugagcgaccugcaggaagcucucgaccaagcccugaauuaugugcgggaugcggaggacaugaacagagccacagcugcccgccagcgggaucaugaaaagcagcaggagagaguucgcgaacaaauggagguggucaauaugucucuuuccaccagcgcugacucucugaccacaccccggcucacgcuguccgagcuggaugacaucauuaagaacgccagcgggaucuacgcggaaauugauggagccaaauccgagcuucaggugaagcucucuaaccugagcaaucugucccacgaccucguucaggaagcuaucgaucacgcccaggaccugcaacaggaggcuaacgaacuuucuagaaaacugcauagcuccgauaugaauggccucgugcagaaggcccuggacgccagcaacgucuaugagaauaucgugaacuacgucucugaggcuaaugaaaccgcggaguucgcccugaacacaaccgaucgcauuuacgacgcuguguccgggaucgacacacagauuaucuaucacaaagaugaaagcgagaaucuucucaaccaagcccgggagcugcaggccaaggcugaaucuuccagcgacgaggccguugcggauaccucuagacgggugggcggagcucuggcccgcaagagcgcccucaaaacgagacuguccgacgcugucaagcagcuucaagccgcggaacggggcgaugcucagcagagacuggggcagagccgccucauuacagaggaagccaaucggaccaccauggaggugcaacaggccacagcuccuauggccaacaaucugaccaacuggucucagaaucugcagcauuuugacuccagcgcuuacaacacagccguuaacuccgcgagagaugccgugcgcaaucuuacggaggucgugccccaacuccuggaccagcugagaaccguggaacagaaacggccggcuucuaacguuagcgccuccauccagcgcaucagagagcucauugcucaaacacggucugucgccagcaagauccagguguccaugauguucgauggacagucugccguggaaguccacagccgcaccuccauggacgaucugaaggcuuucacaagccuuucucuguauaugaagccucccgugaagagaccugagcucaccgaaacggcggaccaauuuauucuguaccugggcuccaaaaaugccaagaaagaguauauggggcuugcuaucaagaacgauaaucucguuuacguguauaaccugggaaccaaagacgucgagauuccccuggacagcaagccugugucuuccuggcccgccuacuucagcaucguuaagauugaacgggugggcaaacaugggaaggucuuucucacagugccgucucuguccagcaccgccgaggaaaaauucaucaagaaaggcgaguuuuccggagaugacagccuucuggaucucgacccugaagauacaguuuucuacgugggcgggguccccucuaauuuuaagcugcccaccagccugaaccuuccuggauucgugggcugccuggagcucgcuacgcugaauaacgacgugaucucccucuauaauuuuaaacacauuuacaacauggauccgucuacaagcguccccugugcccgcgacaagcuggcguucacccaguccagagcugccucuuacuuuuucgaugggagcggauacgccguugugcgggacaucacacgcagaggcaaguuugggcaagugacccgguucgauauugaggucagaaccccugcugacaauggccuuauccugcucauggugaacggauccauguucuuucgccuggaaaugcggaauggcuaucugcacguuuucuacgacuuuggguucucuggaggccccgugcaucuugaggauacacugaaaaaggcccagauuaacgacgcgaaauaucacgaaaucagcaucauuuaccauaacgauaagaaaaugauccucgucguggacagacgccacguuaaguccauggauaaugagaagaugaaaauuccuuuuacggacaucuacauugggggagcucccccugagauccugcaaagccgggcccucagagcccaucugccccuugauaucaacuuccgcggcugcaugaagggguuucaguuccagaaaaaggacuuuaaucugcucgaacagaccgagacacugggcgugggauauggcuguccggaagauucucugauuucccggagagcuuacuucaacgggcagagcuuuaucgccucuauucagaaaaucuccuucuuugacggauucgagggcggguucaauuuucgcacccuucagccuaacggacuccuguucuauuacgcuagcggcuccgaugucuuuucuauuagccuggacaauggcacagugaucauggauguuaaggggaucaaggugcaguccgucgacaaacaauauaacgacggacucagccauuucgugauuucuuccgugagccccacccgguacgaacugaucgucgauaagucuagaguuggcagcaaaaauccuacgaaggggaaaauugagcagacacaggccuccgagaagaaguuuuauuucggaggcucucccaucagcgcgcaguacgccaacuuuaccgggugcauuuccaaugcuuacuucacccggguggaccgcgauguggaagucgaggacuuucaaagauauacagaaaaagugcacaccucucuuuacgagugcccgaucgaaagcuccccucuguuccugcuccauaagaaaggaaagaaccugagcaaacccaaggccucucagaauaaaaagggcggcaaguccaaagaugcuccuagcugggaccccguugcccuuaagcugcccgagcggaacacaccucgcaauucccacugucaucucucuaacagcccgagagccauugagcacgcuuaucaguacgggggaacggccaauucccggcaagaauuugagcaccugaaaggcgauuucggggccaagucucaguucagcaucagacuccgcacccgguccagccauggaaugaucuuuuaugugucugaccaggaagagaacgauuucaugacacuguuucuugcucacggcagacuggucuacauguucaacguggggcauaaaaagcugaagauucgcucccaggaaaaauauaaugacggacucuggcacgauguuaucuuuauucgggagagaagcucuggccgccuggugaucgacggccuucggguccuggaggaaucccugcccccuaccgaggccacauggaagauuaaagggcccaucuaccugggaggcguggccccugggaaggcugucaaaaacgugcaaaucaauagcauuuacucuuucagcggaugccucuccaaccugcagcuuaauggcgccucuaucaccagcgcgucccagacguuuagcguuacccccuguuucgaagggccuauggagacaggaaccuauuuuuccacagagggcggcuacgugguccuggaugaaucuuucaacauugggcugaaguuugagaucgcuuucgaagugagaccgcgcagcuccucuggaacccucguucauggccacagcgugaauggggaguaucugaacguccacaugaagaauggacaggugauugugaaaguuaacaauggcaucagagacuuuuccacaucugucacccccaagcaaagccuuugcgacgggcgguggcaucgcaucacggugauuagagauuccaacgugguccagcuggacguggauagcgaaguuaaucacguggucggaccucucaaccccaaaccuaucgaccaucgggagcccguguucguuggcggcgugccggagucucugcucacaccucgccuggcccccuccaagcccuucaccggguguauuagacacuuugucaucgauggacacccugugagcuucucuaaagccgcucuuguuuccggcgccgugagcauuaauucuugccccgcggccuga

SEQ ID NO: 71362 - RNA, 11088 nt, Artificial Sequence
  derived and/or modified sequence opt5 from LAMA5__Homo_sapiens__NP_005551
auggccaagagacugugcgcuggcagcgcccucugugugcgggggccccgcggaccugcgccccugcuucuggugggccuugcucugcuuggggccgccagagcucgggaagaagccggaggcggguucucccugcaucccccuuacuuuaaccuugcugaaggagcccgcaucgccgccucugcuaccugcggcgaagaggcccccgcuagaggcagcccucggcccacagaagaccuguauuguaaacugguugggggaccuguggccggcggggauccgaaucagacgauucgcggacaauacugcgacaucuguaccgcggccaacuccaauaaggcucaccccgccucuaacgcuauugauggcacagagagaugguggcagagcccuccccucucccgggggcuggaguauaaugaagugaacgucacccuugaccugggacagguguuccacguugccuacgugcucaucaaauuugccaauucuccucgccccgaucuguggguccuugagagaagcauggacuucggccggacauaucagccguggcaauuuuucgcuuccagcaagcgcgauugccuggaaagauuuggcccucagacccucgagcggauuacacgcgacgaugcggccaucuguaccacggaguacucuagaaucgugccccuggaaaacggggagauuguugugucccuggucaauggacggccuggcgcuaugaacuucagcuauucuccccuccugagagaauuuaccaaagccacaaaugugcgccuucgguuccugagaaccaacacacuccuggggcaccuuaugggaaaggcccugcgcgaccccaccgugacgcggagauacuacuauuccaucaaggauauuagcaucggcgggcgcugcgucugucacggacaugcugacgccugcgaugcgaaagacccuacagacccguuucggcuccaguguaccugccagcacaauacaugcggcggcaccugugauagaugcugucccggguucaaccaacagccuuggaagcccgcuaccgccaauucugccaacgagugccaguccuguaacugcuacggacacgcuacagacuguuauuacgauccugaaguugaccgccggagagccagccagucccuggauggcacguaucaagggggaggcgugugcauugacugucagcaucacaccacaggggugaauugcgagcgcugucugcccggcuuuuaccggucuccgaaccauccucucgauagcccccacgucugcagacggugcaauugugaguccgacuucaccgauggaacaugcgaagaccugaccggccgcuguuauugcagaccuaacuucagcggggagcggugugaugugugcgcugaaggauuuacgggcuuccccucuuguuacccuacacccuccagcucuaaugacaccagagagcagguucuuccggccgggcaaaucgugaacugcgacuguagcgcggccggaacccagggcaaugcuugccgcaaagauccucgggucgggagaugucugugcaagcccaacuuucagggcacacacugcgaacucugugcccccggauucuacggcccugggugccagccgugucaaugcuccucucccggaguggcugacgaucgcugugacccugauaccggccagugcagaugucggguuggguuugagggagccacaugcgaccgcugugcgcccggcuauuuccauuuuccucugugccagcuuugugggugcagccccgccggcacgcugccugagggaugcgaugaagcuggcagaugucucugccagcccgaguucgccgggccgcacugugaccggugccgcccuggauaccauggcuuucccaauugucaggcuugcaccugugauccuagaggggcccuggaccagcugugcggagccggcgggcucugucggugccgccccggcuauacaggaaccgcuugucaggaaugcuccccgggcuuccacggguuuccuagcugcgugcccugucauugcucugcggagggaucccugcacgccgcuugugauccuagaagcggccagugcucuugucggccccgcgucacagggcuuagaugcgacaccugugugcccggagccuacaacuucccuuauugcgaagccggcuccugucacccggcuggccuggcccccgucgauccugcgcuccccgaggcucaagugccuugcaugugucgggcccauguugaggggcccagcugcgacagaugcaaaccuggauuuuggggccuguccccgucuaaucccgaaggguguacgcgcugcagcugugaccugcggggaacccuuggcgggguggccgagugccagccuggaacaggccaguguuucugcaagccccacgucuguggccaggcuugcgccuccuguaaggauggguucuuuggacucgaccaagcggauuacuucggcugcagaucuugucgcugcgacauugggggagcucugggccagagcugugaaccucggaccggggugugcagaugccgccccaacacacagggaccgaccuguuccgagccugcccgggaucauuaucugcccgaccuccaccaccugagacuugagcuggaagaggccgcuacgcccgaaggccaugccguucgcuuuggcuucaauccucucgaguuugaaaacuucagcuggcggggguacgcucaaauggcccccgugcagccuagaaucgucgcgcggcugaaucugacaucuccggaucucuuuuggcucguguuccgcuacgugaacagaggagccauguccguuagcggccgggucucugugcgcgaggaggggagauccgcuaccugcgccaacuguacagcucagagccagcccguggccuuuccucccucuaccgaaccugccuucaucaccgucccccaacggggauuuggcgagccguucgugcugaauccugggacaugggcucugagaguugaagcggagggagugcuccuggacuaugucgugcuucugcccagcgccuacuaugaagcugcccuccugcagcugcgcguuacggaggccugcaccuaccggccuuccgcucagcagagcggcgauaacugucuucucuauacacaucugccccuggacggcuuuccuucugccgcggggcucgaggcucugugcagacaagauaauucccuuccccgcccguguccuaccgaacagcugagccccucccaucccccucucauuacaugcaccggaucugacguggauguccagcugcaaguggccguuccgcaacccggccgguacgcccugguggucgaguaugcuaacgaagacgccagacaggagguggggguggcgguccacacgccucagcgcgcuccccaacagggacuucucagccugcauccuugucuguacuccacacucugccggggcaccgccagagacacccaggaucaccuggccguuuuccaccuugacucugaagcuagcgugcgccugacagccgagcaggcuagauucuuucuccauggggugacccugguccccaucgaggaguucuccccugaguuuguggaaccgcggguuucuuguauuagcucccacggagccuucggccccaauagcgcggccugccugccuucucgcuuucccaaaccuccccaaccgaucauucuuagagauugccaggugaucccucugccgcccggccucccucugacacaugcucaggaccucacgcccgccauguccccugcugggccgcggccccgcccucccaccgccgucgauccugacgccgagcccacacugcuuagagagccgcaggcuaccgugguuuucacaacccacgugccuacgcugggacgguacgcguuucuccugcauggcuaucaacccgcccacccuaccuuccccgucgaagugcugaucaacgcugggagaguuuggcagggacacgccaaugccagcuuuuguccucauggcuacgggugccgcacacuuguggucugugagggacaggcucugcucgaugugacccacucugaacugacagugaccguccggguucccaagggcagauggcucuggcuggacuaugugcuuguggucccggagaacguguacuccuucggcuaucugcgcgaagaaccucucgauaaaagcuacgacuuuauuucucauugcgccgcgcagggguaucacaucucccccagcuccagcucucuguucugucggaaugcugccgccagccugucccuuuucuacaacaauggagcuagacccugcggcugucacgagguuggggccacaggaccuaccugcgaaccguuuggcgggcaaugucccugccaugcgcacgugauuggacgggauuguucucgcugcgccacgggcuacuggggcuucccuaacugcagacccugugacugcggggcucggcugugugacgagcucacaggacagugcaucuguccuccccgcaccauuccucccgauugccugcucugucagccgcagaccuuuggcugccauccucuggucgggugugaagagugcaauuguagcggacccggcauccaagaacuuacagacccuaccugcgauacggacuccgggcagugcaaguguagacccaacgugacaggccggcgcugcgauaccuguucuccgggauuccacggcuauccuagaugccggcccugugacugccaugaggccgggacagcucccggaguuugugauccucugaccggccagugcuacuguaaagagaaugugcaagggcccaagugcgaccaguguagccugggaacauuuucccucgaugccgcuaacccuaaaggcugcacccgcugcuucuguuuuggggccacggaaagaugccggucuagcuccuauaccagacaggaguucgucgacauggaaggcugggugcugcuuagcacagaucgccaggucgugccgcacgagcggcaacccggaaccgaaaugcugagagcggaccuccgccacguuccugaggccgugcccgaggcuuuuccugaacuguacuggcaggcgcccccuucuuaucucggcgaucgggucuccagcuacgggggaacacugagauaugagcuucauucugaaacccagcgcggcgacguguucguuccgauggagucccggcccgacgugguccugcaggggaaccaaaugagcaucacguuucuggagccugcuuaccccacaccuggacacgugcauagaggccagcuccagcugguggaagggaauuuccgccacaccgagacacggaacaccguuuccagagaagaacuuaugaugguccuggccucucucgaacagcugcaaauucgcgcccucuuuagccagaucuccagcgcuguguuccugcggagaguggcgcuugaggucgccucucccgcuggccagggagcccuggccuccaauguggagcugugucucugcccggcuagcuaccgcggcgauucuugucaagaaugcgccccuggguucuauagagacguuaagggacuguuucuuggccggugugugcccugccagugucacgggcauagcgaucgcugccugcccggauccggcgucuguguggacugccagcacaacaccgagggcgcgcauugcgaaagaugucaggccggguucguuucuagccgggaugacccuuccgcucccugcgugucuuguccuugcccgcucagcguccccuccaauaacuuugccgagggaugugugcugagaggcgggcggacacaaugccucuguaagccuggauacgcuggcgccagcugcgaacgcugugcgcccggguucuuuggaaauccucugguucuuggaucuuccugccagcccugugauugcagcggcaacggggacccgaaucugcuguucuccgauugcgacccucucacgggagccuguagaggcugccugcggcacaccacagggccccgcugugagauuugcgcuccuggauuuuauggcaacgcccuucugcccgggaauuguaccagaugcgauuguacaccgugcggaaccgaggcuugugacccucauucuggccacugccucuguaaagccggcgugacggggcggcgcugcgauagaugccaggaaggacacuucggcuuugacggguguggaggcugccggcccugugcuugcgggcccgccgcggagggaagcgaaugucauccucaguccggccaaugccacugucgccccggcacaauggggccucagugcagagagugugccccgggauacuggggccugcccgaacaggggugccggcgcugucagugcccuggaggcagaugcgacccccauaccgggcgguguaacugcccucccggacugucuggcgagcgcugugauaccugcagccaacagcaccaggucccugugccgggcgggcccgugggacacuccauccauugugaggucugcgaccacuguguugugcuccuucuggaugaccuggaaagagcuggcgcccuccugccugcuauucaugagcagcuucgggggaucaaugccagcucuauggccugggcgagacugcaccgccucaacgcuuccauugccgaucugcaaagccagcugcggucuccccucggaccuagacaugaaacagcucagcaacuugaggugcuggagcagcaguccaccagccugggccaggacgcccgccggcucgggggacaagccgucggcacaagagaucaggcuucucagcugcuugccggcacggaagcgacccuggggcacgccaagacacuccuggcugccauccgcgcuguggaccggacccugagcgagcucaugucccagacaggacaccuuggccuggccaaugcgucugcccccagcggggaacaacugcucagaacccuggcugagguugaacgccuucugugggagaugcgggccagagaucucggagcuccgcaggccgcugccgaggcggaacuggccgcugcccagcgccugcucgcucgggugcaggagcaacuuuccagccugugggaagagaaccaggcccuggccacgcagaccagagaccggcucgcgcaacaugaagcuggccugauggaucuuagagaggcccugaaccgcgccgucgacgcuacacgggaggcccaggaacucaauuccagaaaccaggagcgccuggaagaggcucugcagagaaaacaagaacucucucgggacaaugccacccuucaggcgacacugcacgccgcucgcgauacccuggccagcguguucagacuccugcauucccuugaccaggcuaaggaggagcuggaacggcucgccgcgucucuggauggggcccgcacaccucugcuccagagaaugcaaacguuuagccccgcuggauccaaacuucggcugguugaggccgcugaagcccacgcucagcagcugggccagcucgcccugaaccuuucuagcaucauucuggacgugaaucaagaucgccucacccagagagcgaucgaggccuccaacgcuuauagccggauucugcaggccguccaagccgcugaggacgccgcgggccaggcucugcagcaggccgaucauacaugggccaccgugguccgccaagggcucguggacagagcucagcagcuucuggccaauucuaccgcucuggaagaggccaugcuccaggaacaacagcggcugggacuuguuugggcggcccugcagggcgcucgcacacagcucagagaugugcgggccaagaaggaccaacuggaggcucacauccaggccgcgcaggccaugcuggcuauggauacggacgaaaccuccaaaaagauugcccacgcuaaagccguggccgcugaggcgcaggauacagccaccagaguccaaagccagcuccaggcuaugcaagagaacguugaacgcuggcaggggcaguacgagggacuucggggccaggaccuggggcaagccgugcuggacgccggccauucuguguccacacucgaaaagacccugccccagcuucuggcuaaacucagcauccuggagaauagaggaguccacaacgccucucuggcgcucuccgcuagcaucggccgcgugcgggaacuuauugcccaggccagaggggcugccuccaagguuaaggugccuaugaaauucaauggacgcagcggcguccagcugcggacgcccagagaucuggcugaccucgccgcguauacagcccugaaguuuuaccuucaagggccugagccggagcccggacagggcaccgaagaucgcuucgugauguacauggggucucggcaggcuaccggcgacuauaugggagucagccugagagauaaaaaggugcauuggguuuaccagcucggcgaggccgggccugcugugcuguccaucgacgaagauauuggagagcaauucgccgcggucucucuggaccggacacuccaguuuggccacaugagcgugaccguugaacgccagaugauccaagagacaaaaggggauaccguggcccccggagcugagggccugcuuaaccugagaccugacgauuucgucuuuuaugucgggggcuaccccuccacguucacaccgccuccccuccugcgguuuccuggauaucgcggcugcauugaaauggacacccuuaaugaggaagugguuucucuguacaacuucgagagaacauuucagcucgacaccgccgucgaucggcccugugcuagaagcaaguccacgggggacccuuggcugaccgauggaucuuaucuggacggcacaggguucgcccgcaucagcuuugauucccagaucagcaccacaaagcgguucgagcaggaacucagacuggugucuuacuccggagugcucuuuuuccugaaacaacagagccaguuucucugccuggccguccaggagggcucucuuguucugcucuacgacuucggggcuggccugaagaaagcggugccccugcaaccgcccccuccccucaccuccgccagcaaggcuauucagguguuccugcuuggaggcucccgcaaacggguccuggugagaguugaacgcgccacaguguauucugucgagcaggauaaugaccucgaacuggccgaugcuuacuaucuugggggagugccuccggaccagcugcccccuagccucagacggcuguuucccaccggcggguccguucgcggaugugugaagggcaucaaagcccugggcaaguacgucgaucucaagagacugaacacgacaggggugagcgcgggaugcaccgcugaccuucuggugggccgggccaugaccuuccacgggcauggauuucuccgccuggcccuuucuaaugucgcuccucugacaggcaacguuuauuccggguucggauuucacagcgcccaagauucugcucuccuguacuauagagccagccccgacggccugugccaggugucccuccagcagggccgggugucucugcaacuucugcgcaccgaggucaaaacacaggcgggguucgccgacggagcuccucauuacguggccuuuuacagcaacgcuacgggcguuuggcucuauguggaugaccagcugcaacagaugaagccccacagagggccgccucccgagcuucagccucagcccgaaggaccgccucggcugcuccugggcgggcugcccgaguccggaaccauuuacaauuucucuggcuguaucagcaacgucuuugugcaaagacuccugggcccccagcgcguuuucgaucuucagcagaaucugggguccgugaacgucagcacaggaugcgccccugcgcuccaagcccagacccccggccuggggccucggggacuucaggcuacagccagaaaggcuucucgccgguccagacagccggcccgccaucccgccuguaugcugccuccccaccuccggaccacgagagacagcuaucaauuuggcgggucccugucuagccaccuggaguucgugggcauucuugcucggcaucgcaauuggccuucccugucuaugcacguucuucccagaagcucccggggccugcuccuguuuaccgcgcgccuuagaccgggcagcccuucucuggcccucuuccuguccaacgggcauuucguggcucagauggagggacugggcacacggcuucgcgcccagagcagacaacggucuagacccgggcgcuggcacaaggucuccgugcggugggagaaaaauagaauccugcucgucaccgauggagcccgcgcuuggagccaggagggcccucaccggcagcaucagggggccgagcacccccaaccucauacacuguuugugggaggccuccccgcgucuucccacagcucuaagcugccgguuaccgugggcuucagcgggugcgucaagagacuucgccugcauggacggccccugggcgcuccuacgagaauggccggggugacacccuguauccucggaccucuggaagccggccucuuuuuccccggguccggaggcgugauuacccuggaccucccuggcgcuacacugccggauguugggcucgagcuggaagugcgcccccuggccgucaccggacuuaucuuucaccugggccaggcucggaccccucccuaccuccagcuucaggugacagagaaacaaguucugcugagagccgacgauggggcgggagaguucagcacguccgugacccgcccuucuguccucugcgacggccaguggcacagacuggccgugaugaaaagcgggaacguccuccggcuggagguggaugcucaguccaaucauacaguuggaccccugcuugccgcugccgcgggcgccccggcuccucuguaucucggcgggcugcccgagccuauggccgugcagcccuggccgccugcuuacuguggaugcaugcgcagacuugccgucaaccggucucccguggcgaugaccagaagcguugaagugcacggcgccgucggggcuuccggaugucccgccgcuuga

SEQ ID NO: 71363 - RNA, 5361 nt, Artificial Sequence
  derived and/or modified sequence opt5 from LAMB1__Homo_sapiens__NP_002282
augggccugcuccagcugcuugccuucagcuuucuggcucucugcagagcccgggugcgcgcgcaagagcccgaauucuccuacgggugugcugagggaucuugcuauccugccaccggcgaccugcuuaucgggagagcccagaagcugagcgucacauccacguguggacuccacaaaccggaacccuacugcauuguuucucaucugcaggaggauaagaaauguuuuaucugcaacagccaggacccuuaucacgaaacccugaaucccgauucccaucucauugagaacguggugacaaccuucgcuccuaaucggcugaagaucugguggcaaucugagaacggcgucgaaaaugugacaauucagcuugaccuggaggccgaauuucacuucacccaucucaucaugacauuuaaaaccuuccgccccgcugccaugcugaucgagagaagcuccgauuuugggaagacguggggaguuuaccgguauuucgcguacgacugugaggccagcuuuccuggcauuucuaccggcccgaugaagaaaguggaugacaucauuugcgauucccgcuauagcgacaucgaacccucuacagagggggaagucauuuucagagcucuugauccugccuuuaagaucgaggaccccuacuccccucggauucagaaccugcucaaaaucaccaaucugcgcaucaaguucgugaaacugcacacacucggagauaaccugcuugacagcagaauggaaauucgggagaaguacuauuacgcuguuuaugacauggugguccgcggcaauuguuucugcuacgggcacgccucugagugugcgcccguggauggauuuaacgaagagguggaaggcaugguccaugggcacugcaugugcagacauaauaccaagggacugaacugugagcucugcauggacuucuaucacgaucugccguggcggccugccgaaggccgcaauuccaacgcuuguaaaaagugcaauuguaacgagcacagcaucuccugccauuuugacauggccguuuaccuugcuacgggcaacgugucugggggagugugugaugacugccagcacaauacaaugggcagaaacugugagcaaugcaaacccuucuauuaccagcauccugaacgggauauuagagaccccaauuuuugugagcgcugcaccugcgaucccgccgggagccagaacgaaggaaucugugacuccuacacagauuucagcaccggccugauugccgggcagugccgguguaagcucaaugucgagggagaacacugcgacguguguaaagagggcuuuuaugaccugucuuccgaggauccuuucggcugcaagagcugugcuugcaacccgcuggggaccauccccggaggcaauccuugugacucugaaacagggcauugcuacuguaaaagacucguuacgggacaacacugcgaucagugccugcccgagcacuggggccuuagcaacgaccuggaugggugucgcccuugcgacugugaucucggcggagcgcugaauaacuccugcuuugccgaaucuggccaguguagcugccggccccauaugaucgggagacaauguaaugagguggagccgggauauuacuucgcuacccuugaccacuaucuguacgaagccgaggaagccaaccucggcccuggggucuccauuguggagcgccaguauauccaggaucggauucccagcuggacaggagcuggcuuuguuagagugccugaaggggccuaccuggaguucuuuaucgacaauauucccuacucuauggaguaugauauccugauccgcuacgaaccucagcuccccgaccauugggagaaggcggucauuaccgugcaacggccgggcagaaucccuacauccagccgcugcggaaacaccauucccgaugacgacaaucaggucgugucucugucccccggcagccgguauguugugcuuccuagaccggucuguuucgaaaaggggacgaacuacacagugcggcuggagcucccccaguauaccuccucugauagcgacguugaauccccuuacacccugaucgauucucuggugcuuaugcccuauugcaaaagccucgacauuuucacagucggaggcuccggggauggaguggugaccaacagcgcuugggagacauuucagcgcuacagaugucuggagaauucucgguccguugucaagacgccuaugaccgacgugugcagaaacaucauuuucagcaucucugcccugcuccaccaaacaggccuggccugcgaaugugauccccaggggucccuuagcucugugugcgacccuaauggcggacagugucagugccgccccaacgucgugggccggaccuguaauagaugcgcuccggggacauuuggauucggcccuagcggguguaaacccugcgagugucaccugcaaggauccguuaacgccuuuugcaauccugugaccggccagugucauugcuuccagggggucuacgcucgccagugcgauagaugucuccccggccacuggggauuuccgagcugccaaccuugucagugcaacggccaugccgacgauugugaccccgugacgggggaaugccugaauugucaggauuauaccaugggacacaacugcgagcggugucuggcgggcuacuauggggacccuaucauuggaucuggcgaccauugccgccccugucccugcccugauggcccggacuccgggagacaauucgcccggagcugcuaccaggaucccguuacacuucagcucgcuugugugugcgacccuggauauaucggcucccgcugugaugacugcgccucuggguacuuuggaaaucccagcgaagucggcggguccugucagccuugccaaugucacaacaauauugauaccacagaccccgaggcuugcgauaaggagaccggaagaugucugaaaugccuguaucacacggaaggcgagcauugucaguucugccgguuuggcuacuacggggacgcccuccagcaggauugucgcaagugcgugugcaacuaucugggaacaguucaagaacacuguaauggcucugacugccagugugacaaggcgaccgggcagugccuuugucugccuaacgugaucggacagaacugcgauagaugugccccgaauacauggcaacucgcuagcggcaccgggugcgaccccuguaacugcaaugccgcucauuccuucggaccuucuuguaacgaguuuaccggccagugccagugcaugcccggcuucgggggacggacauguagcgagugccaagaacuguucuggggcgauccugacgucgagugucgcgccugcgauugugaccccagagggauugaaacgccgcagugcgaucaguccaccggacagugugugugcguggagggcgucgaagggccucggugugacaaaugcacaagaggauacagcggcguuuuucccgauuguacccccugccaccaaugcuucgcccugugggacgugaucaucgcugagcuuacaaaucgcacccaucgguuucucgagaaggcgaaagcccugaagauuucuggcgugaucgggccuuauagagaaacggucgauuccguggagcgcaaaguuagcgaaauuaaggacauccuggcucagucucccgccgccgagccucucaagaacauuggaaaucuguucgaagaggcugagaaacuuaucaaggaugugacagaaaugauggcccaggucgaggugaaacuguccgacaccaccagccagucuaacuccacagcgaaggaacucgacagccugcaaaccgaggcugaaucccuggauaauacaguuaaagagcuugccgagcagcucgaauuuaucaagaacagcgacauucggggcgcccuggauucuaucacgaaguacuuccagaugagccuggaggcugaagagagagugaaugccuccaccacagagccgaacucuaccgucgaacagagcgcgcucaugcgcgaccggguggaggauguuaugauggaaagagagucccaauuuaaagaaaagcaggaggagcaggcucgccugcuugacgaacuggccgggaaacuccagucucuggaucugagcgccgcugccgagaugacauguggaacccccccuggcgcuuccugcucugaaacggagugugggggacccaauugccggaccgacgaaggcgagagaaaguguggcgggccuggaugcggcgggcuugugacagucgcccacaacgcguggcaaaaagccauggaucuggaccaggaugugcucagcgcucuggccgagguggaacagcucuccaagauggucagcgaggcuaaacugcgggccgacgaagccaagcaaucugcugaggauauucuucugaagaccaaugcgacaaaagaaaagauggacaaauccaacgaggagcuccgcaaccugaucaagcagauuagaaauuuccugacccaggacagcgccgaucuugacucuaucgaagcuguugccaacgaggugcugaaaauggaaaugcccuccacaccgcagcaacuccagaaucugaccgaggauauccgggagcgcguggaaagccucucccaggucgaggugauucugcagcacucugccgcugacaucgccagagcggaaaugcuucuggaggaagcuaagcgggccagcaaguccgccacggauguuaaagugacagcugacauggucaaggaggcccucgaggaagcggagaaagcucaaguggccgccgaaaaggcuauuaaacaggccgaugaggacauccagggaacccagaaccugcugaccagcauugaaucugagacagcugccuccgaggaaacccuuuuuaaugcgagccaaagaaucucugagcuggaacgcaacguugaggaacucaagcggaaggccgcucagaauagcggcgaggccgaguauauugaaaaaguggucuacacggugaagcaguccgcugaggaugucaaaaagacacuggacggggaacucgaugagaaauauaagaagguggagaaccugaucgccaaaaagaccgaagagucugccgacgcuagacgcaaagcggaaaugcuucaaaaugaggccaagacacugcuggcucaggccaacagcaaacuccagcugcuuaaggaccuggaacggaaauacgaggauaaucagagauaccucgaggacaaggcccaagaacuggcucgccucgagggagaaguucggucccugcuuaaggauaucucucagaaaguggccgucuauagcaccugucuguga

SEQ ID NO: 71364 - RNA, 5397 nt, Artificial Sequence
  derived and/or modified sequence opt5 from LAMB2__Homo_sapiens__NP_002283
auggagcugaccagcagagaacggggccgcgggcagccccucccuugggagcugagacuuggacugcuccuguccgugcuugccgcuacacuggcccaagcgccggcucccgacgucccuggcugcucucgggggagcuguuaccccgccacgggagaucuccugguuggccgcgccgacagacugaccgcuuccucuacaugcgggcucaacggaccucagcccuauuguaucgugagccaccugcaggaugaaaagaaaugcuuccuuugugacucccggcgcccuuuuucugccagagauaauccgcauagccaccggauucagaacguggucaccuccuucgcuccccaacgcagagccgcgugguggcagagcgagaauggcaucccugccgugacaauucagcuggaccucgaagcugaguuucauuucacccaccugaucaugacauuuaagaccuuccggcccgccgcuaugcuuguugagcgcucugccgauuuuggcagaacguggcauguguaccgguauuucuccuacgacugcggggcggauuuuccuggagucccccuggccccgccucgccacugggacgaugugguuugugaaagcagauauucugagauugaacccuccaccgagggcgaggugaucuaccggguccucgacccugcuauccccauucccgauccuuauagcucuagaauccagaaccugcugaaaauuacaaaucuccgcgugaaccugacccggcuucacacacugggggacaaucuccuggacccgagacgcgaaauccgggagaaguacuacuaugcccuuuacgaacugguggucagaggaaacugcuucuguuauggccaugcuuccgagugcgcccccgccccuggggcucccgcgcacgccgaaggaaugguucauggcgcuuguauuugcaaacacaauacccgcggccucaacugcgagcaaugucaggauuuuuaccgggaccugccuuggagacccgccgaggaugggcacagccaugccugccgcaagugugaaugccacggacauacgcacuccugucauuucgacauggcuguguaucuggccucuggcaaugugagcgggggagucugcgauggcugucagcacaacacagcggggcggcacugcgagcucuguagaccguuuuucuaccgcgacccuaccaaggaucugcgggaccccgcugugugcagauccugugauugcgacccuaugggaagccaggauggcggccggugcgacucucaugacgaucccgcccuugggcugguuuccggacaaugucgcugcaaagaacacguggucggcacaagaugucagcagugccgggacggguucuuuggacucagcaucucugauagacugggcugucgccggugccaauguaaugccagagggaccgugccuggcagcacccccugcgacccgaacuccggaucuuguuauugcaagcgccuuguuacaggcagagggugugaucggugccugccuggacauuggggccucagccacgaccugcuggggugccgccccugugauugcgacgugggaggcgcucucgauccccagugugacgaggggacgggccagugccacuguagacagcauauggucggacggcgcugcgaacaagugcagccuggcuacuucagaccguuucuggaucaccuuauuugggaggccgaggacacccgggggcagguccuggaugugguugaacgccucgugacacccggagagaccccuuccuggacaggcagcggguucgucagacugcaggaaggacaaacccuggaguuucuuguggcuucuguucccaaagccauggacuacgaccuccugcugcggcucgaaccucaggugcccgagcagugggcggagcuggaacuuaucguccagcgcccuggccccgugccggcccauucccugugugggcaccucgugccuaaggaugacagaauccaaggcacgcugcagccccaugcucgguaucugauuuucccuaaucccguuugccuugagccgggaaucagcuacaaacuccaccugaagcuggucagaacaggcgggucugcccagccugaaacccccuauuccggaccuggccuccugauugauagccuugugcugcucccccgcgugcugguccuggagauguuuuccgggggagacgcugccgcgcuugagcggcaggccaccuucgaaagauaccaaugucacgaggaaggccucgugcccucuaagacaagcccuuccgaggcuugcgccccgcugcugaucucucucagcacccugauuuauaacggggcucuucccugucagugcaacccucagggcucccugagcucugaaugcaauccccauggaggccaaugucucugcaaaccugggguugugggacgccggugugaucugugcgcccccggcuacuauggguuuggaccuacaggcugucaggccugccaguguucccacgagggcgcucugagcucucuuugcgagaagacguccgggcagugucucugcagaaccggagcguucggccugcgcugugaccggugccaaagagggcaguggggauuuccgagcugccgccccugugucugcaacggccaugccgaugaauguaauacacacaccggggcuugccugggaugucgggaccauacaggcggcgagcacugcgaaagauguaucgccggguuccacggagauccucggcuccccuacggcgggcagugccgcccuugucccugcccggagggaccuggcucucagagacauuuugccaccagcugucaccaagacgaauacucccagcagaucgugugccauugccgggcuggguauacgggacugcgcugugaggccugcgcgcccggccacuucggcgaucccagcagaccugggggacggugucagcuuugcgaguguucuggcaacauugaccccauggauccugacgcuugcgacccgcacaccgggcaaugucugagaugccuccaucacacagaaggaccccauugugcccacugcaaaccuggcuuccaugggcaggccgcucgccaguccugucaccggugcaccuguaaucugcugggaacaaacccccaacagugcccuagccccgaucagugccacugugacccguccucuggccagugcccuugucuucccaauguucaaggcccuagcugcgauagaugugcccccaacuuuuggaaucugaccuccgggcauggaugccagccuugugcgugccaccccucucgcgcucggggcccgacguguaacgaguucacagggcagugccauuguagagccggauuuggcgggcgcaccugcagcgaaugccaggagcuccacuggggagacccuggccugcaaugucacgccugcgauugugacucccggggcaucgauacaccccagugccauagauucaccgggcacuguucuugccgccccggagugagcggcgucagaugugaccagugcgcucggggguuuuccggaauuuucccugccugucauccgugccacgcuuguuuuggcgauugggaccgcgugguucaggaucucgccgcgagaacccaacggcuggaacagcgcgcccaggagcuucagcaaacaggggugcugggagcuuucgagagcucuuuuuggcauaugcaggaaaagcucggcaucguccagggcauugugggggccagaaauacguccgcugccagcaccgcccaacugguggaggcuacagaagagcugcggagagagaucggagaagcgaccgagcaccuuacacagcuggaagccgaccucaccgacguccaggaugagaacuucaaugcuaaccacgcccugucuggccucgaacgcgaccggcuggcccuuaaucugacgcucagacagcuggaucaacaucuggaccuucugaaacacuccaacuuucucggggcuuacgauagcauccgccaugcccacucucaguccgcggaggcugagcggagagccaacacaagcgcccuggcuguucccuccccugugagcaauucugccagcgcgcggcaccgcaccgaagcucucauggacgcccagaaggaggauuucaacuccaaacauauggccaaucagagagcucugggaaagcuuucugcccacacccauacacugagccugaccgacauuaacgaacucgugugcggcgcucccggggaugccccuugcgcgacaucccccuguggaggcgccggcugccgggacgaggaugggcaaccucgcuguggaggccugucuugcaauggggcugccgcuacggccgaccuugcccugggaagagcucggcacacccaggcggaacuccagcgcgcccuggcugagggcgggagcauccucuccagagucgccgagacacggcgccaggccucugaagcucaacagagagcccaggcggcucuggauaaggccaacgccagccggggccaaguggagcaggcuaaucaggaacuucaggagcugauucaauccguuaaagacuuucugaaccaggaaggagccgacccggauagcaucgagaugguggcgaccagaguccucgagcugucuauucccgccuccgcugaacagauccagcaucuugccggcgcuauugccgagcgcgugcggagccuggcugacguugaugccauccucgcgagaacagugggggacguccgccgggccgaacaacugcuccaggaugcuagacgcgcccggucuugggcugaggacgagaagcagaaagccgaaaccgugcaggccgcucuggaggaagcgcaaagagcccagggaaucgcucagggcgccauucgcggggccguugcugauacgcgggacaccgagcagacacuuuaucaagugcaggaaagaauggccggagcggagcgcgcccuguccagcgcuggcgagcgggccagacagcuggaugcucuccuggaagcccuuaagcugaaacgcgcggggaauucccucgccgcuucuaccgccgaggaaacagcuggcagcgcccaaggaagagcucaggaggccgaacagcugcuccggggcccucugggggaccaguaccaaaccgucaaggcgcuugccgagcgcaaggcucagggagugcuggccgcucaggccagagccgagcagcugcgggaugaagcgagagaccuccugcaagcugcccaggauaaacuucagcggcugcaggagcucgaaggcacauaugaggaaaacgagcgcgcucuggaguccaaggccgcccaacuggacgggcucgaagcuagaaugcggagcgugcuucaggccaucaaucugcagguccaaauuuacaacaccugucaguga

SEQ ID NO: 71365 - RNA, 3519 nt, Artificial Sequence
  derived and/or modified sequence opt5 from LAMB3__Homo_sapiens__NP_001121113
augagacccuucuuucugcucugcuucgcccugccuggccuucugcacgcucagcaagccuguagccgcggggcgugcuacccgcccgugggagaccuccuggucggccggaccagauuucuucgggcuuccucuacaugugggcugacgaagccugagaccuauugcacacaguacggagaauggcagaugaaauguugcaagugugauagccgccagccccauaacuauuacucccacagaguugagaauguggccucuagcuccggcccuaugcggugguggcaaucucagaacgacgugaaucccgucagccuccagcuggaucuggaccgcagauuccagcuccaagaagugaugauggaguuucaggggccuaugccggccggaaugcugaucgaacgguccagcgauuucggcaaaaccuggcgcguuuaucaguaccuugcugccgacugcacaucuaccuuucccagagugcggcagggccgcccucaauccuggcaggaugucagaugucagagccugccccaacggccuaacgcucgccucaaugggggaaaggugcagcugaaccuuauggaccugguuucuggcauucccgccacacagucccagaaaauccaagaggugggggagauuaccaaucucagagucaacuucacgcggcuggcgccggugccucagagaggauaucaucccccuagcgccuacuacgcugugucucagcugcgccuccagggcuccugcuuuugucacgggcaugccgaucggugcgcucccaagcccggagccagcgcgggcccuuccaccgccguccaaguucacgacgugugcgugugucagcacaauacagcuggcccgaacugcgaaagaugugcccccuucuauaauaaccgcccuuggcggcccgcugaggggcaggaugcccaugaaugccagagaugugacugcaauggacacucugagaccugucauuuugauccugccgucuucgcugcgagccaaggcgccuacgggggagugugcgacaacugucgcgaccacacagagggcaagaauugcgaacggugucagcugcacuauuuuagaaaccgccggcccggggcuuccauccaggagaccugcauuagcugcgaaugugauccggacggagccguuccuggcgcccccugcgauccugugacgggccagugugucugcaaagagcaugugcaaggggaaagaugugaccuuugcaagcccggauucacaggccugaccuacgcuaacccucaggggugucaccgcugcgauuguaauauccucggaucucggagagacaugcccugcgaugaggaguccggccggugucugugccuuccgaacguuguggggccuaaaugcgaccagugugcccccuaucauuggaagcuggcgagcggccaaggaugcgaacccugugcuugcgauccucacaauucucucagcccgcaguguaaccaguucacaggccagugccccugucgcgagggguuuggaggccugaugugcuccgccgccgcuaucagacaauguccugaccggaccuacggggaugucgccaccggaugcagagcuugugacugcgacuuccgcggcacagaagggcccggcugcgauaaagccucuggacggugucugugcagaccuggccucacggggccccgcugugaccagugccagagaggauauuguaaucgguacccugugugcgucgcgugucaucccugcuuucagaccuacgaugccgaccugcgcgagcaagcucuuagauucggccggcugcgcaacgccacagcuagccucugguccgggccgggacuggaagauagaggccuugccagccggauucuggacgcgaagucuaagaucgagcagauucgcgccgugcucuccagcccugcuguuaccgagcaggaaguggcccaggucgcuucugccauccugucccugagacggacacuccaagggcugcagcuugaucugccccucgaggaagagacccugagccugccucgcgaccuugaaucccucgauagaucuuuuaauggccugcugacgauguaucagcggaaaagagagcaauucgagaagauuagcuccgccgaccccucuggagcuuuucgcaugcucagcacagcguacgaacaguccgcccaggcugcccagcaagugagcgauucuucccggcugcuugaccagcugagagauagccgccgggaggccgaaagacucguucgccaggcuggcgggggaggcgggaccggaucuccgaaacugguggcccugcggcuugagauguccagccucccugaccugacccccacauucaacaagcuguguggcaauucuagacagauggcgugcaccccuaucagcugucccggggagcucugcccccaagacaacggcacagcuugcggaucccgcugucggggcguccugccuagagccgggggagccuuucuuauggcuggccagguggccgaacagcugcggggguucaaugcgcagcuccaacgcacgagacagaugauucgggcugccgaggaaagcgccucucagauccaguccagcgcucaacgccuggagacccagguguccgccucuagaagccagauggaagaggauguucggagaacacgccugcuuauccaacagguccgggacuuucucaccgauccggacacagaugcugccaccauucaggagguguccgaagcggugcuggcccuguggcuccccacggacucugcuaccguccugcagaaaaugaacgagauccaagccauugcugccagacuuccuaauguggaucugguucucagccagacaaagcaggacaucgcccgcgcucggagacugcaggcggaagccgaggaagcucgcucccgggcccacgccguggagggacaagucgaggaugugguuggcaaccugagacagggcaccguggcccuucaggaagcucaggacacaaugcaagggaccucucgcagccucagacugauucaggaucgggucgcggaggugcagcaaguucugcgccccgcugaaaaacucgugacguccaugacaaagcagcugggagacuucuggaccagaauggaggaacuucggcaccaggcccgccagcaaggcgccgaggcuguccaggcccagcagcuggcggagggggcuagcgaacaagcccucucugcccaggagggauuugaaagaaucaagcagaaauaugcugagcugaaggaucggcugggccaguccagcaugcuuggggagcaaggagccagaauccagucugugaaaacagaagcugaggaacuguucggcgagaccauggaaaugauggaccgcaugaaggacauggagcucgagcugcuccggggcucccaggccauuaugcugagaagcgcggaucuuaccgggcuggaaaaacgcguggagcagauccgggaccauauuaauggaagaguccucuacuaugccacaugcaaguga

SEQ ID NO: 71366 - RNA, 5286 nt, Artificial Sequence
  derived and/or modified sequence opt5 from LAMB4__Homo_sapiens__NP_031382
augcaguuccaacugacccucuuucugcaccuuggcuggcugagcuacagcaaggcccaggacgacugcaacagaggggcuugucaccccacaacgggagaccuccuggugggccggaacacccagcuuauggccucuagcacaugcgggcugucccgcgcgcagaaguauuguauccucucuuaccuggaaggagaacaaaagugcuucauuugugauagcagauuuccuuaugaccccuacgaucagcccaacucccacaccaucgaaaaugucauuguuucuuucgaaccugaccgggagaaaaagugguggcagagcgaaaacggccuggaucauguguccauccgccucgaccuggaagcucuuuuuagauucagccaccugauucucacauuuaaaaccuuccggcccgccgccaugcugguggagcgcucuacagauuaugggcauaauuggaaggucuuuaaguacuucgcuaaagacugcgccaccuccuuuccuaacaucacgagcggacaggcucaaggcgugggcgauaucguuugugacucuaaguauuccgauauugaacccagcaccgggggagaggugguccuuaaagugcuggacccuucuuucgaaaucgagaauccguacucccccuacauucaggaccucguuacacugaccaaccugagaaucaauuuuacaaagcuccacacccugggcgaugcccuucuggggcggcgccagaacgacagccucgauaaauauuacuaugcgcuguacgagaugauugugagaggauccugcuucuguaauggccacgccucugaaugccggccuaugcagaagaugcgcggggacgucuucuccccucccggaauggugcauggccaaugugugugccagcacaacacggauggccccaauugcgagagauguaaggacuuuuuccaggaugcuccguggcggccugccgcugaccuucaagauaacgccugccgcuccuguagcugcaauucucauuccagcagaugucacuuugacaugacaaccuaucuggcgucugggggacucagcggcggggucugcgaagauugucagcacaacacagagggacagcauugcgaccgguguagaccccuguucuaccgcgacccucugaaaaccaucuccgaucccuaugccugcauucccugugaaugcgacccugauggcaccaucucugggggaaucugcguuagccacuccgacccggcucucggcagcguggccggccagugucugugcaaggagaacguggagggggcuaaaugugaucaaugcaagcccaaucauuacggacuuucugccacagacccucugggcugucagcccugcgauuguaacccucucgggucccugcccuuucuuacgugcgacgucgauaccggacagugucugugccucagcuacgugacaggcgcccacugugaagagugcaccguuggguauuggggccugggaaaucaucugcacggcugcucuccgugugacugcgauauugggggagcuuacuccaacguguguagcccuaaaaauggccagugcgaaugucggccccacgucacagggagauccugcucugagccugcgcccggauauuucuuugccccucucaacuucuaccuguaugaagcugaggaggccaccacgcuucaaggccuggcgccccuggggagcgaaacauuuggccaguccccggcugugcauguugugcugggagagccuguccccggcaaucccgugaccuggaccgggccuggauucgcccgcguccugccgggcgcggggcuucgguuugcugugaacaauauccccuucccuguugacuuuacaauugccauccacuacgaaacccagucugccgcugauuggacagugcagauugucgugaaucccccuggaggcagcgagcauuguauccccaagacgcuccaauccaaaccucagagcuucgcccugcccgcugccaccagaaucaugcugcucccgacaccuauuugccuggaacccgacguucaguauucuaucgacguguacuucucccagccucuucaaggggagagccacgcgcacucucauguccugguggauucccucggccugauuccccagaucaauagccuggagaacuuuuguucuaagcaggaccuugaugaauaccaacuccacaauugcguggagauugccagcgcuaugggaccgcagguucugccuggcgccugugaacgccugaucaucuccaugagcgcuaagcuccaugacggggccgucgcgugcaaaugccacccccagggaucugugggcuccagcuguucccggcucgggggacagugccaauguaagccucuuguggucggcagaugcugugaucgcugcucuaccgggagcuaugaccugggccaucacggaugucaccccugccauugucacccccagggcuccaaagauacagugugcgaccagguuaccgggcaguguccuugccauggagaggugucuggccggagaugcgaucgcugucucgccggguacuucggauuuccgagcugccaccccuguccuugcaaccgguucgcugagcugugugaccccgaaacgggcuccugcuuuaauuguggcggguucaccacaggaagaaacugcgagcgguguauugauggcuauuacgggaacccuucuagcggacaacccugccgcccuugucugugcccggacgaucccuccagcaaucaguauuuugcccauucuugcuaccagaaccuuugguccagcgacgucaucuguaauugccuccagggcuauaccgggacacaauguggagaaugcucuaccggcuucuacggcaacccuagaauuuccggggcucccugucagccuugcgccuguaauaacaauaucgacgugacggaucccgagagcugcucucggguuacaggagaaugucugagaugccugcacaacacccagggcgccaauugucaacucugcaagccggggcacuacggauccgcucugaaccagacaugucgccggugcagcugccaugcguccggcgugagcccuauggaguguccgcccgggggaggcgccugccuuugugacccugucaccggcgcuugccccugucugccuaaugugaccgggcucgccugcgauagaugugccgacggauauuggaaccugguuccgggccgcgggugccagucuugugauugcgaccccagaacaagccaguccucucacugugaucaacugacgggacagugcccuugcaaacuuggcuacgggggaaagcgguguagcgagugccaggaaaauuauuacggcgaucccccuggccgcuguauucccugcgauuguaacagagcugggacccagaagccgaucugcgacccugauacaggaaugugucggugccgcgagggcguguccgggcaaagaugugaccggugcgcccgcggacauucucaggaauuucccaccugucuccagugccaccugugcuucgaccagugggaucacacaauuagcucccugucuaaagcgguccaaggccucaugagacuggcugccaauauggaggacaagcgggaaacccuuccugugugugaggccgauuuuaaagaccugcgcgggaacgugagcgagaucgaaagaauccucaagcaucccgucuucccuuccggaaaauuucugaagguuaaggauuaucacgacagcgugcggagacagauuaugcagcugaacgagcagcuuaaagcuguguacgaguuccaagaucugaaggacacgaucgagcgcgccaaaaaugaagcggaucuccugcucgaggaccugcaggaggaaauugaucuucagucuuccguccugaacgcuagcaucgccgacucuuccgagaauauuaagaaauauuaccauaucagcuccucugccgaaaagaagaucaacgagacaagcuccaccauuaauaccagcgcuaacacacggaaugaucuccugaccauccuggacacacuuacgucuaaaggcaaccugucccucgagagacugaagcaaauuaaaauccccgacauucagauccucaaugaaaaggugugcggcgauccggggaacguuccuugugugccccugcccugcggaggcgcccuuuguaccgggcgcaaaggacaccggaagugcagaggcccugggugucauggaagccugacacucucuaccaaugcucugcagaaagcccaggaggccaagagcaucauucgcaaccuggacaagcaaguccggggccuuaaaaaucagaucgaauccauuucugagcaggccgaagugagcaagaacaaugcucugcagcucagagagaaacugggcaacauccgcaaccaauccgauucugaggaagagaauauuaaccucuucaucaagaaaguuaagaauuuucugcuugaagagaacgugccgcccgaagacaucgagaaggucgccaauggggugcuggauauucaucugccuauccccagccagaaccucacagacgagcugguuaaaauucagaagcacaugcagcuuugcgaagauuaccggaccgacgagaauagacugaacgaagaggcugauggagcccaaaaacuccuggugaaggccaaagcugcggaaaaggccgcuaauauccuccugaaccuugacaagacgcugaaucagcugcagcaagcccagauuacccagggccgggccaacuccacaaucacccagcucacagcuaauauuaccaaaaucaagaaaaacguccugcaagccgagaaucagacacgcgagaugaaaagcgaacuugagcuggcgaaacagagaucugggcucgaagauggacugucccuccugcagaccaaacuucaacggcaucaggaccacgcugugaacgccaaggugcaggccgagagcgcucagcaucaagccggcucccuggagaaagaguucgucgagcugaagaaacaguaugcgauccuccagcgcaagacgucuacaaccgggcugaccaaagaaacacuuggaaagguuaaacagcugaaggaugcugccgagaagcucgccggcgacaccgaagcuaaaauuagacggaucacggaccuggagagaaagauucaagaucucaaucugagccgccaggccaaagcugaccagcuucggauccuggaggaucaagugguggccauuaagaacgaaaucgucgagcaggagaagaaguacgcgagauguuauuccuga

SEQ ID NO: 71367 - RNA, 4830 nt, Artificial Sequence
  derived and/or modified sequence opt5 from LAMC1__Homo_sapiens__NP_002284
augagaggcagccaccgggccgcucccgcccugcgcccuagagggcggcucuggccggugcuggcgguccuugcugccgccgcugccgcuggaugcgcccaggcggccauggacgaguguaccgaugaaggcgggcgcccccaaagaugcaugccugaguucguuaacgcugccuuuaaugugacaguggucgcuacgaacaccuguggaacacccccugaagaguacugcgugcagaccggcguuacaggggugaccaaguccugucaucugugcgacgccggacagccccaccuccagcauggcgcggccuuccugacagauuauaauaaccaagcugacaccacgugguggcagucucagaccaugcuugccggcguccaguacccuagcuccaucaaucugacacuccaccuggggaaggcuuuugauauuaccuaugugcggcugaaauuccauacaucucgcccggagagcuuugccaucuacaaaagaacccgggaagacggacccuggauuccuuaucaauacuauuccggcucuugugagaacacguacagcaaggccaaucgcggguucaucagaacaggaggcgaugaacagcaggcucucugcaccgacgaguuuuccgauauuagcccccugacagggggaaacguugcguucucuacccuugaaggccggccuuccgccuacaauuuugacaacagccccgugcugcaggagugggucaccgcuacagauauccgcgugacgcucaauagacugaacaccuucggcgacgagguguuuaaugauccgaaaguccuuaagucuuauuacuaugccaucuccgacuucgccguugggggacgguguaagugcaacggccacgcuagcgaauguaugaaaaaugaguuugacaagcuggugugcaacugcaaacacaacacauacgggguggauugugaaaagugccucccuuucuucaaugaccgccccuggagacgggccaccgcggagucugcuuccgaaugucugccuugcgauuguaacggaagaagccaagagugcuauuuugaccccgagcuguaccgcuccacaggccaugggggacacuguaccaauugccaggauaacacggacggcgcccauugugaacggugcagagagaauuucuuucgccucggcaacaaugaagccuguucuagcugccacugcucccccgucgggagccugucuacacagugugauuccuauggacggugcagcuguaaaccuggcgugaugggggacaagugcgauagaugucaaccgggauuccacucucuuaccgaggcuggcugccgccccuguagcugcgacccuuccgggucuauugaugaauguaacaucgagaccggccggugcguuuguaaggacaauguggagggauuuaacugcgaaagaugcaaacccggcuucuuuaaucuggagagcuccaacccucgcggguguacacccugcuucuguuuuggacauagcucugucugcaccaaugccgugggcuacuccguuuacagcauuucuuccacauuccagaucgacgaagauggguggcgggcugagcagagagacggaagcgaagccucccucgaguggucuagcgagcgccaggauauugcggugaucuccgacucuuauuuuccgcgguacuucauugccccugcuaaguuucugggcaaacaaguccuuagcuaugggcagaaccuguccuucagcuucagaguggaucggcgcgacacgagacucucugccgaagaucugguccuggagggcgcuggacuccggguguccguuccccugaucgcccagggcaauagcuacccuucugaaaccacagugaaguaugucuuuagacuucacgaggcgaccgacuaccccuggcgcccugcccugacacccuucgaguuucagaaacuccugaacaaccuuaccuccaucaagauucgggggacguauagcgaaagaucugcuggauaccuggaugacgugacccucgccagcgcucgcccgggcccugggguucccgccacauggguggaguccuguaccugccccgucggauacggcgggcaauucugugaaaugugccugagcggcuauagacgggagacaccuaaucugggaccguacucucccugugugcucugcgccuguaacggccauuccgaaaccugcgauccugagacgggggugugcaauugucgcgacaacacagcuggaccccacugcgagaaauguagcgauggcuauuacggggacuccaccgcgggaacaucuagcgacugccagccuugucccugcccuggcggguccucuugugccguuguccccaagaccaaggaaguggugugcaccaauuguccgacaggcacgaccggaaaaagaugcgagcugugugaugacggcuauuuuggggauccucuuggacggaacggccccguccgccugugcagacucugccaguguagcgacaauaucgauccuaacgcuguggggaauugcaaccggcugacaggagaaugucugaagugcauuuacaauaccgccggcuucuauugugaccgcugcaaagauggcuuuuucgggaacccccuugccccgaauccugcugacaaguguaaagccugcaacuguaaucucuacggaacaaugaagcagcaauccucuugcaaccccguuaccggccagugugagugccugccucaugugacggggcaggauugcggagcgugugaccccggcuuuuacaaccugcagagcgggcaaggaugcgaaagaugugauugccacgcucucggcuccacaaauggccagugugacauccggaccgggcagugcgagugucaacccggaauuaccggccagcacugcgagcgcugugaagucaaccauuucggguuuggaccugagggcugcaagccgugugauugccaccccgaagggagccugucucuucaguguaaagacgacggaagaugcgagugccgggaaggcuucgugggcaauagaugugaucagugcgaggagaacuauuuuuacaaucgcuccuggccugggugucaagaaugccccgccuguuaucggcugguuaaggacaaaguggccgaucauagagucaagcuccaggagcuggaaagccugaucgcuaaccuuggaacaggcgacgagauggugaccgaucaggccuucgaggaccgccucaaagaagcggagcgggaaguuauggaucugcugagagaggcucaggacgugaaggaugucgaccaaaaucucauggaucgccugcagcgggugaacaauacacuuucuucccagaucagcagacugcagaacauucgcaauacgaucgaagagaccgggaaccucgccgagcaagcccgggcucacguggaaaauacagagagacugauugaaaucgccucucgggagcuggaaaaggcuaaagucgccgcggccaacguuuccgugacccagccugagagcacaggagaccccaauaacaugacccuucucgcugaggaagcccgcaagcuggcugagagacacaaacaggaagccgacgauauugugcgggucgccaagacggcuaacgacaccuccacagaggcguacaaucugcuccugcgcacccuugccggcgaaaaccaaacagcuuucgagaucgaggaacugaauagaaaauaugagcaggccaagaacaucagccaggaucucgaaaagcaggccgcucgggugcaugaggaggccaaaagagcgggggacaaggcuguugaaauuuacgccucuguggcccaacugagcccucuggauuccgagacccuugaaaaugaggcuaacaauaucaaaauggaagccgagaaccucgagcagcugauugaccagaagcugaaagauuaugaagaccuccgcgaggauaugcggggaaaggaacuggaggucaaaaaucuucuggaaaagggcaagacagagcagcaaaccgcggaccagcuccuggcuagagccgaugccgcuaaagcccuggcugaggaagccgcgaagaaaggccgcgacacgcuucaggaggccaacgauauccugaauaaccucaaggacuuugaccggagagugaaugauaacaaaacagcugccgaagaggcucugcgcaagauuccggccaucaaucagaccauuaccgaagccaacgagaagacacgggaggcucaacaggcgcucgggucugccgcugccgacgccaccgaagcuaaaaauaaggcccacgaggcggaaagaaucgcuagcgccguucagaaaaacgccacguccacaaaggcugaggccgagcgcaccuucgcggaagugacagaucuggacaacgaggucaauaacaugcuuaaacagcugcaagaagccgagaaggaacucaagagaaaacaggaugacgcugaucaggacaugaugauggccggaauggcuucucaagccgcucaggaggccgagaucaaugcgcggaaggccaaaaacagcgugaccucccugcugucuauuaucaaugaucuucuggaacagcucggccagcuggacacaguugaucucaacaagcugaaugagauugaagggacccuuaacaaagcuaaggacgagaugaaggugagcgaucuggaccgcaaagucuccgaccucgaaaaugaggccaagaaacaagaggcugccaucauggauuacaacagagacauugaagagaucaugaaggauauccggaaucuggaagacauucgcaaaacgcugcccagcggaugcuuuaacaccccuucuaucgagaagcccuga

SEQ ID NO: 71368 - RNA, 3582 nt, Artificial Sequence
  derived and/or modified sequence opt5 from LAMC2__Homo_sapiens__NP_005553
augcccgcccuguggcucggcugcugucugugcuucagccuucugcucccugcugccagagcgaccucccggcgcgaggugugugacugcaacgggaagucuagacaguguaucuuugaucgggaacugcaccgccaaacaggaaauggcuucagaugccuuaacuguaaugacaacacggaugggauucacugcgagaaauguaagaauggauuuuaccggcaccgcgaaagagaccggugccugccguguaacugcaauagcaaaggcucccucucugcucgcugcgauaacagcgggagauguuccugcaagcccggagucaccggcgcccggugugaccgcugccugccuggcuuccauaugcugacagaugccggguguacccaggaccagagacuccuggauucuaaaugcgacugugaucccgcuggaaucgccggcccuugcgacgcugggcgguguguuugcaagcccgccgugacaggagagcgcugugauagaugccggagcggcuauuacaaucuugacgggggaaacccugaaggcugcacccaguguuuuugcuauggccacuccgcgagcuguagaucuuccgccgaguacagcgugcauaagauuacaucuaccuuccaccaagacgucgauggguggaaagcugugcagcgcaauggauccccggccaagcugcaguggagccagcggcaccaagacguuuuuagcuccgcucagagacucgaucccguguauuucgucgccccugcgaaauuucugggcaaccaacaggugagcuacgggcaaucccuuucuuucgacuaucgcguugaucggggaggcagacaucccagcgcccacgacgugauccuggagggggcuggacuccgcauuacggccccucugaugccccugggcaagacccucccgugcggccugacaaaaaccuacacauuucggcuuaaugaacauccuuccaacaauuggagcccccagcugucuuacuucgaguauagacgccuccugcggaaccuuaccgcucugagaauccgcgccacguacggggaauauuccacaggauacaucgauaacgucacccucauuagcgcccggccugugucuggcgcucccgcgcccuggguggagcaguguaucugcccugucggguauaagggacaauuuugucaggacugcgccagcggcuacaagagagauuccgcucggcuggggccguucggcacauguauucccugcaauugucagggaggcggggccugcgacccugauaccggagacugcuauucuggcgacgagaaccccgauaucgaaugugccgacugcccuauuggguucuacaaugauccccacgacccgcgcagcuguaaaccuugccccugucacaacggauuuuccugcagcguuaugccugagaccgaagaggugguguguaauaacugucccccuggcgucacaggggcuagaugcgaacugugcgccgauggcuacuucggagaccccuuuggcgagcaugggccggugcggccuugucagcccugccaaugcaauaacaauguugaucccucugcguccggaaacugugacagacucacgggccgcugccugaaguguauccacaauaccgcugggauuuauugcgaucaguguaaagccggauacuucggcgacccucuugccccgaaccccgcugauaagugccgggccuguaauugcaacccuauggggagcgagcccgugggcuguagaucugacggaacaugcgucuguaaaccuggcuuugggggacccaauugcgaacauggcgcuuucuccugcccugccuguuauaaccaggugaagauccagauggaucaauuuaugcagcagcugcagcgcauggaggcgcucaucagcaaagcccaagggggagacggcguugugcccgacaccgaacuggaggggagaaugcagcaggcugaacaggcccuucaagauauucugcgggacgcucagaucuccgagggcgccucucgcagccucggacugcagcuggcgaaggucagaucccaagagaacucuuaccagagccggcucgaugaccugaagaugacaguggaacgcgucagagcccuuggcucccaguaucagaaucgggugcgcgauacccacagacugauuacgcaaaugcagcucagccuggcugagucugaagccucccuggggaacacaaauaucccggcuagcgaccauuacguuggaccuaacggcuucaaaucucuugcccaggaggccacccggcucgcugaaucccacguggagagcgcgucuaauauggagcagcugacccgcgaaacagaggauuauagcaagcaagcccugucccucgucagaaaagcucugcacgaaggggugggaagcggcucuggcucccccgacggggccguugugcagggacuugucgagaagcuggagaaaaccaagagccucgcccagcagcugacacgggaagcuacgcaagccgagauugaagcggauagauccuaccagcauucucugcgccuucucgacagcgugucccggcugcagggcgugucugaucagagcuuucagguugaggaagcuaagagaaucaaacagaaggccgacucccugucuagccucgucacccgccacauggaugaguucaaacggacacagaagaaccuggggaauuggaaagaggaagcccaacagcuucugcagaacggaaaguccggcagagagaagucugaccagcuccugucucgcgcuaaucuggccaaaucccgggcgcaagaagcucuuagcauggggaacgccaccuuuuacgagguggaaucuauccucaagaaucugagagaguucgaccuccagguggauaaccgcaaagccgaggcugaagaggccaugaagcggcuguccuauauuagccagaaagucucugacgcuuccgauaagacacagcaagccgaaagagcgcugggaagcgccgcugccgacgcucagcgggccaagaauggcgccggcgaggcucuugaaaucuccagcgagauugagcaggaaaucgggucucugaaccucgaggcgaaugugaccgccgauggagcucuggccauggaaaaaggccuggccagccuuaaguccgagaugcgcgagguugaaggggagcucgaaagaaaagagcuggaauuugacacgaacauggaugcugugcagauggucauuaccgaggcccaaaagguggacacacgggcgaaaaacgcuggaguuaccauccaggauacacugaauacccucgacggccugcuucaucugauggaucagccucucucuguggacgaggaagggcugguccugcuugagcaaaagcugagccgcgccaaaacgcagaucaacucccagcucagacccaugaugucugaacuggaggaacgggccagacagcaacgcggacaccuccaucugcuugagacaagcauugacggcauccuggcugaugugaagaaucucgagaacauucgggacaaucugccgccuggcugcuacaacacccaggcccuggaacagcaguga

SEQ ID NO: 71369 - RNA, 4728 nt, Artificial Sequence
  derived and/or modified sequence opt5 from LAMC3__Homo_sapiens__NP_006050
auggccgcugccgcgcugcuccugggccuugcucugcucgcccccagagccgcuggggccggaaugggcgcuugcuacgacggggccggacggccucagcgcugucugccgguguucgagaacgcggccuuuggcagacuugcucaagccagccauaccugcgggucucccccugaagauuucuguccccacgucggagcugccggcgcgggcgcccacugccagcggugugacgcugccgauccucagcgccaucacaaugcuuccuaucugacagacuuucauagccaggaugaguccacgugguggcaaucucccagcauggccuucgggguucaguacccuaccuccgugaacaucacacucagacugggaaaggccuaugaaauuaccuacgugcggcugaaauuucacacaucucgcccggagagcuucgcuaucuauaagagaucccgggcggacggccccugggaaccuuaccaguuuuauagcgccucuugccagaaaaccuacgggcgccccgagggacaauaccucagaccuggcgaggaugaacgggucgcuuucuguacauccgaguuuagcgacauuucuccccuguccgggggaaauguggccuucagcacccuugaaggccgcccgucugccuauaacuuugaggaguccccuggccugcaggaauggguuacgagcaccgagcuccugaucucccuugauagacugaauacauucggggacgauauuuuuaaggaccccaaagugcuccagucuuacuauuacgcugucagcgauuucuccgugggaggccggugcaaguguaacgggcacgccagcgaaugcggaccugacguugcgggccagcuggcuugucgcugccaacauaauaccacagggaccgacugcgagagaugucugcccuucuuucaggaucggcccugggccagaggaacggccgaagcugcccacgagugccucccuuguaacugcucuggccgcuccgaggaauguacauucgaccgggagcuguuuagaagcaccggccaugggggacgcugccaccacugucgggaucauacagcuggcccgcacugcgaaagaugucaggagaauuucuaucauugggacccccgcaugccuugccaacccugugauugccagucugccgggagccuucaucugcagugcgacgauaccggaaccugugcgugcaagccuacagugacgggcuggaaaugugaccggugccuccccggguuucacucccugucugaaggcggauguagaccgugcaccuguaacccugccggcagccuugauacaugcgacccccgcuccgggcgguguccuugcaaggagaaugucgagggaaaccugugugauagaugccgccccggcaccuucaaucuccagccucacaaccccgcugggugcagcucuuguuuuugcuacggacacuccaaagugugugccagcacagcucaauuccaggugcaucacauccugucugacuuucaucagggcgccgaaggguggugggcgcgguccgucggcggaagcgagcacccgccucaguggucccccaauggcguucugcucucucccgaagacgaggaggaacugaccgccccugagaaguuccuuggggaucaaagauuuagcuauggacagccgcugauccucacguuccgggugcccccuggcgacucuccccugccugugcagcuucgccuggaagggacaggacucgcucugucccugagacacagcucccucagcggcccccaggaugccgggcauccucgggaggucgaacugagauuucaccuucaagagaccucugaggacguggcucccccgcugccucccuuccauuuccagcgccuccuggccaaccugaccucccuucggcucagaguuagcccuggccccucuccggccggaccuguguuucugacagaaguccgccugaccuccgcuagacccggccucagcccucccgcgucuuggguggagauuugcagcugucccacaggguacacgggacaguucugcgaauccugugccccuggcuacaaacgggagaugccgcaagggggacccuaugcuagcugcguuccuuguaccugcaaccagcacggcacaugugaucccaauaccgggaucugcgugugcucucaucacacagaaggcccuuccugugagcgcugccugcccggauuuuacggcaacccuuucgccgggcaggccgacgauugucagccgugccccuguccuggacaaagcgcuugcaccacgauucccgaguccagagaagucguguguacccacugcccucccggccagcgggggcgcagaugugaggucugcgacgauggauuuuucggcgacccgcuuggccuguuugggcauccucagcccugucaccagugccaaugcucuggaaauguggaucccaacgccguuggcaauugugacccucucagcgggcauugccugcggugucugcacaacacaaccggagaucauugcgaacacugucaggagggcuucuauggguccgcgcuugcuccccgcccugccgacaagugcaugccguguucuugccacccccagggaagcguguccgaacagaugccuugugaccccgucacaggccaaugcucuugucucccucaugugaccgccagagauugcagccggugcuaccccggcuuuuucgaccugcagccggggcgcggauguagauccugcaagugucacccucugggcagccaggaggaucagugccaucccaaaacggggcaauguacaugccggccuggaguuaccggccaggcuugugacagaugccagcucggguuuuucggauuuucuaucaagggcugucgcgccugccgguguagcccccugggcgcggcuuccgcccaaugccacgagaaugggacaugugugugcagaccuggauucgaaggcuauaaaugcgaucgcugucacgacaacuucuuucuuaccgccgaugggacccauugccagcagugucccucuugcuacgcucuggucaaggaggaagccgcuaaacucaaggcccggcugacacugacggagggauggcuucagggcuccgacugugggagcccguggggaccucucgauauucugcugggcgaagcgcccagaggcgacguguaucaagggcaccaucuccugcccggagcccgcgaggcuuuccuugagcagaugaugucucuggaaggcgccgugaaagcugcccgggagcagcuccagagacugaauaagggggcccgcugcgcucaagcgggaucccagaagaccuguacacagcuggccgaucuugaagcuguucucgagagcuccgaggaagagauccugcacgccgccgcuauucuggccagccucgaaaucccucaggagggcccgucucaacccaccaaauggagccaucuggcgacagaagcucgggcccuugccagaucccaccgggacaccgcuacgaagaucgccgcgacagcuuggcgcgcccugcucgccucuaacaccagcuacgcucugcuguggaaucuucuggaggggagagucgcccucgagacccagcgggaucuggaagaccgcuaccaggaggugcaggcugcccaaaaagcgcucagaacagccguggcugaaguccugccugaggccgaauccgugcuugcuaccguucagcaggucggagccgacacagcccccuaucuggcucuccuggcgucuccuggcgcccugccccaaaagagccgggcugaggaucuuggccugaaagccaaggcccucgagaagacgguggcuuccuggcagcacauggccaccgaagcggcuagaacacugcagaccgccgcccaggcuacacuccgccaaaccgagccucugacgaaacuucaucaggaagcccgggcggcccugacccaggcuucuagcuccgugcaggccgcuacaguuaccgugaugggggccagaacacuccuggcugaccuggagggaaugaaacuucaauuuccgcgccccaaggaucaggccgcgcugcagcggaaggccgacagcgucucugauagacuccuggcugacacccgcaaaaagacaaagcaggccgaacggaugcucggcaacgcugccccucuguccagcucugccaaaaagaaagggagagaggcugaggugcuugcgaaggauuccgccaaacuggcuaaggcccugcuccgcgaaagaaagcaagcccaccggcgcgcuagcagacugaccucccagacgcaggccacacuucaacaggcgucucagcagguucuggccagcgaggcucggcgccaagaacucgaggaggccgaaagagugggagcuggccuguccgagauggaacagcagauucgggagagcagaaucucucucgaaaaagacauugagacccuguccgagcuucuggcccgccuggggagccucgauacccaucaggcgcccgcccaagcucugaaugaaacacagugggcccuugagcggcugagacuccagcugggaucuccuggcagccuccagcgcaagcugucccuucuggaacaagagucucagcagcaggaacugcaaauccagggcuucgagagcgaccucgcugagauucgggccgauaaacagaaccuggaagcuauccuucacucccugcccgagaauugcgccucuuggcaauga

SEQ ID NO: 71370 - RNA, 1254 nt, Artificial Sequence
  derived and/or modified sequence opt5 from LAMP1__Homo_sapiens__NP_005552
auggccgcucccggcagcgccagacggccucugcuccugcuucugcuccugcuucugcucgggcugaugcacugcgcguccgcugccauguucauggugaagaacggaaauggcaccgccuguaucauggcuaacuuuucugccgcuuucagcgucaauuacgacacaaaauccgggccgaagaacaugacguuugaucugcccucugacgccaccguugugcucaaucgcagcuccugcggaaaagagaacacaucugauccuagccuggugauugcguucggcagagggcauacccuuacacugaauuuuacccggaacgccacacgcuauuccguccagcucaugagcuucguguacaaucugucugacacccaccuuuuucccaacgcuuccagcaaggaaaucaaaacgguugagucuauuaccgauaucagagccgacauugauaagaaguaucgguguguguccggaacacaaguccauaugaauaacgugaccguuacacugcacgacgcuaccauccaggccuaccucagcaauucuuccuucagccgcggcgaaacgagaugcgagcaggaucggccuucccccacaaccgcgccuccggcucccccuucucccagcccuucccccgugccgaaaagcccuucugucgacaaguauaacguguccggcacaaaugggaccugucugcuggccagcaugggacuccagcugaaccuuaccuacgaacgcaaagauaacacaacggugaccagacugcucaauaucaaccccaauaagacaucugccagcggcuccugcggggcucaucuggucacccuugagcugcacucugagggaacaaccguucuccuguuucaauucggcaugaacgccagcuccagccgguuuuuccugcaggggauucagcucaauacgauccugccugacgcccgcgaucccgcuuuuaaagcggccaacggaucucuuagagcucugcaggccacagugggcaauuccuauaaguguaacgccgaggaacacgugcgggucaccaaggcuuucagcgugaauauuuucaaaguuugggugcaagccuuuaaggucgaaggcgggcaguucggaucuguggaggagugccuccuggacgaaaacuccaugcuuauccccauugcgguuggcggggcucuggccggacucgugcugaucguccugauugccuaccucgugggccgcaaaagaagccaugcuggguaccagaccaucuga

SEQ ID NO: 71371 - RNA, 1236 nt, Artificial Sequence
  derived and/or modified sequence opt5 from LAMP2__Homo_sapiens__NP_001116078
auggugugcuucagacuguuucccgucccuggcagcgggcucguucuggugugucuugugcugggagccguccgguccuacgcucucgagcugaaccuuaccgacucugaaaaugccacaugccuguaugcgaaguggcagaugaacuucacggugcgcuacgagaccacaaauaaaaccuauaagacaguuaccaucagcgaucacggcacagugaccuacaacggguccauuuguggagacgaucaaaauggcccgaaaaucgcuguccaguuugggcccggauucucuuggauugccaacuuuacgaaggccgcuagcaccuauuccaucgacucugugagcuucuccuacaauacaggcgauaacaccacauuuccugacgccgaagauaaaggcauucucaccguugacgagcugcuggcuaucagaaucccccucaaugaucuguuccggugcaacagccuuucuacgcuggaaaagaaugacgugguccagcauuauugggaugugcucgugcaggccuuuguccaaaacgggacaguuuccaccaaugaguuccugugugacaaggauaaaacaagcaccguggcgccuaccauucacacaacggugcccucuccuaccacaaccccgacacccaaggagaaaccugaagccggaaccuacuccgucaacaauggcaacgacacgugccuucuggcuacaauggggcuccagcugaacaucacccaggacaagguggccagcguuauuaauaucaaccccaauaccacacauucuaccggauccugucgcagccacacagcucugcucagacugaacuccucuacgauuaaauaccuugauuuuguguucgccgucaagaaugagaaccgguuuuaucugaaggaagugaauaucagcauguaccucguuaacggcuccguguucagcauugcgaauaacaaucugucuuauugggacgccccucuuggguccagcuacaugugcaacaaagagcagaccgucucugugagcggagcuuuccaaaucaauacauuugaucugcgcguccagcccuucaacgugacccagggcaaguauuccacagccgaggaauguucugcugacagcgaucucaauuuucugaucccgguugccgugggcgucgcccugggguuccucauuaucgugguuuuuauuuccuacaugaucggaagacggaaaagccgcaccggcuaucagucuguguga

SEQ ID NO: 71372 - RNA, 1251 nt, Artificial Sequence
  derived and/or modified sequence opt5 from LAMP3__Homo_sapiens__NP_055213
augcccagacagcugagcgccgcugccgcccucuucgcuucccuggccgugauccuucacgacggcucucaaaugcgggccaaggcuuuuccugagacccgcgauuacagccagccgacagccgcugccacgguccaggacauuaaaaagcccguucagcaaccugcgaaacaggcgccccaccagacccuggcugccagauucauggaugggcacaucacauuucagaccgcugccacagugaagauuccuaccacaacccccgcgacgaccaaaaacacagccaccacauccccuaucaccuauacgcucgugacaacccaagcuacaccgaauaacucucauaccgcucccccugucaccgaagugacaguuggacccagccuggccccuuacucccuucccccgacgauuaccccucccgcccacacaaccggcacaucuagcuccaccgugagccauacgacagggaauaccacccagccuucuaaccagacaacccugcccgccacacucuccaucgcucugcacaagagcacgaccggacagaagcccguccaaccuacacacgcgccgggcaccacagccgcugcccauaauaccacgcggaccgccgcucccgccucuacagugccugggcccacccuggcgccucagcccuccagcguuaaaacaggaaucuaucaggugcucaacggcucucgccugugcauuaaggcugagaugggcauccaacuuauuguccaggacaaagaauccguguucagcccgagacgguacuuuaauaucgauccuaacgccacccaggccuccgggaauuguggaacgcgcaagucuaaccugcuccugaauuuccagggcggguuugugaaccuuacauucaccaaagacgaggaaagcuauuacauuuccgaggucggagcuuaucugacaguuagcgaucccgagaccaucuaccaaggcauuaagcacgccguggugauguuucagaccgcugucgggcauucuuucaagugcguguccgaacagagccuccagcugucugcccaucugcaaguuaaaacaacggacgugcagcuccaggcguuugauuucgaggacgaucacuuuggaaaugucgacgaauguagcuccgauuacaccaucgugcugccuguuaucggcgccauuguggucggccuuugccugauggggaugggaguguauaagaucagacuccggugucagucuagcggcuaccaacgcauuuga

SEQ ID NO: 71373 - RNA, 486 nt, Artificial Sequence
  derived and/or modified sequence opt5 from LAMTOR1__Homo_sapiens__NP_060377
augggcugcuguuacagcuccgagaacgaagacucugaucaggacagagaggaacggaagcugcuccuggaucccagcuccccuccgaccaaagcccuuaauggggcugagcccaacuaucacucucugccuagcgcccgcacagacgaacaagcgcuccuguccucuauccuugcuaagacggccagcaauauuaucgauguguccgccgcugacagccagggaauggagcagcaugaguacauggauagagcccggcaguauucuacccgccuggcuguccucuccagcucucugacacacuggaaaaagcugcccccucuccccucccugaccagccaaccucaucagguucuugccucugaaccgauucccuucuccgaccugcaacaggugagcagaaucgcggccuacgcuuauuccgcccucucucagauucggguggaugcuaaagaggaacuggucgugcaguuuggcaucccuuga

SEQ ID NO: 71374 - RNA, 288 nt, Artificial Sequence
  derived and/or modified sequence opt5 from LAMTOR2__Homo_sapiens__NP_001138736
augcugagacccaaggcccucacccaggugcugagccaagcuaacacaggcgggguccaguccacgcuucugcucaauaacgagggaucucugcuugccuacagcggcuauggggacaccgaugcgcggguuacagcugccaucgccuccaauauuugggcugccuacgaccgcaacggaaaucaggcuuucaacgaagauaaucugaaauuuauccucauggacugcauggcccaggcgcuggugcaauaucuggaggaaccucucacccagguggccgcuucuuga

SEQ ID NO: 71375 - RNA, 375 nt, Artificial Sequence
  derived and/or modified sequence opt5 from LAMTOR3__Homo_sapiens__NP_068805
auggccgacgaucugaagagauuccucuacaaaaagcugcccagcguggagggccuucacgcuaucgucguuuccgaccgggauggggugccugugauuaaagucgccaacgacaaugcgccggaacaugcucugcgccccggauuucucucuaccuucgcccuggccacagaucagggcagcaaacuugggcuguccaagaacaagucuaucauuugcuauuacaauacguaucaagugguucaguuuaacagacucccucugguggucagcuucaucgcuuccucuagcgccaauaccggacugauugugucccucgagaaggaacuggcuccccuuuuugaggaacugcggcagguuguggaggucagcuga

SEQ ID NO: 71376 - RNA, 1200 nt, Artificial Sequence
  derived and/or modified sequence opt5 from LANCL1__Homo_sapiens__NP_001130047
auggcccagagagcuuuccccaacccuuacgccgacuauaauaagagccuggcggagggcuacuuugaugcugccgggcggcucaccccggaguucucccaacgccugacaaacaaaaucagagaacuucugcagcagauggaacggggacucaagucugccgacccccgcgauggcacgggguauaccggaugggcuggcauugccgugcuguaccuucaccuguaugacgucuuuggggauccugcuuaccuccagcuggcccauggauauguuaaacaaagccugaauugccucacaaagagauccaucaccuuccuguguggcgacgcgggcccccuugccguggcugccgugcuguaccacaaaaugaacaaugagaagcaggcugaagauugcauuacacggcucauccaucugaacaagauugacccucacgcccccaaugagaugcuuuacgggcgcaucggauauaucuacgcgcugcucuuugucaacaaaaauuucggcguggagaagauuccucagucucauauccagcaaauuugugaaaccauccugacaagcggggagaaccuggccagaaaacggaauuuuaccgcuaaguccccgcucauguaugaaugguaccaggaguauuacguuggagccgcucacggccuggccgggauuuauuacuaccuuaugcagcccucucuccaggugagccaaggaaaacugcacucccuggucaagccuagcguggauuauguuugccagcuuaaguuccccucuggcaacuacccucccuguaucggcgacaaucgcgaucugcucgugcauuggugccacggggccccgggagucauuuauaugcugauccaggcuuacaaaguguuuagagaggaaaaguaucugugugacgcguaccaaugcgccgaugugaucuggcaguauggccuccugaaaaagggguacggacuuugucauggcuccgcugggaacgccuacgccuuccugacgcucuauaaucugacccaggacaugaaauaccuuuaucgggcuugcaaguuugccgaguggugucuggaauacggagagcacggcugccgcacaccugacacccccuucagccucuuugaaggcauggcggggacaauuuauuuccuggcugaucugcucgucccuaccaaagccagauuccccgccuuugagcuguga

SEQ ID NO: 71377 - RNA, 1353 nt, Artificial Sequence
  derived and/or modified sequence opt5 from LANCL2__Homo_sapiens__NP_061167
augggcgagaccaugagcaagagacugaaacuccaccuugggggagaagccgagauggaggaacgggcuuucgugaaccccuuuccugacuacgaagccgcggcuggcgcccugcuggccuccggggcugccgaggagacaggaugcguccgcccgcccgcuacgaccgaugaaccuggccuccccuuccaucaggacgggaagaucauucacaauuuuaucagacggauucaaacaaaaaucaaggaucugcuucagcagauggaggaaggacugaaaaccgccgacccucaugauuguucugcguauacaggcuggaccggcauugcccuccuguaccugcagcucuaucgcguuacaugcgaccaaaccuaccugcuuagaagccuggauuaugugaagcggacgcuccgcaaccugaaugggagacgggugaccuuccuuuguggagacgcuggcccccuggccgucggggcugugaucuaccacaagcuccgcuccgauugcgagucucaggaguguguuacaaaacugcugcagcuccagagaagcguggucugccaagaauccgaccugccugaugagcuucuguauggacgggccggcuaccucuacgcgcugcuuuaucugaacaccgaaaucgggccgggaacagugugugagucugccauuaaggaaguugugaaugcuaucauugagagcggcaaaacccucucccgcgaggaaagaaagacggagcggugcccccugcuguaccaguggcaucgcaaacaguaugucggcgccgcucacgggauggccggaaucuacuauaugcucaugcagccugccgcuaagguggaccaagaaacacugaccgagauggugaagcccagcauugauuacgucagacacaaaaaguuucggucuggcaacuauccuuccagccuuucuaaugaaacagacagacugguucauuggugucacggggcgcccggagugauccauaugcucaugcaggccuacaaaguguucaaggaggagaaauaccugaaggaagcuauggagugcuccgacgucauuuggcagcgcggccuucugcggaaaggguauggaaucugucacggcaccgccggcaacggguacagcuuucucucucuguauagacugacccaagauaagaaguaccucuaucgcgccugcaaauucgcugaauggugccuggacuacggagcccacggcugucggaucccggauagaccuuauucccuuuuugaggggauggcgggagcuauucauuuccugagcgacgugcucggccccgaaacaucccgcuuuccugccuucgagcuggauucuagcaagcgggacuga

SEQ ID NO: 71378 - RNA, 1560 nt, Artificial Sequence
  derived and/or modified sequence opt5 from LAP3__Homo_sapiens__NP_056991
auguuccugcucccccugccugccgcuggcagaguggucguucggcgccuugccgugagacgguuugggagccgcucccugucuaccgcggacaugacaaagggacucgugcugggcaucuacagcaaagagaaggaagaugacgucccgcaguucacguccgcuggggagaacuuugauaaacuucuggccggaaagcucagagaaacccugaauauuucugggcccccucugaaagccggcaagacacggaccuucuauggacuccaccaagacuuucccagcgugguucuggugggccuuggcaagaaagcugccgggaucgaugagcaggaaaacuggcaugagggaaaggagaauauucgcgcugccgucgcggccggcugcagacagauccaggaccuggaacucuccucuguggagguugauccuuguggggacgcucaagccgcugccgaaggagcggugcugggccuuuacgaguaugaugaccugaaacagaagaaaaagauggccgucagcgcuaagcucuacggguccggagaucaggaggccuggcagaaaggcgugcuguucgcuagcggccaaaaccuggcccggcagcucauggaaacacccgccaaugagaugaccccuacacgcuuugcugaaauuaucgagaagaaccugaaaucugcguccagcaagaccgaagugcacaucagaccgaaaucuuggauugaggagcaggccaugggguccuuccuuagcgucgcuaagggaucugacgaacccccuguuuuucuggagauccauuauaaaggcucccccaaugccaacgaaccuccccucguguucguggggaagggaauuacguuugauagcggcgggaucuccauuaaggccucugcuaauauggaccugaugcgggccgacaugggaggcgcggcuaccaucugcagcgccauugucuccgccgcuaaacuuaaccugccgaucaauaucauuggccucgccccucugugugagaacaugcccagcgggaaggcuaauaaaccuggagaugugguucgcgccaagaacggcaaaacaauccagguggacaauaccgaugcggaagggagacugauucucgccgacgcucugugcuacgcccacacauucaaccccaaggucauccuuaacgcugccacccugacgggagcgauggauguggcccucggcucuggggcuacaggcguuuuuaccaauuccagcuggcuguggaacaaacuuuucgaggccucuauugagacaggagaccggguguggcgcaugccccuguucgaacauuauaccagacaagucguggauugucagcucgcugacgucaauaacaucggcaaguaccggagcgccggggccugcaccgcugcggccuuucugaaggaguucgugacacacccuaaaugggcucaccuggauaucgccggaguuaugacgaauaaggacgaagugccguaccucagaaaaggcaugaccgggcgccccacacggacccugauugaguuucuucugagauucucccaggauaacgccuga

SEQ ID NO: 71379 - RNA, 954 nt, Artificial Sequence
  derived and/or modified sequence opt5 from LAPTM4B__Homo_sapiens__NP_060877
augaccagcagaacacgggugacguggcccuccccuccgcgcccccugccuguccccgccgcugccgcgguugcuuucggcgccaaggggaccgacccugccgaggcuagaucuagccggggaaucgaagaggccggcccccgcgcucacgggagagccggacgggaaccugagcgcagacggucccgccagcaaagacggggcgggcuccaggcgcgcagaucuacacugcuuaaaaccugcgcccgggcucgcgccacagcuccgggagccaugaagaugguggcgcccuggaccagauuuuacagcaacuccuguugccuguguugccaugugcggacaggcaccauucuccugggcgucugguaucuuaucauuaaugccgugguucugcucauccugcugucugcucucgccgauccugaccaguacaacuucagcuccagcgaacucgggggagauuuugaguucauggacgaugcuaauauguguauugccaucgccaucucucuucugaugauucucaucugcgcuauggcgacguauggcgccuacaaacagagagcugccuggauuauccccuuuuucuguuaucaaauuuuugacuucgcccugaacaugcuuguggcuaucaccguccugauuuacccuaauuccauccaggaguauauccgccagcugcccccgaacuuuccuuaccgggaugacgugaugagcguuaaucccacaugccuggugcugauuauccuccuguucauuucuaucauucuuaccuuuaagggguaccugaucuccugugucuggaacugcuauagauacaucaauggacgcaacagcucugaugugcucguguaugucacauccaaugacaccacgguucugcuuccucccuacgaugacgccacagugaacggcgcggcuaaagaacccccuccgcccuaugugagcgccuga

SEQ ID NO: 71380 - RNA, 2271 nt, Artificial Sequence
  derived and/or modified sequence opt5 from LARGE__Homo_sapiens__XP_005261889
augcugggcaucugcagagggcggcgcaaguuccucgccgcuagccugucccuucuguguauucccgccaucaccuggauuuaccucuuuucuggcagcuucgaggacggaaaaccugugucccugucuccgcuugaaagccaggcgcacucccccagauauacagcuucuagccaacgggagcgcgaaucccuggaggucagaaugcgggaaguugaggaggaaaaccgcgcccucagacggcagcugagccuggcccaggggcgcgcuccuucucauagacggggaaaucacuccaagacguacagcauggaggaaggcaccggggauucugagaaccuccgcgccggaaucguggcuggcaauuccagcgagugcggccagcaacccguggucgaaaaaugugagacaauucauguggccaucguuugcgcgggguauaacgccucuagagacguggucacccuggugaaguccguucuuuuucaccggcgcaauccucugcauuuccaccucaucgcugauagcauugccgaacagauccuggcuacacuuuuucagaccuggauggugcccgccgucagaguggacuucuacaacgcggaugagcugaaauccgaagugucuuggauuccuaauaagcacuauagcggaaucuacggccucaugaagcugguccugacaaaaacccucccggccaaccuggagcggguuauugugcuugacacggauaucaccuuugcuacagacauugccgagcugugggcuguguuccauaaguuuaaagggcagcaaguccucggacugguggaaaaucaguccgauugguaucuuggcaaccuguggaagaaucacagacccuggccugcccucgggcgcggauacaacaccggcguuauccugcugcuccuggacaaacuucggaagaugaagugggagcagauguggagacugacagccgaacgcgagcucaugggcaugcugagcaccucucuugcugaucaggacaucuucaaugcggugauuaaacaaaaccccuuucuggucuaccagcucccuuguuucuggaaugugcagcuguccgaucauacgcggagcgaacaaugcuauagagacguuucugaccugaaggugauccacuggaacagccccaaaaagcuccgcgucaaaaacaagcacguggaguuuuuccggaaucuguaccuuacauuccuggaguaugaugggaaccuccugagacgcgaacuguuuggauguccguccgaggccgacgucaauucugaaaaccuucagaaacagcucagcgagcuggaugaagacgaucugugcuacgaguuccggagagagcgcuuuaccgugcaucggacacaccucuauuuccugcauuacgaauaugagccugcugccgacuccaccgauguuacccuuguggcccagcugagcauggacagacuccaaaugcuggaagcuauuuguaagcacugggagggccccaucucucuggcccuuuaccucuccgaugcggaggcucagcaguuucugcgguacgcccaggggagcgaaguccugaugucucgccauaaugugggauaucacauuguuuacaaggagggccaauucuauccugugaaccuccugagaaaugucgccaugaaacacaucuccacacccuacauguuucuuagcgacaucgauuuccugcccauguaugggcucuacgaauaucugcggaaguccgugauucagcuggaccuugcuaacacgaaaaaggccaugaucgugccugcuuuugagacccucagauaccgccugucuuucccgaaaagcaaggccgaacugcucuccaugcuggacaugggaacacuuuuuaccuuccgguaccauguuuggacaaagggccacgcgcccaccaauuuugccaaauggagaacggcuacaaccccuuaucgcgucgagugggaggccgauuucgaacccuacgugguggucagacgggacugcccugaguaugaucgcagauucgugggcuuuggguggaacaagguugcucauauuauggaacuggacgugcaggaguacgaguucaucguccuccccaaugccuauaugauucacaugccgcacgcgccuucuuuugauaucaccaaauuccggagcaacaagcaguaccgcaucugucugaaaacacugaaggaagaguuucaacaggacauguccagacgguauggauucgccgcucuuaaguaccucaccgccgaaaauaacagcuga

SEQ ID NO: 71381 - RNA, 3060 nt, Artificial Sequence
  derived and/or modified sequence opt5 from LARP1__Homo_sapiens__NP_056130
augcuguggagagugcuccugagcaagcggcccccuuucccgcaccccgagcuugacuuucaggaagccccuauccccuccugcccuggccgccugcccgggcggaaaaacucugucgcucucgccgcggcuccuagaaaggagccgaccggagaucgcgaaaaaccccugccuuuccccguucuugccccuuuuagcaaucccgagcauuccgccccggcuaagguggugagagccgcugucccuaaacaacggaagggcucuaaggugggggacuucggagaugccauuaacuggcccacaccuggcgaaaucgcgcacaaaagcguucagccccagucccauaagccccagccuacgcgcaaacugccgcccaagaaagacaugaaggagcaagagaagggggaaggaucugauagcaaagaguccccuaagaccaaaagcgacgaaucuggcgaggagaagaauggcgaugaagacugucagagagggggacagaaaaagaaaggcaacaagcacaagugggugccccuccagauugauaugaaaccugaggucccccgggaaaagcuggccucccgcccgacaagaccucccgagccucggcauauccccgcuaaucgcggggaaauuaaaggaagcgagucugccaccuacgugccuguugcucccccgaccccugccuggcaacccgagaucaagcccgaaccugcguggcacgaccaggaugagaccuccagcgugaaaucugacggcgccgggggagcuagagccuccuuucggggccgcggcagagggcggggaagaggccgcgggcggggaagaggcgggacacgcacccacuucgauuaucaguuuggauaccggaaguucgacggcgucgaaggcccgagaacgcccaaguauaugaacaauaucaccuacuauuuugacaacgugagcuccacagagcuguacucuguggaucaggaacuccugaaagacuauauuaagcgccaaaucgaguacuacuucagcgucgauaaucuugagcgggacuuuuuccugagacgcaaaauggaugcugacggguuucucccuauuacccugaucgccuccuuccaucggguucaggcccuuacaaccgauauuagccugaucuucgcugcgcucaaggacucuaaagugguggaaauugucgaugagaaggugagacgccgggaggaacccgaaaaguggccucugcccccuaucguugacuauucccagacggauuuuagccaacugcucaacugccccgaguucgugccgagacagcacuaccagaaagagacagaaucugccccuggaagcccccgggcugucaccccugugcccacaaagaccgaggaaguuuccaaucugaaaacccuuccgaagggccugucugccagccucccugaccuggacuccgagaacuggaucgaggugaaaaagcgccccagaccuagccccgcccggcccaagaaaucugaagaguccagauuuagccaucuuacaucucugccucagcaacucccgucccagcagcugaugagcaaggaucaggacgaacaagaggaacuggauuuccucuuugacgaggagauggaacagauggaugggcgcaaaaauacguucaccgcuugguccgacgaggaaucugauuaugagauugacgaucgggacgucaacaagauccugauugugacacagacaccccacuacaugagacgccacccuggaggcgauagaacagggaaucauaccagccgggccaaaauguccgcggaacuugcuaaggucaucaacgacggccuguuuuauuacgagcaggaucucugggccgagaaauucgaacccgaguauucucaaauuaagcaggaaguggagaacuuuaagaaaguuaauaugaucagccgcgaacaguucgacacgcugacaccugagcccccuguggacccgaaccaggaggugcccccuggacccccuagauuucaacagguccccaccgaugcccuugcuaauaagcuguucggcgccccggaaccuuccaccaucgcucggagccuccccacaaccguucccgagucuccuaacuaccgcaauacaagaacgccccggaccccucgcacaccgcagcugaaagacuccagccaaaccucuagauuuuaccccguggucaaggaagggcggacacuggaugccaaaaugccucgcaagagaaagacccggcacuccagcaaucccccucucgagucucaugugggaugggugauggacagcagagagcaccgcccccggacggcguccauuucuucuuccccgagcgaaggcaccccuacaguuggguccuauggauguacaccccagucucugccuaaauuccagcaucccagccacgagcuucugaaggaaaacggcuucacccagcacgucuaccauaaauauagacgccggugccucaacgagagaaagcgccuggggaucggccaaucccaggaaaugaauacccuguuucgguucuggagcuuuuuccuuagagaucacuuuaacaaaaagauguacgaggaguucaagcagcucgcccuggaagacgcuaaagagggauaucgcuacggccuggaaugucucuuucgguauuacagcuacgggcuggagaagaaauucagacuugauauuuuuaaggacuuccaggaagagacggugaaagauuaugaggccggacaacuguacggccucgaaaaguuuugggcuuuccugaaguauuccaaagccaagaaucuggacaucgauccuaaacuucaggaguaccucgggaaguuucggcgccuggaagacuucagaguggaucccccgaugggagaggaaggcaaccauaaacggcacucugucguggccgggggcggaggcggggagggacgcaagagaugcccuagccaguccagcucucggcccgcggcuaugauuucccagcccccuacaccgcccaccggccaaccuguuagagaggacgccaaauggacaagccagcacucuaauacccagacccuggggaaguga

SEQ ID NO: 71382 - RNA, 1749 nt, Artificial Sequence
  derived and/or modified sequence opt5 from LARP4__Homo_sapiens__NP_001164274
augcuccuguucguggagcaggucgccagcaagggcaccgggcugaaccccaaugcuaaaguuuggcaagaaaucgccccuggaaacacagacgcgacgccggugacccacggcacagaguccucuuggcaugaaauugcugccaccagcggggcccaccccgagggaaaugcugaacuuuccgaggauaucugcaaggaguacgaagugauguauucuagcuccugugagacaaccagaaacacaaccggcauugaagagucuacggacgggaugauccugggaccugaggaucucagcuaccagauuuaugacgucuccggcgaaagcaauucugccguguccaccgaggaucugaaagaaugccuuaagaaacagcuggaguuuuguuucagccgggaaaaccucucuaaggaccuguaccugaucucccagauggauagcgaccaauuuauccccauuuggacaguugcuaauauggaggagaucaagaaacucaccacagauccugaccugauucuugaagugcugagaucuucccccaugguccagguggaugagaagggcgaaaaaguucgcccuagccauaagcggugcaucgugauucuccgcgagaucccggaaaccacgcccauugaggaggucaaagggcuguucaaguccgaaaacuguccuaaggugaucucuugcgaguuugcccacaauagcaacugguauaucacauuccaguccgacaccgaugcgcagcaagccuuuaaauaccuuagagaagaggugaagacauuccagggaaaacccauuauggcuccuuuucccaauggcagcuucgucaacggguuuaauucuccgggauccuauaagaccaacgccgcugccaugaauaugggccggccuuuccagaaaaaccgcagaacccuguuucgggggcgcagacggcgcgaagacgacagaaucagccggccccauccuucuacagcggagagcaaggcccccacgcccaaauucgaucuccuggcuuccaacuucccuccgcugcccggaucuagcucccgcaugccuggcgagcucguucuggaaaauagaaugagcgacguggugaagggcgucuacaaggagaaagauaacgaggaacuuaccauuucuugucccgugccugccgacgagcagacagaaugcaccuccgcucaacagcugaauaugagcacaucuucccccugugccgccgagcucaccgcucugagcacgacacagcaagaaaaggaucuuaucgaggacuccucuguucagaaagaugggcugaaccagaccaccauuccggugagcccucccuccacaaccaagccuucucgggcgagcacagccucccccugcaauaacaauaucaacgcugccacggccgucgcucuccaggaaccuagaaaacugagcuacgccgaggugugucaaaagcccccgaaggagccuucuuccguucuggugcagccccuccgcgaacugcggagcaaugucgugucucccaccaaaaacgaggacaauggagcgccugaaaacuccgucgagaagccgcacgaaaaacccgaggcuagagccagcaaggauuauucuggcuuucgcgggaauaucauuccucggggagccgcuggcaaaaucagagagcagcgccggcaguucagccacagagccauuccccaaggggugacacgccggaacggaaaggaacaguacguuccucccagauccccuaaguga

SEQ ID NO: 71383 - RNA, 1476 nt, Artificial Sequence
  derived and/or modified sequence opt5 from LARP6__Homo_sapiens__NP_060827
auggcccagagcggcggggaggcuagacccggaccuaagaccgccgugcaaauccgggucgcgauucaggaagcugaggacguugaugaacuggaggacgaagaggagggcgccgaaacacgcggggccggagauccggcuagauaccucucccccggcugggggucugccagcgaggaagaaccuucccggggacacucuggcacgaccgcuagcggcggggagaacgaacgcgaggaccuggaacaggaguggaaacccccugaugaggagcuuaucaagaaacugguggaccagauugaguucuauuuuuccgaugaaaaucucgagaaggacgccuuccugcuuaaacaugugagacggaacaagcugggauacgucucugugaagcuccugacauccuuuaaaaagguuaaacaccugacccgcgauuggagaacaaccgcgcaugcccucaaguauuccgugguccuggaacuuaaugaggaccaccggaaagugcgcagaacaacccccguuccucuguucccgaacgaaaaucuccccagcaagaugcugcuuguguacgaucuguaucucucuccuaagcugugggcucuggccacgccccagaaaaacggccggguccaagagaaggugauggagcaucuccugaaacuuuuugggaccuucggagugaucuccagcguccgcauucugaagccuggcagagaacugcccccggacauccggcgcaucucuuccagauacagccagguugggacacaggagugcgcuauuguggaauuugaggaaguggaggccgcgaucaaagcccacgaguucaugauuaccgaaucucaaggaaaggagaauaugaaagcuguccucaucggcaugaagccucccaagaaaaagccugccaaagauaagaaccacgacgaggaacccacagcuuccauucaucuuaauaaaagccugaacaagcggguggaggaacuccaguauaugggcgacgaguccucugccaauagcuccagcgaucccgaaucuaacccuaccuccccgauggccgggagacgccacgcugcgacgaauaagcugagccccucuggacaucagaaccuguuucucagcccuaaugccucccccuguacaucuccuuggagcagcccccuggcucagcggaaaggcguuagcagaaagucuccgcuugccgaggaagggcgccugaacugcuccaccagcccugagaucuuccggaaauguauggacuacucuuccgauagcuccgugacacccucuggaagcccuugggucagacgccggagacaagccgagaugggcacccaggaaaagucccccgggaccucuccucuccugagccgcaaaaugcagacagcugacggacuucccgugggcguucugcggcucccgagaggcccugauaacacgcgcggguuucacggacacgagcgguccagagccugcguguga

SEQ ID NO: 71384 - RNA, 1770 nt, Artificial Sequence
  derived and/or modified sequence opt5 from LARP7__Homo_sapiens__NP_001253968
augauccccaacauugagggcauggaaaccgagagcgggaaucaggaaaaggugauggaggaagaguccacagagaaaaagaaagaagucgagaagaaaaagagaucucggguuaagcaagugcuggccgacaucgcuaaacagguggauuucugguuuggagacgccaaccuccacaaggaucgcuuccugagagaacagauugagaaaagccgggacggcuacgucgauaucucccuucuggugucuuuuaauaagaugaaaaagcucacgaccgacgggaagcugauugcgcgcgcucuuagaagcuccgccguuguggagcuggaucucgaaggaacacggauccgcagaaagaagccucugggcgagcggccgaaagacgaagaugagcgcaccgucuauguggaacugcuccccaagaacguuaaucauucuuggaucgagagaguguucgggaaaugcggaaacgucguguacauuagcaucccucacuauaaguccacaggcgaccccaaaggcuuugccuucguggaguuugaaaccaaggagcaggcugccaaggcuauugaguuccugaauaacccucccgaagaagccccucggaaaccggggaucuuucccaagacagucaaaaauaagccuauucccgcgcuucgcguuguggaggagaaaaagaagaaaaagaaaaagaaaggaagaaugaagaaggaagauaacauccaagccaaagaggaaaauauggacaccagcaacacgucuauuuccaagaugaaacggagccgcccuaccucugagggcuccgauaucgaaagcacagagccccagaagcaguguucuaaaaagaagaaaaagagagaccggguggaggcuuccagccugccggaagucagaaccgggaaacgcaagcgguccucuagcgaggacgccgaaucccucgcuccuagaagcaaagugaagaaaaucauucagaaggauaucauuaaggaggccucugaggcguccaaagaaaaucgcgacaucgagauuagcacagaagaggaaaaggauaccggagaccugaaagauucuagccuucugaagacgaaacggaagcauaagaaaaagcacaaagagagacauaagaugggcgaggaaguuaucccccuccgcgugcuguccaaaucugaguggauggaccugaagaaggaauaccucgcccugcaaaaagcuagcauggccucccuuaagaaaacaaucagccagauuaagucugaguccgaaauggagaccgauagcggggucccucagaacacaggaaugaaaaaugagaagaccgcuaaccgggaagagugcagaacccaggaaaaggugaacgccacaggcccccaauucguuucuggcgugaucgucaaaauuaucuccacggagccccugccugggcgcaaacaggugcgggacacccucgccgcuauuagcgaaguccuguauguggaucuucuggagggagacacagagugucacgcgagauuuaaaaccccggaagaugcccaggcuguuaucaaugccuacacagagaucaacaagaaacacugcuggaagcucgaaauucuguccggcgaccaugagcaacgcuauuggcagaaaauccugguggaccggcaggccaagcucaaucagcccagagagaagaaacgggggaccgaaaagcugauuacgaaagcugagaagauccgccuugccaaaacacaacaggcgucuaagcacauuagauucagcgaauacgauuga

SEQ ID NO: 71385 - RNA, 2712 nt, Artificial Sequence
  derived and/or modified sequence opt5 from LARS2__Homo_sapiens__NP_056155
auggccagcguguggcagagacugggcuucuacgcuucccuccugaagcggcaacuuaacgggggacccgacgucaucaaaugggagcgcagaguuauuccuggcugcacccggucuaucuauagcgccacagggaaguggacgaaagaauacacccugcagacacgcaaggauguggagaaaugguggcaccagagaauuaaggaacaggcguccaagaucucugaggcugacaaaagcaagccgaaauuuuaugugcucuccauguuccccuacccuucuggaaagcugcauaugggccacguccggguguauaccauuagcgauacaaucgcccgcuuucaaaagaugagagggaugcagguuaucaaucccaugggaugggacgccuucggccuuccugcugaaaacgccgcuguggagcggaaucugcauccccaguccuggacccagagcaacauuaagcacaugcgcaagcaacucgauagacugggccuguguuuuucuugggaccgggagaucacaaccugccucccugauuacuauaaauggacgcaguaccuguucauuaaacuuuacgaagccgggcuggcguaucagaaagaggcccucgucaauugggacccgguggaucagaccguucuggcuaacgaacaaguggacgagcauggauguuccuggcgcagcggcgccaaggucgagcagaaauaccuuagacagugguuuaucaagacaaccgcuuaugccaaagcgaugcaagaugcccuggcugaccuccccgaaugguacgggauuaagggaaugcaggcccacuggaucggcgauugcguggggugucaccuggacuucacacugaaggugcauggacaggcuaccggcgagaaacucacggccuauacagccaccccugaagcuauuuacggcacaucucacgucgcgaucucccccagccaucggcugcuucacgggcacucuucccugaaggaggcccuccgcauggcucugguuccuggaaaagacugccuuacccccgugauggccgugaauaugcugacccagcaagaagucccggugguuauccucgccaaggcugaucuggagggcagccuggacuccaaaauugggaucccuucuacaagcuccgaggauacgauucucgcccagacccugggacuugcguauagcgaagugaucgagacacugcccgacggcaccgaaagacucucuuccagcgcugaguuuacagggaugacccggcaggaugccuuccuggcccuuacgcagaaggcuagaggaaagcgcgucggcggcgacgugacaucugauaaacugaaggacuggcucauuagccggcaaagauacugggggaccccuauccccaucguucauugucccgugugcggaccuaccccggucccccuggaagaucugccugugacacuccccaacauugccuccuuuaccggcaaagggggaccuccccuggcuauggccucugagugggucaauuguagcugcccgcgcuguaagggcgcggccaaacgggagacagacacgauggauaccuucguggacuccgcuugguacuauuuuagauacacagacccucacaacccccauagcccuuucaauaccgccguugcugauuauuggaugcccguggaccuuuacaucgggggcaaggaacacgccgucaugcaucuguucuaugcgcgcuuuuucucucacuuuugccacgaucagaagauggugaaacaucgggagccuuuccacaagcuccuggcccagggacugauuaaaggccagacauuuagacuucccuccgggcaauaccuccagcgcgaagagguugaccugaccggaagcgugccgguccaugcuaagacgaaagaaaagcuggaggugaccugggagaagaugucuaaauccaagcacaacggcguggauccugaagagguugucgaacaguaugggaucgacacaauucggcucuacauccuguucgccgcuccucccgagaaagauauccuuugggacgugaagaccgaugcccugcccggagugcucagauggcagcaacgccuguggacacugaccacgcgguuuauugaggccagagcuagcggcaaauccccgcagccccagcuucucucuaauaaggaaaaagcggaggcccggaagcugugggaauacaagaacagcgucaucucccaagugacaacccacuucacagaggacuuuucucugaauagcgcuauuucccagcucauggggcugagcaacgcccuuucucaggccucccagagcguuauccugcauucuccugaguucgaagaugcucucugcgcccugauggugauggcggcuccccuggccccucacgucaccuccgagauuugggccggccuugcucucgugccccgcaaacugugugcccauuauaccugggacgcgagcguucugcuccaggcuuggccugccguggaucccgaauuucugcaacagccggaggucgugcagauggccguucuuaucaacaauaaggcuugcggaaaaauuccugugccccaacaggucgccagagaccaggacaaggugcacgaguucgugcugcagucugaacucggcguccggcugcugcaagggagaagcaucaaaaaguccuuucuuagcccucgcacagcucucaucaacuuccugguucaggauuga

SEQ ID NO: 71386 - RNA, 3531 nt, Artificial Sequence
  derived and/or modified sequence opt5 from LARS__Homo_sapiens__NP_064502
auggccgagagaaagggcaccgcuaaaguggacuuccugaagaaaaucgaaaaggagauucagcaaaaaugggauacagaacgggucuuugagguuaacgccagcaaucucgaaaagcagacguccaaggggaaauacuucgugaccuuucccuauccuuacaugaacggacgccugcaccuuggccauacauucucucugagcaagugcgaguuugcggugggguaucagagacucaaaggaaaguguugccuguucccguuuggccuucacuguaccgggaugcccaucaaggcuugcgccgacaagcugaagcgggagauugaacucuacggauguccucccgauuucccugacgaggaagaggaggaagaggaaacauccgucaaaaccgaggauaucauuaucaaggacaaagccaagggcaaaaagucuaaagcugccgcuaaggccggcagcuccaaguaucagugggggaucaugaaaucucugggacugagcgaugaagagauugugaaguuuuccgaggcggaacauuggcucgacuacuuucccccucuggccauccaagaucuuaaacgcaugggccugaagguugacuggagacggagcuucauuacaaccgaugugaauccguauuacgacucuuucguccgcuggcaguuucucacgcugagagagcggaacaaaaucaaguucgggaagcgcuacaccauuuauucccccaaagauggacagccuugcauggaccacgacagacagacaggcgaaggggugggaccccaagaguacacccuucugaagcucaaaguucuggaaccuuaucccagcaagcugucuggccucaaaggcaagaauaucuuccugguggcugccacacuucggccggagaccauguuugggcagacgaacuguuggguccgcccugauaugaaguacauuggauucgagacagugaauggcgacaucuuuaucugcacccagaaagcugccagaaacauguccuaucagggguucacaaaggauaauggagugguccccguugugaaagaacugaugggcgaggaaauucucggggcgagccugucugccccucuuaccuccuacaaggugaucuauguccugcccaugcucaccauuaaagaggacaagggaacaggcgugguuacgagcgugcccuccgauucuccugacgauaucgcugcccugcgggaccugaagaaaaagcaagcucuccgcgccaaauacggcauuagagaugacaugguccugccguuugaacccgugccuguuaucgagauccccggguucggaaaccuuagcgccgugaccauuugugaugagcugaagauccagucccagaaugaccgggaaaaacucgcugaggcgaaggagaaaauuuaccugaagggcuuuuaugaagggaucaugcuugucgacggauucaagggccaaaaagugcaggaugucaagaaaacaauucagaagaaaaugaucgacgccggggaugcucugaucuacauggagccugaaaaacaggugaugagcagaucuuccgacgagugcguuguggcccucugugaucaaugguaucuggacuacggcgaagagaacuggaagaaacagaccagccagugccugaagaaucucgaaacauuuugcgaggagacccgccggaacuucgaagccacgcugggauggcuucaggagcaugcuuguucuagaacauauggccuggggacccaccuccccugggaugaacaauggcugauugagagccuguccgacucuaccaucuacauggccuuuuauacagucgcgcaccuucuccagggaggcaaucugcaugggcaggcugaaagcccgcugggcauucgcccucagcaaaugaccaaagaggugugggauuacguuuucuuuaaggaggcccccuucccuaaaacacagaucgccaaggaaaagcucgaccagcugaaacaggaguucgaauuuugguaccccguggaucuucgggucuccggaaaggaccuggugccuaaccaccucagcuauuaccuguauaaccauguggcuauguggcccgagcaaucugauaaauggccgacggccguuagagcuaaugggcaucugcuucucaacuccgaaaagaugagcaaaucuaccggcaauuuccugacacugacccaggccauugacaaguuuuccgcggacggaaugcgccucgcccuggcugaugccggcgacacagucgaggaugcuaacuucguggaggccauggcggacgccgggauccuucggcuguacaccuggguggaaugggucaaggagaugguggcuaauugggauagccucagauccggaccugccucuacguuuaacgaccgcguuuucgcuagcgaacugaaugccggcauuaucaaaaccgaucagaacuaugagaagaugauguuuaaagaggcccugaagacaggguucuuugaguuccaagcugcgaaagacaaguaccgggaacuugccguggaaggaaugcacagagagcucgucuuucgcuucaucgaagugcagacccugcugcucgcucccuuuugcccccaccugugugagcacauuuggacacuucugggcaaaccugauuccaucaugaaugccucuuggccgguugccgggcccgugaacgagguccucauucauagcucccaguaucugauggaagugacccacgaccugcggcuuagacucaagaauuacaugaugccugcuaagggcaaaaagacggauaaacagccccugcaaaagccuagccauugcacaaucuacguugccaaaaacuaucccccuuggcagcacaccacacugucugugcuccggaagcacuucgaggcgaauaacggaaagcugcccgacaauaaagucauugcuuccgaacuuggcagcaugccggagcugaagaaauacaugaagaaagugaugccuuucguggccaugaucaaggaaaaccucgagaagauggggccccgcauccuggaucugcagcuugaguuugacgaaaaagccguccugauggagaacauuguuuaucucaccaauucucuggaacucgagcauaucgaagugaaguucgcuuccgaggccgaggacaaaauuagagaagauuguugcccuggaaagccccugaacguguuucggaucgagccgggcgucagcgugucucuuguuaauccucagcccagcaacgggcacuucuccaccaaaauugaaaucagacaaggagacaauugugauagcaucauucgccggcugaugaagaugaacagaggcaucaaggaccucucuaaagugaagcugaugcgcuuugaugacccucugcuugggcccagacggguccccgugcugggcaaagaguacacagagaagacgccuauuuccgaacaugcgguuuucaauguggaucucaugagcaaaaagauccaccugaccgagaacggcauucgcgucgacaucggagauacaaucauuuaucucgugcacuga

SEQ ID NO: 71387 - RNA, 2154 nt, Artificial Sequence
  derived and/or modified sequence opt5 from LAS1L__Homo_sapiens__NP_001164120
augagcugggaguccggcgccgggcccggacugggcucucaggggauggaccucguguggagcgcuugguacggaaagugcgucaaaggcaaggggucccugccucuuucugcccacggaaucguuguggcguggcugagcagagcugaaugggaucaagugaccgucuaucucuucugugacgaucauaaacugcagcgguacgcccuuaaccgcauuacaguguggagaucccggucuggcaaugagcugccgcucgccguugcuagcacggccgaccugauccgcugcaagcugcucgaugugaccggcgggcugggaacagacgaacuuagacugcucuauggcauggcucugguccgguuugugaaccuuauuuccgagcgcaaaaccaaguucgccaagguuccccugaaaugucucgcgcaggaagugaauaucccugauuggauugucgaccugagacacgagcugacacauaagaaaaugccccacaucaacgauugccggcgcggguguuacuuugugcucgacuggcugcagaagaccuauuggugcagacaacuugagaauagccugcgggaaacaugggagcucgaagaguuccgcgagggaaucgaagaggaagaucaggaggaagacaaaaacauuguggucgaugacaucaccgagcagaagccugagccccaggacgauggcaagucuacggaauccgacguuaaagccgauggggacagcaagggaucugaggaaguggauucccauuguaaaaaggcucugagccacaaagagcuuuacgaaagagcccgggagcugcucgugucuuaugaggaagaacaauuuaccguccuggaaaaguuccgcuaccugccuaaagcuauuaaggccuggaauaacccgucccccagaguggagugcguucucgcggaacugaagggcgugacaugugagaaucgggaggccguccuugacgcuuuucuggaugacggcuuccucgugccuaccuuugaacagcuggccgcccuucagaucgaguacgaagagaacguugaucugaaugacgugcucguccccaaaccuuucagccaguuuuggcaaccccugcugagagggcuccacucccagaacuucacacaggcucugcuugagcgcaugcugucugaacucccggcccugggaauuagcggcauccggccuaccuauauucugagauggacgguggagcuuaucgucgcuaauacaaagaccgggcgcaacgcgcggagauuuuccgccggacaaugggaagcucgccggggcuggagacucuucaauugcagcgccucucuggauuggccccgcaugguggaguccugucuggggagcccuugcugggccucuccccagcuccugcggaucauuuucaaagcuaugggacagggccuucccgacgaggagcaggagaagcugcucagaaucugcagcauuuacacacaauccggcgaaaacucucugguucaggaggggagcgaagccuccccuaucggaaaaagcccguauacccuggacucucuuuacugguccgugaagcccgcgagcagcuccuuuggcagcgaggcuaaggcccagcagcaagaggaacagggguccgucaacgaugugaaagaggaagagaaggaagagaaagaaguucucccugaccagguggaggaggaagaggaaaaugaugaccaggaggaggaagaggaagaugaggacgaugaagacgaugaggaggaagaccgcauggaggucggacccuucucuaccggccaagaaagcccuacagccgagaacgcucggcugcuggcccagaagagaggggcucuccagggcuccgccuggcaagugucuagcgaagaugugcggugggacacguuuccccugggacgcaugccgggccagaccgaggauccugcggagcuuaugcuggaaaauuaugacacaauguaccuccuggaccagcccguucuggagcagagacuugaaccuuccaccuguaaaacagauacccucgggcugagcugcggagucggcucugggaacuguuccaauucuucuuccagcaacuucgagggacugcucuggucucaaggccagcugcaugggcuuaagacgggccugcagcucuuuuga

SEQ ID NO: 71388 - RNA, 618 nt, Artificial Sequence
  derived and/or modified sequence opt5 from LASP1__Homo_sapiens__NP_001258537
augcugccccucagagaccugcaggaugacaccgagcacgaagaacuucaaggccugcgggaagaggcccuccugcagcgcgugagauacaaggaagaguucgagaaaaacaaggggaaaggauuuagcgucguugcugauacaccugaacuucagcggaucaagaaaacgcaggaccaaauuuccaauaucaaguaucaugaggaguucgagaagucucgcaugggcccgagcgggggagagggcauggaacccgagagacgggauucccaggacgggucuagcuaccgcagaccucuggaacagcagcaaccccaccauauuccuaccuccgcccccguguaucagcagccucagcaacagccgguggcgcagucuuacggaggcuauaaagagcccgcugccccugucagcauccaacgguccgcccccggcgggggaggcaagcgcuacagagcuguguaugauuacagcgccgcugacgaagaugagguuucuuuucaggacggggauacaauugugaacguccagcagaucgacgauggauggauguacggcaccguggagcggacaggggacaccggaaugcucccugccaauuauguugaagcgaucuga

SEQ ID NO: 71389 - RNA, 732 nt, Artificial Sequence
  derived and/or modified sequence opt5 from LAT2__Homo_sapiens__NP_115852
augagcuccggcaccgaacugcucuggcccggggccgcucugcuugugcugcucggagucgccgcgucucugugcguuagauguagccggccuggcgcuaagcgcuccgagaaaaucuaccagcaaagaucucuucgggaagaccagcagagcuucacagggucccgcacguauucucuggugggacaggccuggccgggcccccucgccgauauggcuccuaccagaaaggacaaacugcugcaauuuuaccccagccucgaagauccugccuccagccgguaucagaacuucucuaaggggucccgccacggaagcgaggaggcuuacauugaccccaucgccauggaauauuacaauuggggcagauuuucuaaaccuccggaggaugacgaugcgaacuccuaugaaaaugugcugauuugcaagcagaagacaaccgagacaggcgcccagcaagaagggaucggaggccuuugucgcggggaccugagccucucucuggcucuuaaaaccggacccacauccggccugugcccuagcgccucccccgaggaggaugaagagucugaagacuaccagaacagcgcuuccauucaucaguggcgggagagcagaaaggucauggggcagcuccaacgggaagccucuccuggacccgugggcuccccggaugaggaggacggcgaaccugauuacguuaauggggagguggcggccaccgaggcuuga

SEQ ID NO: 71390 - RNA, 702 nt, Artificial Sequence
  derived and/or modified sequence opt5 from LAT__Homo_sapiens__NP_001014987
auggaggaagccauccuggugcccugcguccucggccugcuucugcucccuauucuggcuaugcuuauggcccuguguguucacugccauagacucccggggagcuacgacuccaccucuagcgauucccuguauccccggggaauccaguucaagcgcccucacacaguggcgcccuggccucccgcuuacccuccggugacgucuuaucccccucugagccaacccgaccuccugccuauucccagauccccgcagccucuuggcgggucucaucggacccccagcucccgcagagauagcgacggagccaacucugucgccuccuacgagaaugaggaaccugcuugugaagaugccgacgaggaugaggacgauuaucacaaccccggcuaccuggugguucuccccgacagcaccccugcuacaucuacagccgcgccguccgcccccgcucugagcaccccugggauccgggauucugccuuuuccauggaaagcauugacgauuaugugaauguccccgaguccggagaaucugcugaggccagccuugacggcucccgcgaguacgugaacguuagccaggaacugcauccuggcgcggccaaaacagagcccgcugcccucucuucccaggaagcugaggaaguggaggaggaaggggccccggacuacgagaaucugcaagaacugaacuga

SEQ ID NO: 71391 - RNA, 2073 nt, Artificial Sequence
  derived and/or modified sequence opt5 from LATS1__Homo_sapiens__NP_001257448
augaagagaagcgagaaacccgaaggcuaccggcagaugcgcccuaagaccuucccggccuccaacuauacagugucuagcagacaaaugcugcaggagauccgggaaucccuccgcaaucugucuaaacccagcgacgcugccaaggcggagcacaacauguccaaaaugucuacggaagauccuagacagguccggaaucccccuaaguuugggacccaucacaaggcucugcaggagauucgcaacagccugcuccccuucgccaaugagacaaacuccagcagaucuaccuccgaaguuaauccucaaaugcugcaggaccuucaggccgcuggauuugaugaggacauggugauccaggcccugcagaaaacaaacaaucggagcauugaagcugccaucgaguucauuucuaagauguccuaccaagauccgcgcagagagcagauggcggccgcugccgcucggcccaucaacgccagcaugaaaccuggcaaugugcagcaaucugucaaccgcaagcaguccuggaaagggagcaaggaaucccucgugccccagagacauggaccuccccugggcgagucuguugcguaucacagcgaauccccgaauagccaaaccgacguggggcggccucugucuggauccggcaucagcgccuuuguccaggcucaucccucuaacggccagcgcgugaauccucccccucccccgcagguuagaagcgugacacccccucccccuccccgggggcaaaccccgccucccagaggaacgaccccucccccucccuccugggagccgaacucucagacaaagcgcuacagcggcaacauggaauaugucauuucccggaucagcccugugccucccggggccuggcaggagggauacccuccgcccccucucaauaccucucccaugaacccucccaaucagggccaaagagggauuuccagcgugccugucggacgccagcccaucauuaugcagucuuccagcaaauucaacuuuccguccggccggccuggcaugcagaaugggacaggacaaaccgauuucaugauccaccagaacguugugcccgcuggcacggugaauagacagccucccccgccuuauccccugacagccgccaacgggcagucuccuagcgcgcuucaaaccggaggcuccgcugcccccucuagcuacacaaauggguccauuccccagagcaugauggucccuaaccgcaauucucacaacauggagcuguacaauaucuccgugccgggacuccagaccaacuggccccaaucuagcuccgcuccugcccagagcucucccagcuccggccaugaaaucccuaccuggcagcccaauauuccuguucggagcaacucuuuuaacaauccgcugggcaacagagccucccacagcgcuaauucccagcccucugccacaacggugaccgcgaucacacccgcucccauucaacagccugucaagagcaugcgcgugcuuaaacccgagcugcagaccgcccucgccccgacacauccuuccuggaucccccagcccauucaaaccguucagccuucucccuucccugaagggacggcuagcaacgugacagucaugccgcccguggccgaggcuccuaauuaucagggacccccucccccguacccuaagcaccuucugcaccagaaccccuccgucccucccuaugaaucuaucagcaaaccuuccaaggaggaccaacccagccucccgaaagaggaugaaucugagaaguccuacgaaaauguggacagcggcgauaaggagaaaaagcagaucaccaccucuccuauuacaguucggaaaaacaagaaagacgaagagagacgcgagucccggauccagagcuauucuccccaagccuuuaaguucuuuauggaacagcauguggagaauguccugaagucccaccagcagagacuucaucggaaaaagcaacuggaaaacgagaugaugcgcgugaaacccuucaagaugagcauuuucauccucaaucaccuguuugcguggugccuuuucuga

SEQ ID NO: 71392 - RNA, 3267 nt, Artificial Sequence
  derived and/or modified sequence opt5 from LATS2__Homo_sapiens__XP_005266399
augagacccaagaccuucccugccacaacguacagcggcaacucccggcagcgccugcaagagaucagagaagggcucaaacagccgucuaagagcuccgugcagggacugcccgcuggcccuaauucugacaccagccuugaugccaaaguccugggguccaaggacgcgacacggcagcaacagcagaugcgcgcuacccccaaauuuggaccuuaucagaaggcccucagagagauucgguacucucugcuucccuucgccaacgaaagcggcacauccgcugccgcugagguuaaucgccaaaugcugcaggaacucgugaacgccgggugcgaucaggagauggcggggagagcccugaagcagaccggcagccggucuaucgaggcugcccuggaauauauuuccaaaaugggcuaccucgacccucgcaaugagcaaaucgugagagucauuaagcagacaagcccggggaaaggacugaugcccaccccugugacgcggcgccccucuuuugaaggcaccggggauuccuucgcuagcuaucaccagcuuucuggaacaccuuacgagggccccuccuuuggggccgacggaccgaccgcgcuggaggaaaugccuagacccuauguugauuaccucuucccuggcgugggcccccaugggcccggacaccaacaucagcacccuccgaagggcuacggggccagcgucgaggcugccggagcucauuuuccccugcagggcgcccacuaugggcggccucaccuucuggugcccggagaaccucucggcuacggcguucagcgcucccccucuuuccaaagcaaaacaccgccugagaccgggggauaugccucccugcccacgaagggccagggaggaccucccggcgcugggcuggcguuuccucccccggccgcuggccucuacgugccucauccccaccauaagcaggccggacccgccgcucaccagcugcacguccuuggcagcagaucucaaguguucgccuccgacagcccuccgcagucucugcucacacccagccggaacucccugaauguggaucuuuaugaacuggggucuaccagcguccagcaguggccugcggcuacacucgccagacgcgacucccugcaaaaacccggacuggaggccccuccccgggcucauguugccuuuagaccugauugucccgugccgagccgcaccaacucuuucaauucccaccagccucggcccggcccucccgggaaggcugagccgagccucccugcccccaacaccgugacagcggucacggccgcucauauccugcacccugugaaaucuguuagagugcuucgccccgaaccccagaccgccgucggaccuucccauccggcuugggugcccgccccugcgcccgccccugcucccgccccugcuccggccgccgagggccuggacgcuaaggaggagcacgcgcucgcccuugggggcgcuggagccuuuccccuggauguugaauacggcgggccugaccggagaugucccccucccccguauccuaaacaucugcuccugcgcagcaaguccgagcaguacgaccuggauucucucugcgccggaauggagcaaagccugcgggcuggccccaaugaacccgaagggggagacaaauccagaaagucugccaagggcgauaaagggggcaaggacaaaaagcagauccagacaagcccugugcccguccgcaaaaacucccgggaugaagagaagagagaaagccggauuaagucuuacuccccuuaugcguucaaauucuuuauggagcaacacguggagaaugucaucaagaccuaccagcagaaagugaaccgcagacuucagcuggaacaagagauggcuaaggccggacucugcgaagccgagcaggagcagaugcggaaaauucuguaucagaaggaaagcaauuacaacagacugaagcgcgcuaaaauggacaagucuauguucguuaaaaucaagacacuuggcauuggggccuuuggagaggugugucucgcgugcaaagucgauacccacgcucuguaugccaugaagacgcugcggaagaaagacgugcucaacagaaaucaaguugcccaugugaaggcugaacgcgauauccuggccgaggcugacaacgaaugggucgugaaacuuuacuauuccuuccaggauaaggacagccuguacuuugugauggacuacauuccgggcggggauaugaugucucuccugaucagaauggagguuuuccccgagcaccuggcccgguuuuauaucgcggaacuuacacucgccauugagagcguccacaaaaugggauucauccaucgcgacauuaagccugauaauauccugauugaccuggauggccacaucaaacucaccgacuuugggcuguguaccggcuucagauggacacauaacuccaaguacuaucagaagggaagccacgugcggcaggauucuauggaacccuccgaccuuugggaugacgugagcaauugccgcuguggcgauagacugaaaacccucgagcaacgggcucgcaagcagcaucagagaugccuggcccacucccuggucgggacaccuaacuacaucgcucccgaagugcuucuccggaaaggauauacgcaacugugugacugguggucuguuggcgugauucuguuugagaugcucgucgggcagccgccuuuccuggcccccaccccuacagagacccagcuuaaggugaucaauugggaaaacacacugcacauucccgcccagguuaaacucagcccugaggcucgcgaucugaucaccaagcugugcugcuccgcggaccauagacuuggacggaauggcgccgacgaucucaaggcucaccccuuuuucucugccauugacuucagcuccgauaucagaaaacaaccggccccuuacgugcccacgaucucucaucccauggacaccagcaacuuugauccugucgacgaagaguccccguggaaugaugcuagcgaaggcucuacaaaggccugggacacccugacaucccccaacaauaaacacccugagcaugcguucuaugaguuuaccuuccgccgguuuuucgaugacaacggguaccccuuuagauguccuaagcccagcggagcugaagccucucaggccgaguccagcgaucuggaaucuuccgaccucguggaucagacggagggcugccagccuguuuacguguga

SEQ ID NO: 71393 - RNA, 1149 nt, Artificial Sequence
  derived and/or modified sequence opt5 from LAX1__Homo_sapiens__NP_001129662
augagaagccacuuccugcagugggcccucgcuaccucccggaacaaggaccaaaucacaaauaucuuuucuggcuucgccgggcugcuugcgauucugcucguggucgcuguguuuugcauucuguggaacuggaauaaacgcaagaaaagacagguucccuaccuucgggugacggucaugccucugcucacccugccgcagacacgccagagagccaagaacaucuaugauauucugcccuggcggcaagaggaccucggacgccaugaaagcagauccaugcggaucuucucuaccgagagccugcuuucccgcaauucugaaagcccugagcacgugcccucccaggccggcaacgcuuuucaggaacauacagcccacauccaugcuaccgaguacgccguugggauuuaugauaaugcgauggugccucagauguguggaaaccugacacccagcgcccacugcaucaaugucagagcuucucgggacugugccuccauuagcucugaggauucccacgacuacgugaacguuccuaccgcugaagagaucgccgaaacgcucgcgagcaccaaaucuccgucccgcaaucuguucgugcuucccagcacacaaaagcuggaguuuaccgaggaaagagaugagggcugcggggacgccggagauuguacaucccucuauucuccuggcgcugaagacagcgauucccugagcaacggcgaggggucuucccagauuagcaaugacuacgucaacaugaccggacuggaucucucugccauccaggaacggcagcuguggguggcuuuccaaugcugucgcgacuaugagaaugugcccgccgccgacccuagcggcucccagcagcaagcugagaaggauguccccucuagcaacauugggcauguugaagacaaaacggaugacccgggaacacacgugcagugcgugaagagaaccuuucuugcguccggcgauuacgccgacuuccagccuuuuacacagagcgaggauucucaaaugaaacaucgggaagagauguccaacgaagacagcucugauuacgagaauguccugaccgcuaagcucgggggaagagacuccgagcagggccccggcacccagcugcuuccugaugaauga

SEQ ID NO: 71394 - RNA, 1149 nt, Artificial Sequence
  derived and/or modified sequence opt5 from LAYN__Homo_sapiens__NP_001245319
augagacccggcaccgcccugcaggcugugcuccuggccguccuucugguugggcuccgggcggcuacaggacgccugcuuagcgccuccgaccuggaucucagaggcgggcaaccugugugccggggaggcacgcagcgcccguguuacaaggugaucuauuuccacgacaccucuagacggcugaacuuugaggaagccaaagaggcuugccgcagagaugggggacagcuggucagcauugaauccgaggacgaacagaagcucaucgagaaauucauugagaaucugcuucccucugauggcgacuuuuggaucggccugcggcgcagagaagagaagcaaagcaacuccacagccugucaggaucucuacgcuuggaccgacgggucuauuagccaguuccggaauugguauguggaugaaccuuccugcggaagcgagguuuguguggucauguaccaucagcccucugccccugcgggcaucgggggacccuauauguuucaauggaacgacgaucgcugcaauaugaaaaacaauuucaucuguaaguacuccgacgagaagccugccgugccgagcagagaagcugagggcgaagagacagaacugaccacacccguucuuccugaggagacccaggaagaggaugccaaaaagacguuuaaagaaucucgggaggcugcccugaaccucgcguauauucugauccccuccauuccucugcuccugcuucugguggucaccacaguggugugcugggucuggaucugucgcaagagaaaacgggaacagcccgacccgagcaccaagaagcagcacacaauuuggccuucuccccaucaaggaaauuccccugaccucgagguuuacaacgugaucagaaaacagagcgaggccgaucuggcugaaacccgccccgaccuuaagaauauuuccuuccgggugugcucuggggaggccacgcccgaugacaugagcugugauuacgacaacauggcugucaauccuuccgaaagcggcuuugugacacugguuucuguggaguccggcuucgucaccaacgauaucuaugaauuuagcccggaccagauggggagaucuaaagagagcggauggguggagaaugaaaucuacggcuauuga

SEQ ID NO: 71395 - RNA, 318 nt, Artificial Sequence
  derived and/or modified sequence opt5 from LBH__Homo_sapiens__NP_112177
augagcaucuacuuccccauucacugcccugacuaucugagauccgccaagaugaccgaggugaugaugaacacacagccgauggaagagaucggccucucuccccggaaagaugggcugagcuaccaaauuuuuccugaccccuccgauuucgaccgcuguugcaaacuuaaggauagacugccuucuaucgucguugaacccacggagggagaaguggagagcggcgagcuccgguggccuccggaagaguuucuggugcaggaagacgagcaggauaauugugaggaaaccgcuaaggagaacaaagaacaguga

SEQ ID NO: 71396 - RNA, 1446 nt, Artificial Sequence
  derived and/or modified sequence opt5 from LBP__Homo_sapiens__NP_004130
augggcgcccuggcuagagcccuccccagcauccugcuugcgcugcuccugaccuccacaccugaggcucuuggggccaacccgggacugguggcccggauuacggacaagggccuccaguacgcugcccaagaagggcugcuggcucuccagucugagcugcuucgcaucacccugcccgauuucacaggagaccuccggauuccucacgucggcagagggcgcuaugaauuucauagccugaauauccacuccugcgagcuucugcauucugcccucagacccguuccuggacagggccugagccuguccauuucugauagcuccauccgggugcagggccgcuggaaagugagaaagagcuucuuuaaacuccaagggucuuucgacgucuccgugaagggaaucagcauuucuguuaaccugcuucugggcuccgaaagcucugggcggcccaccgugacagcguccagcuguuccucugauaucgccgacgucgagguggauaugagcggagaccucggcuggcugcuuaaucuguuucacaaccagauugaguccaaauuccagaagguucucgaaagccgcaucugcgagaugauucagaagucuguguccagcgaucugcaaccuuaccugcagacccucccggucacaaccgaaaucgacucuuuugcugauauugacuauagccugguggaggcccccagagcuacggcccagaugcuugaggugauguucaaaggggaaaucuuucaucggaaucaccgcuccccugucacccugcucgcggccguuaugucucugcccgaggaacacaacaagaugguguacuucgcuaucagcgauuauguguuuaauacagccucccuugucuaccaugaggaaggauaucugaacuucagcauuaccgacgacaugaucccucccgauucuaauauuagacucacaaccaaauccuuucggccguucgugccucgccuggcuagacuguaccccaacaugaaucucgagcugcagggcagcguuccuucugcuccccuucugaacuucucccccggcaaucucagcguggacccuuacauggagaucgaugccuuuguccugcugccguccucuagcaaggaacccguguuccggcuuuccguugccacgaacgugucugcgacacucaccuuuaauacaagcaaaauuaccggguuccugaagccuggaaaggucaaaguggagcugaaggaauccaaagucggccucuuuaacgccgagcugcuugaagcucugcucaacuauuacauccugaauaccuucuaucccaaguuuaacgacaaacuggccgagggguucccucuuccccuccugaagagagugcaacuguacgaucucggacugcagauccacaaagacuuucuuuuccugggcgccaauguucaguauaugcgcguguga

SEQ ID NO: 71397 - RNA, 1722 nt, Artificial Sequence
  derived and/or modified sequence opt5 from LBR__Homo_sapiens__XP_005273182
augcccagcagaaaguucgccgacggcgaggugguccgggggcgcuggccuggauccucucuguacuaugaaguugagauccucagccacgauuccaccucucagcuguacacagugaaauauaaggacggcacggaacuugagcugaaagaaaacgauauuaagccgcucaccagcuuuagacaacggaaagggggauccacaucuagcucccccagccgcagacggggcucucgcuccagaagccggucucgcuccccugggagacccccuaagagcgcucggcgcucugccuccgcgagccaucaggcugacaucaaggaggccagacgggagguggaagucaaacugacaccccuuauucugaagccuuucggaaauuccaucucucgcuacaacggcgagccggaacacauugagagaaaugaugcuccccauaaaaacacccaggagaaguuuagccucucccaggaaagcucuuauaucgccacccaauacucccugcggccuagacgcgaggaagugaaacugaaggagaucgacagcaaggaagagaaauauguugccaaggagcucgcugugcggacauucgaagucacccccauuagagccaaagaucuggaguuuggcggggugccuggaguuuuccuuaucauguuuggccugcccguguuccucuuucugcuucugcucaugugcaagcagaaagacccgucucugcugaauuucccucccccucuccccgcgcuguacgaacuuugggagacgcgcgucuuugggguguaccugcucugguuccugauucaggugcuguuuuaucuucuccccaucggaaaggucguugaaggcaccccucugauugaugggcggagacugaaauaccgccucaacggauucuaugccuucauccugacaagcgcugugauuggcaccucccuuuuucagggcguggaguuccacuacgucuauucucauuuucugcaauucgcccucgcugccacaguguuuuguguugugcugagcgucuaccuuuauaugcggucccugaaggcgccgagaaaugaccucagccccgccucuuccgggaacgcuguguacgauuucuuuaucggacgcgagcugaauccucggaucggcaccuucgaccugaaguacuuuugcgaacucagacccgggcugauuggaugggaggcccuucugacgacaauggauaucauucacgacggcuucggguuuaugcucgcuuucggagaccugguuugggugccuuuuaucuauagcuuccaggccuucuaccuggucucucaccccaacgaaguguccuggccgauggccagccuuauuaucguccucaaacuguguggcuaugugaucuuucgcggcgcuaauucccagaagaacgcguuccggaaaaauccuucugaucccaagcuggcccaucucaaaaccauucacacaagcaccgggaagaaccugcuuguuuccggaugguggggcuuugugagacauccuaauuaccugggggaccucaucauggcucuggccuggucucugcccugcggauucaaccacauucuuccuuauuuuuacaucauuuauuucaccaugcuccugguccaccgggaggcccgcgaugaauaccauuguaagaaaaaguacggcguggcuugggagaaauauugccagagaguucccuaccggaucuuuccguauaucuacuga

SEQ ID NO: 71398 - RNA, 846 nt, Artificial Sequence
  derived and/or modified sequence opt5 from LBX1__Homo_sapiens__XP_005269500
augaccagcaaggaggacggcaaagccgcucccggggaagagagacggcgcuccccucuggaucaccucccgcccccugccaacucuaauaagccccugacaccuuucagcaucgaagacauucuuaacaaacccuccgugagacggucuuacagccugugcggagcggcucaucuccuggccgccgcugauaagcacgcccagggcgggcuuccucuggcuggacgcgcccuccugucccaaacgucuccgcugugugcgcucgaggaacuggccagcaaaaccuuuaagggccuugaggucuccguucugcaggcugccgaggggagagacggaaugacaaucuucggccagcggcagacccccaagaaacgcagaaagagccggacagcuuuuaccaaucaucaaauuuaugaacucgagaaacgcuuccuguaccagaaguaucuuucuccugccgauagagaccagaucgcgcagcaacugggccucacaaacgcccaggugauuaccugguuucagaaucggcgcgcuaaacugaagagagaucuggaagagaugaaggccgacguggaguccgcuaaaaagcucgggcccagcggacagauggauaucgucgcccuggccgaacuugagcaaaacucugaagcuacggcgggcgggggaggcgggugcggacgggccaaaucccgcccuggcagccccgugcugccgccuggcgcucccaaggccccuggggccggagcucuccagcugucucccgccagcccccuuaccgaccagccugcguccucccaagauuguucugaggacgaagaggaugaggaaaucgacguugacgauuga

SEQ ID NO: 71399 - RNA, 585 nt, Artificial Sequence
  derived and/or modified sequence opt5 from LBX2__Homo_sapiens__NP_001009812
augggcaagagaaccagccuggaggugucccucggggaacugggaggcgagaaaugccgcgggggacggagaucuuuucccccucuugccgcuagccggccggcccgccccggcggguggagaugggcgcggcgcgaccuguguaagacagcuuccagagccgaaaacaauucucaggccugccggccucaacgcagagcuggacccgaugcccucggcccuggccccuucgggcggaaacgcagaaagagccggacggcuuucaccgcccagcagguccuggagcuugaacgcagauuuguuuuccagaaauaccuggcgccuuccgagcgggacggacucgccacaagacugggccuggcuaacgcccaaguggugaccugguuucagaaucgccgggcuaagcucaagagagaugucgaggaaaugcgcgccgacguggcgucucugcgggcccuuagcccggagguucuguguucccucgcucugcccgaaggggccccugaucccggacuuugccugggcccugcugggcccgacagcagaccgcaccucucugaugaggagauccagguggacgauuga

SEQ ID NO: 71400 - RNA, 2094 nt, Artificial Sequence
  derived and/or modified sequence opt5 from LCA5__Homo_sapiens__NP_001116241
augggcgagagagcugggagccccggaaccgaccaggaacggaaggcuggcaaacaccauuacuccuaucugucugauuucgagacaccucaaagcuccgggcgcucuagccucguguccucuagcccggccuccgucagacggaagaaccccaaacgccagacgagcgacggacagguucaccaucaggcgccuagaaagcccucuccuaaaggccugcccaaucggaagggggugcgcgugggauuuagaucccaaagccuuaaccgggaaccucugcgcaaggauaccgaccucgucacaaaaagaauccugucugcucggcuucugaagauuaaugagcuccagaacgaaguguccgagcugcagguuaaacuggccgagcuccugaaggaaaauaaaagccuuaagcgccugcaguacagacaagagaaggcccucaacaaauucgaagaugcugagaaugagaucucucagcugauuuuucggcacaacaaugaaaucaccgcccuuaaggagcgccugagaaaaucccaggaaaaggagcgggcuacagaaaagagagugaaggacaccgagagcgaacucuuccgcacaaaauuuucccugcagaagcugaaggaaauuucugaggcccggcaucucccggaaagagaugaccuggcgaaaaagcuggucagcgccgagcuuaaacucgaugacaccgaacgccggaucaaggagcuguccaaaaaccuugagcugagcaccaauucuuuccaaagacagcuccuggcugaacgcaagcgggccuaugaggcucacgaugaaaacaaggugcugcagaaagagguucaaagacucuaccacaagcugaaagaaaaggagcgcgagcuugacaucaaaaauauuuauuccaaccggcugcccaagagcucuccuaauaaggaaaaagagcucgcccugagaaagaacgcggccugccagagcgauuuugcugaccuuuguacgaaaggcgugcagacaauggaagacuucaagcccgaggaguacccucugacccccgaaacaaucaugugcuaugagaacaaaugggaggagccgggccaucucacccuggaucugcagucccaaaagcaggaccgccacggggaagccggcauucucaauccuaucauggagcgggaggaaaaguuugucacggaugaggaacugcauguggugaaacaggaggucgaaaaacuugaggacgagugggaaagagaggaacuggauaaaaagcagaaagagaaggcuucucuccuggaacgggaggagaaacccgaaugggagacaggacgcuaccaacuggggauguacccuauucagaacauggacaaacuucagggagaagaggaggaaagacucaagcgggagaugcugcuggccaagcucaaugaaaucgauagagagcugcaggacagccgcaaccuuaaguaucccguucugccccuccugccugauuucgaauccaaacugcacagcccggagcggucucccaagaccuacagauuuuccgagagcucugaacgccuuuucaauggccaccaucuccaagacauuuccuuuagcacaccuaaaggggagggacagaacuccggcaaugugagaucucccgccagcccuaacgaguucgcuuucggcuccuaugugcccucuuuugcgaagaccagcgaacgguccaauccguucagccagaagucuuccuuucuggauuuccagcgcaacagcauggaaaaacugucuaaggacggggucgaccucaucaccagaaaagagaagaaagccaaucugauggagcaacuuuuuggagcuuccggcagcucuacaaucagcuccaagagcucugauccuaacuccguggccagcuccaagggggacauugauccccugaauuuccucccuggaaacaaaggcucucgggaccaggaacacgaugaggacgaaggguuuuuccugagcgagggacgcuccuuuaaucccaacagacaucggcugaagcacgccgaugacaaaccugcuguuaaggccgcggauucuguggaagacgagaucgaggaagucgcccuucgcuga

SEQ ID NO: 71401 - RNA, 1323 nt, Artificial Sequence
  derived and/or modified sequence opt5 from LCAT__Homo_sapiens__NP_000220
augggacccccugggagcccguggcagugggugacccugcuccugggacuucugcuucccccugccgcucccuucuggcugcuuaacguccuguuuccuccccacacaacgccuaaggccgagcucuccaaucauaccagaccgguuauccuggugcccggcugccuggggaaccaacucgaagcgaaacuggacaagccugauguggucaauuggauguguuaccggaaaacagaggacuucuuuaccauuuggcuugaucugaacauguuccucccccugggaguggacugcuggaucgauaauacacgcguuguguauaacagaucuagcggccuugucuccaaugcuccuggggugcagauucggguucccggauuuggcaagaccuacucuguggaauaucuggacagcuccaaacucgccggcuaccugcacacacugguccagaaccucgugaauaacggguaugugcgcgaugagaccgucagagccgcuccguacgacuggcggcuggaaccuggacagcaagaggaguauuaccgcaagcucgccggccugguugaagagaugcaugcugccuacgggaagcccguguuccucaucggacacucucugggcugucuucaucugcucuauuuucugcugagacagccucaggcguggaaagaucgguucauugacggguuuaucagccucggagcccccuggggcggcuccaucaagcccaugcuggugcuugcuagcggggauaaucagggcauuccuaucaugucuuccauuaaacugaaggaggaacaacgcaucacgaccacaagcccguggauguuccccucuagaauggccuggccugaggaccacgucuuuauuuccacccccagcuucaacuacacaggccgggauuuucagcgcuucuucgcugaccuccacuuugaagaggggugguauauguggcugcagucuagagaccuucuggccggacucccugcgcccggcguggaaguuuacugccuguauggggugggacugccgaccccucggacguacaucuaugaucauggcuuccccuacacagacccugucggcgugcucuacgaggauggggacgauaccguugccacacgcuccaccgaacuguguggacuuuggcagggcagacaaccccagccugugcaucugcucccccugcacgggauucagcaccugaauauggucuuuagcaaccuuacccucgagcacaucaaugcuauccugcugggagccuaucggcaaggcccgccugcuucccccacagccucucccgagccuccgcccccugaauga

SEQ ID NO: 71402 - RNA, 267 nt, Artificial Sequence
  derived and/or modified sequence opt5 from LCE1C__Homo_sapiens__NP_001263260
augagcugccagcaaucccagcagcagugucaacccccuccgaacgugucuagcggcgggugcuguggauccucuagcggcggguccugcggaucuagcuccggcggguguugcagcucuggaggcggcggguguugccugucccaccauagacggcgcagaagccacugucaucggccccagucuuccggaugcuguagccagccuucuggcggguccagcugcugcggaggcggguccggacagcacucuggcggcuguugcuga

SEQ ID NO: 71403 - RNA, 270 nt, Artificial Sequence
  derived and/or modified sequence opt5 from LCE3A__Homo_sapiens__NP_848518
augagcugccagcaaaaccagcagcagugucaacccccuccgaagugccccgccaaauccccugcucagugucugcccccugccucuagcuccugcgcgcccucuagcggcggguguggaccuuccucugagagaagcugcugucucucccaccaucggugccgcagaagccaccggugucgcugccagucuuccaauagcugugacagaggcucugggcagcaaggaggcuccagcucuugcgggcauuccagcgcuggaugcuguuga

SEQ ID NO: 71404 - RNA, 288 nt, Artificial Sequence
  derived and/or modified sequence opt5 from LCE3B__Homo_sapiens__NP_848520
augagcugccagcaaaaccagcagcagugucaaccccugccuaagugcccgucccccaaauguccucccaagucuagcgcccagugccucccucccgcuuccucuuguugcgccccuagaccgggcuguugcgggggacccagcuccgagggcggguguugccugucucaccaucgguguugccgcagccacagaugccggcgccaguccagcaauucuugugacagaggauccggccagcaagauggggcgagcgacugcggauacggcucuggcggguguugcuga

SEQ ID NO: 71405 - RNA, 285 nt, Artificial Sequence
  derived and/or modified sequence opt5 from LCE3C__Homo_sapiens__NP_848521
augagcugccagcaaaaccagcagcagugucaacccccuccguccugccccucuccuaagugucccccuaaaagccccgcccagugccugccuccgcccuccucugacugugcucucagcuccggcgggugcggaccuucuagcgaguccggcuguugccugagccaccauagacacuuccggucucaucagugucgcagacagcgguccaauagcugcgaucgcgggucuggacaacagggcgggggauccuguagaggccacggcagcgggggaugcugcuga

SEQ ID NO: 71406 - RNA, 279 nt, Artificial Sequence
  derived and/or modified sequence opt5 from LCE3D__Homo_sapiens__NP_115952
augagcugccagcaaaaccagcagcagugucaacccccuccgaagugccccuccccuaaaugucccccuaagucucccgugcagugccugccuccggccagcuccggcugugcucccucuagcgggggaugcggcccuuccucugagggaggguguuuccucaaucaccauagacggcaccaucgcugcagacggcagcgccccaacagcugugacagaggcuccgggcagcaaggaggcggcagcgggugcggacacggcucugggggauguugcuga

SEQ ID NO: 71407 - RNA, 279 nt, Artificial Sequence
  derived and/or modified sequence opt5 from LCE3E__Homo_sapiens__NP_848522
augagcugccagcaaaaccagaagcagugucagcccccuccgaaaugccccuccccuaagugucccccuaaaaaucccgugcaaugccugccuccggccucuagcggcugugcucccuccucugggggaugcggcccuagcuccgagggaggguguuuccucaaccaccauagacggcaccaucgcugcagacggcagcgcucuaauagcugugacagaggcuccgggcagcagggaggcggcagcgggugcugucacggaucuggcgggugcugcuga

SEQ ID NO: 71408 - RNA, 357 nt, Artificial Sequence
  derived and/or modified sequence opt5 from LCE5A__Homo_sapiens__NP_848525
augagcugccagcaaucccagcagcagugucaacccccuccgaagugcacccccaaauguccucccaagugcacaccuaaaugucccccuaagugcccgcccaaauguccuccccagugcucugccccuugucccccgccugugagcuccugcuguggcucuagcuccgggggaugcugcucuagcgagggcgggggauguugccugucccaccauagaccccggcagagccuccgcagacggccucagucuuccagcuguugcggcucuggguccggacaacagagcggcgggucuuccuguugccacagcuccggcggaucuggcuguugccauagcuccgggggauguugcuga

SEQ ID NO: 71409 - RNA, 1551 nt, Artificial Sequence
  derived and/or modified sequence opt5 from LCK__Homo_sapiens__XP_011539756
augggcugcggguguagcucccaccccgaggacgauuggauggaaaacaucgacgugugcgagaauugucauuacccuauugucccgcuggauggaaagggcacccuccugaucagaaacgggucugaaguucgggacccccuugugacauaugagggaagcaauccucccgccuccccucugcagggcgauccccgccaacaggggcucaaagacaaggcuugcggaucucuggccgugggcuuccaccuuagcccuacguacuuucugccgggccucgcguuccuggucccccauccugugacccccggguuucugccuauucccgcuagauucucccucaugccgcugguuuuuacagauaaccuugugaucgcccugcacucuuaugaaccuagccaugacggagaucucggcuucgagaaaggggagcagcugcggauucuugaacaguccggagagugguggaaggcccaaagccugaccacaggccaggaaggguuuauccccuucaauuuugucgcuaaagccaacucucucgagccugagcccugguucuuuaagaaucugucccgcaaggacgcugaaagacagcugcucgcccccggaaacacccacggcagcuuccugauccgggagucugaauccacagcgggcagcuuuucucuuuccgugcgcgauuucgaccagaaucaaggggagguugugaaacacuacaagauuagaaaccuggauaauggaggcuucuauaucagcccucggauuaccuuuccggggcuccaugaacugguccgccacuacacgagauauuacaacggacauaccaaaguggccgugaagucccuuaaacagggcucuaugagccccgacgcuuuccuggccgaggcuaaucucaugaagcagcugcagcaccaacggcugguccgccucuacgccguugugacacaggagccuaucuauauuaucaccgaauacauggagaacgggucccugguggacuuucuuaagacacccagcggaauuaaacugaccaucaauaagcuccuggauauggcggcccagaucgcugaaggcauggccuucauugaggaaagaaacuauauccaccgggaccuucgcgcugccaacauucuggucucugauacgcucuccuguaaaaucgccgacuuuggccuggcuagacugauugaggauaaugaguacacagcgcgggaaggggccaaguucccuaucaaauggaccgcucccgaggccaucaacuauggaacauuuaccauuaagagcgacguguggucuuucggcauccuccugaccgaaauuguuacacaugggagaaucccguacccuggaaugacgaaucccgaggugauucaaaaccuugaacgcggcuaucggauggucagaccugauaauugccccgaggagcuguaccagcucaugcgccuguguuggaaagaacggccugaggacagacccaccuuugauuaccugcgcagcgugcuugaagacuucuuuacagccaccgaggggcaguaucagccgcaaccuuga

SEQ ID NO: 71410 - RNA, 1131 nt, Artificial Sequence
  derived and/or modified sequence opt5 from LCLAT1__Homo_sapiens__NP_001291374
auggugagcuggaagggcaucuacuucauucugacccucuuuuggggguccuucuuuggaucuaucuucaugcugagccccuuucuuccucugauguucgucaacccguccugguauagauggauuaauaaccggcucguugccacauggcugacgcuucccguggcucugcucgagaccauguuuggcgugaaagucaucauuacaggggacgccuucgugccuggagaacgcucuguuaucaucaugaaucacagaacccggauggauuggauguuucuguggaacugccugaugcgcuacagcuaucucagacuggagaagauuugucuuaaagcgucccugaagggcgugcccggguucggaugggcuaugcaggccgccgcuuacaucuuuauucaucggaaauggaaggacgauaagucucacuucgaagacaugaucgauuauuuuugcgacauucaugagccucuccaacugcuuaucuuccccgaaggcacagaucugaccgagaauagcaaaucccgcagcaacgccuucgcugagaagaauggccuccagaaauacgaauauguccugcacccuagaacaaccggguuuacguucgugguugaccggcugcgcgagggaaagaaccucgaugccgugcaugacauuaccgucgcguacccgcacaauaucccccagucugaaaaacaucugcuucagggcgauuuuccuagagagauccacuuccacgugcaucgguaccccauugacacacugccuaccuccaaggaggaucuccaacuguggugucacaagcgcugggaagagaaagaagagagacuucggagcuuuuaucagggggaaaagaacuucuacuuuacaggacagucugugauucccccgugcaaauccgagcugcgcguccucguugugaagcugcugagcauccucuauuggacccuguucucuccugccaugugucuucugaucuaccucuauucccuggugaaaugguacuuuauuaucacgaucgucauuuucgugcuucaggagagaaucuuuggcgggcuggaaauuaucgagcucgcuugcuaucggcugcugcacaagcaaccccaucucaauagcaaaaagaacgaauga

SEQ ID NO: 71411 - RNA, 840 nt, Artificial Sequence
  derived and/or modified sequence opt5 from LCMT1__Homo_sapiens__NP_001027563
auggccaccagacagcgggagagcuccaucacaucuugcuguagcacguccucuugcgacgcugaugacgaaggcgugcgcgggaccugugaggaugccagccugugcaagagauucgcggucuccauuggauacuggcacgaccccuauauccaacauuuuguucggcucucuaaagaacgcaaggcuccugagauuaacagaggcuacuucgcccgggugcacggggugagccagcugaucaaagccuuucuucgcaagacagaaugucauugccagauugucaaucugggagcuggcauggauaccacauucuggagacucaaagacgaggaucugcuuccguccaaguauuuugagguggacuuccccaugaucguuacccggaagcugcacagcaucaaacucccuacacugcugauugccgaaugugugcucgucuacaugacccccgagcagucugcuaaccugcuuaagugggccgccaauuccuuugaacgcgcgauguucaucaacuaugagcaagugaauaugggggauagauuuggacagauuaugaucgagaaccugcggcgcagacagugcgaccucgcuggcguugaaacguguaaaagccuggagucucagaaggaacggcuucuguccaauggcugggagaccgccagcgcuguggauaugauggaacucuacaaccgccugccuagagccgaggucucucggauugagucccuggaguuccucgacgaaauggaacugcuugagcaacugaugagacauuauugccucuguugggcgacaaaagggggaaaugaacugggccuuaaggagaucaccuacuga

SEQ ID NO: 71412 - RNA, 531 nt, Artificial Sequence
  derived and/or modified sequence opt5 from LCN1__Homo_sapiens__NP_001239546
augaagccccugcuccuggccgugagccuuggccugaucgcugcccuccaggcgcaccaucugcuugcuuccgacgaggaaauucaagaugucucugggaccugguaccugaaagccaugacaguugacagagaguucccugaaaugaaccucgagagcgugacgccgaugacccugacaacccuggaaggaggcaaucucgaggccaaggugacaaugcugaucuccgggcggugccaggaggucaaagcugugcuugaaaagaccgaugagcccggaaaauauacagccgacggcgggaagcacguugcuuacauuauccgcucucaugugaaggaucacuauaucuuuuacugugaaggagagcugcauggcaaaccugucagaggcgugaagcucguugggcgggaccccaaaaacaaucuggaggcccuugaagauuucgagaaggcggccggagcucgcggccugagcaccgaauccauucucaucccuagacagucugagacgugcagccccggguccgacuga

SEQ ID NO: 71413 - RNA, 597 nt, Artificial Sequence
  derived and/or modified sequence opt5 from LCN2__Homo_sapiens__NP_005555
augccccugggccuccuguggcuugggcuggcccuccugggagcccuucacgcucaggcgcaagacagcaccuccgaucugaucccugcuccgccccucucuaaggugccucugcagcagaacuuccaggacaaucaauuucagggcaaaugguacgucguugggcuggccggaaacgccauucucagagaggauaaggacccccagaaaauguaugcuacaaucuacgaacugaaggaggauaaaagcuauaaugugacguccgugcuuuuccggaagaagaaaugcgacuacuggauucgcaccuuugucccuggcugucagcccggggaguucacacugggaaacaucaagucuuauccuggccucaccagcuaccuggugagaguuguguccacaaauuauaaccaacaugccauggucuuuuucaaaaaggugucucagaaucgggaauacuuuaaaauuacccuuuacggccgcacaaaggaacugaccagcgagcucaaggagaacuucaucagauuuuccaaaagccuggggcugccggaaaaucacaucguuuuccccgugccuauugaucagugcaucgacggauga

SEQ ID NO: 71414 - RNA, 1221 nt, Artificial Sequence
  derived and/or modified sequence opt5 from LCOR__Homo_sapiens__NP_001164237
augcagagaaugauccaacaguucgccgcugaguacaccagcaagaacuccucuacacaggaccccagccagccuaauuccacgaaaaaccaaucucugccgaaggccagccccgugaccacauccccuaccgcggcuacaacccagaaucccguccucucuaaacugcuuauggccgaucaggacagcccucuggaucucacaguucggaagucccagagcgaacccucugagcaagacggcgugcuggaucuuuccaccaaaaagagcccuugcgccgggucuacgucccugagccacucuccgggauguuccagcacccagggcaacgggcgccccggaagaccuucccaguaucggcccgacggccuccgcucuggggauggagugccucccagaagccugcaggacggcacacgggaaggcuuugggcauuccaccagccugaaggucccgcucgcucgcucucugcaaauuuccgaggaacuucugagcagaaaucagcucucuacagccgcuagccugggaccuuccggccuucagaaccacgggcaacaucugauccucucucgggaggccagcugggcgaaaccccacuacgaguucaaucugucccgcaugaaguuuagaggaaacggcgcccugagcaauauuucugaucucccuuuccuggcugaaaacuccgccuuucccaaaauggcccuucaggcuaagcaggacgggaaaaaggaugugagccauucuucccccguugaccugaagaucccucaggugcggggaauggaucucagcugggagucccgcaccggcgaccaauauucuuacagcucccuggucaugggcucucagacggaaagcgcgcuuuccaaaaagcugagagccauucucccgaaacagagccggaagucuaugcuggacgcugggcccgauuccuggggaagcgacgccgagcagucuacauccggccaaccuuaucccaccagcgaucaggagggggacccuggaucuaaacagccccgcaagaaaagaggccgguacagacaguauaauagcgaaauccuggaggaagcuaucuccgugguuaugagcgggaagaugucuguguccaaggcccaaagcauuuacggaaucccgcacuccacacucgaguacaaagucaaggaacgccugggcacccuuaaaaacccucccaagaaaaagaugaagcugaugucuggcuga

SEQ ID NO: 71415 - RNA, 1884 nt, Artificial Sequence
  derived and/or modified sequence opt5 from LCP1__Homo_sapiens__XP_005266431
auggccagaggcagcguguccgacgaggaaaugauggagcugcgggaggcuuucgccaaggucgauaccgacgggaacggauacaucucuuuuaaugaacucaacgaucuguucaaagcggcuugccuuccccugccuggcuaucgcguuagagaaauuacagagaaucucauggccacgggggaccuggaucaggacggacggaucagcuuugaugaguucauuaagaucuuucacggccuuaaauccaccgacguggccaagacauuccgcaaagcuauuaacaagaaggaagggaucugugccaucggaggcaccucugagcaaagcuccgugggcacacagcauucuuacagcgaagaggagaaauaugcuuuugucaauuggauuaacaaggcccuggaaaaugauccggacugcagacacgugauccccaugaacccuaauaccaacgaucucuucaaugcgguuggggacggaauugugcuguguaaaaugaucaaccuguccguccccgauacaauugacgagcggaccaucaauaagaaaaagcucacgccuuuuaccauucaggaaaaccugaaucuugcccugaacagcgcuucugccaucggcugccaugugguuaacaucggggcugaggaccucaaggaaggaaaacccuaccuggugcuuggccugcucuggcaggucauuaagaucgggcuguucgccgauauugagcugucccgcaaugaggcgcucaucgcccugcuuagagaaggagagagccuggaagaccucaugaaacugucuccugaggaacuucugcuccggugggcuaacuaucaccuggagaaugccggcuguaacaagauuggcaauuuuuccacagauaucaaagacagcaaggcuuacuaucaucugcucgagcaaguggccccgaaaggggaugaagagggagugcccgccgucguuaucgacaugucuggccugcgcgaaaaggaugacauucagagagcugagugcaugcuucagcaggcggaacggcuggggugucgccaauucgugaccgccacagauguggucagaggaaacccuaagcucaaucuggcuuuuaucgccaaccuuuucaaucgguaccccgcccugcacaaaccugagaaccaggacauugauuggggcgcucucgagggggaaacccgcgaggaaagaacguuccggaauuggaugaacucccugggagugaaucccagaguuaaccaccuguacagcgaccucuccgacgcccuggugaucuuucagcuuuaugagaagauuaaagucccgguggauuggaaucgcguuaacaagccucccuacccuaaacugggcggcaacaugaagaagcucgagaauugcaacuaugcgguggaacuggggaaaaaucaggcuaaguucucucuggucggaaucggcgggcaagaccuuaacgagggaaaucggacacucacccuggcccugaucuggcagcucaugagacgcuacacacugaacauucuugaagagaucggcgggggccagaaagugaaugaugacauuaucgucaacugggugaaugaaacccugcgggaggccaagaaaagcuccagcauuucuuccuuuaaggaucccaagaucagcaccucucuccccguucuggaccugauugaugcuauccaaccuggaagcaucaacuaugaccuucucaaaacagagaaucugaacgaugacgaaaagcugaauaacgccaaauacgcuauuuccauggccagaaagaucggcgcgcgcguguaugcccucccggaggaucuggucgaagugaaucccaaaaugguuaugacgguguucgcuugucuuauggggaagggaaugaagcgggucuga

SEQ ID NO: 71416 - RNA, 1602 nt, Artificial Sequence
  derived and/or modified sequence opt5 from LCP2__Homo_sapiens__NP_005556
auggcccugagaaacgugcccuuccggagcgagguccucggcugggacccugauucccuggcugacuacuuuaagaaacuuaauuauaaggauugcgaaaaagccguuaagaaauaccacaucgacggggcgcgcuuccugaaccucaccgagaaugauauucagaaguuuccgaagcugagagugcccauccuuucuaaacugagccaagaaauuaacaagaaugaggaacggcgcuccaucuucacaagaaaaccucaggugccccgguuuccugaggagacggaaucucaugaggaagacaacggaggcuggagcuccuucgaggaggaugacuaugaaucucccaaugaugaccaggauggggaggacgauggagacuacgaaagcccuaacgaggaagaggaggcuccggucgaagacgaugccgacuaugagcccccucccuccaaugaugaagaggcccuccagaacagcauucugccugcuaagcccuuucccaauucuaacuccauguacaucgaccgcccucccagcggcaaaaccccucaacagccgcccgugccuccgcagagacccauggccgcucugccucccccucccgccgggcggaaucacucuccgcucccucccccucagacaaaccaugaggaacccucccgcagcagaaaucacaagaccgcgaagcugccugcccccucuaucgaucgguccacaaaaccgccucuugaccgcagccuggcucccuucgauagagagcccuuuacccucggaaagaaaccuccguucuccgacaagcccucuauuccugccggccggagccugggcgaacaucuucccaaaauccaaaagccuccccugccucccacaaccgagcgccacgaaagauccagcccgcucccugggaaaaagcccccuguucccaagcacggauggggcccggaucggagagagaacgacgaagaugacgugcaucagcgcccucugccccagccugcucugcuccccaugucuuccaacacguuucccagccggucuaccaaaccuagcccgaugaauccccugccuuccucucacaugcccggggccuucagcgaguccaacagcucuuuuccucaguccgcgagccuucccccuuauuucucucaaggaccguccaauagacccccuauucgcgccgagggccggaacuucccccugccucuccccaauaagccgagaccucccagccccgcugaagaggaaaacucccugaaugaggagugguacgucucuuacaucacacgcccugaagccgaggcugcccuucggaaaauuaaccaggacgggaccuuucuggugagagauagcuccaagaaaacaaccacgaaucccuauguucucauggugcuguacaaggacaaggucuauaacauccagauucgcuaccaaaaagaaucucagguguaucugcucggaacaggccugcggggcaaggaggauuuccuuagcguguccgacaucaucgauuacuuuagaaaaaugccucugcuccugauugacgggaagaaucgcggaagccgguaucaguguacccuuacacaugccgcuggcuacccguga

SEQ ID NO: 71417 - RNA, 5784 nt, Artificial Sequence
  derived and/or modified sequence opt5 from LCT__Homo_sapiens__NP_002290
auggaacugagcuggcacguggucuucaucgcccuccuguccuuuucuugcuggggaagcgacugggaauccgaucggaacuucauuucuaccgcugggccccuuacaaacgaccugcuccauaaccugagcggacuucugggcgaucaguccucuaauuuuguugccggggacaaggauauguacgugugucaccaaccucucccgacguuccugcccgaauauuuuagcucccugcaugccagccagaucacccacuacaaaguguuccucucuugggcucagcugcuuccugccggauccacacagaaccccgacgaaaagaccguccaaugcuaucggcgccugcucaaagcccugaagacagcuagacuucagccuauggugauucugcaucaccagacccuccccgccagcacacugcggcgcaccgaggcuuuugccgaucuguucgcggacuacgccacguuugcuuuccacucuuuuggcgaucucguugggaucugguucaccuuuuccgaccuggaagaagugauuaaagaacuuccucaucaggaaagcagagccucucaacugcagacacucuccgaugcucaccggaaggccuaugagaucuaccaugaaagcuaugcguuccagggaggcaagcuguccgucgugcuucgcgccgaggacaucccggagcugcuccuggaacccccuauuucugcucuggcccaggauaccguugacuuccucagccuggaccuuuccuacgagugucaaaaugaagcuagccugagacagaaacucucuaagcugcagacaaucgagcccaaagugaaggucuuuauuuucaaccuuaaacugccugauugccccuccaccaugaagaauccggccagccuccuguuuucucuguucgaagccaucaacaaggaccaagugcucacgauuggcuuugauaucaaugaguuccugagcuguuccucuagcuccaaaaagagcaugucuugcucccuuacagggagccuggcucuccagccugaccagcagcaagaucacgagaccacagacucuucccccgcgagcgccuaccagcggauuugggaggcuuuugccaaccagucccgcgccgagagagaugcuuuccugcaggacaccuuuccugaaggauuccuguggggcgccucuaccggggcguuuaauguggagggaggcugggcugaagggggacggggcgucagcaucugggauccccgcagaccccuuaacacaacggagggccaagccacccucgagguugccuccgacucuuaucacaaaguggcuagcgauguggcccugcugugugggcuccgggcucaggucuacaaguucuccaucagcuggucucgcauuuuuccuaugggacauggcuccagcccgucucugcccgggguggccuauuacaauaaacuuaucgacagacugcaggacgcgggaauugaaccuauggccacacucuuccacugggaucugccccaggcucugcaagaccauggcggguggcagaacgaguccguuguggaugccuuccuugacuaugcugccuuuugcuucagcaccuuuggagaucgggucaagcucugggugacauuccacgaaccuuggguuaugucuuacgcgggcuauggcaccgggcagcaucccccgggaaucagcgacccuggcguggccuccuuuaaagucgcucaccuggugcugaaggcccacgcuagaacguggcaucacuacaauagccaucaccgcccccagcaacaggggcacgucggaauugugcucaacucugauugggccgagccucugucccccgaacggccugaggaccuuagagccagcgagcgcuuccugcauuuuaugcucggcugguucgcucaccccguuuuuguggauggggacuacccggcgacacugcggacccagauccaacagaugaacagacaguguucccauccugucgcccagcugcccgaguucaccgaggcugaaaagcaacuucucaaaggcucugccgauuuucugggacugagccacuauacaucccgccucaucucuaaugcgccccagaauaccugcauuccuagcuacgacacaaucggcggguucucccagcaugugaaucacguuuggccgcagacgucuagcuccuggauucgggugguccccuggggaaucagacgccugcuucaauuugugagccuggaguauacccggggcaaggugccuauuuaccucgcugggaacggaaugcccaucggcgagucugaaaaucuguucgaugacucccugagaguugacuauuucaaccaguacaucaaugagguccuuaaagccauuaaggaagauagcguggacgugcgcucuuauaucgcgcggucccucauugauggguuugagggcccuagcggauacucucagagauucggccugcaccaugucaacuuuuccgacagcuccaaaagccggacaccccgcaagucugcuuacuucuuuaccagcaucauugaaaagaauggguuccugacaaaaggagccaagagacuccugccucccaacaccgugaaucuuccguccaaaguucgggccuuuacguucccuucugaggugcccagcaaggcuaaagucgugugggagaaguuuuccucucagccuaaguucgaaagagaucuguuuuaucacggcaccuuccgcgacgauuuccucuggggaguuagcuccucugccuaccaaaucgagggagcgugggacgcugauggcaaagggcccagcauuugggacaacuuuacacauaccccgggcuccaaugugaaggauaacgccacaggagacaucgccugugauagcuaucaccagcuggacgcugaccugaauaugcuucgggcccugaaagucaaggcuuacagauucucuaucuccuggagccgcauuuuuccuaccggcagaaacucuuccaucaacagccaugggguggauuauuacaaucggcucauuaacggacugguugccuccaauaucuuccccauggugacgcucuuucacugggaccugccucaggcgcuucaagauauuggcgggugggaaaaccccgcccugaucgaccucuucgauucuuaugcugacuuuugcuuccagacauuuggagaucgcgucaaauucuggaugaccuuuaaugagcccauguaccuggccuggcugggcuacgggagcggcgaguucccuccgggagugaaggaccccggcugggcuccuuauagaaucgcccacgccgugauuaaggcucaugcgcgggucuaccacacauaugaugagaaauaccgccaggagcagaaggggguuaucucccuuagccugucuacccauugggccgaacccaaauccccuggagugcccagagacguggaggcugccgaucggaugcuccaauuuagccugggcugguucgcccacccuauuuuccgcaacggggacuauccggacaccaugaaguggaaagucggaaauagaucugaacuccagcaccuggcuacaagccggcuucccuccuuuacggaggaagagaagcgcuucaucagagccaccgcggauguguuuugccugaacacauacuauucucggauuguucagcauaaaaccccuagacucaaucccccuagcuacgaggacgaucaggaaauggcugaggaagaggaccccuccuggccgucuacagccaugaaccgcgccgcuccuuggggcacccggagacugcugaauuggaucaaggaggaauacggcgauauccccauuuauaucacggagaacggggugggacuuacaaaucccaacaccgaagacaccgaucgcauuuucuaccacaagacauauaucaaugaggcccugaaagcguaccggcucgacggcauugaucugagaggguaugucgcuuggagccucauggacaacuuugaauggcugaacggauacaccgugaaguucggccuuuaucauguugauuuuaauaacacaaaucgcccucggacggccagagccuccgcucgcuacuacaccgaggugaucacaaacaaugggaugccccuggcccgggaggacgaguuccuguauggaagauuuccugagggcuucaucuggagcgcugccucugcggccuaccaaauugaaggcgcuuggcgggccgaugggaaaggacucuccaucugggacaccuuuagccacacaccgcugcgcgucgagaacgacgcuauuggcgauguggccugugacuccuaucauaagaucgccgaagaucuuguuacccugcagaaucucggggugucucacuacagauucagcauuuccuggucucggauccugcccgacggaacgacccgcuauauuaacgaggcuggccucaauuacuaugucagacugaucgauacacuucuggcggccagcauccagccucaggugaccauuuaccacugggaccugccccaaacacuccaggaugugggcgggugggagaacgaaaccaucguccagcgguuuaaagaguacgcugacguucuguuccagagacuuggggauaaggugaaguucuggauuacacugaaugaaccuuuugugaucgccuaucaaggcuacggguauggaaccgccgcucccggcgucuccaaccgcccggggacggccccuuacauugugggacauaaucucaucaaagcgcacgcugaggccuggcaucuguauaacgacguuuaccgggccagccagggcggggugaucucuauuacaaucuccagcgauugggcugaacccagagacccuucuaaucaggaggaugucgaggccgcgcgccgguaugugcaauucaugggaggcugguuugcccaccccauuuucaagaacggcgacuacaacgaaguuaugaaaaccagaauccgcgaccggucccucgcugccgggcugaauaagagcagacuuccugaguuuaccgaaucugagaaacgcagaauuaacggaacauacgauuucuuuggcuucaaucacuauaccacggugcuggcuuacaaccugaauuaugccacagcuaucagcuccuuugacgccgauagaggggucgcgucuaucgccgaccgcagcuggcccgauuccggcagcuucuggcucaagaugaccccguuuggcuucagacggauucugaacuggcuuaaggaggaauacaaugacccucccaucuaugugacagagaacggggucucccagcgcgaagagaccgaucugaaugacacagcuagaauuuacuaucuccggaccuacaucaacgaagcccugaaagcugugcaggauaagguugaccucagaggauacacgguguggucugccauggauaauuuugagugggccaccggcuucagcgagcgcuucggccugcauuuugucaacuauuccgaccccucucuuccucggauuccgaaagcuagcgcgaaguucuacgccuccgugguuagaugcaauggguuucccgacccugcuacaggaccccacgccugucugcaucagccugaugccggccccaccaucucuccugugcgccaagaagagguccaguuccuggggcucaugcugggaacaaccgaagcucagacggcccuuuaugugcuguuuagccucgugcugcugggcguuugcgggcucgcguuccuuuccuacaaauauuguaagcggagcaagcagggaaaaacacaaagaucucagcaggagcuguccccggucagcucuuuuuga

SEQ ID NO: 71418 - RNA, 1236 nt, Artificial Sequence
  derived and/or modified sequence opt5 from LDB1__Homo_sapiens__NP_001106878
augagcgugggcugcgccugucccgggugcuccucuaagagcuucaaacuguacuccccuaaggagccgcccaacggaaaugcuuuuccucccuuccacccuggcaccaugcucgacagagaugucgggcccacaccuauguauccgcccacguaccuggaaccuggaaucggccggcauacccccuaugggaaccagacagacuaccgcauuuuugagcuuaauaaaagacugcaaaacuggaccgaagagugugauaaucucuggugggacgccuucacaaccgaauuuuucgaggaugacgcgaugcugacaaucaccuuuugccuugaggauggaccuaagcgguauacgauuggccgcacccugauccccagauacuuccggucuauuuuugaaggcggggcuacagagcucuauuacguucugaaacacccgaaggaagccuuccauagcaacuuugugucccuggacugugaucagggaucuauggugacccagcacggcaagccuauguucacacaggucugcguggaggggcgccucuaccuggaguuuauguucgacgauaugaugagaaucaaaaccuggcauuucagcauccggcaacaccgcgaacuuauucccagauccauccuggccaugcacgcucaggacccucagaugcucgaucagcugagcaagaauauuacgcgguguggacuuucuaacuccacacugaauuaucuccgccugugcguuauccuggagcccaugcaagaacucaugagcagacauaaaaccuacucucugagcccccgggacugucuuaagacaugccuguuucagaaauggcagcgcaugguggccccuccggcugagcccaccagacagcaaccuuccaagcggagaaagcgcaaaaugucuggcggguccaccaugagcuccggaggcggcaacacaaauaacucuaauagcaagaaaaagucccccgccagcacguucgcgcucucuucccaggucccugacgugaugguugugggggaacccacccugaugggaggcgaguuuggggaugaggacgaacggcuuauuacaagacuggagaacacccaguucgaugccgcuaauggaaucgacgaugaagacagcuuuaacaacucuccggcccucggcgcuaauagcccuuggaacuccaaacccccuucuagccaagaguccaagagcgaaaaucccacaucucaggccucccaguga

SEQ ID NO: 71419 - RNA, 996 nt, Artificial Sequence
  derived and/or modified sequence opt5 from LDB2__Homo_sapiens__NP_001124306
augagcuccacaccccacgacccuuucuacucuagcccguuuggccccuucuauagacggcauaccccuuacauggugcagcccgaguaucgcaucuacgaaaugaacaagagacugcaaucccggacggaggauucugacaaucucuggugggaugccuuugcuaccgaguucuuugaagacgaugccacacugacccuuagcuucugccuggaagacgggccuaaacgcuauacaauuggaagaacccucaucccccgguacuuuuccacagucuucgagggcgggguuaccgaucuguauuacauucuuaagcacucuaaagagagcuaccauaacuccagcaucacgguggacugugaucagugcaccauggugacacagcacggaaagccuauguuuaccaaagucuguacagaaggccgccugauucucgaguucaccuuugacgaucugaugagaaucaagacguggcauuucacaauccggcaguaucgcgaacuggugccgagaucuauucucgcgaugcacgcucaagacccccagguucuggaucagcuuuccaagaauaucacccggauggggcugacaaacuuuacccucaauuaccugcgccuuugcgugauucuggagccuaugcaggagcucaugagcagacacaaaaccuauaaccugucuccccgggacugucugaagacaugccucuuccaaaaauggcagcgcauggucgccccucccgccgaaccgacgagacagccuaccacaaagcggagaaaacgcaaaaauuccaccagcucuacauccaacagcuccgcuggaaauaacgccaauucuaccggcagcaagaagaagacgacagcugccaaccugucccuuagcucucaggugcccggccugggggcgaucccuaauuguucccucaaccccggacgggacggcgaucugugccauagcaccgccguuacccccucugggcaauucaaagagaagcacuga

SEQ ID NO: 71420 - RNA, 1854 nt, Artificial Sequence
  derived and/or modified sequence opt5 from LDB3__Homo_sapiens__NP_001073583
augagcuacuccgugacccugacaggccccgggccuuggggauucagacuccagggcgggaaggacuuuaacaugccgcugacgaucucucggauuacccccggaagcaaagccgcucaaucccagcuuucucagggcgaucuggucguugccaucgacggggugaauacagauaccaugacacaccucgaggcgcagaacaagauuaaaagcgcuuccuauaaucugucucuuacccugcaaaagagcaaacgcccuauccccauuuccacaaccgccccucccgugcagacgccucucccggucaucccccaucagaaggugguugugaacagcccugccaaugcugacuaccaggaaagauucaaccccucugcccugaaggauuccgcucugagcacccacaaaccuaucgaggucaagggacucggcggcaaagccacaauuauccaugcgcaauauaauacccccauuucuauguacucccaggacgccaucauggaugcuauugccgggcaggcucaggcccaaggaagcgacuuuucuggcucccugccgaucaaggaucuugcgguggacagcgccuccccuguuuaucaggcugugauuaaaucucagaacaagcccgaagaugaggccgacgaaugggcucggcgcagcuccaaucugcaaagcagaucuuuccggauccucgcccagaugacagggaccgaguuuaugcaggauccugacgaggaagcccugcgcagaucccggccccaggcuagcucuuacagccccgcggucgccgcuuccucugccccugccacgcacacaagcuauuccgagggaccggcugcccccgcgccuaagccccgcguggugaccacagcuagcaucagaccuucugucuaccaacccguuccggccuccaccuacagcccuucucccggcgccaacuauuccccuacccccuacacaccuagccccgcuccggccuauacgccuucccccgcucccgccuacaccccuucuccggugcccacauauaccccuagccccgcgccugccuacacacccuccccugcucccaauuauaacccggccccuucuguggcuuacagcgggggacccgccgaaccugcgucccggcccccgugggucaccgacgauagcuucucucagaaauuugccccuggcaaguccacgacaagcauuucuaaacagacccuuccccgcggcgggccugcuuacacccccgccggaccccaggugccuccgcuggcuagaggcacaguucaacgggccgagcgcuuccccgccuccagcagaaccccucucugcgggcauuguaauaacgugauccggggacccuuucuggucgcuaugggcagaucuuggcacccugaggaguucacaugcgcguauuguaagacgagccuggccgacgugugcuuuguugaagaacagaauaacguguacugugagcgcugcuaugaacaguucuuugcuccccucugugccaaaugcaacaccaagauuaugggggaggucaugcacgcccugcggcagacauggcauaccacauguuucgugugcgcugccuguaaaaagccuuucggaaauucccuuuuucacauggaggauggcgaaccguacugcgagaaggacuauaucaaccuguucagcaccaaaugccauggcugugauuuucccgucgaagcgggggacaaguucauugaggcucucggacacacguggcacgauaccugcuuuaucugugccgugugccauguuaaucuggaaggccaaccuuucuacucuaaaaaggacagaccccuuuguaaaaagcacgcccauacaaucaaccuguga

SEQ ID NO: 71421 - RNA, 825 nt, Artificial Sequence
  derived and/or modified sequence opt5 from LDHA__Homo_sapiens__NP_001128711
auggccacccugaaggaccagcucaucuacaaccugcuuaaagaggaacaaacaccccagaauaagauuacgguggucggcguuggggcugugggaauggccugcgcgaucagcauucugaugaaagaucucgcugacgagcuggcccuuguggaugucaucgaagacaagcugaaaggcgagaugauggaucuccagcacgggucccuguuccugagaaccccuaagauugugucuggaaagguugacauccucacauauguggccuggaaaaucagcggcuuuccgaagaaccgggucauuggguccggauguaaucuggauucugcucgcuucagauaccuuaugggcgaacggcugggcgugcauccccucagcugccacggguggguucugggagagcauggcgacuccucugugccugucuggagcgggaugaacguggccggagugucccuuaaaacccugcaccccgaucucggcacagacaaggauaaagagcaguggaaggaaguccauaagcaaguuguggagagcgcuuaugaagugaucaaacugaagggguacaccucuugggccauuggacuguccgucgcggaccucgccgagagcaucaugaaaaaucugcgcagagugcacccuguuucuacaaugauuaagggccuuuauggcaucaaagaugacguguuucuguccguccccuguauucucgggcagaacggaaucagcgaccuggugaagguuacccuuacgucugaggaagaggcucggcugaaaaaguccgccgauacccucuggggcauccagaaggaacugcaguucuga

SEQ ID NO: 71422 - RNA, 1146 nt, Artificial Sequence
  derived and/or modified sequence opt5 from LDHAL6B__Homo_sapiens__NP_149972
augagcuggaccgugcccgucguuagagccucccagagagugucuagcgugggcgcuaacuuccugugccucgggauggcccuguguccucgccaagcgacaagaaucccgcuuaauggaacguggcuguuuacccccgucuccaagauggcuacagugaaaucugagcucauugaacgguucaccagcgagaagccuguucaccauuccaaagugucuaucauuggcacagggagcgucggaauggccugcgccaucuccauucugcuuaagggccugagcgacgaacucgcucugguggaucuggacgaggauaaacucaagggggaaaccauggaccugcagcacggaucucccuuuacaaagaugccuaacaucguuuguuccaaagauuacuucgugaccgccaauagcaaccuugucaucauuacggcuggcgcccgccaggagaagggcgagaccagacugaaucucgugcagcggaacguggcgaucuuuaaacugaugauuucuuccaucguccaauauagcccccauugcaagcugauuaucguuucuaauccuguggacauucugacauacguggccuggaaacucuccgcuuucccgaagaaccgcaucaucgggagcggauguaaucuggauaccgccagauuucgguuccugauuggccagaagcucgggauccacuccgaaucuugccauggauggauucugggcgagcacggggacagcuccguccccguguggagcggaguuaacaucgcuggcgugccucuuaaagaucuuaauucugacauuggcacagauaaggaccccgaacaguggaaaaacguccacaaggaggugaccgccacggcguaugagaucaucaaaaugaagggguacacauccugggccauuggacucagcguugcugaucugaccgaaucuauccuuaaaaaucugcgccggauucauccugugagcacaaucauuaagggccucuaugggaucgacgaggaagucuuucuguccauccccuguauucugggagagaacggcaucaccaaucucauuaagaucaaacugaccccggaagaggaggcccaccuuaagaaaucugcuaagacacugugggaaauucagaacaaacucaagcuguga

SEQ ID NO: 71423 - RNA, 1005 nt, Artificial Sequence
  derived and/or modified sequence opt5 from LDHB__Homo_sapiens__NP_002291
auggccacccugaaggagaaacucaucgcucccguggccgaagaggaagcgacagucccuaacaauaagauuacgguugugggcguggggcaggucggaauggcuugcgccaucagcauucugggcaaaucccuugccgacgagcuggcucucguggauguucuggaagacaaacuuaagggggagaugauggaucugcaacacggaucucucuuccugcagaccccgaagaucguggccgacaaggauuacagcgucacagcuaacuccaaaauugugguugugaccgccggcgucagacagcaggagggggaaucucggcugaaucucgugcaacgcaacgugaaugucuuuaaguucaucaucccccagauuguuaaauauagcccugacuguaucauuaucgugguguccaaccccgucgauauucugacauacgugaccuggaaacuuucuggacugccuaagcauagaguuaucggcagcggcugcaaucucgacuccgcgcgguuucgcuaucugauggccgagaaacuugggauucaccccagcucuugucauggauggauccugggcgaacacggggauuccagcguggcugucuggucuggagugaacguugccggcgugucccuccaggagcugaauccugagauggggacagacaacgauagcgaaaauuggaaggagguccauaagaugguggucgaaucugcuuacgaggugaucaagcugaaaggauauaccaacugggccauuggccucuccguugcggaccugaucgaaagcaugcuuaagaaucugucccggauucacccggugucuacgauggucaaaggcauguacgggaucgagaacgagguguuccucagccugcccugcauucuuaaugccagaggacugaccuccguuaucaaccagaagcucaaagaugacgaaguggcucaacugaaaaagagcgccgacacacugugggauauccagaaggaccucaaggaucuguga

SEQ ID NO: 71424 - RNA, 999 nt, Artificial Sequence
  derived and/or modified sequence opt5 from LDHC__Homo_sapiens__NP_059144
augagcaccgugaaggagcagcugauugaaaaacucauugaggacgaugaaaacucccaaugcaagaucacaauugucggcacgggggccguuggaauggcuugugccaucucuauucugcuuaaagaccuggcggaugagcucgcucugguggacguggcccuugauaagcugaaaggcgaaaugauggaccuccagcacgggagccuguucuuuuccaccucuaagaucacaagcggaaaggauuacuccgucucugccaauagcagaaucgugauuguuaccgcuggcgcccggcagcaggagggggagacacgccuggcucucgugcaaagaaacgucgccaucaugaaauccauuauccccgcgauugugcauuauagcccugacugcaagauccugguugugucuaauccggucgauauucuuaccuacaucguguggaaaaucuccggacugcccgugacacgggucauuggcagcggcuguaaccucgacucugcccgcuucagauaucugaucggggaaaaacuuggaguucacccuaccuccugccauggcuggauuaucggggagcacggagauagcucugugccccugugguccggcgugaaugucgcugggguggcccucaagacgcuggacccuaagcugggaaccgauagcgacaaggaacauuggaaaaacauucacaagcagguuauccaguccgcuuacgagaucauuaaacucaagggcuauacaucuugggccaucggccugagcgugauggaccuugucggguccauucugaaaaaucuccggcgcgugcaccccguuagcaccauggugaagggacuguacggcaucaaagaggaacuuuuucugucuauuccuuguguccucgggagaaacggaguguccgaugucgugaagaucaaucugaacagcgaggaagaggcgcuguucaagaaaucugccgaaacacucuggaauauccagaaggaccugaucuuuuga

SEQ ID NO: 71425 - RNA, 1524 nt, Artificial Sequence
  derived and/or modified sequence opt5 from LDHD__Homo_sapiens__NP_705690
auggccagacugcuccggagcgcuaccugggagcuguuccccuggcgcggcuacugcucccagaaggccaaaggggaacuuuguagagacuuuguggaggcgcugaaggcugucguuggaggcucucacgugagcacagccgccgugguccgggaacaacaugggcgcgaugaguccgugcacagaugcgaaccuccggacgcuguuguguggccccagaacgucgaacaggugucucggcucgccgcucuguguuaucgccagggaguuccuaucauucccuucggcacggggaccggacuugagggcggcgugugcgccguccaagggggagugugugugaaucugacacauauggauagaauccucgaacugaaccaggaggacuuuagcgucguuguggaaccuggcgugacccggaaagcgcugaaugcccaccuccgcgauuccgggcugugguuccccgucgacccuggagcugaugccucucuuugcggcauggcugccacaggggcgagcggaaccaacgccgugagauacggcacaaugcgggacaauguucugaaccucgaggugguccugccggauggccgccuucugcauaccgcugggagaggacggcacuuucgcuucggcuuuuggcccgagauuccucaccauacggccugguauucccccugugugagccucgggagacggaagucugcugccggauacaaucugaccggccuguucguuggguccgaaggaacacucggccugaucaccgccacaacccuuagacugcacccugcucccgaggcgacgguggccgcuacaugcgccuuuccgagcguccaggccgcuguggacucuaccguccauauucuccaggccgcggugccuguugcucgcaucgaguuccuggaugaggugaugauggacgccuguaaccgguauuccaaacuuaauugccuggucgcccccacacucuuucuggaguuccacggcagccaacaggcucuggaggagcagcuccagagaaccgaagagaucgugcaacagaacggggccucugauuuuuccugggcuaaggaagccgaggaacgcagccggcuguggaccgcgagacacaaugccugguacgcugcccuugcuacacgcccuggauguaagggcuauuccacggacguuugcgugcccauuucucggcugcccgagaucgucgugcagaccaaagaggaccucaacgccagcgggcugacaggauccauugugggccauguuggggauggcaauuuccacugcauccuucuggucaacccugacgaugcggaagaacucggaagagugaaggccuucgcugaacaacugggccgccgggcccuggcucuccaugggaccuguacaggagagcacggcauugggaugggaaaaagacagcugcuucaggaagaggugggcgccgucgggguggagaccaugcgccagcugaaggccguucucgacccgcaaggccugaugaaucccggaaaagugcuguga

SEQ ID NO: 71426 - RNA, 1038 nt, Artificial Sequence
  derived and/or modified sequence opt5 from LDLRAD3__Homo_sapiens__NP_777562
auguggcugcucggcccccugugccuucugcucagcuccgccgcugagucucagcugcuuccugggaacaauuucaccaacgaauguaauaucccgggaaacuuuaugugcagcaauggcagauguauucccggggccuggcaaugcgacggacugccugauuguuucgacaaguccgaugagaaagaaugccccaaggcgaaaucuaaguguggcccuacauuuuuccccugcgcuagcgggauccacuguauuaucggacgguuucgcugcaacggcuucgaggacuguccugauggcuccgacgaagagaauugcacggccaacccgcuccugugcucuaccgccagauaccauuguaaaaaugggcugugcauugauaagagcuuuaucugugacggacagaacaauugccaggauaacuccgacgaggaaagcugugagucuucccaggaacccggcagcgggcaaguguucgucacaucugagaaucagcucguuuauuacccuuccaucaccuaugcuauuaucggaagcucugugauuuuugugcuggucguggcccuucuggcucucguucugcaccaucagcggaagcgcaacaaucuuaugacacugcccgugcacagacuccagcauccuguccugcugucccggcucgugguucuggaucacccccaccauugcaacgugaccuacaacgucaauaacggcauccaauauguggccagccaggcggagcagaaugccuccgaaguggggucuccgccuagcuacuccgaggcccuucuggaccagcgccccgcuugguaugaucucccucccccucccuacagcucugacacagaaucccugaaccaagcugaccuuccgcccuacagaagccggucuggaagcgccaauuccgcgucuagccaggccgcuuccagccugcucucugucgaggauaccucccacagcccuggccagcccggcccucaagaagggacggccgagccccgcgacucugagccgucccagggaaccgaagagguuuga

SEQ ID NO: 71427 - RNA, 810 nt, Artificial Sequence
  derived and/or modified sequence opt5 from LDLRAD4__Homo_sapiens__NP_001003674
augagcuccgaccaccugaacaauucuacccucaaggaggcccaguucaaagaucuguuucuuaagaaagcugaacuggaguucgcccaaaucauuaucauuguggucguugugacagugauggucgugguuaucgugugccuccugaaccauuacaaggucagcacgagauccuuuauuaaucggcccaaccagucucgcagacgggaagacggccuuccucaggaggggugucuguggccgagcgauuccgcggcuccccgccucggagccucugaaaucaugcacgccccuagaagccgggaccgcuucaccgcucccuccuuuauccagagagaucgguucagccgcuuucaaccuacauaucccuacgugcagcaugagauugaccugccuccgaccaucucucuguccgauggcgaggaacccccucccuaucaggggccuugcacacuccagcugagagaccccgagcaacagauggaacuuaaucgggagagcguucgcgccccgccuaacagaaccauuuucgauucugaccugaucgauauugcuauguacuccggaggccccuguccucccagcucuaauuccgggaucagcgccuccacaugcucuagcaacggacggauggaggggcccccuccgaccuauuccgaagugaugggccaccaucccggcgcgagcuuucuccaccaccagcgcucuaaugcccauagaggaucccggcugcaguuccaacagaacaaugcugagagcacgauugucccuaucaaaggcaaggacagaaagcccgggaaccuuguguga

SEQ ID NO: 71428 - RNA, 2583 nt, Artificial Sequence
  derived and/or modified sequence opt5 from LDLR__Homo_sapiens__NP_000518
augggccccuggggguggaagcugagauggaccguggcccuccugcuugcugccgcgggaacagcugucggcgaccggugcgagcgcaacgaguuccagugucaagaugggaaaugcaucagcuacaaguggguuugugacggauccgccgaaugccaggauggcucugacgaaagccaggagacgugucuguccgugaccugcaaaucuggggauuuuagcuguggaggcagagugaaucggugcauuccucaguucuggcgcugugacggccaagucgauugcgacaacggguccgaugaacagggauguccgcccaagacaugcucucaggacgaguuuagaugccacgauggcaaauguaucagccggcaguucgugugcgacuccgaucgcgacugucucgacgggagcgaugaggccucuugcccuguucugaccuguggacccgcuuccuuucaaugcaauagcucuacauguauuccucagcuuugggccugcgacaacgaucccgacugugaagauggcuccgacgaguggccucagagaugccgggggcuguauguguuccagggagauagcucuccguguuccgcuuuugaguuccauugccucagcggcgaaugcauccacuccucuuggcgcugugacggcgggcccgauugcaaggacaagagcgaugaggaaaauugugccgucgcgaccugcagaccugacgaguuucaauguuccgacggaaacugcauucauggcagccggcagugugaucgcgaauacgacugcaaagauaugucugacgaggugggguguguuaaugugacacugugcgaaggacccaacaaguucaaaugucacuccggcgagugcaucacccuggauaaggucugcaauauggccagagacugucgggauuggagcgacgagccuaucaaagaaugcgggacgaacgagugucucgauaauaacggaggcugcucucauguguguaaugaccugaagauuggcuaugaaugccuuugucccgauggguuucagcugguggcucaacgcagaugcgaggacaucgaugaaugucaggacccggauaccugcagccagcucugugucaaccuggagggaggcuacaagugccagugcgaggaaggguuccaacuugacccucacacaaaagccuguaaggcuguuggauccauugccuaucuguuuuucaccaaucggcacgaggugagaaaaaugacacucgaccgcucugaauacaccagccugauccccaaccugcggaacguggucgcgcucgauacggagguggccuccaauagaauuuauuggagcgaccugucucagcgcaugaucugcuccacacagcuugaucgggcucauggcguuagcucuuacgacaccgugauuuccagagauauccaggccccugacgggcuggcugucgauuggauccacagcaacauuuacuggacagacuccgugcucggcaccguuucuguggccgauaccaagggagucaaacgcaagacacuguuccgggaaaauggcagcaaacccagagccaucguggucgaccccgugcauggguuuauguauuggacggauuggggaaccccugcuaagauuaagaaaggcgggcuuaacggaguugacaucuacucccuggugacagagaauauucaauggccgaacggcaucacccucgaccugcugucugggcgccucuauugggucgauagcaagcugcacuccaucagcucuauugacgugaauggcggaaaccggaaaacaauccuugaggaugaaaagagacuggcgcaccccuucucccucgccguuuuugaggacaaaguguucuggaccgauauuaucaaugaagcuauuuuuagcgccaaccgccugacgggcucugacgucaaucuucuggccgagaaccuccuguccccugaggauauggugcuguuccauaaucucacacagcccagaggggugaacuggugugaacggaccacccugagcaauggaggcugccaguaccuuugucugccugcuccccagaucaacccgcacucuccuaaguuuacaugcgccugucccgacgggaugcuccuggcgcgggauaugcgcagcugccugaccgaggcugaagccgccguugcuacacaagagacguccaccgucagacuuaaggugagcucuacagccgugcggacccagcauacaaccacgagaccuguccccgacaccucccgccucccuggagcuacacccggccugaccacaguggaaaucguuaccaugagccaccaggcccugggggauguggcgggccggggaaacgagaaaaagccguccucugucagagcccucagcauugugcugccuaucguucuucugguguuccucugucugggcgucuuucugcuuuggaaaaauuggcgccucaagaacauuaauuccaucaacuucgacaaucccguguaucagaaaacgacagaggacgaaguucauauuugccacaaccaagauggguacucuuaucccagcagacagauggugucccuggaggacgaugucgcuuga

SEQ ID NO: 71429 - RNA, 441 nt, Artificial Sequence
  derived and/or modified sequence opt5 from LDOC1__Homo_sapiens__NP_036449
augguggacgagcugguccuccugcuucacgcccugcucaugagacaucgggcucugagcaucgaaaacucccagcuuauggagcaacugcgccuccugguuugcgaaagagccucucugcuccgccaggugcggcccccuagcuguccggugcccuucccugagaccuuuaauggcgaauccucuagacugcccgaguucauuguccagacagcgagcuacaugcuugugaacgagaaucgguuuugcaacgaugcuaugaagguugccuuccugaucucccuccugacgggggaagccgaggaauggguggucccuuauauugagauggacucucccauccuuggagauuaccgcgcuuuucuggacgagaugaaacaguguuucggcugggaugacgaugaagacgaugacgaugaggaagaggaagacgauuauuga

SEQ ID NO: 71430 - RNA, 720 nt, Artificial Sequence
  derived and/or modified sequence opt5 from LDOC1L__Homo_sapiens__NP_115663
auggugcagccccaaaccagcaaggccgaguccccugcucuggccgcgucuccgaacgcucagauggacgaugucaucgacacacucacgagccugagacuuaccaauuccgcccugcggcgcgaagccucuacacucagagcugagaaagccaaccugaccaauaugcuugaaagcguuauggcugagcugacacuccugcggacccgcgcccggauucccggcgcgcugcagaucacaccucccauuuccucuaucaccagcaacgggacgagaccuaugaccacacccccuaccucccucccggaacccuucagcggagauccuggccgccuggccggguuucuuaugcagauggacagauucaugauuuuucaggcuucucgguuccccggagaggccgagcgcguggcuuuucugguguccagacucacaggcgaagccgagaagugggcgaucccucacaugcaacccgauagcccgcugcggaauaacuaccagggguuccuugccgaacugcgcagaaccuauaaaucuccucuccggcaugcucgcagagcccagauccggaagacguccgcuagcaauagagccguccgcgagcggcaaaugcugugcagacagcuggccucugcuggaacaggccccuguccugugcaccccgcguccaacggcaccagccccgccccugcucucccggcccgcgcccggaaucuguga

SEQ ID NO: 71431 - RNA, 234 nt, Artificial Sequence
  derived and/or modified sequence opt5 from LEAP2__Homo_sapiens__NP_443203
auguggcaccugaagcucugcgccgugcugaugaucuuccuucugcuccugggccagauugacgggagccccaucccugaggucuccucugcuaaaagacggccgcgcagaaugacccccuuuuggcggggaguuagccuucgcccuauuggcgccuccuguagagaugacucugaaugcaucacacggcugugucgcaagagacggugcagccucuccguggcgcaagaguga

SEQ ID NO: 71432 - RNA, 1002 nt, Artificial Sequence
  derived and/or modified sequence opt5 from LECT1__Homo_sapiens__NP_001011705
augaccgagaacagcgacaaggugcccaucgcccuggucggcccugaugacguugaguucugcuccccgcccgcuuacgccacacucacggugaaaccuucuagccccgcgagacugcuuaaggugggggcugucgugcugauuuccggagccguucuccugcuuuuuggcgccaucggggcuuucuauuuuuggaaaggaucugauagccacauuuacaaugugcauuauaccauguccaucaacggcaagcugcaggacgggucuauggaaauugaugccggaaauaaccucgaaacauucaaaaugggcagcggcgcugaggaagccaucgcggucaaugacuuucaaaacgggaucaccggcauucgguucgccggaggggagaaguguuacaucaaggcucaggugaaagcccgcauuccugagguuggagcugugacaaagcaguccaucagcucuaaacuggaaggcaagauuaugcccgucaaauaugaggaaaauucccugaucuggguggccguggaucagccugucaaggacaacagcuuucucucuuccaagguucuggagcuuugcggggaucugccgauuuucuggcucaaacccaccuacccuaaggagauccaaagagaacggcgcgagguggugagaaaaaucguccccacaaccacgaagcggccucacagcggaccccgcucuaauccgggcgcgggcagacugaacaaugaaacccggccuuccgugcaggaggacagccaggccuuuaaccccgauaauccuuaucaucaggaaggggaguccaugacauucgacccccgccuugaucacgagggaauuuguugcaucgaauguagacggucuuacacccauugccagaaaauuugugagccccugggcggguacuauccuuggccguacaacuaucaaggaugccgcagcgcuuguagaguuaucaugcccugcuccugguggguggcccggauucucggcauggucuga

SEQ ID NO: 71433 - RNA, 456 nt, Artificial Sequence
  derived and/or modified sequence opt5 from LECT2__Homo_sapiens__NP_002293
auguucagcaccaaggcccugcuccuggcuggacuuaucuccacagcccuggcggggcccugggcuaacauuugcgccggaaaaucuagcaaugagaucagaacgugugaccggcacggcugcgggcaguacuccgcccaacgcucucagagaccucaucagggaguggauauucucuguagcgcuggcuccaccgucuaugccccguuuacagggaugaucguuggacaggaaaagcccuaccaaaacaaaaaugcuauuaacaauggcgugcggaucucuggccgcggguucugcgugaagauguuuuauaucaaaccuauuaaguacaagggacccaucaaaaagggcgagaaacuggggacccuucugccucuccagaaggucuaucccggcauucagagccacgugcauaucgaaaacugugacuccagcgauccuacagccuaccuguga

SEQ ID NO: 71434 - RNA, 1116 nt, Artificial Sequence
  derived and/or modified sequence opt5 from LEF1__Homo_sapiens__NP_001124185
augccccagcugagcggcgggggaggcgggggaggcggggacccugagcucugcgccaccgaugaaaugaucccguucaaggacgagggagauccccaaaaagaaaagauuuuugcugagaucucccacccugaagaggagggcgaccuggccgauauuaaaucuagccuugugaacgaauccgagaucauucccgcgucuaauggccaugaagucgcuagacaggcccagacaagccaggagccuuaccacgacaaggcccgggagcaucccgaugacgggaaacacccugauggaggccuguauaacaaggggccguccuacucuagcuauuccggauacaucaugaugcccaauaugaacaaugacccuuauaugagcaacggcucucucuccccucccaucccccgcacgagcaauaagguuccgguggugcaaccuucucaugcuguccacccccugaccccucuuauuacauacuccgaugaacacuucagccccgggucucaucccucccacaucccuagcgacgugaacuccaaacagggaaugucuagacauccgcccgccccugauauucccaccuuuuauccucugagccccggcggcguugggcagaucacaccgccucucggaugguucucccaccacaugauucccggcccucccgggccucauaccacaggaaucccccacccggcuauugugaccccucaggucaagcaagagcauccccacacggacagcgaccugaugcaugugaaaccccagcacgaacagcggaaggagcaggaaccuaaacgcccgcacaucaagaagccccugaaugccuuuaugcucuacaugaaagagaugagagcgaacguuguggccgaguguacccugaaggaaucugcugccaucaaucaaauucuuggccggcgcuggcaugcucuguccagagaggaacaggccaaauacuaugagcucgcgcggaaggaacgccagcugcacaugcaacuuuacccuggguggagcgccagagauaacuauggcaaaaagaaaaagcggaagcgcgagaaacugcaggagucugcuagcggaacaggccccagaaugaccgccgcuuacaucuga

SEQ ID NO: 71435 - RNA, 1101 nt, Artificial Sequence
  derived and/or modified sequence opt5 from LEFTY1__Homo_sapiens__NP_066277
augcagccccuguggcucugcugggcccugugggugcuuccucuggcuagcccgggcgccgcgcucaccggggagcaacugcuuggaucccugcucagacagcugcagcugaaggaaguccccacacucgaccgggcugauauggaggaacugguuaucccuacgcacgugcgcgcccaguacguggcccuucugcaaagaucucauggcgaccggagccgcgggaaaagauucucccagucuuuucgggaggucgcuggacgcuuccucgcccuggaagcuagcacccaccuucugguguuuggcauggagcagagacugcccccuaacuccgagcucguucaggccgugcugcgccucuuccaagaacccgucccuaaggcggcccugcaucggcacgggagacuuucuccgcggagcgcucgcgccagagugacaguugaguggcugcgggugcgcgaugacggauccaauagaaccagccucauugauucucggcuggucuccgugcaugaaagcggcuggaaggcuuuugacgugacagaggccgucaacuucuggcagcagcuuucuagaccccgccagccucugcuccugcaaguuuccgugcagcgggagcaccugggcccccucgcgagcggggcccacaaacuggugagauuugcuucucagggagccccugcuggccuuggggaaccccaacuggagcuccauacccuggaucuuggagacuauggcgcccagggggauugugacccggaagccccuaugacagagggaacccgcugcugucggcaggaaauguacaucgaucugcagggcaugaaaugggcugagaauuggguccucgagcccccuggcuuccuggcguaugaaugcguggggacguguagacaaccucccgaggcccuggcuuuuaaguggcccuuccucggaccgcgccagugcauugccuccgaaaccgacagccugcccaugaucguuuccauuaaggagggcgggcggacaagaccucagguggucucucuucccaacaugcgcgugcagaaauguagcugcgccuccgauggagcucugguuccucggagacuccaacccuga

SEQ ID NO: 71436 - RNA, 999 nt, Artificial Sequence
  derived and/or modified sequence opt5 from LEFTY2__Homo_sapiens__NP_001165896
auguggccccuguggcucugcugggcccugugggugcuuccucuggcuggcccgggggccgcgcucaccgaggagcagcugcuuggaagccugcucagacaacugcagcuguccgagguccccguucucgaccgggcugauauggaaaagcuggugaucccugcccacgugcgcgcccaguacgucgugcuucugagacggucucauggcgaccgcagcagagggaaacgguucucccagucuuuucgcgagguugcuggaagauuccucgccagcgaagcugcccugcaccggcauggccgccuuucccccagaucugcgcaagcccgggugacagucgaguggcugcgcgugagagaugacgggagcaaccggacgucccucauugauagccgccugguuucugugcacgaguccggauggaaggcuuuugacgucaccgaagccgugaauuucuggcagcagcugagcagaccucggcagccccuccugcuucaagugucuguccagagagagcaucugggcccucucgcuuccggcgcccacaaacugguucgcuuugcgagccagggggccccggcuggacuuggcgaaccccagcuggagcuccacacacuggaucugcgggacuauggggcccaaggagauugugacccugaggcucccaugaccgaaggcacaagaugcugucgccaggagauguacaucgaucuccaggggaugaagugggccaaaaacugggugcuggaaccucccggauuccuugccuaugagugcgugggcaccugucaacagccgccugaagcucuggcguuuaauuggcccuuccucggcccucggcagugcauugccucugagacagcuucccugcccaugaucgucagcauuaaggaagggggaagaacccgcccccaggugguuucccuuccuaacaugcgggugcaaaaguguucuugcgccagcgacggcgcccuggucccgagacgccuccagcccuga

SEQ ID NO: 71437 - RNA, 2079 nt, Artificial Sequence
  derived and/or modified sequence opt5 from LEKR1__Homo_sapiens__NP_001004316
auggaccaccauauccccaugcacgcccugccugaggaaauucagaagaugcucccggaggaaaaagugugcaaguacuguggcgucagcuaucugauccuucaugaguucaaagcuauggaagagaagguuaaagccauggagaaggaaaugaaguuuuaccaaggguccguggauagagagaaacggcugcaggaaaagcuccacucucugagccaggagcuugagcaguauaaaauugacaacaaguccaaaaccgaacgcaucuacgaugugggaaugcaacugaagucucagcagaaugaguuccagaaggucaaaaagcaacucagccaucugcaggacgaacugaaaauuaaguauagacaguccuacaucuuuucucagcggcucagcgaguauaaauacuucuggaacaagacacugucccuucugacguuuaccaaacgcgaacucacaagcaucaagaaugagguguacgauaacuaucaaaauuggaccucucugaagggcgcgguuuuccuucagauuaaauccaucagcgagacagcucugaccgaaauugacauccucaacaagucucugacagugucccagagaaauaaagucugccuggagaaggaaaugaaaaaccucaagcugcuuagcgaugccgccauucugcggucucaacagauccgcaccuccagacagcaggaggugaaucuccaaacgcgguguuacgaccugcagaaggaaguucuugaucugcagugccucguggaggcucuggggcugaaacuccagaaggccgucaccgagauggacaacuauaaagaaaugcugaugaauaagagcaacgaggcugaugacugucaacgcgaacuuaaaaagcugaaguuugaguccauuaucucugaaagccagcacacaaugcuccugaaagagaaggaggauucccuuaugaccugccagcagaucuacaaagcccugcaagaagaacucacagugaaggaaaaacaggaggaggacauuaagagacggaucaaucuggcggaaaacgagcuggaaauuaccaagacgcuccugaaucagacacgcgaggaagugcuuacccugaaaaacgagagagagcucaugcugaucagccaccagaagucuauugaacaacugcaggagacacuucggcagaaacuccuguccgacgauaacuggaaggagaaaaucgaggccgaacuggcuaaggagcgcgcccaacaucucgucgaguucgaagaacaggcucugcuuuuuaaagaagagaccaagcugcagcucgacaucgaaaaggagaaacaccaggauguuauucaaaaguauaaaaaggagcaggaggagcugcagaugaaaaucagcgaccugauuaccggagccacaagagaucuucggcaggaagugacgacccucaaggagaagcugcauaaaucucacaucagauacacagaggaaagcaauuccaaggagaaagaaauugagaaccugaagaaucucguggcggaguucgaaucucgccugaaaaaggagaucgacagcaacgauuccgucagcgaaaaucuucggaaggagauggaacaaaaaucugacgagcugaagagagugaugcucgcccagacccagcugaucgaacaguuuaaccaaucccaggaggagaauacauuccugcaggaaaccguucgccgggagugugaagagagauuugaacuuacggaggcucucagccaagcccgcgagcagcugcuggaacucucuaaacugcggggcucccuucccuucagcccuugcucccugucuaaggggagccucacaucccccgcugccgccgugucuaaccacggagagagaagccuggcucgccuuaauuccgaaaaaggcauucagaucccuaaccugcggggcgucagcaagcccaccaccuucccuacaucugauaagccgaaaagagugcgcuccgggguucccauucucccucagccccauccuccccggggaggcgcgagcucugccaaugagaccagacaacggcuggcugccauccugcgcagacggagaucccagcaguga

SEQ ID NO: 71438 - RNA, 606 nt, Artificial Sequence
  derived and/or modified sequence opt5 from LEMD2__Homo_sapiens__NP_001137416
auggaggcccaggaauacaucgcuaacgugaccagcuccucuagcgccaaguucgaggcggcucugacauggauucucuccucuaauaaagacgucggcaucuggcugaagggggaagaucaaagcgagcuuguuacgaccguggacaaaguggucugccuggaauccgcccaccccagaaugggagugggcugucggcucucucgcgcccugcuuacagcuguuaccaacgugcugauuuucuucuggugccucgccuuucugugggggcugcucauccugcuuaaguauagauggcggaaacuggaggaggaggaacaggcuauguacgaaauggucaagaagauuaucgaugugguucaggaccauuauguggauugggagcaggacauggagcgcuacccuuaugucggaauccuccacgugagagauagccugauuccgccccaaucccggcgcagaaugaaacgggugugggaccgcgccgucgaauuucuugcgagcaaugagucuagaauccagacagaaucccaucggguugccggcgaggauaugcugguguggcgcuggaccaagccuagcucuuuuuccgacagcgaaagauga

SEQ ID NO: 71439 - RNA, 2736 nt, Artificial Sequence
  derived and/or modified sequence opt5 from LEMD3__Homo_sapiens__NP_055134
auggccgcugccgcggcuagcgcuccccagcaacuguccgacgaggaacucuucucucagcugagacgguacggccuuagcccugggccggugaccgaguccacacgccccgucuaucugaagaaacucaagaaacugagagaagaggaacagcagcaacaccggucuggaggccgcgggaacaagacgagaaauagcaacaauaacaauaccgccgccgccacaguugcugccgcgggaccugccgcugccgcugccgcgggcaugggggugcggcccguguccggagaucuuucuuaccugcgcaccccuggcggccucugcagaaucagcgccuccgggcccgagagccugcugggaggcccugggggagcuucugccgcuccggccgccggcuccaaaguccuccugggguuuagcucugacgaguccgauguggaagcuagcccccgggaccaggcgggaggcggcgggcgcaaggauagagccucucuucaguaucggggacugaaggcuccucccgccccucucgccgcuuccgagguuacaaacagcaauuccgccgaacgcagaaaaccccauucuugguggggcgcgcggcgcccggcugggccugagcugcagacacccccuggaaaggacggcgccguggaggaugaagagggggaaggagaggacggcgaagagagagaucccgagaccgaagaaccccuuugggccagccggaccgucaacggcuccagacuggugccuuacagcugucgcgaaaauuauucugacuccgaggaagaggaugacgaugacguugcuagcucucggcaagugcucaaagacgauagccuguccagacaccgcccgcggagaacgcauucuaagccccugccuccccucaccgccaaaagcgcugggggacgccuggagacauccguccagggcgggggaggccuugccaugaacgaccgggcggccgcugccgggagccuggauagaucucgcaaucucgaagaggcugccgcggccgaacagggcggaggcugcgaccagguggauuccagcccugugccccgguacagagucaacgcuaagaagcugaccccgcuucugccucccccucucacagacauggauucuacccuggacuccagcacggggucccugcucaaaacaaauaaccacauuggaggcggggccuucucuguugauagcccccgcaucuauuccaauucucugccucccagcgcugccguggccgcuuccagcucucuucggauuaaccaugcgaaccacaccggauccaaucacacauaccugaagaacaccuacaauaaaccgaagcucagcgagccugaagaggagcugcuucaacaguuuaaaagagaagaggugucucccaccggcuccuucagcgcccauuaucugucuauguuucuccugacagcugccugucuguucuuucucauccuggggcuuacguaccugggcaugcggggaaccggcgucagcgaagacggggagcucuccauugagaaccccuucggagaaacauuuggcaagauccaggagagcgaaaagacccugaugaugaauacacuguauaaacuucacgaucgccucgcccaacuggcuggggaccaugagugcggaucuuccagccagagaacccuguccgugcaggaagccgcggcuuaccucaaggaccugggcccugaguaugaggggaucuucaacacgucucuucaguggauucuggaaaauggcaaagauguuggaauccggugugugggcuuugggccggaggaggagcucacaaacauuaccgacguccaauuccugcagagcaccagaccccugauguccuuuuggugccgcuuccggagagccuucgugacaguuacccaccgccuucuccugcugugucucggaguggucauggugugcgucgugcugagauacaugaaguaucgguggacaaaagaagaggaggaaacgcgccagauguacgauaugguugugaagaucauugacguccuuagaucucacaaugaggccugucaggaaaacaaagaucugcaaccuuacaugcccaucccucaugugcgggacagccucauucagccccacgaucgcaagaagaugaaaaagguuugggacagagcuguggauuuucuggccgcgaaugagucccggguccgcaccgaaacaagacggaucggcggggcugacuuccugguguggcgcuggauccagccuucugccagcugcgauaaaauucuugugauccccuccaagguuuggcagggacaagccuuucaucucgacagacggaacagcccgccuaauucucugacccccugucugaaaauuagaaacauguucgauccugucauggagaucggcgaccaguggcaccucgcuauucaggaggccauccuggaaaagugcuccgacaaugaugggaucgugcauauugcuguggacaagaacagccgcgagggcugcgucuaugugaaaugucuuucucccgaauacgccggaaaggcguuuaaagcccugcacggcuccugguucgaugggaagcucguuacagugaaauaucugcggcuggacagauaccaccaucgcuuuccgcaggcucuuaccagcaacacgccucucaagcccucuaauaagcacaugaacuccaugagccaucugcggcugagaaccggacucacaaauucccaaggcagcucuuga

SEQ ID NO: 71440 - RNA, 1821 nt, Artificial Sequence
  derived and/or modified sequence opt5 from LEO1__Homo_sapiens__NP_001273359
auggccgacauggaggaucuguucggcagcgacgcugauuccgaagccgagagaaaggacucugauagcggguccgacucugauagcgaccaggaaaacgcggcuuccggaucuaaugccagcggcuccgagagcgaucaagacgaacgcggggauucuggacagcccuccaacaaagagcucuuuggcgacgauagcgaggacgaaggggccucucaccauuccggaagcgacaaucacucugagcgguccgauaacagaagcgaggcuuccgagcggucugaccaugaggauaaugacccuagcgauguggaccagcacuccggcagcgaagccccgaacgaugacgaggaugaaggccaucgcucugacgggggaucccaccacagcgaggcugaaggcucugagaaggcccauagcgaugacgagaaaugggggagagaagacaaguccgaucagucugacgaugagaaaauccaaaauagcgacgaugaagaacgggcgcagggauccgacgaagauaagcugcagaacagcgacgaugacgagaagaugcagaauaccgaugacgaggaacgcccccaacuuucugaugacgagagacagcagcuguccgaagaggaaaaagccaacagcgacgaugagcggccugucgcuucugacaaugaugacgagaagcagaacuccgaugacgaagaacaaccccagcucagcgaugaagagaaaaugcaaaauuccgacgaugagcgcccucaggccucugacgaggagcacagacauagcgaugacgaagaggaacaggaucacaaguccgagucugcucggggcagcgacuccgaggacgaaguucugcgcaugaaaagaaagaacgccauugcgagcgauucugaggccgacuccgauacagaagugcccaaggacaauagcgggacgauggaucuuuucggaggcgcugacgauaucucuuccggcagcgacggggaggauaaaccuccgacccccggacagccuguggacgaaaacggccugccccaggaucaacaggaggaggaaccuauucccgagacacggaucgaagucgagauuccgaaggugaacaccgaccucgggaaugaccuguacuuuguuaaacugccuaacuuccucucuguggaacccagcaugucccugcaccuuggaaaugaggucuuugauguguauaaggccccucugcagggcgaccauaaccaccucuucauccgccaggggacaggacugcaaggccaggcuguuuuuaaaaccaaacuuacauucagaccccauagcaccgauucugccacgcaccggaagaugacccugucccucgccgacagaugcagcaagacacagaagauccgcauucugcccauggcuggccgggauccugagugucagagaaccgaaaugaucaaaaaggaggaggaacgccugcgggcguccauuagacgcgagucucaacagcggagaaugcgcgaaaaacagcaucagcgggggcucagcgccuccuaccuggagccggacagauaugaugaagaggaagagggagaggaaucuaucagccuugcugccauuaagaaucgcuacaaaggcgggauccgggaggaaagagcccggauuuauuccucugacagcgaugagggauccgaagaggacaaggcucaacgccugcucaaggccaaaaagcugacaagcgaugaggaaggcgagcccucugggaaaagaaaggcggaagacgaugacaaagcuaacaagaagcacaaaaaguacgugaucuccgacgaggaagaggaggaugacgauuga

SEQ ID NO: 71441 - RNA, 504 nt, Artificial Sequence
  derived and/or modified sequence opt5 from LEP__Homo_sapiens__NP_000221
augcacuggggcacccugugcggguuccucuggcuguggcccuaccuguuuuaugugcaggccgucccuauccaaaagguucaggacgauacaaaaacgcuuauuaagaccaucgugacaagaauuaacgacaucagccauacccaguccgugucuagcaaacagaaggucacaggacucgauuucauuccgggccugcaccccauccuuacccuguccaaaauggaccaaacacucgcuguguaccagcagauccugaccucuaugccuagccggaauguuauucagaucuccaacgaucuggagaaucuccgcgaccugcuucaugugcuggccuuuucuaagagcugucaccuccccugggcguccgggcuggaaacgcuugauagccugggaggcguccucgaggcuucuggguauuccaccgaagugguugcccugagcagacugcaaggaucucuccaggacaugcuguggcagcuugaucuguccccuggcugcuga

SEQ ID NO: 71442 - RNA, 510 nt, Artificial Sequence
  derived and/or modified sequence opt5 from LEPROTL1__Homo_sapiens__NP_001121680
auggccggcaucaaggcucugauuagccucuccuucgggggagccaucggccugauguuucuuaugcuggggugcgcgcuccccauuuacaacaaauauuggccucuguucgugcuguuuuucuacauccuuucuccgauucccuauuguaucgcuagacggcucgucgacgauaccgacgccaugagcaaugccugcaaggagcuggcuaucuuucugacaacgggaauuguuguguccgccuucggccucccuaucguguuugcucgcgcccaccugauggggagacuucccuucuuuucuaaaaugggaaccgcggaaagcgagggccgggaaacacugacccagcaacucccucugcccgccgcugccaugcgcagacuucugccugcuucccgggucucuacacagccggugcuccgccuggccgauagcgcggagucccugcucggcagacccgcccugugggcucuuggguuccugcucuguccucccagccaggcccaguga

SEQ ID NO: 71443 - RNA, 2220 nt, Artificial Sequence
  derived and/or modified sequence opt5 from LETM1__Homo_sapiens__NP_036450
auggccagcauccugcucagauccugccggggccgcgcucccgccagacugccuccgcccccucgguacaccgugccccgcgggucuccuggagaccccgcgcaccuuagcugugcuuccacacugggccucagaaacugccugaaugucccuuucggguguugcacgccgauucaucccguuuauaccucuagccggggagaucaccuuggcuguugggcccugcgcccugagugccucagaaucgugucccgggcccccuggacaucuaccagcgugggguuugucgcugugggaccucagugucugcccguucgcggcuggcauuccagcagaccggugcgggacgauucugucguggaaaagucccugaaaagccucaaggacaaaaacaagaaacuggaggaaggcgggccuguuuacucucccccugccgagguggucgugaagaagucccuuggacaacgcgugcuggaugaacucaaacacuauuaccauggcuucagacugcuuuggauugacacaaagaucgcugcccggaugcuguggcgcauucucaaugggcacagccugaccagacgggagagacgccaguuucugcggaucugcgcggaucucuucagacugguccccuuucuuguuuucguggugguccccuuuauggaguuccugcucccuguggccguuaaacuguuuccgaacaugcuucccucuacauucgaaacccagucccugaaggaggaacgccucaaaaaggagcugcgggugaagcuggagcucgcuaaauuucugcaggacacgaucgaagagauggcccuuaagaauaaagcugccaagggaagcgcgaccaaagauuucuccgucuuuuuccaaaagauuagagaaacaggcgagcgcccuucuaacgaagagaucaugcgguucagcaaacuguuugaggacgaacucacccuggauaaucuuacaagaccccagcugguggcccucuguaagcugcuggagcuccaguccauugggaccaacaauuuccugcgcuuucagcuuacgaugcggcugagaagcaucaaggcugacgauaaacucauugccgaagagggaguugacucucugaacgugaaggaacugcaagcugccugccgcgcccggggcaugagagcucuuggcgucacagaggaccggcuccgcgggcagcugaaacaguggcuggaucuccaucugcaccaggagaucccuaccucccuucugauucucagcagagcgauguaucugcccgacacacugucuccggccgaucaacuuaagagcacccuccagacccugccugaaaucguggcuaaagaggcccaggucaagguggccgaaguugagggagaacaaguggacaauaaggcuaaacuggaggccacacuccaggaggaagcggcuauccagcaggagcaccgggaaaaggagcugcaaaagagauccgaggucgccaaggauuucgaacccgagcgcgugguugccgcuccucagcggcccggcacggaaccucagcccgagaugccggacaccgugcuucagucugaaacacugaaagauaccgccccuguccucgaggggcugaaggaggaagagauuacaaaggaagagaucgacauucugagcgaugcuuguuccaaacuucaagaacagaagaaaagccucaccaaggagaaagaggaacuggagcugcucaaggaagacgugcaggauuacucugaggaccugcaggaaaucaagaaagagcuuuccaagacgggagaggaaaaauauguggaggaaagcaaggccucuaaaagacugacaaagcgcguucaacagaugauuggccagaucgacgggcucaucucccagcuggagauggaucaacaggcgggaaaacuggcccccgcuaacggcaugcccaccggcgagaaugucauuagcguggccgaacuuaucaacgcuaugaaacaggugaagcauauuccugaguccaaacucaccucucuggccgcggcccuggacgaaaauaaggaugggaaagucaacaucgacgaucucgugaagguuauugagcugguggacaaagaagauguccacaucagcacaucccaaguggcugagaucguugccacccuugagaaggaagagaagguggaagagaaagaaaaggcuaaagagaaggccgagaaagaagucgccgaggugaagucuuga

SEQ ID NO: 71444 - RNA, 1122 nt, Artificial Sequence
  derived and/or modified sequence opt5 from LETMD1__Homo_sapiens__NP_001230618
auggcccugagcagagugugcugggcucgguccgccgucuggggcucugcgguuacccccgggcacuucgugacacgcagacuccagcugggacggagcggccuugcuuggggagccccucgcuccucuaagcugcaucucagcccgaaagccgacgugaagaaccugauguccuacgucgugacgaaaaccaaggcuaucaaugggaaauaucacagauuucuuggccggcauuucccccgcuuuuacguucuguauacaauuuucaugaaggggcuccaaaugcugugggccgaugcuaagaaagccagacggaucaagaccaacauguggaaacacaauauuaaguuucaucagcugccuuaccgcgagauggaacaccucagacaggugugggcgcggggacgcuaucccgagguccacggcgaguucagacaggacgugacaaaaugucuguuucuuggcaucauuucuaucccucccuucgccaacuaccugguuuuucuccugauguaucuuuucccucggcaacugcucauccgccauuuuuggaccccgaagcagcagacagauuuccuggacauuuaccacgcuuuuagaaagcagagccaucccgaaaucauuuccuaccuggaaaaagugaucccucucauuagcgaugccgggcugcgguggagacuuaccgaccugugcacgaagauccaacgcggaacccaccccgcuauucacgauauccucgcccugcgggaguguuucucuaaucauccucuuggcaugaaccagcugcaggcgcuccacgucaaagcccuguccagagcuaugcugcucacaagcuaucugcccccgccucuucugcgccaucggcucaagacccacacaaccgugauccaucagcuggacaaagcccuugcuaagcuggggauuggacaacucacggcccaggaggugaaaucugccugcuaccugagaggccucaauuccacacacaucggggaagaucgcugucggaccuggcugggagaguggcugcagauuagcugcucucuuaaggaagcugagcugucccuccugcugcacaacgucguucuucucagcacaaauuaucugggcaccagacgcuga

SEQ ID NO: 71445 - RNA, 507 nt, Artificial Sequence
  derived and/or modified sequence opt5 from LEUTX__Homo_sapiens__NP_001137304
augcaccccagccuggccaccaugggcaagcucgcuuccaaacugcagcuugaccugucuguggucaagaucugguucaaaaaccaaagagccaaguggaaacggcagcagcgccagcaaaugcagacaagaccuagccucgggccggcgaaucagacgaccuccguuaagaaggaggaaacacccucugcuauuaccacagccaacauccggccugugagccccggaauuuccgaugccaaugaccaugaucugcgcgagccuucuggcaucaaaaaccccgggggagcuagcgccuccgcuagagugagcucuugggacucccagagcuacgauauugaacaaaucugccuuggcgccucuaauccuccgugggcguccacccuguuugagaucgacgaguucgucaagauuuaugaucuccccggggaagacgauacaagcucucugaaccaguaccuguuuccugugugucucgaguaugaccagcugcaguccagcguuuga

SEQ ID NO: 71446 - RNA, 1140 nt, Artificial Sequence
  derived and/or modified sequence opt5 from LFNG__Homo_sapiens__NP_001035257
augcugaagagaugcggccggcgccuccugcuugcccuggcuggggcccuccuggcgugucuucuggugcucaccgcugaucccccuccgcccccucugcccgccgagagaggacggcgcgcccugagaagccucgcuggcccugccggggcugcccccgcgccuggacugggcgccgcugccgcugccccgggggcgcuuguccgggacguucacucccugucugaauacuucagccuccugacacgcgccagacgggacgcuggacccccucccggcgccgcuccucgccccgccgauggccauccgagaccucuugccgagccccuggcuccucgggacguguuuaucgcggugaaaacgaccaagaaauuccaccgcgccagacucgaucugcugcucgaaacauggauuucccggcauaaggagaugaccuuuaucuucacagacggggaagaugaggcucuggcccgccacaccggaaacgucgugauuacaaauugcucugccgcucauagcagacaggcccuuuccuguaaaauggcgguugaguaugaccgguuuaucgaaucuggcagaaagugguucugccacguggaugacgauaacuacgucaaucugcgcgcucuccugcggcuucuggccagcuauccccacaccagagacguguacguugggaagcccucccucgaucgcccuauucaagccauggagcgggugagcgaaaacaaagucagaccggugcauuuuugguucgcuacgggaggcgccggguuuuguaucucucgcggacuggcucugaagaugucccccugggccagcggcggccacuucaugaauaccgcggagcggaucagacucccugacgacugcacaauuggguauaucguggaggcccugcuuggagucccccugauucgcucuggccucuuucauucccaccuggaaaaccuucagcagguuccuaccagcgagcugcacgaacaggugacacucucuuacgggauguucgagaauaaacggaacgcugugcaugucaagggacccuuuuccguggaagccgauccgagcagauuccgcuccauccacugucaucuguauccugacacccccuggugcccucggacggcuauuuucuga

SEQ ID NO: 71447 - RNA, 1014 nt, Artificial Sequence
  derived and/or modified sequence opt5 from LGALS12__Homo_sapiens__NP_001136007
augagccagcccuccggcgggagagccccuggaacccggaucuacucuuggagcugcccgacagugaugucccccggcgagaagcuggacccuauucccgauucuuucauccuccaaccucccgucuuucacccuguugugccguaugugacgaccauuuucgggggacugcaugcuggcaaaauggucaugcuucagggggugguuccccuggacgcccacagccgcuuucagguggauuuccaguguggaugcucccucuguccuagacccgacaucgcguuucauuucaacccucgguuucacacaaccaagccccaugucauuugcaauacacugcacggcggccgcuggcaaagagaagcucgguggccgcaccuugcccugcgcagagggucuagcuuccucauccuguuucuguucggaaacgaggaagugaaaguuuccgugaauggccagcauuuucuccacuuccgguaccgccugccucuuagccaugucgauacccuggggaucuuuggagacauucucguggaggccgugggcuuccugaacaucaaucccuucgucgaagggucuagagaguauccugcuggacaccccuuucuucugaugagcccccggcucgagguuccuuguucccacgcccugccgcagggccugucucccggccaggugauuaucgugcgcgggcucguccugcaagaaccuaagcauuucacagugucccuuagagaucaggcugcccacgcgcccguuacccugcgggccagcuuugcugaccgcacgcucgccuggauuucuagauggggacagaaaaagcugaucuccgcuccuuuccuguuuuacccccagcgguucuuugaggugcuucuccuguuccaagaaggcgggcugaagcucgcccugaacggacagggccuuggggcgaccagcaugaaucagcaagcccuggagcagcucagagagcugcgcauuuccggaucuguccagcuuuauugcgugcauagcuga

SEQ ID NO: 71448 - RNA, 420 nt, Artificial Sequence
  derived and/or modified sequence opt5 from LGALS13__Homo_sapiens__NP_037400
augagcucccugcccgugccuuacaagcucccggucucucugagcguuggcuccugcgugaucauuaaagggacccccauccacucuuucauuaacgacccucagcuucaaguggauuuuuauacagacauggaugaggacagcgauaucgccuucagauuucggguccauuucggaaaucacgugguuaugaaccgcagagaauuuggcauuuggaugcuggaggaaacgaccgacuacgugcccuucgaggaugggaagcaguuugaacucuguaucuauguccauuacaaugaguaugagaucaaagugaacggcauucggaucuacggauucguucaccgcauuccucccuccuuugugaagaugguccaggugucuagagacaucagccugacauccgugugcgucuguaauuga

SEQ ID NO: 71449 - RNA, 420 nt, Artificial Sequence
  derived and/or modified sequence opt5 from LGALS14__Homo_sapiens__NP_064514
augagcucccugcccgugccuuacacccucccggucucucugcccguuggcagcugcgugaucauuacagggacgccuauccuuaccuucgugaaggacccccagcuggaggucaacuuuuauacaggaauggaugaagacuccgauauugccuuccaauuuagacuccacuucggccauccugcuaucaugaacucuuguguguuugggauuuggcgguacgaggaaaaaugcuauuaccugcccuucgaggacggaaagccuuuugaacuuuguaucuauguucgccacaaagaguacaaggugauggucaauggccagagaaucuauaauuucgcccaucgguuuccgcccgcgagcgugaaaaugcugcagguuuuccgcgauauuucccucaccagagugcugaucucugacuga

SEQ ID NO: 71450 - RNA, 429 nt, Artificial Sequence
  derived and/or modified sequence opt5 from LGALS16__Homo_sapiens__NP_001177370
augagcuuccugaccgugcccuacaagcucccugucucccugucuguuggcagcugcgugaucauuaaagggacacuuaucgacuccucuauuaacgagccgcagcugcaaguggauuuuuauacggaaaugaaugaggacagcgaaaucgccuuccaccucagaguccaucugggacggcgcgugguuaugaacuccagagaguuuggcauuuggaugcuugaagagaaucugcacuacgugcccuucgaggaugggaagccuuuugaccuccggaucuaugucugucauaacgaauacgaggugaaaguuaauggagaauauaucuacgcuuucgugcaccgcauucccccuucuuaugucaagaugauccagguguggagagaugugagccuggacuccguccugguuaacaauggccggcgcuga

SEQ ID NO: 71451 - RNA, 408 nt, Artificial Sequence
  derived and/or modified sequence opt5 from LGALS1__Homo_sapiens__NP_002296
auggccugcggccugguggcuagcaaccucaaucugaagcccggggagugucuuagaguccggggagaaguugccccugacgcgaaauccuucgugcugaaccucggcaaggauucuaauaaccugugccuucacuuuaauccgcgcuucaacgcucauggggacgccaauaccaucguguguaacagcaaagauggaggcgccugggggacagagcagagagaagcugucuuucccuuccaaccuggauccguggccgagguuugcauuacguuugaccaggcuaaucugaccgugaagcuccccgauggcuacgaguucaaauuuccuaaccggcugaaucuggaagccaucaacuauauggcggccgacggcgauuucaagauuaagugugucgcuuuugacuga

SEQ ID NO: 71452 - RNA, 399 nt, Artificial Sequence
  derived and/or modified sequence opt5 from LGALS2__Homo_sapiens__NP_006489
augaccggcgagcuggaagugaagaacauggacaugaaacccgggagcacacucaagaucacgggauccauugccgauggcaccgacggguucgucaucaaucugggacagggcacagauaaacuuaaccugcacuuuaauccuagauucucugagagcaccauuguuugcaacucccucgacgggucuaauuggggacaagaacagcgggaggaucaucuguguuuuagcccgggcuccgaagugaaguucacagugaccuuugagucugacaaauucaaggucaaacuucccgauggccacgagcugacauuuccuaaccgccucgggcauagccaccuguccuaccugagcgugagaggaggcuucaauaugucuuccuuuaagcucaaggaauga

SEQ ID NO: 71453 - RNA, 1758 nt, Artificial Sequence
  derived and/or modified sequence opt5 from LGALS3BP__Homo_sapiens__NP_005558
augacacccccuagacuguucuggguguggcuccuggucgccggcacccaggggguuaacgacggagauaugcggcuugcugacggcggggccacgaaucaaggacgcguggagaucuuuuacagaggccagugggggaccgugugcgauaaccugugggaccucacagaugcgagcgucgugugucgggcucugggauucgaaaaugccacccaggcccuuggccgcgcugccuuuggccagggguccggaccgauuaugcuggacgagguucaaugcacaggcaccgaggcuucucucgccgauuguaagagccugggguggcugaaauccaacugcagacacgaacgggacgcgggaguggucuguacaaaugaaacccgcucuacgcauacccucgaucugagcagagagcuuuccgaggcccugggccagaucuucgacucucagcgggggugcgaucucagcauuuccgugaacguucagggagaagacgcucugggcuuuuguggccacacagugauccuuaccgccaaucuggaggcucaagcccucuggaaggaacccgggagcaacgucacaaugucuguggaugcggagugcgugccuaugguccgcgaccugcugagauauuucuacucccggcgcauugacaucacccucagcucuguuaaauguuuucauaagcuggccuccgcuuauggagccagacagcuucagggcuacugcgcuagccuguucgccauccuccugccccaggauccuucuuuucaaaugccccuugaccuguaugccuacgcuguggcgacgggggaugcccuccuggagaaacugugucuccaguuccuggcuuggaauuuugaagcccuuacacaggccgaggcuuggccuuccgugccgaccgaccugcuccaacugcuucugccccggagcgaucucgccgucccuuccgaacuggcgcugcucaaggcuguggacacauggucuuggggagagcgcgccagccacgaagagguugagggccugguggaaaagauuagauuccccaugaugcuuccugaggaacuguuugagcuccaguucaaccugucccuguauuggagccaugaagcccuuuuccagaaaaagacccuccaggcucuggaguuucacaccguccccuuccaacugcucgcccgguacaaagggcugaaucuuacagaggauacguacaagccgagaaucuauaccucuccuacaugguccgcuuuugugaccgacagcucuuggagcgcccgcaaaucccagcugguuuaccagucucggagaggaccccucgugaaguauagcuccgauuacuuccaggcgccuagcgacuaucgcuacuaucccuaccaaucuuuucagacaccccagcacccuuccuuccuguuucaggauaagcgggucagcuggucucugguguaccuuccgaccauucaauccugcuggaacuauggcuucagcugcuccucugacgaacuccccguccugggccugacgaaaagcgggggauccgacagaacaaucgccuacgagaauaaggcucucaugcugugugaaggccuuuuuguggccgauguuaccgacuucgagggguggaaagcugccauuccuucugcgcuggauaccaacagcuccaagagcacaucuuccuuucccugcccugccggacauuucaauggcuuucgcaccgugauccggcccuucuaucucacaaacagcucuggggucgacuga

SEQ ID NO: 71454 - RNA, 603 nt, Artificial Sequence
  derived and/or modified sequence opt5 from LGALS3__Homo_sapiens__NP_001170859
auggccgacaacuucagccugcacgaugcucucuccggcucugggaaucccaacccucagggauggccgggcgccugggggaaucaacccgcgggagcuggcggguacccuggagccagcuaucccggcgccuacccuggccaggcucccccuggggccuauccgggacaggcucccccuggcgccuaccccggggcgccuggagccuaucccggcgcuccggccccugggguguaccccggaccucccuccggccccggcgcuuauccuucuagcgggcagccguccgccaccggagcguaccccgccacaggcccuuacggggcucccgccggaccucugaucguccccuauaaccuuccgcugccuggcgggguugugcccagaaugcucauuacgauccugggaaccgugaagccuaaugcuaaccggauugcccuugacuuucaacgcggcaaugaugucgccuuccauuuuaaccccagauucaaugagaacaaucggcgcgugaucguuugcacauacauguguaaaggcuuuauguucaccgugucugaaaacuuuuauauucaccaguacccuagcugcaaguccagcacauga

SEQ ID NO: 71455 - RNA, 972 nt, Artificial Sequence
  derived and/or modified sequence opt5 from LGALS4__Homo_sapiens__NP_006140
auggccuacgugcccgcuccuggcuaucagccgaccuacaaccccacacugccuuauuaccaacccaucccugggggacucaaugucggcaugagcguuuauauucaggggguggccuccgagcacaugaagagauucuuugugaacuucgucgugggacaggaccccggcucugauguugcguuucauuucaauccucgguuugacgggugggauaaaguggucuucaacacgcugcagggaggcaaguggggcagcgaagaacgcaaaagauccaugccguuuaagaaaggggcugccuucgaacuuguguuuaucguucuggccgagcacuacaagguggucgugaauggaaaccccuucuaugaauacggccaucggcucccucugcaaauggugacccaccuucaggucgacggggaucugcagcuccagucuauuaauuuuaucggaggccaaccccugcgcccucaggggcccccgaugaugccucccuacccuggacccggccauugccaccagcagcugaacagccuccccacaauggagggcccuccgaccuucaaucccccuguucccuauuuugggagacugcaaggaggccuuacagcucggcgcaccauuaucaucaagggguacgugccucccacaggaaaauccuucgccauuaacuucaaggugggcucuagcggggacaucgcucugcacauuaauccgagaaugggaaacggcaccgucgugcgcaauucccuccugaacggcagcugggggucugaggagaaaaagaucacgcauaauccuuuuggacccggccaguucuuugaucuuuccauucggugugggcuggacagauucaaaguuuaugccaacggacagcaccucuuugauuucgcgcaucggcugagcgccuuucaacgcguggacacccuggagauccagggcgaugucacacucucuuacgugcagauuuga

SEQ ID NO: 71456 - RNA, 411 nt, Artificial Sequence
  derived and/or modified sequence opt5 from LGALS7B__Homo_sapiens__NP_001035972
augagcaacgugccccacaaguccucucugccugagggcaucagaccggggaccguccuccggauucgcggacugguucccccuaaugccagcagauuccaugugaaccuucugugcggcgaggaacagggguccgacgcugcccuccacuuuaauccccggcuggauacaucugaaguggucuucaacagcaaagagcaaggauccuggggccgcgaagagagagggccuggagugcccuuucagcggggccagccuuucgagguucuuaucauugcgucugacgauggcuuuaaggcuguggucggggacgcccaguaccaucacuuccgccauagacugccgcucgcccgggugcgccugguugaagugggaggcgauguccaacuggacagcgugagaaucuuuuga

SEQ ID NO: 71457 - RNA, 1080 nt, Artificial Sequence
  derived and/or modified sequence opt5 from LGALS8__Homo_sapiens__NP_006490
augaugcugagccucaacaaucugcagaacaucauuuacaaucccgugaucccuuucgucggcaccauuccggaccaacuugaucccgggacacugaucguuauuagaggacacgugccuuccgacgccgaucgguuucagguggaccuccagaacggcucuagcaugaagccccgcgcugaugucgccuuccauuuuaauccuagauucaaacgggcggggugcaucguguguaacacgcugaucaaugagaaguggggacgcgaagagauuaccuaugacacacccuuuaaaagagaaaaguccuucgagaucguuauuauggugcuuaaagauaaguuucaggucgcugugaacggcaagcacacccugcucuacgggcaucggaucggaccugagaaaauugacacacugggcaucuauggcaagguuaauauucacucuaucggguucagcuuuuccucugaucugcaaagcacccaggccuccagccucgaacugacagagaucucucgcgaaaacgugccgaaauccggaacgccccagcuuccuagcaauagaggcggggacauuucuaagaucgcuccccggaccgucuacaccaaauccaaggauagcacagugaaccauacccugacaugcaccaagauuccucccaugaauuaugugucuaaacgccucccguucgccgccagacugaacacgccuaugggacccggccggacagucguugugaagggggaggugaaugcuaacgccaaauccuuuaacgucgaccuucuggcgggaaagagcaaagauaucgcccuccaccugaauccucgccugaacauuaaggcuuucgugagaaauuccuuucuccaggaaucuuggggcgaggaggaacggaacaucaccagcuuccccuucucccccggcauguacuuugagaugaucauuuauugugacguucgcgaguucaaaguggccgucaauggggugcacagccuggaauacaagcauagauuuaaggaacuuucuuccaucgacacacuggagauuaacggagauauccaccuccuggagguucggagcugguga

SEQ ID NO: 71458 - RNA, 972 nt, Artificial Sequence
  derived and/or modified sequence opt5 from LGALS9__Homo_sapiens__NP_002299
auggccuucagcggcucccaggcucccuaccugucuccugccgugccguuuagcgggaccauccaaggaggccuccaggacgggcugcagauuacagucaacggaacgguucuuuccucuagcggcaccagauucgcggugaauuuucagacaggguucuccggaaacgauaucgcuuuucacuucaauccccgguuugaggacggcggcuauguggucugcaacacccgccaaaaugggucuuggggaccugaagagagaaagacacauaugcccuuccagaaaggcaugccuuuugaucuguguuuccucgugcagagcuccgacuuuaagguuauggugaacgggauucuguucguccaguacuuucaccgggugcccuuccaucgcguugauaccaucagcgugaauggaucuguccaacuuuccuauauuagcuuccagccuccgggcguguggcccgccaacccugcccccaucacacagaccgugauccacacgguccagucugcuccugggcaaauguuuuccacccccgccauuccgccuaugauguacccccauccugcuuaucccaugcccuucaucacaaccauucugggaggccucuacccuagcaaaucuauccugcuguccggcacaguucucccgagcgcccagagauuucacauuaaucugugcuccgggaaccacaucgcguuccaucuuaauccccgguuugacgaaaacgccguggugcgcaauacccagauugauaacucuuggggaagcgaggaaagaucccugccucggaagaugcccuucguccgcggccagagcuuuucuguguggauccucugugaggcucacugccugaaaguugccguggacgggcaacaucuuuucgaguauuaccacagacugcggaaucucccuacgaucaaccgccuggaagucggaggcgauauucagcugacacacgugcagaccuga

SEQ ID NO: 71459 - RNA, 519 nt, Artificial Sequence
  derived and/or modified sequence opt5 from LGALSL__Homo_sapiens__NP_054900
auggccggcagcguggcugacuccgaugccgucguuaagcuggacgaugggcaccucaacaauucucugagcucccccgugcaggcggacguguacuucccuagacuuaucgucccguuuugcggacauauuaagggcgggaugcggcccggaaagaaagugcugguuaugggcaucguggaucucaacccugagucuuucgcuauuagccugaccuguggggacuccgaagaucccccugccgacgucgccaucgagcuuaaggcuguguuuacagaucgccaacugcucagaaauucuugcauuagcggagaacggggcgaggaacaguccgccauccccuauuucccuuuuaucccggaccagcccuuccgcguugagauucugugugagcacccuagauuucggguguucgucgauggccaucagcuguuugacuucuaccaccgcauccaaacgcucagcgcuauugauaccaucaaaauuaacggggaccugcagaucacaaaacuuggauga

SEQ ID NO: 71460 - RNA, 1674 nt, Artificial Sequence
  derived and/or modified sequence opt5 from LGI1__Homo_sapiens__NP_005088
auggagagcgaaagauccaagcggaugggcaacgccugcaucccccugaaacgcauugcuuacuuccucugucugcuuucugcccugcuccugaccgaggggaagaaaccugcgaagccgaaaugccccgcuguguguacaugcacgaaggacaaugcccuuugugaaaacgccagaagcaucccucggaccguucccccugaugucauuucccugucuuuugugcgcagcggauucacagagaucuccgaaggcucuuuucucuucacccccagccugcagcugcuccuguuuacauccaauagcuucgacgugauuucugaugacgcuuuuaucgggcuuccucaccuggaguaucucuucaucgagaacaauaacauuaaguccaucagcagacauaccuuucggggacugaaaucucuuauucaccugucccucgccaauaacaaucugcaaacacugccgaaggauaucuucaaaggccucgacagccugaccaacgucgaucuucgcggcaauucuuuuaacugcgacuguaagcugaaauggcucguggaauggcugggacauacgaaugcuaccguugaggauauuuacugcgaagggcccccugaguauaagaagagaaaaaucaacucccuuagcuccaaggacuucgauuguauuaucacagaguuugccaaaucucaggaccugcccuaccagagccucuccaucgauaccuucagcuaucugaaugacgaauacguggucauugcgcagccuuucacaggcaagugcaucuuucuggagugggaccacguggagaaaaccuuccggaacuaugauaacauuacggggacaucuaccguuguguguaagcccaucgucauugaaacacaacucuacgugaucguggcccagcuguuuggaggcucccauaucuacaaacgcgacagcuucgcuaauaaguuuauuaagauccaggauauugaaauccuuaaaauuagaaagccgaacgacaucgagaccuucaaaaucgagaauaacugguauuuugucguugccgauucuagcaaggcuggguucaccacaauuuacaaauggaauggaaacggcuuuuauucccaccagucucugcacgccugguaccgggacacggauguggaauaucucgagaucgugcgcaccccucaaacacugagaacaccccaucuuauucugagcuccagcucucagcggccugucaucuaccaguggaauaaggcgacccaacucuucaccaaccagacggacauucccaauauggaagauguguaugccguuaagcacuuuuccgugaaaggggacgucuacaucugccugacacgcuucauuggagauagcaaggugaugaaauggggcgggucuuccuuucaggacauccagagaaugcccagccggggcuccaugguuuuccaaccucugcagaucaacaauuaccaguaugcuauucucggaucugacuacagcuucacccagguguauaacugggaugccgagaaggcuaaauuugucaaguuccaagaacugaaugugcaggccccgagauccuuuacccaugucucuaucaacaagcgcaauuuccuuuuugccagcuccuucaaaggcaacacacagauuuacaagcacgugaucguugaccugagcgcuuga

SEQ ID NO: 71461 - RNA, 1638 nt, Artificial Sequence
  derived and/or modified sequence opt5 from LGI2__Homo_sapiens__NP_060646
auggcccugagacggggcgggugcggagcucucggccugcuucugcuccugcuuggggccgcgugucugaucccccgcagcgcucaggugagacggcucgcccgcugcccugccaccuguuccugcacaaaggagucuauuaucugugucggaagcuccuggguuccgagaauugugcccggcgacaucucuagccugucccuggugaacgggacguucucugaaauuaaagaucggauguuuagccaccucccuucccugcaacuucugcuccugaauagcaacucuuucaccaucauccgcgacgaugcuuuugccggacuuuuccaucuggaguaccucuuuauugaaggcaauaagaucgagacaauuuccagaaacgcuuuccggggccugcgcgaccugacccaccucagccuggccaauaaccauaucaaagcgcuucccagagaugucuuuucugaccuggauucccucauugaacuggaccuucgggggaauaaguucgagugcgauuguaaagccaaguggcuguaucucuggcugaagaugacaaacagcaccgugucugacguucugugcaucggaccucccgaguaccaggagaaaaagcucaaugaugugacauccuuugacuaugaauguaccacgaccgauuucgucgugcaccagacacugccuuaccagagcguuuccguggacaccuuuaacucuaaaaaugacgucuauguggcuauugcccaaccgagcauggaaaacugcauggugcuugagugggaucauaucgagaugaauuuccgcuccuacgacaacaucacaggccagagcauugucggguguaaggcuauccugauugaugaccagguuuuugugguggucgcccagcucuuuggaggcucucacaucuauaaauacgaugaauccuggaccaaguucgugaaguuucaagacauugagguuagcagaaucucuaaacccaaugauaucgaacuguuccagauugacgaugagacguuuuucgugaucgcggacagcuccaaggccgggcuuucuacagucuacaaauggaacagcaagggauuuuauuccuaccagagccugcacgaaugguuccgggauaccgacgcugaguuuguggacauugauggcaaaucucaucucauccuguccagccgcucucagguuccuauuauccugcaauggaacaaguccagcaaaaaguucgugccccacggcgacaucccuaauauggaggauguccucgccgugaaguccuuuagaaugcagaacacacuguaucuuucucugacccgguucauuggggacagcagagucaugcgcuggaacuccaaacaguuuguggaaauccaagcucuccccucucggggagccaugacccugcagccguucagcuuuaaggauaaucauuaccuggcccuuggcuccgacuauacauucagccagauuuaccagugggauaaagagaagcaacucuucaaaaaguuuaaggaaaucuauguucaggcuccuagaucuuucacggcgguguccaccgaccgccgggauuucuucuuugccagcucuuucaaagggaagacaaaaauuuuugagcacaucauugucgaccugucccuguga

SEQ ID NO: 71462 - RNA, 1614 nt, Artificial Sequence
  derived and/or modified sequence opt5 from LGI4__Homo_sapiens__NP_644813
augggcggggccggaauccugcuccugcuucuggcuggcgccgggguggucguugcguggagacccccuaagggaaaaugcccgcuccgguguagcugcuccaaggacucugcucugugugagggcagccccgaucuuccuguguccuucucucccacccugcucagccugucccuggugcgcacaggggucacgcagcucaaagccggaucuuuucugcggauuccuagccuucaccuccugcuguucaccuccaacagcuuuucugugaucgaagacgaugccuucgcuggccuuucccaucugcaauaccucuuuauugaggacaaugaaaucggcagcauuucuaagaacgcccugagagggcugcgcucccucacacaccugagccuugcuaauaaccaucuggagacccuccccagauuccuguuucggggacuugauacacugacccacguugaccuccgcggcaauccuuuccagugcgauuguagagugcuguggcugcuccaguggaugccgacagucaacgccucuguggggaccggagcgugcgccggccccgcuucccugagccauaugcagcuucaccaccuggacccuaaaacguuuaagugucgggccaucgaacucuccugguuccaaaccguuggggagucugcucugagcguggagcccuuuuccuaucagggagaaccucauaucguccuugcccagcccuucgcgggccgcugccugauucucagcugggauuacucucugcagagauuucggccggaggaggaacugccugccgcuuccguggugagcuguaagccccucguccugggcccuucucuuuucguucuggccgcucgccucuggggcggaagccaacugugggccagacccucccccggccugcggcuugccccuacacagacccucgcuccgcgcagacugcugcggcccaaugacgcggagcuccuguggcuugaagggcagccuugcuucgugguggccgaugcuucuaaagccggaagcacaacccugcucuguagagacggccccggguuuuauccucaccagucccugcaugccuggcaccgcgauacggacgcugaggcccuggaacuugacggacggccccaccuccugcuggcgagcgcuucucaaagaccgguccucuuccauuggacaggcggccgcuuugagcggagaaccgauaucccugaagccgaggacguguacgccacacgccacuuccaggcugggggagauguuuuucugugccuuacccgguauauuggcgacuccauggugaugagaugggaugggagcauguuccgccugcuccagcaacugcccucucggggagcccaugucuuucagccucugcuuaucgcuagagaccagcucgccauucugggcuccgauuucgcguuuagccaggugcugcgccucgagcccgacaaggggcugcuugaaccucugcaagagcucgggcccccggcccugguugcuccucgggccuucgcucacaucaccauggccggaagacgguuucuguucgcggccugcuuuaaaggccccacacagauuuaccagcaucacgaaaucgaucuuuccgcuuga

SEQ ID NO: 71463 - RNA, 1302 nt, Artificial Sequence
  derived and/or modified sequence opt5 from LGMN__Homo_sapiens__NP_005597
augguguggaaggucgccguuuuccugagcguggcucucggcaucggggccgugcccauugacgauccugaggacggaggcaaacacugggucgugaucguugcgggguccaacggaugguacaauuauagacaucaggcugaugccugccacgccuaccaaauuauccaucggaacggcauuccggacgaacagaucguggucaugauguaugaugacaucgcuuacucugaggauaaucccaccccugggauugugaucaaccgccccaauggaacagacguuuaucagggcgugccuaaggauuacacgggcgaagacgucacaccccagaacuuucuggccgugcuuagaggggaugcugaggccgugaaaggaauuggcagcgggaagguccugaaauccggaccucaagaccacguuuucaucuauuuuaccgaucauggcucuaccgggauucucguguucccgaaugaagaccugcacgugaaggaccuuaacgagacaauccacuacauguacaagcauaaaauguaucggaagauggucuuuuacauugaggcgugugaaagcggauccaugaugaaucaucugcccgauaacaucaauguguaugccaccacagcugccaacccucgcgagucuagcuacgcuugcuauuacgacgagaaaagauccaccuaucucggcgauugguacagcguuaauuggauggaggacucugauguggaggaccugacgaaggaaacccugcacaaacaguaccaccucgucaagucccacacaaacaccagccaugugaugcaguauggcaauaagacaaucucuaccaugaaaguuaugcaguuccaagggaugaagcggaaagccuccagccccgugccucugcccccggucacgcaccuugaucugacaccuucucccgacgugccucucaccauuaugaagcgcaaacugaugaacacaaacgaucuugaggaauccagacagcugaccgaggaaauccagcggcaucucgacgcgcgccaccugauugaaaagagcgucagaaaaaucgugucccugcucgccgcuucugaggccgaaguugagcagcugcuuagcgaacgggcuccccugaccggacauuccuguuaccccgaggcccuccugcacuuucgcacacacugcuucaauuggcauagcccuacguaugaauacgcccuuagacaccuguaugugcucgucaaccugugugagaagccguacccccugcaucggauuaagcucucuauggaucacgugugccugggccacuauuga

SEQ ID NO: 71464 - RNA, 2856 nt, Artificial Sequence
  derived and/or modified sequence opt5 from LGR4__Homo_sapiens__NP_060960
augcccggcccucuggggcuccugugcuuccuugcccugggacuccugggcagcgcugggccguccggagccgcgcccccucuuugugcugcccccugcucuugugacggcgauagacggguggacugcagcgggaagggacugaccgccgucccugagggccucuccgcuuuuacacaggcccuggauaucucuaugaacaauauuacgcaacugcccgaagacgcuuucaaaaacuuuccuuuccucgaggaacugcagcuugccggcaaugaucugagcuuuauccacccgaaggcgcucuccgggcugaaagagcuuaagguucugacccuccagaacaaucagcugaaaacagugcccucugaagccauucgcggacugagcgcucuccaaucccugagacuugacgccaaccauaucaccagcgugccugaggauucuuucgagggccugguccagcuccggcaccuguggcuugacgauaauucccugacagaagugcccguucauccucucagcaaccugcccacccugcaggcucucacacuggcccuuaauaagauuucuuccaucccggacuuugcguucaccaaccugagcucucucgugguccugcaccuucauaauaacaagauccgcucccugagccagcacuguuuugaugggcucgacaaucuggagacgcuggaucucaacuacaauaaccugggagaauuuccucaagccauuaaagcccuucccucccugaaggagcucggcuuucacucuaacagcaucuccgugauuccugacggggcuuucgacggaaauccccugcugagaaccauccaucuuuaugauaacccccucagcuuuguuggcaauucugcuuuccacaaccuguccgaccugcauagccucgugauucggggcgccucuaugguccagcaguucccuaaucugacagggaccgugcaccuugagagccugacacucaccggaacgaaaaucuccucuauuccgaacaaucugugccaggaacaaaagaugcugcgcacacuugaucucagcuacaacaauaucagagaccugcccuccuuuaacggcugucacgcccuggaggaaaucagccuccagcggaaucagauuuaucaaaucaaagaggggaccuuccagggacugauuucucuucgcauccuggaucucuccagaaaccugauucaugaaauccacagccgggcuuuugcgacacugggcccuaucaccaaucuugacgugucuuucaacgagcucaccuccuuucccacagaggggcugaauggacugaaccagcucaagcuggucggcaacuucaagcugaaagaagcccuggcugccaaggauuuuguuaaucuccgcagccuguccgugccuuacgccuaucagugcugugcuuucuggggcugcgacucuuacgccaaccugaauacggaggauaacagccuucaagaccauuccguggcgcaggaaaaagggaccgcugaugccgccaaugucacaucuacccucgagaacgaggagcacagccagauuaucauucauuguacacccuccaccggagcuuuuaagccgugcgaguaucugcugggcagcuggaugaucagacucacggugugguucauuuuucugguugcccuuuucuuuaaucugcucgugauccugacaaccuucgcuucuugcaccucccugccuagcucuaaacuuuucaucgggcugauuuccgucagcaaccucuuuaugggaaucuacacaggcauucugaccuuccucgacgccgugucuugggggcgguuugcggaguucggcaucuggugggaaacaggaagcggcuguaagguugccggguuucuggcuguguucuccagcgaaucugccauuuuucuucugaugcucgcuacggucgagcgcucccugagcgccaaagacaucaugaagaauggaaaguccaaccaccugaaacaguucagaguggcggcccuucuggcuuuucucggcgccaccgucgcugggugcuucccccuguuucaccggggagaauacucugccagcccucucugucugcccuucccuacaggcgagacccccucccuuggguuuacagugacccugguucuccuuaauucucuggccuuccuucugauggcugugauuuauacgaagcucuacugcaaccuggagaaagaagaucucagcgaaaauucccaaucuagcaugaucaagcaugucgcguggcugaucuucaccaacuguauuuucuucugcccgguggccuuuuucuccuuugcuccucuuaucacagccauuagcaucucucccgaaauuaugaaauccguuacccugaucuucuuuccccugccugccugucucaauccggugcuguaugucuucuuuaaccccaaguucaaggaggacuggaaacuucugaagagacgcgugaccaaaaagagcggcucuguguccguuagcaucucuucccagggaggcugccucgagcaggauuuuuacuaugacugugggauguacagccaucugcagggaaaccucacagucugcgauuguugcgaauccuuccugcuuacgaaaccugugagcugcaagcaccugauuaagucucacagcugucccgcucuggccguggcguccugccaacggccugagggcuauuggucugacugugggacacagagcgcucacuccgauuacgccgacgaagaggauucuuucgucagcgacuccucugaucaggugcaggccugcggcagagcuuguuuuuaccaaagccgcggauucccccucguucgguaugccuacaaucugccuagagugaaagacuga

SEQ ID NO: 71465 - RNA, 2652 nt, Artificial Sequence
  derived and/or modified sequence opt5 from LGR5__Homo_sapiens__NP_001264155
auggacaccagcagacugggcgugcuccugucccuucccguccugcuccagcuggccacagggggaucuagcccucgguccggcguucuucugcgcgggugcccgacgcacugucauugcgagcccgauggaagaaugcuccugcggguggacuguucugaucugggccucagcgaacugccuuccaaccuuucuguguucaccagcuaccuggaccucuccaugaauaacaucagccaacugcuucccaauccucugcccucucuccgcuuucuggaggaacugagacucgcugggaacgcccugacauauauuccuaagggagcguucaccggccuuuacucccugaaaguccucaugcugcagaauaaccagcuucggcacgugccgacagaggcucugcagaaucuccgcagccugcaaucucugagacucgaugccaaccauaucuccuauguucccccuagcugcuuuucuggccugcacucccuucggcaucuguggcucgacgauaaugcccugaccgaaauucccgugcaggcuuuccgcagccuuuccgcccugcaggcuaugacacucgcccugaacaagauccaccacauuccugacuacgcguuugggaaucugucuagccucgucgugcugcaucuucacaacaauagaauccauucccugggcaaaaaguguuucgauggacuccacagccuggagacccuggaccuuaacuauaauaaccucgaugaguuucccacggccauccggacccugucuaaccugaaagaacuccacuucuacgacaauccgauucaguuuguugggcgcuccgcuuuccaacaucugccugagcuuagaacacugacccucaacggagccagccagaucacagaauuucccgaucugaccggcacggcuaaucuggagucucuuacacucaccggggcccagauuagcucccugccucagacagugugcaaccaacugcccaaucuccagguccuggaccuuucuuauaaccugcucgaggaccugcccagcuucuccgugugucagaagcugcaaaagaucgaucuucggcacaaugaaauuuacgagaucaaaguggacaccuuucagcagcuccugagccugcgcucucucaaccuggcguggaauaagauugccaucauccauccuaacgcuuucuccacccuuccgagccugauuaaacucgaucugucuuccaaucugcuuagcuccuuccccaucacaggacuccacggccugacgcaucugaagcucaccggcaaccacgcccugcagucucuuauuagcuccgaaaauuuuccugagcugaaagucaucgaaaugcccuacgcuuaucaaugcugugccuucgggguuugcgagaacgccuacaagauuucuaaucaguggaacaagggagacaacagcuccauggaugaccuccacaaaaaggaugcuggcauguuucaggcgcaggacgagagagaucuggaagacuuccugcuugauuuugaggaagaccugaaagcccuccauagcgugcaauguucuccuucccccgggccguucaagccuugcgagcaccuucucgacggauggcugauccggaucggcguguggacaauugcuguccuugcccugaccugcaaugcccucgugacaagcaccguuuuuagaucuccccuguauaucuccccuauuaaacugcuuaucggggugauugcugccgucaacaugcugacgggagugagcucugcgguucucgcuggcguggaugccuucacauuuggcagcuucgcccgccauggggcuuggugggaaaauggagucggcugucacgugaucggguuucuguccaucuucgccagcgagucuuccgucuuucuccugacccuugcugcccuggagcggggauucagcgugaaguacuccgcgaaauucgaaaccaaggcccccuuuucuagccucaagguuauuauccugcugugcgcucugcuggcccucacaauggcugccgugccucugcucggcggguccaaauauggcgcgucuccccugugucuuccgcugccuuucggagagcccagcaccaugggcuacauggucgcccugauucuccugaacucccuuugcuuucugaugaugacaaucgcuuauacgaagcucuacuguaaucuggacaaaggggaucucgaaaacauuugggacugcucuauggugaagcacaucgcccugcuucuguucaccaauuguauucugaacugccccguugcuuuucucagcuucuccagccugaucaaucuuacauuuaucucuccugaggugauuaaauucauccugcucgucguggugccgcugcccgccugucucaacccucugcuuuacauucuguuuaauccccauuucaaggaagaucugguuucccucagaaagcagaccuaugucuggacacgcagcaaacacccuucucugauguccaucaacagcgacgauguggagaagcagucuugcgacuccacccaggcccuugugacguuuaccagcuccagcauuacauacgaucugcccccuucuagcguccccuccccggcuuauccugugaccgagucuugucaucucagcuccguugcguucgugcccugccuguga

SEQ ID NO: 71466 - RNA, 2904 nt, Artificial Sequence
  derived and/or modified sequence opt5 from LGR6__Homo_sapiens__NP_001017403
augcccagcccuccgggccugagagcccucuggcugugcgcugcccuuugugcgucccggcgcgcugggggagcuccccagccuggccccgggccuacagccugccccgcuccuugucacugccaagaggacggaaucaugcugucugccgauuguagcgaacucggccuguccgcugugccgggggaccuugauccccugacagccuaccucgaccugucuaugaacaaucugacggagcuccagccuggacuguuccaucaccuuagauuucuggaggaacuccggcugagcggcaaccaucuuucccacauucccggccaggcguucucugggcuguauagccucaagauccugaugcugcagaauaaccaacucggaggcauuccugccgaagcucugugggagcuucccucccugcagagccuccgccuggaugccaaucuuaucucucuggucccggagagauccuuugaagggcucagcucucugcggcaucuguggcucgacgauaacgcucugaccgagauuccuguucgcgcccuuaauaaccugcccgcgcuccaggccaugacacuggcucuuaauagaaucucccacaucccugacuacgccuuccagaaccugaccagccucguggugcugcaucugcacaauaaccggauucaacaccucggaacacauucuuuugaaggccugcacaaucuugagacccuggaucucaacuauaauaaacugcaggaguuccccgucgcuauccgcacacuggggagacuucaggaacucggauuucacaacaacaauauuaaggccauccccgagaaagccuucaugggcaacccucugcugcagaccauucauuuuuacgacaauccgauccaauucgugggccgguccgcuuuucaguaucuccccaagcugcacacgcuuagccugaacggggcgauggauauucaggaguucccugaccucaaaggaaccacaucccuggaaauccugacccuuacacgcgccggcaucagacuccugcccucugggaugugccaacagcugccucggcuccgcguucuggaacuuagccauaaucagauugaggagcugcccucccuccacagaugucagaagcuggaagagaucggacugcaacauaaccggauuugggaaaucggcgcugauaccuuuagccagcuuucuucccuccaggcccuggaccugagcuggaaugccauuagaucuauccacccggaggcuuucagcacgcuccacucccuggugaagcuggaccugacagauaaccagcucaccacacugccucuggccgggcuuggaggccucaugcaucugaaacugaagggcaaucucgcgcugucucaagccuucagcaaagacuccuuucccaaacuucgcauccuggaagucccuuacgccuaucagugcugucccuacgggaugugcgccagcuucuuuaaggcuucuggacagugggaggccgaggaucuccaccuggacgaugaagaguccagcaagcggccucugggccuucuggcuagacaggccgaaaaccauuacgaccaagaucucgacgagcugcagcucgaaauggaggauucuaagccccacccguccgugcaguguagcccuacccccgggcccuucaaaccuugcgaguaucuguuugaauccuggggcauucgccuugcgguuugggccaucgugcugcucucuguccugugcaauggacuggugcuucugaccguguucgcugggggcccggucccccucccucccguuaaguuuguggugggagccauugcuggcgccaacacacugacggggaucagcuguggacuccuggcguccgucgacgcccuuaccuucggccaguuuucugaguacggggcucggugggaaacaggacugggcugcagagccaccggguuccucgcugugcugggcagcgaggccuccguucugcuucugacacucgccgcugugcaauguagcgucucuguguccugcguucgcgcguauggaaaaagcccuucucugggcuccgugcgggccgggguccucggaugucuggcucuugccggccuggccgcugcccugccccucgcgagcgugggggaguacggagcuucuccucugugccuucccuaugccccgccugaaggccagcccgccgcucugggguuuaccgucgcccucgugaugaugaauagcuucuguuuucugguuguggcgggcgcuuacauuaagcucuauugcgaucugccuagaggagacuucgaggccgucugggacugugccauggugcgccacguugcuuggcuuaucuucgccgauggccugcuguacugccccguggcuuuucucuccuucgccagcaugcuggggcuuuuuccggucacgccugaagcggugaaaucugugcugcucguuguccugccccucccugccugucugaacccccuucuguaccuucucuucaauccccauuuucgggacgaucugagacgccuucggccuagagcuggagacuccggcccgcuggccuaugcugccgccggggagcucgaaaagagcuccugcgauucuacacaggcucugguggcguucagcgacguggaucucauccuggaggccuccgaggcuggacggcccccuggccuugaaaccuacggguuucccucugucacccugauuagcugccaacagccuggcgcuccccgccuggagggaucccacuguguggaaccugagggcaaccauuucgggaacccgcagcccucuauggacggagaacuccugcuuagagccgagggcagcaccccugccgggggaggccuguccggcgggggaggcuuucagcccagcgggcucgccuucgcgucucacguuuga

SEQ ID NO: 71467 - RNA, 627 nt, Artificial Sequence
  derived and/or modified sequence opt5 from LGSN__Homo_sapiens__NP_001137412
augaacaaugaggaagaccugcuccaggaggauagcaccagagacgaaggcaacgagacagaagccaauuccaugaacacgcugcggcgcaccagaaagaaagugacaaagcccuacgucugcucuaccgagguuggggagacagauaugagcaauuccaacgacuguaugcgggauucuagccaaauccuuaccccuccgcagcuguccucucgcaugaaacacauuagacaggcuauggccaagaaucggcuccaguucgugcgcuuugaagcgacagaccugcauggagugagcagauccaaaaccauccccgcucacuucuuucaagagaaggucagccauggcgugugcaugccucggggguaucuugaaguuauucccaacccuaaggauaaugagaugaacaauauccgcgccacguguuucaacucugacauugugcugaugcccgagcucuccaccuuuagaguccugccuugggccgaucggacagcucgcgugaucugcgacaccuucacaguuaccgugagcggaaugucuaucggcagaaaaacguguuccgccgcucugcucgaacugucuagcucccggagccuugggaagaauggauggcaggauuccuga

SEQ ID NO: 71468 - RNA, 426 nt, Artificial Sequence
  derived and/or modified sequence opt5 from LHB__Homo_sapiens__NP_000885
auggagaugcugcagggccuccugcuucugcuccugcuuagcaugggaggggccugggcuuccagagaaccccugcggccuuggugccacccgaucaacgccauucucgcgguggagaaggaaggcugucccgucugcaucaccguuaauacaacgauuugugcuggguacugcccuaccaugaugcgcgugcugcaagccgugcugcccccucucccccaggucguguguacauauagagacguucgguucgagucuauccgccugccuggaugcccgagaggcguggaucccgucgugagcuuuccuguugcccuuuccugucggugcgggcccugucgcagaucuaccagcgacugcggaggcccuaaagaucauccccugacaugugaccacccgcagcucuccggccugcuuuuccuguga

SEQ ID NO: 71469 - RNA, 2100 nt, Artificial Sequence
  derived and/or modified sequence opt5 from LHCGR__Homo_sapiens__NP_000224
augaagcagagauucagcgcccugcaacuccugaaacuucugcuccugcuucagcccccucugccgcgggcucuccgcgaggcccugugccccgaaccuuguaacugcgugcccgacggcgcgcugagauguccugggcccaccgcuggacucacacggcugucccuugccuaccugccugucaagguuaucccgucucaggccuuucgcggccucaaugaggugauuaaaaucgaaauuagccagaucgauucccuggagagaauugaagcuaacgccuucgacaaucuucugaaccucucugagauccugauccaaaauacgaagaaccugcgguauauugagcccggggcuuuuaucaaucucccucgccugaaauaccuuagcauuugcaacaccggaaucagaaaguuccccgaugugacaaaggucuuuuccucugaaagcaauuucauucuggagaucugugacaaccuccacauuaccacaaucccuggcaaugccuuucaggggaugaacaaugaauccgugacccugaaacuuuauggaaacggcuucgaggagguucagagccaugcguuuaauggcacaacccugacgucucucgaacugaaggagaacgugcaccuggaaaagaugcauaacggggccuuccggggagcuaccggccccaagacacucgauaucuccagcaccaaacugcaggcccuuccgucuuacgggcuggaguccauucaacgccucaucgcuacaagcucuuauucccugaagaaacuuccuagcagagaaaccuuugucaaucugcucgaggccacgcugacauaccccucccacugcugugcguuccggaaccugccuaccaaagagcagaauuuuucucauagcauuuccgaaaacuucagcaagcagugcgagucuacagugcgcaaaguuaauaacaagacccucuauuccagcaugcuggccgaaucugagcuuagcggaugggacuacgaauacggcuucugucugcccaaaacccccagaugcgcuccugagccggaugccuuuaaucccugugaggacaucaugggguaugauuuccuccgggugcugauuuggcugaucaacauccuugcuauuaugggaaauaugacaguccucuuugugcugcugacgucccgcuacaagcucaccgugccuagauuccugaugugcaaccuuucuuuugccgacuucugcaugggccuguaucuccugcugaucgccagcgucgauucccagacaaaaggccaauacuauaaucacgcuauugacuggcagaccgggagcggauguucuacagcgggcuuuuucaccguuuuugccuccgaacuuagcguguacacgcucacagugaucacccuggagcgguggcacaccauuacauaugcuauccaucuggaucagaagcucagacugcgccacgccauccuuauuaugcucgggggauggcuguucucuucccugaucgccaugcugccccuugucggcgugagcaacuacaugaagguuuccauuugcuuuccuauggacguggaaaccacacucucucaagucuacauccugacgauucugauccucaaugugguugcuuucuuuauuaucugugccugcuauaucaaaauuuacuucgcggugcggaaccccgagcugauggcuaccaauaaggacacaaaaaucgccaagaaaauggccauucuuaucuucaccgauuuuacauguauggcuccgauuagcuucuuugccaucuccgcugccuucaaggucccucugaucaccgugacgaacucuaagguccuccuggugcuguuuuaucccauuaacagcugcgcgaauccuuuccuuuacgccaucuuuaccaaaacauuccagagagacuuuuuccuccugcuguccaaguuuggguguugcaaacgccgggcugaacucuauagacgcaaggauuucagcgccuacaccucuaacuguaaaaauggauuuacaggcuccaacaagcccagccagucuacccugaaacuuuccacgcugcauugccagggcacagcucuccuggacaagacccgguauacagaguguuga

SEQ ID NO: 71470 - RNA, 603 nt, Artificial Sequence
  derived and/or modified sequence opt5 from LHFP__Homo_sapiens__XP_011533163
auggccagcucccugaccugcacaggcgugaucugggcucuccugucuuuccuuugugccgcgacgagcugcgucggguuuuucaugcccuacuggcuguggggaucccagcucggcaagccuguuucuuuugggaccuucagacgguguagcuauccggugcacgacgagucccgccaaaugauggugauggucgaagagugcggaagauacgcuucuuuucagggcauucccagcgccgaauggcggaucuguacaauugugaccgggcugggaugcggccuucugcuccugguugcccugacagcucucaugggcuguugcguguccgaucugaucagccgcaccgucgggagaguggccggaggcauucaguuccuugggggacugcucaucggcgcugggugugcccuguauccucuuggaugggacucugaggaaguucggcagacaugcggcuacaccuccggccaauuugaucuggggaaaugugagaucggaugggcguauuacugcacgggcgccggggcuaccgccgcuaugcuccugugcacauggcuggccuguuucagcggaaagaaacagaagcauuaucccuacuga

SEQ ID NO: 71471 - RNA, 732 nt, Artificial Sequence
  derived and/or modified sequence opt5 from LHFPL1__Homo_sapiens__XP_011529245
auggugaccuacugcaucugguguugcgaccccacacaucugccuauuccggccgagaagcccgucacgaugagaagcucccucaccaugguuggcacacugugggcuuuccuuucucuggugaccgccgugacaagcuccaccucuuauuuucucccuuacuggcuguucgggagccagaugggaaaacccgucuccuuuucuacauuccggcgcuguaacuauccugugagaggcgaagggcacagccuuaucaugguugaggaaugcggacgguacgcguccuuuaaugcuauucccagccuggccuggcaaauguguaccguggucacgggcgccgggugcgcucuccugcugcucguggcccuggcugccguucuuggauguugcauggaggaacugaucucucgcaugaugggcagauguaugggcgcggcccaguucgucgggggacuccugauuuccagcggcugcgcucuuuauccucugggguggaacucuccggagaucaugcagaccuguggaaauguguccaaccaguuucaacucggcacaugccggcuggggugggccuacuauugcgcuggaggcggcgccgcggccgcuaugcugaucuguaccuggcucagcugcuucgccgggcgcaaucccaagccugugauucugguggagucuaucaugagaaacacaaauuccuacgcuauggaacuugaucacugucugaaacccuga

SEQ ID NO: 71472 - RNA, 687 nt, Artificial Sequence
  derived and/or modified sequence opt5 from LHFPL2__Homo_sapiens__NP_005770
augugccacgugaucgucaccuguagaagcaugcuguggacacuccuguccauuguuguggccuucgcugagcuuaucgccuuuaugucugcggacuggcugauuggcaaggcucggagccgcgggggaguggaacccgccggcccugggggaggcuccccggagcccuaccauccuacgcucgggaucuaugccagaugcauucggaaccccggaguccagcacuuccaacgcgauacccuguguggcccuuacgcugaaucuuuuggcgagaucgccagcggguucuggcaggcuacagccaucuuucuugcggugggaauuuucauccugugcaugguugcccucguguccgucuuuaccaugugugugcagucuauuaugaaaaagagcaucuucaauguuugcggccugcugcaggggauugcuggacucuuucugauccuuggccugauucucuaucccgccggguggggaugucaaaaagcuaucgacuacugcggccauuaugccuccgcguacaagccuggcgauuguagccuggggugggccuucuauacagcuaucggaggcaccgugcuuacauuuauuugcgccgucuucucugcucaggccgaaaucgccaccuccagcgacaaagugcaggaggagauugaagaggggaagaaccugaucugucuccuguga

SEQ ID NO: 71473 - RNA, 711 nt, Artificial Sequence
  derived and/or modified sequence opt5 from LHFPL3__Homo_sapiens__NP_945351
augcccggcgccgcugccgcggcugccgccgcugccgcugccaugcugccugcgcaggaggccgcuaagcucuaccacaccaacuaugugagaaauagccgggccaucgggguccugugggcuauuuucacaaucugcuuugccauuguuaacgugguguguuucauccaaccguacuggauuggagacggcgucgauacgccccaggcgggguauuuuggacuuuuccauuacugcaucggcaauggguuuucccgcgaacugaccuguagaggaucuuucacagacuuuagcacccucccuuccggcgccuucaaagcugccagcuuuuucaucggccugucuaugaugcuuauuaucgcuugcauuaucuguuuuacacuguucuuuuucugcaacaccgccacaguguauaagauuugugccuggaugcagcucaccuccgcugcgugccugguucugggguguaugaucuuccccgauggaugggacucugaugaggugaaacggaugugcggcgaaaagacggacaaauacacccucggggccuguagcguccgcugggcuuauauucuggccaucaucggcauucuugaugcccugauccucuccuuucuggcuuucgugcuuggaaauagacaggacagccugauggccgaggaacucaaggcggagaacaagguucugcugucucaauacucccucgaguga

SEQ ID NO: 71474 - RNA, 744 nt, Artificial Sequence
  derived and/or modified sequence opt5 from LHFPL4__Homo_sapiens__XP_011531995
augcugcccagccaggaggccuccaagcucuaccacgaacauuauaugagaaacucucgggcuaucggcgugcugugggccauuuucaccaucugcuuugcgauuaucaaugucguuguguucauucaaccuuacugggugggggacagcgucuccacaccgaaacccggauauuuuggccuuuuccacuacuguguggggucuggacuggcuggccgcgagcucacgugcagagggagcuuuaccgauuucuccacaaucccuucuagcgccuuuaaggccgcugccuucuuuguucugcuuuccauggugcugauccucggauguauuaccugcuucagccuguuuuucuuuuguaacacagcuaccgucuauaaaaucugcgccuggaugcagcugcucgcggcccugugucuugugcugggcugcaugauuuuccccgacggcugggaugcugaaacaauccgggacauguguggggccaagaccggaaaauacucucucggcgauugcuccguucgcugggcuuauauucuggccaucauugggauccuuaaugcgcugauccucagcuuccuggccuuugugcugggaaacagacagacggaccuccugcaggaggaacuuaagccugagaauaaggauuucgucggcucuaccguguccagcgugcugcggcccgggggagacgucucuggcuggggcguucucccuuguccgguggcucauucccaagggcccuga

SEQ ID NO: 71475 - RNA, 660 nt, Artificial Sequence
  derived and/or modified sequence opt5 from LHFPL5__Homo_sapiens__NP_872354
auggugaagcugcuccccgcccaggaggcugccaaaaucuaccacaccaacuaugucagaaauagccgggcgguuggcgugaugugggggacacugacgauuugcuucuccgugcuugucauggcucuguuuauccaaccuuacuggauuggagacucugugaacaccccgcaggccggcuauuucgggcucuuuagcuacuguguuggaaaugugcuguccucugaacuuaucugcaagggcgggccccuggauuucagcuccauuccuucucgcgccuuuaaaacagcuauguucuuugucgcccucggaauguuccugaucaucggcagcauuaucuguuuuucccuguucuuuauuugcaacaccgcuacaguguauaagaucugugccuggaugcagcucgcggccgcuaccggccugaugauugggugccuuguuuaccccgacggaugggauagcucugaggugagacggauguguggcgaacagacagggaaauauacccugggacauugcacgauccgcugggccuucaugcucgcuauucuguccaucggcgacgcccuuauccugagcuuucucgcguucguccugggguacagacaagauaagcugcucccugacgauuacaaggccgacggaaccgaggaaguguga

SEQ ID NO: 71476 - RNA, 633 nt, Artificial Sequence
  derived and/or modified sequence opt5 from LHPP__Homo_sapiens__NP_001161352
auggcccccuggggcaagagacuggcuggggugcggggaguccuccuggacaucagcggcguucuuuacgauuccggggccggaggcgggaccgcgauugcuggaucuguggaggccguggcccgccugaaaagaagccggcucaagguccgcuucugcacaaacgaaucccagaaaucuagagcugagcuggugggccaacuucagcggcugggcuuugacaucagcgaacaggagguuacggccccugcuccggccgcgugucagauucucaaggaacaagggcugcgccccuaucugcucauccacgauggagugagauccgaguucgaccagauugauaccucuaauccuaacugcgucgugaucgccgacgcuggcgagagcuuuuccuaccagaauaugaacaaugccuuccagguucugauggaacuugagaaacccgugcugaucagccucgggaagggacgguauuacaaggaaacaucuggccugaugcuugaugucgggccuuauaugaaagcucuggaguacgccuguggaauuaaggcggagguggugggcaaacccuccccugaauuuuucaagagcgcccuccaagcuaucggcgucgaggcccaucaggcucaguga

SEQ ID NO: 71477 - RNA, 1221 nt, Artificial Sequence
  derived and/or modified sequence opt5 from LHX1__Homo_sapiens__XP_011545112
auggugcacugcgccggcuguaagagacccauccuggaccgguuccuccugaacguccuugaucgcgcuuggcauguuaaaugcgugcaguguugcgaguguaagugcaaucugaccgaaaaauguuuuagcagagaggggaagcucuacugcaaaaacgacuucuuucgguguuucggaacaaagugcgccggcugugcgcaagggauuuccccuucugaucuggugcgcagagcucggagcaaggucuuucaccuuaauugcuucacgugcaugauguguaacaaacagcuguccaccggagaggagcucuauaucauugacgaaaauaaguuugugugcaaagaggauuaccugucuaacagcuccguugccaaggaaaauucucugcauagcgccacaaccggcuccgacccgagccucucucccgauucccaggacccuagccaggaugacgcuaaagauucugaauccgccaacgugagcgacaaggaggcugggucuaaugaaaacgaugaccaaaaucugggagccaagcgcagaggcccccggacaaccaucaaagcgaagcagcuugagacacugaaagccgcuuucgccgcuaccccuaagcccacgcgccacauuagagagcagcucgcccaggaaaccggccugaacaugcgggucauccaagugugguuucagaaucgcagauccaaagagcggcgcaugaagcagcuuagcgcgcugggggccagacggcaugcuuucuuuagauccccucgccggaugagaccgcucguugaccgccuggaacccggagagcugaucccuaacggccccuucucuuuuuauggggauuaccagagcgaauauuacggaccuggcgggaauuaugacuucuucccccaaggaccgccuuccagccaggcccagacacccguggaucucccuuuuguccccucuuccggccccagcggcaccccucuugggggacuggagcacccgcugcccggccaccauccuucuagcgaggcucaacgguucacagacauucucgcccaucccccuggggauucccccucuccggaaccuagccugcccggaccucuucacuccaugagcgccgagguguuuggccccucuccucccuucuccagccugucugugaacgggggagcuuccuacggcaaccaccucagccacccgccugaaaugaaugaggcggccgucugguga

SEQ ID NO: 71478 - RNA, 1221 nt, Artificial Sequence
  derived and/or modified sequence opt5 from LHX2__Homo_sapiens__NP_004780
augcuguuccacagccucuccggccccgaggugcauggggucaucgacgaaauggauagacgggccaagucugaggcuccugccauuagcuccgcgaucgaccgcggagauaccgaaacaacgaugccgucuauuagcuccgacagagcugcccugugcgccggcugugggggaaaaaucucugaucgguacuaucuucuggcuguugacaagcaguggcacaugcgcugccucaaauguugcgaguguaagcugaaccuugaaagcgagcugaccugcuuuuccaaagauggcagcauuuacuguaaggaggacuauuacagacgguucucugugcaacgcugcgccagaugucaucucgggaucuccgcuagcgaaauggugaugcgggcccgcgaucuggucuaucaccugaauugcuuuacauguaccacaugcaacaagaugcucaccacaggagaccauuucggcaugaaagauucucugguguacugcagacuucacuuugaggcgcugcuccagggcgaauaucccgcccacuucaaucaugcugacguugccgcugccgcggccgcugccgcugccgccaaguccgcugggcugggagcggccggcgcuaacccucuugggcugcccuacuacaauggagugggcaccguccagaaagggcggccucgcaagagaaaaagccccggaccuggcgccgaucucgccgcuuauaacgccgcgcugucuuguaaugagaacgacgcugagcaccuggaccgggaucagccguaccccuccagccaaaagacgaagcgcaugagaaccuccuuuaaacaucaccagcuccggacaaugaagucuuauuucgccaucaaucacaacccugacgccaaagaucugaagcagcuugcucagaaaaccggccugacaaagagagugcuccaaguuugguuucagaaugcccgcgcuaaauuccggagaaaccugcuucgccaggaaaauaccgggguggacaagagcacggaugccgcgcugcagacaggaacccccuccggcccugccagcgagcucucuaacgcuucccugagccccucuagcacaccgaccacccugacagaccucacguccccuacccugcccacagucaccucugugcuuacaagcgugccugggaaucuggaaggacaugagccccacucccccagccaaaccacgcucacaaaccuguuuuga

SEQ ID NO: 71479 - RNA, 1209 nt, Artificial Sequence
  derived and/or modified sequence opt5 from LHX3__Homo_sapiens__NP_055379
auggaggccagaggcgaacuggggcccgcucgggagagcgccggaggcgaccuccugcuugcgcugcucgcucgcagagccgaucugcggcgcgaaaucccucuuugcgccgggugugaccagcacauucuggauagauucauccucaaggcucuggaccggcauuggcacuccaaaugccugaaguguucugauugccauaccccgcucgccgagcgcuguuuuagcagaggagaauccguguacugcaaagacgauuucuuuaagcgguucggcacaaaaugugcugccugccaacuggggauucccccuacgcaggucguucgcagagcgcaggacuuuguguaucaccuucauuguuucgccugcguggucuguaagcggcagcuggcuaccggagaugaguuuuaccucauggaggacucucgccuggugugcaaggccgauuaugaaacagcuaaacaaagagaggccgaagcgaccgccaagcggccccgcacaaccaucacagcuaaacagcuugagacccucaagagcgccuacaacacguccccuaaacccgcuagacacguucgggagcagcugucuagcgaaaccggccuggacaugagagugguccaggugugguuccaaaaucgccgggccaaggagaagagacugaaaaaggaugccggccgccagcggugggggcaguauuuuagaaacaugaaacgcucccggggaggcagcaagucugacaaagacuccguucaggaagggcaagauagcgacgcugaggugucuuucccugaugaaccgucccucgcggagaugggacccgccaauggccuguacgggagccuuggagagccuacacaggcucugggcagacccucuggcgcccucgggaacuuuucccuggaacacggaggccuugccgggccugagcaguaucgcgaacugcggcccggaagcccguacggcgucccucccuccccugcugcgccccaaucucuccccgggccucagccgcugcugagcucccucguguaccccgacaccagccugggacuugugccuucuggcgcccccggcgggccucccccgaugagaguccuggcuggaaauggcccuuccagcgaucucucuacagggagcuccggaggcuaucccgacuucccugccucucccgccagcuggcuggaugagguugaccaugcucaguuuuga

SEQ ID NO: 71480 - RNA, 1173 nt, Artificial Sequence
  derived and/or modified sequence opt5 from LHX4__Homo_sapiens__NP_203129
augaugcagagcgccaccgugcccgcugagggcgccgucaaggggcugccugaaaugcucggaguuccgaugcaacagaucccccagugcgcgggcuguaaccagcacauucuggacaaauucauccuuaaggugcuggauagacauuggcacuccucuugccucaaaugugcugacugccaaaugcagcuggccgaucgguguuuuagccgcgccggguccguguacugcaaggaggacuucuuuaaaagauucggaacaaaguguacggcuugccagcagggcauuccucccacccaagucgugcggaaggcccaggauuuuguuuaucaucuucacuguuucgcuugcaucauuuguaaucgccagcuggccacaggggacgaauuuuaccucauggaggauggaagacuggugugcaaagaagacuaugagaccgcgaagcagaacgaugacucugaggccggcgcuaaacggccucgcacaaccaucacagccaagcaacuggaaacccucaaaaaugcuuacaagaacagccccaagccugccagacauguccgggagcagcuguccucugaaacgggccuugauaugcgcgugguucaggugugguuccaaaauagacgggcgaaagagaagcgccugaaaaaggacgccgggagacaccgguggggacaguuuuauaaaagcgucaagcgcuccagaggcagcucuaaacaggagaaggaauccagcgcugaggauugcggggugucugacuccgaacucagcuuccgggaggaccagauccugucugaacuuggacacaccaacagaauuuacggcaaugugggggaugucacaggaggccaacugaugaacggcuccuuuagcauggacgggaccggacaguccuaucaggaucuccgcgacggcucuccguacgggaucccccagagcccuuccagcauuucuucccugcccagccaugccccucugcucaauggacuggauuacacaguugacucuaaccuuggcaucauugcucacgccgggcaaggagugagccagacccugcgggccauggcuggcggccccacguccgauaucucuacagggagcuccgugggauauccggacuucccuaccagccccggcucuuggcucgaugagauggaccauccucccuuuuga

SEQ ID NO: 71481 - RNA, 1209 nt, Artificial Sequence
  derived and/or modified sequence opt5 from LHX5__Homo_sapiens__NP_071758
augauggugcacugcgccggcugugagagacccauccuggaccgguuccuccugaacguccuugaucgcgcuuggcauauuaagugcguucaguguugcgaauguaaaaccaaucugagcgagaagugcuuuuccagagaagggaaacucuacuguaagaacgacuucuuucggcgcuucggaacaaaaugcgccggcugugcgcaagggaucucuccuagcgaucuggugagaaaggcucgguccaagguguuucaccuuaauugcuucacguguauggucugcaacaaacagcugucuaccggagaggaacucuaugugauugacgagaauaaguuuguuugcaaagaugacuaccugagcuccucuagccugaaggagggcucccucaacagcgugucuuccuguacagaucgcagccugucuccggaccuucaggaugcccugcaggacgaucccaaagaaaccgacaauuccacaagcucugauaaggagaccgccaacaaugaaaacgaggagcaaaauuccgggacaaagagacggggaccucgcaccacgaucaaagcuaagcagcucgaaacccugaaagccgcuuucgccgcgacacccaagccuaccagacauauucgggagcagcuugcccaggaaacaggccugaacaugcgcgucauccaagugugguuucagaauagacggagcaaagagcgcagaaugaagcagcucuccgcucugggcgcccggagacacgcuuucuuucgcucuccccggagaaugcgcccucucgggggacggcuggacgaaagcgagaugcugggcuccaccccguauacguacuauggggacuaccagggagauuauuacgcccccggcagcaacuacgacuucuuugcgcaugggccucccucucaagcccaguccccugcugauagcucuuuccuugccgcuagcggacccggcuccacaccgcugggcgcccucgagccuccccuggccgggccucacgcugcggacaaucccagauucaccgauaugaucucucaccccgacacaccuagcccggaacccggacuuccuggcacccugcaucccaugccuggggagguguuuuccggaggccccagcccgccuuuccccaugucugggaccuccggauauagcggcccucucucucaccccaacccugaacugaacgaggccgcuguuugguga

SEQ ID NO: 71482 - RNA, 1101 nt, Artificial Sequence
  derived and/or modified sequence opt5 from LHX6__Homo_sapiens__NP_001229262
augagacggggccugugccgcagaagcgccgagaaccccgacgcugggccugugauggcccagccgggauccggcuguaaggcgaccacacggugccucgaagggacggcucccccugccauggcccaaucugaugcugaggcccuggcuggagcccuugacaaagaugaaggccaggcgagccccuguaccccuuccacacccucugucugcagcccuccguccgccgcuucuagcguucccuccgccgggaagaauaucuguagcucuugcggacuggagauucucgaccgcuaccugcuuaaagugaacaaucugaucuggcacgugagaugucucgaaugcuccgucugucggaccagccugcgccagcagaacucuugcuauauuaagaauaaagagaucuucuguaagauggauuacuuuuccagauucggcacaaagugcgcucggugcggccgccaaauuuaugccagcgacugggugagacgggcgcgcgggaacgccuaccaccuggcuuguuuugccugcuucucuuguaaaagacagcucuccaccggagaggaauuuggccugguugaggaaaaggugcuuugccggauccacuaugauacaaugaucgagaaucugaaacgcgcugccgagaacgggaauggacucacccuggaaggcgccgucccuagcgagcaggacucccagcccaagccugcuaaaagagcgcggacgucuuucaccgccgaacaacuucaggugaugcaggcucaguuugcccaagauaacaaucccgacgcccagacacugcagaagcucgcugauaugaccgggcugagcagacgcguuauucaagugugguuccagaacugucgggccagacauaagaaacacacaccgcagcauccugugcccccuuccggagcgccucccagccgccugcccucugcucucuccgacgauauccacuacaccccguuuagcucucccgagcgggccagaauggucacgcugcacggcuauauugaaagccauccuuucuccgugcuuacacugcccgcccucccucaucugcccgucggcgcuccgcagcuuccucugucucgcuga

SEQ ID NO: 71483 - RNA, 1167 nt, Artificial Sequence
  derived and/or modified sequence opt5 from LHX9__Homo_sapiens__NP_001014434
augcugaacggcaccacacucgaggccgcuaugcuguuccacgggaucagcggaggccauauucaggggaucauggaagagauggaaagacgguccaagacggaggcccgccuugcgaaaggagcucaacugaauggcagagacgccgggaugcccccucucucuccggaaaagcccgcccugugcgcuggauguggcggcaaaauuagcgaucgguacuaucuucuggccguggacaagcaguggcaccuccgcugccugaaauguugcgaguguaagcuggcucucgaguccgaacugaccugcuuugccaaggaugggucuaucuacuguaaagaggacuauuacagacgguucagcguccagcgcugcgcgagaugucaucuuggaauuuccgccucugaaaugguuaugcgggcucgcgauagcguguaucaccuguccugcuuuacauguucuaccugcaacaagacacucaccacaggcgaccauuucgggaugaaagauagccugguguacugcagagcccacuuugagacccuucugcagggagaguauccuccccaacucuccuacacggaacuggcugccaagagcggcgggcuggcgcucccuuacuucaauggaaccggcacaguccagaaaggccggccccgcaagagaaagucuccugcccuggggguggacaucguuaacuauaauuccggauguaacgagaaugaagcugaucaccuugaccgggaucagcagccguaucccccuagccagaaaaccaagcgcaugagaacaucuuuuaaacaucaccaacugcggaccaugaaguccuacuucgccaucaaccauaaucccgacgcuaaagaucucaagcagcuggcccagaaaacgggccuuacaaagagagugcugcaagucugguuucagaacgcccgcgcuaaguuccggagaaaucuccugcgccaggagaacgggggaguggacaaagcggacggcaccagccugccugcucccccguccgccgauucuggggcccucacaccucccggaaccgccaccacacugacggaccuuaccaauccuacaauuaccguugugacaagcgucaccuccaacauggauagccacgaaucuggcucccccagccaaacgacacugaccaaucucuuuuga

SEQ ID NO: 71484 - RNA, 1119 nt, Artificial Sequence
  derived and/or modified sequence opt5 from LIAS__Homo_sapiens__NP_006850
augagccugagaugcggcgacgccgcucggacccucgggccccgcguguucggaagauacuuuuguuccccuguccggccgcugucuagccuucccgauaagaaaaaggaacugcuccagaacggcccugaccugcaagauuucguuuccggggaccuugccgaucgcucuacaugggacgaauauaaaggaaaucugaagagacagaaaggcgagcggcuccgccugcccccuuggcugaagacggaaauccccauggggaagaacuacaauaaacucaagaacacccugagaaaucuuaaccugcacacagugugcgaggaagcgcgguguccuaauauuggagagugcuggggcggcggggaguaugcuaccgccacagccaccaucaugcucaugggagauacauguacccgcggcugcagauuuuguagcgugaaaacggcucggaacccgcccccucuggacgccuccgaacccuacaauaccgcuaaggccauugcggagugggggcuugauuaugucgugcugacaucuguugaccgcgaugacaugccugauggaggcgccgaacauaucgcuaaaaccgugagcuaccucaaggagagaaaccccaagauucuggucgagugccugacaccggacuuccgcggggaccucaaagccaucgaaaagguggcucuguccggacuugauguuuaugcccacaauguggagaccgucccugaacugcagagcaaagugcgggaccccagagcgaacuuugaucagucucuccgggugcugaagcaugccaaaaagguccaaccugacguuaucuccaaaacgagcauuaugcuuggccugggcgagaaugaugaacagguguacgcuacaaugaaggcccucagagaggcugacguggauugucugacccuggggcaguacaugcagcccacacgccggcaccucaaggucgaggaauauaucacccccgagaaauucaaguacugggaaaaagugggaaacgagcugggcuuucauuauaccgccucugggccucuuguuagauccagcuacaaggccggagaguucuuucugaaaaaucucguggcuaagcgcaagacaaaagaccuguga

SEQ ID NO: 71485 - RNA, 609 nt, Artificial Sequence
  derived and/or modified sequence opt5 from LIF__Homo_sapiens__XP_011528474
augaaggugcuggccgcuggcgucguuccccuccugcuugugcugcacuggaaacauggggccggaagcccucucccgaucacccccgugaacgcgacaugcgcuauuagacacccuugucauaauaaccugaugaaucagauccggucccaacuugcccagcugaacggcucugccaaugcucucuucauucuguacuauacggcccagggggagcccuuuccuaacaaucuggacaagcucugcggacccaacgucaccgauuucccuccguuucacgcuaauggcacagaaaaagccaagcugguggagcuuuaccgcaucguuguguaucuggggaccagccucggaaacauuacaagagaccagaaaauccugaaucccuccgcgcuuucucugcauagcaagcucaacgccaccgcugauauccugcggggccugcucuccaauguccugugucgccuuugcucuaaguaccacgugggccacguugacgugacauaugggccugauaccagcggaaaagacgucuuccaaaagaaaaagcugggcugucagcuccuggggaaauacaagcagauuaucgccgugcuugcucaggccuuuuga

SEQ ID NO: 71486 - RNA, 3294 nt, Artificial Sequence
  derived and/or modified sequence opt5 from LIFR__Homo_sapiens__XP_011512344
augauggacaucuacgugugccugaagagacccagcuggauggucgauaacaaacggaugcgcaccgccuccaauuuccaguggcuccugucuacauuuauucuucuguaucucaugaaccaaguuaauagccagaagaaaggcgcuccucacgaccugaagugugugacgaacaaucuucagguguggaacugcuccuggaaagccccgucugggaccggaagaggcacagauuacgaggucuguaucgaaaaucggagccgcuccugcuaucagcuggagaagaccucuauuaagauccccgcgcucagccauggggacuacgaaauuacaaucaacucccugcacgauuucggaagcucuaccuccaaauuuacacugaaugagcaaaacgugagccucaucccugacacccccgaaauucugaaucuuucugcugauuucuccacgagcacccuguaucucaaguggaacgacagaggcucuguuuuuccucaucgguccaaugugaucugggagauuaaaguccugcgcaaggagagcauggaacuugugaaacugguuacacacaacaccacacucaaugggaaggauacccugcaucacugguccugggccucugacaugccccuggagugugccauccacuucguggaaauuagaugcuacaucgauaaccuccauuuuagcggacuggaggagugguccgacuggagcccugucaagaacauuucuuggaucccggauucccagacgaaaguguucccccaggacaaggugauccuugucggcagcgacauuacauuuuguugcguuucucaggaaaaagugcugagcgcucucaucggccacaccaauuguccucugauucaucuugauggggagaacguggccaucaagauucggaauaucuccgucucugcuagcuccggaacaaacgugguuuucaccaccgaagacaauaucuuuggcacagugauuuucgccggguaucccccugauacgccccaacagcugaacugcgagacccacgaccucaaagaaaucauuuguagcuggaauccgggacgcgucacagcgcuggugggcccuagagccaccucuuacacacugguugaguccuuuagcgggaaguacgugcggcucaaacgcgcugaggcccccaccaacgaaucuuaucagcugcuuuuccagaugcugccuaaucaagagaucuacaacuucacgcucaaugcucacaacccccugggaagaucccagagcacaauucuugucaauaucaccgaaaagguguauccccauaccccuacauccuuuaaggucaaagauaucaacucuaccgccgugaagcugagcuggcaccucccgggcaauuucgcgaaaauuaacuuucugugcgagaucgaaauuaagaaauccaacucuguucaggagcaacggaaugugacaaucaagggcgucgagaacagcuccuaccugguggcccucgacaagcugaaucccuauacgcuuuacaccuuccgcauuagaugcagcacagaaaccuuuuggaaauggucuaagugguccaacaaaaagcagcaucugacaaccgaggcuagcccuucuaaagggcccgauacguggcgggaaugguccagcgacggaaagaaucucaucauuuauuggaagccucugcccaucaacgaggccaauggcaaaauccugucuuacaacguuagcuguuccagcgaugaagagacccagucucuuuccgagauuccggacccucagcacaaggcugaaaucagacucgauaaaaaugacuacauuaucagcguggucgccaagaacuccguggggucuagcccucccuccaaaauugccucuauggagauccccaaugacgaucugaagaucgaacaagugguuggaaugggcaaggggauucugcucacauggcauuaugacccuaacaugaccugcgauuacgucaucaaaugguguaauagcucccgcucugagcccugccugauggacuggcggaaggugccgagcaacuccacagagaccgugauugaaagcgaugaguucagaccuggaauccgcuauaacuuuuuccuuuacggcugucggaaucagggcuaucagcugcucagaucuaugauuggguacaucgaagaacuggcucccaucgucgcgcccaacuuuacgguggaagacacauccgccgauagcauucugguuaaaugggaggacaucccuguggaggaacuucgcggauuccuccggggcuaucuguuuuacuucgggaagggagagagagauaccucuaaaaugcgcguccuggaauccggccggagcgacauuaaggugaaaaauaucacagauauuucucagaagacccucagaaucgcugaccugcaagggaagaccuccuaccaccuuguucugcgcgccuauacagauggcggagugggcccggagaaaagcauguacgucgugacgaaggaaaacuccguugggcucaucauugccauccugauucccguggcugucgccgugaucgugggagucguuaccagcauucugugcuaucggaaaagagaguggaucaaggagacauuuuacccugacauucccaauccugaaaacuguaaagcgcuucaguuccagaagucugugugcgagggcagcuccgcucucaagacccuggaaaugaaucccuguacaccuaacaauguggagguccuggaaacccggucugccuuccccaaaaucgaggacacggagaucauuagcccgguggccgaacgcccugaggauagauccgacgcugaacccgagaaccacguuguggucucuuauugcccucccaucauugaggaagagaucccgaauccugccgcugaugaagccgggggaacagcccaggugauuuacaucgacguucaaagcauguaucagccccaggcgaagccugaggaggagcaggagaacgaucccgugggcggggcuggcuacaaaccccaaaugcaucucccuaucaauuccaccgucgaagacauugccgcugaggaagaucuggacaagaccgccggauaccggccgcaggcgaacgugaauacauggaaccuuguuucucccgauagcccuagauccaucgacagcaauucugagauuguguccuuuggcagccccuguucuaucaacucccgccaguuccugauuccucccaaagaugaagacagcccuaaguccaacgggggaggcuggucuuuuaccaauuucuuucaaaacaagccgaaugauuga

SEQ ID NO: 71487 - RNA, 2667 nt, Artificial Sequence
  derived and/or modified sequence opt5 from LIG1__Homo_sapiens__NP_001275992
augcagagaagcaucauggccgcucugaaggaguggaacggcguggucuccgaaucugacagccccguuaaacggccugggcgcaaggccgcgagagugcucggauccgagggcgaagaggaagaugaggcucugucuccggccaaagggcaaaagcccgcccuugacugcagccagguguccccuccccggccugcuaccucucccgagaauaacgccagccuguccgauacaagcccuauggacucuuccccgagcggcauucccaaacgcagaacggcucggaagcagcucccuaagcgcaccauccaggaaguccuggaggaacaaucugaggaugaggacagagaagccaaacggaagaaagaggaagaggaagagacacccaaggagucccuuaccgaagcggagguggccacagaaaaagagggagaagauggggaccagccuaccacacccccgaagccucugaagaccagcaaagcugagacgcccaccgagucuguuuccgaaccugagguggccacaaagcaggaacuccaggaggaagaggagcaaaccaaaccuccccgcagagcucccaagacacugagcuccuucuuuaccccgcggaaacccgccgucaagaaagaagugaaggaggaagaaccuggagcgcccggcaaggagggcgccgcugaagggccucuggaucccucuggauacaauccggccaaaaacaauuaucacccuguugaggacgcuuguuggaagcccggccagaaagugccuuaccucgccgucgcccgcacguucgaaaagauugaggaagugagcgcuagacugcggaugguggagacacuuuccaaccugcuccgcagcgucguugcgcugucucccccugaucuucugcccgugcucuaucugucccugaaucaucucgggccgccucagcagggacuggagcuuggcgugggggacggaguccugcucaaagccguggcucaagccaccggcagacagcuggaaagcguucgggccgaggcugccgaaaagggcgauguggggcuugucgcggagaacucuagaagcacacagcgccugaugcugcccccucccccgcucaccgcuuccggaguguuuucuaaguuccgggacaucgccagacugaccggcagcgccuccacagcuaaaaagauugacaucaucaaagggcucuuuguugccugccgccacagcgaagcucgguucauugccagaucucuguccggacgccuucggcugggccucgcggagcaaagcgugcuggccgcucuuucucaggccgucucccugacgcccccugggcaggaguuucccccugcuaugguggaugccggaaagggcaaaaccgcggaagccagaaagacauggcucgaggaacagggcaugauccugaagcaaaccuucugugagguccccgaccuggaucgcauuaucccugugcuccuggaacaugggcuugagcggcugcccgagcacugcaaacucagcccgggcauuccucugaagcccaugcuggcucauccuacaagaggaaucuccgaaguucuuaaacgcuuugaggaagccgcuuucaccugugaguacaaguaugacgggcagcgggcccagauucacgcccucgagggaggcgaagugaaaaucuuuucuagaaaucaggaggauaacacggggaaguaccccgacaucauuagccggaucccgaagauuaaacugccuuccgucacaucuuucauccuggauaccgaagcuguggcgugggaccgcgagaagaaacaaauucagcccuuucagguucucaccacaagaaagcggaaagaaguggaugccagcgagauccagguccaagugugccuguaugcuuucgaccuuaucuaccugaauggcgagucccucgugagagaaccucugagccgccggagacagcugcuucgcgagaacuucguugaaaccgagggagaauuugucuucgccacaucucucgauacgaaggacauugagcagaucgccgaguuucuggaacaguccgugaaagacagcugugagggccugauggugaagacccucgaugucgacgcuacauacgaaauugccaagagaucucacaauuggcugaaacuuaagaaagauuaucuggacggggugggagauacccucgaccugguugugaucggcgcguaccuggggcggggaaagcgcgcuggcagauaugggggcuuccuucucgccuccuacgaugaggacagcgaggagcugcaagccauuugcaaacugggaacaggcuuuucugaugaggaacucgaggaacaucaccagagccugaaggcucuuguccugcccagcccccggccuuaugugcgcaucgacggggccguuaucccggaucauuggcucgaccccuccgcggugugggaggucaagugugcugaucugucucuguccccuauuuaccccgccgccagaggacuuguggacagcgacaaaggcaucucccuccgguucccucgcuuuauuagaguucgggaggauaagcagcccgaacaagcuaccacgucugcccagguggcuugccuguaucgcaaacagagccagauccaaaaccagcagggggaggacuccggaucugauccugaagacaccuacuga

SEQ ID NO: 71488 - RNA, 3057 nt, Artificial Sequence
  derived and/or modified sequence opt5 from LIG3__Homo_sapiens__XP_005258027
augagcaaguucagaggccugcgguacaugucccucgccuuuaaaaucuucuuuccccagacccugcgcgcucuuucuagaaaggagcugugccucuuccggaaacaccauuggcgcgacgugagacaauuuagccagugguccgaaacagaucugcuucacgggcauccucuguuccuccggcgcaagccgguccugucuuuucagggaagccaccugagaucccgggccacguaucucguuuuccugcccggccuucauguggggcuguguucuggaccuugcgagauggcggaacagcgcuuuuguguggacuacgcuaaaagaggcaccgccgggugcaagaaguguaaagagaagauugucaaaggagugugccggaucggcaagguugugcccaacccuuucagcgaauccggcggggauaugaaagagugguaucacauuaaguguauguuugagaagcucgaacgcgccagagcuacaaccaaaaagaucgaggaccugacagaacuugagggaugggaggaacuggaggauaaugaaaaagagcaaauuacccagcacaucgccgaccucagcucuaaggcugccggcacacccaaaaagaaagcggucgugcaggccaagcugaccacgaccgggcagguuacauccccugugaagggagcuagcuucgucaccucuacaaacccgcggaaauuuuccggcuucagcgccaagcccaauaacucuggggaagcuccuuccagccccaccccuaaacgcucccugucuagcuccaagugcgaucccagacauaaagacugucuccugcgggaguucagaaagcucugcgccaugguggcggauaauccgagcuacaacacgaagacacaaaucauucaggacuuucugcgcaaaggaucugccggcgauggcuuccacggggacguguaucucaccgucaagcugcuucugccuggaguuaucaaaacaguguacaaucucaacgauaagcagauugugaaacuguuuucccggaucuucaauuguaaccccgacgacauggcuagagaucuggagcagggcgacgucagcgaaaccauucgcguguuuuucgagcaaucuaagagcuuuccucccgccgcuaagucccuccugaccauccaggaaguugaugaguuccuucugcggcucucuaaacugacaaaggaagacgagcagcaacaggcccuucaggauauugccagcagaugcacggcuaaugaccugaaaugcaucauccgccucauuaagcaugaucugaaaaugaacuccggggcgaagcacgugcuggacgcccucgaucccaaugcuuaugaggccuuuaaggccagccggaaccugcaggacgucguggaaagaguucuucacaaugcucaagagguggaaaaagagccuggacagcgccgggcccugucuguccaggcgucccucaugaccccggugcagcccaugcuggcugaagccuguaagagcgucgaguacgccaugaaaaagugcccuaacggcauguucucugagaucaaauacgauggggaaagagugcaaguucauaagaacggagaccacuuuuccuauuucagccgcucccugaaacccgugcuuccucauaaggucgcucacuuuaaggacuacauuccccaggccuucccgggcggccauucuaugauccucgauagcgaggugcugcugauugacaauaaaacagggaagccucuccccuucggaacccugggcguucacaaaaaggcugccuuucaggaugcgaacgugugucuuuucgucuuugacugcaucuauuucaaugaugugucccugauggaccggccucucugugaaagacggaaauuucugcacgauaacaugguggagauccccaaucgcauuauguucucugagaugaagagaguuacaaaggcccuggaccuugcugauaugaucacccgggucauucaggaagggcucgagggacuggugcugaaagacgugaagggcacguacgaaccugggaaaagacauuggcucaaggucaaaaaggauuaucugaacgagggcgccauggcugacacagccgaucuugugguucugggagcguuuuacggccaagggagcaagggaggcaugauguccaucuuccucauggggugcuaugaccccggaagccagaaaugguguaccgugaccaagugcgccggcgggcacgacgaugcuacacuggcccgccugcagaaugaacuugacauggucaaaauuucuaaggauccguccaaaaucccuagcuggcucaaggugaacaagaucuacuaccccgacuuuauuguucccgauccuaaaaaggcugccgugugggagaucaccggcgccgaguucucuaaauccgaagcucauacagcggacggaauuagcauccgguuuccgagauguacgcgcauuagagaugacaaggauuggaaaucugccaccaaucugccccagcugaaggagcucuaucaacugagcaaagaaaaggcugacuucacagucguggccggcgaugagggguccagcaccacaggagggucuuccgaagagaacaagggcccuagcggauccgccguuucucggaaagcucccagcaagccuuccgccucuaccaaaaaggcggagggcaaacuuagcaauuccaacucuaaggacgggaauaugcagacggcuaagcccagcgccaugaaagugggcgaaaagcuggccaccaaauccagcccugucaaggugggagagaaacgcaaggcugccgaugaaacacucugccagaccaaggugcugcuggacaucuuuacaggcgucagacuuuaccuucccccgucuaccccugacuucucccggcugcgcagauauuucguugcguuugauggggaccuggugcaagaguucgauaugacgagcgcuacacacgugcucggaucucgggacaaaaaccccgccgcccagcaggucuccccugaauggauuugggcuuguauccgcaagagacggcugguggcccccugcuga

SEQ ID NO: 71489 - RNA, 2736 nt, Artificial Sequence
  derived and/or modified sequence opt5 from LIG4__Homo_sapiens__XP_005254115
auggccgcuagccagaccucccaaacaguggccucucacguccccuucgcggaccugugcagcacgcucgagagaauccagaaguccaaaggccgggcugaaaagauucgccauuuuagagaguuccuggauucuuggcggaaauuucacgacgcccuucauaagaaccacaaagauguuaccgacagcuucuacccugccaugcgccugauccucccgcagcuggaaagagagcggauggcuuaugggauuaaggaaacaaugcuugccaagcuguacaucgagcuccugaaucugccccgcgauggaaaagacgcucucaagcugcuuaacuauagaaccccuacaggcacccauggggaugccggagacuuugcgaugauugccuacuucgugcugaaaccccggugucuccagaagggcucccugacaauccaacaggugaaugaucuucuggacucuaucgcuagcaacaauuccgccaaacgcaaggaucucauuaagaaaagccugcugcagcucaucacccagucuuccgcucuggagcaaaaguggcuuauuagaaugaucauuaaagaccugaagcucggggucagccagcagacgaucuuuucuguguuccacaacgaugccgcggaacugcacaauguuaccacagaccuugagaaagugugccggcagcugcaugacccuuccgucggacucagcgauauuucuaucacccuguuuuccgccuucaagcccaugcuggcugccaucgcugacauugaacacaucgagaaagauaugaagcaucagagcuuuuauauugagacaaagcucgacggcgaacgcaugcaaaugcacaaagauggcgacguguacaaguauuucuccagaaacggguacaauuacaccgaucaguuuggagccucuccuacggagggcagccugacaccguucauccacaacgccuucaaagcugacauucaaaucuguauccuugauggggaaaugauggcguauaaucccaacacccagacauuuaugcagaagggaaccaaauucgacauuaagcggaugguugaggauuccgaccugcagaccugcuacuguguguuugacguccucauggugaauaacaagaaacugggccaugaaacacuucgcaagagauaugagauccugagcucuauuuucacgccuauccccgggcggauugagaucgugcagaaaacccaagcccacacaaagaaugaagucaucgaugcucucaacgaggccauugacaaaagagaagagggaaucaugguuaagcagccucuguccauuuacaagcccgauaaacgcggcgaaggcuggcugaagaucaaaccggaguaugugagcgggcucauggacgagcuggauauucuuaucgugggaggcuacugggggaagggaucucggggcgggaugaugagccauuuucugugcgccgucgcugaaaaaccucccccuggagagaagcccuccguguuccacacccucucuagaguuggcagcggcuguacaaugaaggaacuguaugaccuggggcuuaaacucgccaaguacuggaaacccuuucaucgcaaggcgccuccguccagcauucugugcggaaccgagaaacccgaaguguacaucgagccuuguaacucugucaucgugcagauuaaggcugccgagaucguucccuccgauauguauaaaacgggcugcacacugcgguucccuagaauugaaaagauccgcgacgauaaggaguggcacgaauguaugacccucgacgaucuggagcaacuucgggggaaagccagcggaaagcuggcuucuaaacaccucuacauuggcggggacgaugagccccaggaaaagaaaagaaaggccgcuccgaagaugaaaaaggugaucggcaucauugagcaucugaaagccccuaaucugaccaacgucaauaagaucuccaacauuuuugaagacguggaguucugcgucaugagcggaacagacucccagcccaaaccugaucuugaaaaucgcaucgcggaguuuggcggguauauugugcagaaccccggaccugacaccuacugcguuaucgccggcucugagaauauccgggugaagaacauuauccucagcaauaagcacgaugucgugaaacccgcuuggcugcuggaauguuucaagacaaaauccuuuguuccguggcaaccuagauucaugauucauaugugccccucuacgaaggagcacuucgcccgcgaauaugacuguuacggggauagcuauuuuaucgacaccgaucucaaccagcugaaagagguguucuccggaauuaagaauagcaacgaacagacacccgaggagauggcuucucuuaucgccgaccuggaauaccgguacuccugggauugcagcccucucucuauguuuagacggcacaccgucuaucuggacuccuacgcggugaucaaugaucugagcacaaagaacgagggcacccgccuugccauuaaagcucucgaacugagauuccauggggccaaggugguuucuugucuggcugagggcgucagccacgugaucauuggagaagaccauucccggguggccgauuuuaaagccuucagacgcacguuuaagcggaaauucaagauccucaaagagagcugggucaccgacucuauugacaagugcgagcugcaggaagagaaucaauaucuuaucuga

SEQ ID NO: 71490 - RNA, 1470 nt, Artificial Sequence
  derived and/or modified sequence opt5 from LILRA1__Homo_sapiens__NP_006854
augacccccaucgugacaguccugauuugccucagacugagccuuggcccucggacgcacguucaggccgggacccugccgaagcccacacucugggcugagccuggauccgugaucacccaaggcucucccgugacacuguggugucaggggauucuugaaacccaggaguaccgccuguauagagagaaaaagacagccccuuggaucacccggauuccccaggaaaucgucaaaaagggacaauucccuaucccgagcauuacgugggaacauaccggccgcuacagaugcuuuuaugggucccacacagcgggauggucugagcccagcgacccucucgagcuggugguuaccggcgcuuacaucaaacccacacuguccgcccucccuucucccguggucaccagcggcgggaacgugacgcugcauuguguuucccagguggccuucggauccuuuauucuuugcaaggaaggcgaggaugaacacccgcagugucucaauucucagccucggacacauggguggucccgcgcuaucuucagcgucggacccgugucuccuuccagacgguggagcuaucgcugcuacgccuaugacucuaacagcccccacguguggagccugcccuccgaucugcuugagcugcucguccugggcguuucuaagaaaccuagccuguccgugcaaccggggcccauuguggcuccuggagagagccucacccugcagugugucucugacguguccuacgauagauuuguucuuuacaaggaaggcgagcgggacuuccugcagcuccccggcccucagccccaagccgggcugagccaggcgaauuuuacacuuggaccggugucucgcagcuauggcgggcaguacagaugcuccggagccuauaaccugucuagcgaaugguccgcuccuagcgauccccucgacauccugauugccggccaauuccgggggcgcccuuuuaucucuguccaccccggaccuaccguggcuuccggcgagaauguuacccugcucugucagagcuggggccccuuccauacauuucugcuuacgaaagccggggcggccgaugcuccgcugagacuccggucuauccacgaauacccuaaguaucaggccgaguuccccaugucccccgugaccagcgcucauuccggaacauacagaugcuauggcucucugagcuccaacccuuaccuucugucucacccgagcgacucccucgagcugauggucagcggggccgccgaaacccugucucccccucagaauaaauccgauagcaaggcuggagcggccaacacacucucucccucccaaaauaagaccgcuagccacccucaggacuacacgguggagaaccugauucgcaugggcaucgccgggcuuguccuggugguucucggcauucugcuguuugaagcccagcauucucagcggagccuuuga

SEQ ID NO: 71491 - RNA, 1401 nt, Artificial Sequence
  derived and/or modified sequence opt5 from LILRA2__Homo_sapiens__NP_006857
augacccccauccugacagugcucauuugccugggccuuagccuggggccuagaacgcacguccaggccggacaucucccgaagcccacccugugggcugagccuggcuccguuaucauucaagggucucccgugacacuucggugucagggaagccugcaggccgaagaguaccaccucuaucgcgaaaacaaauccgcgucuugggugagacggauccaggagccuggcaagaaugggcaauuccccauuccuagcaucaccugggaacaugcuggacgcuaccacugccaguauuacucccauaaccacucuagcgaguauuccgacccgcuggagcuggucgugacaggcgccuacagcaaacccacccucucugcccugccuucccccguugugacaagcggcgggaaugucacccuucagugugugucucagguugcuuuugauggauucauccugugcaaggaaggcgaggacgaacacccucaaagacucaacucccauagccacgcccggggguggucuugggcuaucuuuuccgugggacccgucagcccgucccgcagauggucuuaucgguguuacgccuacgauagcaauuccccuuauguguggagccugcccucugaccuucuggagcuccuggugccuggcgucuccaaaaagcccagccugucuguucagcccgggccuaugguggcgccgggagagagccucacgcugcagugcguguccgaugucggcuacgaccgcuucgugcuuuauaaggaaggcgagagagauuuucugcagcggcccggguggcaaccucaggccggacucucucaggcuaacuucacccugggccccguuagcccuucccaugggggacaauaccgcuguuauagcgcccacaaucuuucuuccgaauggagcgcucccucugacccgcuggauauucucauuacaggccaguuuuacgacagaccuucccugagcgugcagcccgucccuaccguggcccccgggaaaaacguuacacugcucugccagucccggggacaauuccacaccuuucugcuuacgaaggagggcgcgggccauccuccccugcaccuccgcucugaacaucaggcccagcagaaucaagcugaguucagaauggggccggugacaagcgcccacgucggaaccuaucgguguuacuccucucugagcuccaacccuuaccuucugagccuccccucugauccccuggagcugguggucuccgcuagccucggccagcauccucaggacuauacaguggaaaaucugaucagaauggggguugccggacuugugcuggucgugcucggcauucugcuguuugaggcccagcacucucaacgcucccuucaggaugcugcggggcgguga

SEQ ID NO: 71492 - RNA, 1128 nt, Artificial Sequence
  derived and/or modified sequence opt5 from LILRA3__Homo_sapiens__NP_001166125
augacccccauccugacagugcucauuugccugggccuuagccuggacccuagaacgcacguccaggccgggccgcuccccaagccuacccugugggcugagcccggauccguuaucacacaaggcucuccugugacccuucggugucaggggagccuggaaacacaggaguaccaucucuaucgcgagaaaaagaccgcccuguggauuacaagaaucccccaggaacuggugaaaaagggacaauucccuauucucuccaucaccugggaacacgcgggccgguacugcuguaucuaugggucucauacggcuggacugagcgaguccucugauccgcuugagcuggucgugaccggcgccuacagcaaacccacacucuccgcccugccuagccccguugugaccucuggcgggaacgucacaauucagugcgacucccagguggcuuuugauggauucauccuuuguguuagcaagaagccuucucuguccgugcagcccggcccggucguggccccuggggaaaaacucaccuuucaaugcggaagcgacgcuggcuaugaucgcuucgugcuguacaaggagugggggagagacuuucugcagcggcccggacgccagccucaggccggccucucucaagcgaauuucacgcugggccccgucuccagaagcuaugggggacaguacacauguuccggcgccuacaaccuuucuagcgaaugguccgcucccagcgauccucuggacauucucaucaccgggcagauucgggcccgcccguuucugucuguuagacccggaccuacaguggcuuccggcgagaaugugacccuucugugccaaagccaagggggaaugcacaccuuccuccugacaaaagagggcgccgcggauucuccccugcggcucaagagcaaacgccagucccauaaguaucaggccgaauuuccuaugucucccgucacgagcgcucacgccggcaccuacagauguuaugggucccugagcucuaacccguaccuucugacacacccuuccgacccccucgagcuggugguuagcggagcugccgaaacccuuucuccuccccagaauaaguccgauagcaaagccggcgaguga

SEQ ID NO: 71493 - RNA, 1500 nt, Artificial Sequence
  derived and/or modified sequence opt5 from LILRA4__Homo_sapiens__NP_036408
augacccugauccucacaagccugcuuuucuuuggccugucccucgggcccagaacgcgggugcaggccgagaaccugcuuaagccuauucugugggcugaaccgggacccgucaucaccuggcacaauccuguuacaauuuggugccaaggcacccucgaggcccagggguaccgccuggacaaagaaggaaacucuaugagcagacauauccugaagacacucgaguccgaaaauaaagugaagcugucuauucccagcaugaugugggagcacgcgggccgguaucauuguuacuaucaguccccugcuggguggucugagcccagcgauccucuugaacugguggucaccgccuacucccgcccgacacucagcgcccugcccucuccugugguuaccuccggagugaacgucacgcuuagaugcgcuagccggcugggccucggccgcuucacccugaucgaggaaggggaccacagacugucuuggacacucaauucccaucagcacaaccacggaaaauuucaagcccuguuccccaugggcccucuuaccuuuagcaaucgggggacauuccgcuguuauggauacgagaacaauacccccuauguguggucugagccguccgauccucugcagcuccugguuagcggcguguccagaaagcccucucuucugacgcuccaggggccugucgugacacccggagaaaaccugacccugcagugcggcagcgacgugggcuacauccgguacacacucuauaaggagggggcugauggacugccccaacgcccuggcagacagccgcaggccgggcuuucccaggcgaauuuuacccugagccccgucucucgguccuacggaggccaauaucgcuguuacggggcccauaacguuagcucugaauggagcgcuccuuccgacccccucgauauucugaucgccggacagauuucugacagaccuagccuuuccgugcagcccggcccgaccgugacaagcggcgagaaagucacgcugcucugccaaucuugggauccuauguucaccuuucugcugacaaaggaaggggcugcccaucccccucuccggcugagauccauguauggagcgcacaaauaccaggccgaguuccccaugagcccugugaccucugcucacgccggcacauaucgcuguuacgggucccggagcuccaaucccuaccuucugucucacccgagcgagccucucgaacugguuguguccggagcuaccgagacgcugaaccccgcccagaagaaaucugacagcaagacagcuccccaucuucaggauuauaccgucgaaaaucucaucagaaugggcguggccgggcugguucugcucuuucugggcauucuucuguucgaggcgcaacacucccagcgcagcccuccgcggugcucucaggaagccaacuccagaaaggacaacgcucccuuucgcguggucgagccuugggagcagaucuga

SEQ ID NO: 71494 - RNA, 900 nt, Artificial Sequence
  derived and/or modified sequence opt5 from LILRA5__Homo_sapiens__NP_067073
auggcccccuggagccacccuuccgcucagcugcaaccggugggcggggacgccgucucucccgcgcucaugguucugcuuugccugggacucagccugggcccuagaacccaugugcaggcugggaaccuuuccaaggccacacugugggccgagcccggaucugugaucagccggggcaauuccgucacgauucgcugucaggggacccucgaagcucaggaguacagacuggugaaagaaggaucuccugagcccugggauacacaaaacccucuggaaccgaagaauaaagcccgguucagcauccccuccaugaccgagcaccaugcuggccgcuauagaugcuacuauuacagcccugccggcuggucugagcccuccgacccucucgaacugguugugacaggguuuuauaacaagcccacccuuagcgcgcugccgucuccugucgugacauccggagagaauguuacccuccaguguggcagccggcugcgcuucgauagauuuauucuuacggaagagggggaccacaaacugucuuggacccucgauucccagcugacacccagcggacaguuccaagcccuguuuccugugggccccgucacccccucccaucgguggaugcuccgcugcuacgggucuagacggcacauccuucagguguggagcgagccuuccgaccugcuggaaauuccggugagcggagcugccgauaaccucucucccucccagaauaagagcgacucuggcacagcuagccaucugcaggauuaugccgucgagaaccuuauccgcaugggcauggcggggcugauccucguugugcugggcauucugaucuuccaagacuggcacucccagagaucuccucaggccgcugccggacgguga

SEQ ID NO: 71495 - RNA, 1956 nt, Artificial Sequence
  derived and/or modified sequence opt5 from LILRB1__Homo_sapiens__NP_001075107
augacccccauccugacagugcucauuugccugggccuuagccuggggccuagaacgcacguccaggccggacaucucccgaagcccacccugugggcugagccuggcuccguuaucacacaagggucucccgugacccuucggugucagggaggccaggaaacacaggaguaccgccuguauagagagaaaaagaccgccccuuggauuacacggaucccccaagaacucgugaaaaaggggcaguucccuauuccgagcaucaccugggaacacacgggacgcuacagaugcuauuacggcuccgacaccgcgggccggucugagagcuccgauccccuggagcuggucgugacaggggcuuauaucaaaccuacccucucugcccagcccagcccuguugugaacuccggaggcaaugucacacugcagugugacagccaaguggccuuugauggguucauucuuugcaaggaaggagaggacgaacauccccagugucugaacucucagccgcacgcucgcggcuccagcagagccaucuuuucuguugggccugugucccccagccggcgcuggugguacagaugcuaugcuuacgauucuaauuccccuuacgaguggagccuccccuccgaccugcuugagcugcucguccugggagugucuaagaaacccagccuguccgugcagccuggcccgauugucgcccccgaagagacccucacgcugcaauguggcagcgaugcgggguauaaccgguucguucuuuacaaggacggagaacgcgauuuucugcagcucgccggcgcucagccucaagccgggcugucucaggcuaauuucacacuuggacccguguccagaagcuauggcgggcaguaccggugcuauggagcccauaaccugucuagcgagugguccgcgccuucugacccccucgauauccugauugccggccaguuuuacgaccgcgugagccuguccguccaaccgggcccuaccguggcuagcggggaaaauguuacacuccugugucagucucagggauggaugcagaccuuccuucugaccaaagagggcgccgcugaugaccccuggagacuccgguccacauaucaaagccagaaguaccaggccgaguuuccuauggggcccgugacgucugcccacgcuggaaccuacagaugcuauggcucccagagcuccaaaccuuaccugcuuacacaccccucugacccgcuggaacucgucgugagcgggccuuccggcggacccucuagccccaccacaggcccuaccuccacgagcgcggggccggaggaucaaccccugacaccuaccggaucugacccccaguccggccuggggcgccaucucggaguugugaucggcauucuggucgccgugauccuucugcuccugcugcuucuccugcuguuccucauccugcggcacagacgccaggggaagcauuggaccagcacacagcggaaggcugauuuucaacacccugccggcgccgucggacccgaaccuaccgacagaggccuucaguggcgcagcucccccgcugccgaugcgcaggaggaaaaccuguaugcugccgugaaacacacacaaccggaggacgggguugagauggauacgcggagcccucaugacgaagauccccaggccgugaccuacgcugaggucaagcacucuagaccucgccgggaaauggccucucccccguccccucucagcggagaguuccuggacacaaaagauagacaggcugaagaggaccgccagauggacaccgaggccgcggccucugaagcuccccaagaugugacauaugcccagcugcauucccuuacccuccggagagaggcuacggaaccuccucccagccaggagggccccuccccggccguucccucuauuuacgcgacccuggccauccacuga

SEQ ID NO: 71496 - RNA, 1449 nt, Artificial Sequence
  derived and/or modified sequence opt5 from LILRB2__Homo_sapiens__NP_001265333
augaccggcgccuaccccaagccuacacugagcgcucagccgucccccguggucacgucugggggaagaguuacccuccaaugcgagagccagguggccuucggcggguuuauccuguguaaagaaggagaggacgaacacccucagugccuuaacucccagccccaugcgcggggcucuagccgcgcuauuuucuccguggggccugucucucccaauagacgguggagccaccgcuguuauggauacgaucugaacuccccuuauguguggagcucuccguccgaccuccuggagcuucugguucccggcgugagcaagaaaccuucucucuccguccaacccggcccugugauggcccccggggaaagccugacacugcagugcguuucugaugugggauacgacagauuuguccucuauaaggagggcgagcgggaucugcgccagcuuccggggagacagccucaagccggacugucccaggcuaauuucacccucggccccgugagccgguccuacgggggacaguaucgcuguuacggcgcccauaaccugucuagcgaaugcuccgcuccuagcgacccccuugauauccugauuacaggccagaucagagggacccccuuuauuucugugcaaccuggaccgacagucgccuccggcgagaauguuacccuccugugucagagcuggcggcaguuccacacguuucugcucaccaaagcgggggccgcugacgcuccccugcgccuuagaucuauccaugaauacccuaaguaucaagccgaguuccccaugagcccugugacauccgcccacgcgggaaccuaccggugcuauggcucucugaacagcgaucccuaccuccugucccacccgagcgagccucuugaacugguggucucugggcccuccaugggaagcucuccucccccuacaggccccaucuccaccccggccggcccugaggaccagccccucacgcccacagggagcgauccucaguccggacugggccgccaucugggggugguuauuggaauccucguggcugucgugcugcuucugcuccugcuucugcuccuguuucugauucucagacaccggagacagggcaagcauuggaccucuacacaacgcaaagccgacuuccagcacccggcuggggccguuggccccgaaccuaccgaucggggacugcaguggagaagcucccccgccgcugacgcgcaggaggaaaaucuuuaugccgcugugaaggacacccaaccugaggauggcgucgagauggacacacgcgccgccgcuucugaagcgccccaggaugugacguacgcccagcugcacagccucacccugcggagaaaagcuacagagccucccccgucccaggaacgcgagccucccgccgaaccuagcaucuaugccacccuggcuauucauuga

SEQ ID NO: 71497 - RNA, 1446 nt, Artificial Sequence
  derived and/or modified sequence opt5 from LILRB3__Homo_sapiens__XP_006726238
augacccccgcccugacagcucuccugugccuuggccugagccucgggccuagaacgcgggugcaggccggaccguuccccaagccuacccugugggcggagcccggcuccgucaucucuugggggagcccuguuacaauuuggugucaaggaucccuugaagcucaggaguaccagcuggacaaagaaggcucucccgagccucucgaucgcaacaauccgcuggaacccaagaacaaagccagauuuagcaucccuuccaugacccagcaccaugccgggcgguaucgcugccacuacuauucuagcgcuggaugguccgagcccagcgacccucuggagcucgugaugacaggcuucuacaauaagcccacccugucugcccuuccguccccuguggucgcuagcggcgggaacaugacacugagauguggaucucaaaaaggcuaucaucacuuugugcucaugaaggaaggggagcaucagcugccccggacccuugauucccagcagcugcacagcggaggcuuccaagcccucuuuccuguugggcccgugacgcccucucaccgcuggagauuuaccugcuacuauuacuacacaaauaccccucgggucuggucccauccgagcgacccccuggaaauucugccuuccggagugucucgcaagcccagccuccugacacuucagggcccuguucuggcgcccggccagucccucacccugcagugugggagcgaugugggauaugacagauucguccuuuacaaagagggcgagcgggauuuccugcaacgcccggggcagcagccucaagccggacucucucaggcuaacuuuacgcugggccccguguccccuagccacgggggacaguauagaugcuacggcgcccauaaucugucuagcgaaugguccgcucccucugacccucucaacauccugauggccggccagauuuaugauacagugagccuuuccgcgcaacccgggccgaccgucgccagcggagagaauguuacacugcucugucagucucggggcuacuucgacaccuuucugcuuaccaaggaaggggcugcccacccuccccugcgccucagauccauguauggagcucacaaauaccaggccgaguuccccaugagcccugugacaucugcccaugcuggcacguaccggugcuauggguccuacagcuccaacccgcaucugcugucuuuucccagcgaaccucucgagcugaugguguccggccacucuggaggcagcucccuucccccuaccgggcccccuagcacacccgcgucucacgccaaggauuauaccgucgagaaucugaucagaaugggaauggcuggccucgugcugguuuuccuggggauccuucucuucgaagcccagcauucccaacgcaacccgcaggacgccgcuggacgguga

SEQ ID NO: 71498 - RNA, 1473 nt, Artificial Sequence
  derived and/or modified sequence opt5 from LILRB4__Homo_sapiens__XP_011546956
auggagcagccccacgacgaaaaggauccugccagcaaaagaccgcaucccgugugccuguucguccucccugcucugcggacccaccccuccgcccaacuuggcccucucgggggagacgcgaugauccccacauuuacggcucugcugugucuuggccugucucucgggccucgcacccauaugcaggccggaccgcugcccaagccuacacugugggccgagcccggcagcguuauuuccugggggaacucugugaccaucuggugccagggaacacucgaagcuagagaguaccggcuggauaaagaagagagcccugcccccugggaccgccagaauccgcuugagccuaagaacaaagcuagauucuccauucccucuaugaccgaagauuaugccggccgguaccgcuguuauuacagaagcccugugggcuggucccaacccagcgacccccuggagcucgucaugacaggggcguauucuaagccuacccuguccgcccuuccgagcccccuggugacgucuggaaaguccguuacccuccugugccagagccggucuccuauggauacauuucugcucaucaaagaacgcgcugcccacccccugcuucaucugagauccgagcacggcgcucagcagcaccaagccgaguucccuaugagccccgugaccuccguccaugggggaacauaccgguguuuuucuagccacggcuucucccauuaucuccugagccacccgucugacccucuugaacugauuguguccgggagccucgaggauccccgcccuucucccaccagaagcguuuccacggcggccggaccugaagaccagccccugaugccgacaggcucugugccucacagcggccugcggcgccauugggagguccucaucggggugcugguggucuccauccuucugcucagccugcuucuguuucuccugcugcagcacuggagacagggaaagcaucggacccucgcucaaagacaggccgauuuccagcgcccucccggcgcugccgaacccgagccgaaagacgggggacugcaacggagaucuucccccgccgcugauguucagggcgagaauuuuagcggggcggccgugaagaacacacagccugaagacggaguggagauggacacccgccagucuccccacgaugaagacccucaagcugucaccuacgccaaagugaagcauucccggcccagacgcgagauggccagcccucccuccccgcuuucuggcgaguuccuggauacaaaggaccggcaggcugaagaggauagacagauggacacggaagccgcggcuagcgaggccccucaggauguuaccuacgcccaacuccacuccuuuacacugcgccagaaagcuaccgaacccccucccucucaggagggcgccagcccggcugaaccuuccguguaugccacacuggcgauucacuga

SEQ ID NO: 71499 - RNA, 1776 nt, Artificial Sequence
  derived and/or modified sequence opt5 from LILRB5__Homo_sapiens__NP_001074911
augacccugacacucagcgugcugaucugccuuggccuguccgucgggcccagaacguguguucaggccggaacccucccuaagccgacacugugggcugagcccgccucugugauugcgcggggcaaaccugugacccuuuggugccaagggccccuggaaacagaggaauaccgccucgacaaggagggacugccuugggcuagaaaacggcagaacccccuggaaccuggcgccaaggccaaauuccacaucccgagcaccgucuaugauuccgcugggcgcuacagauguuauuacgagacacccgccggauggucugagccuagcgacccccucgaacugguggcuaccggcuuuuaugccgagccuacgcuucuggcgcuccccuccccgguuguggccucuggcgggaaugucacccugcagugcgauacacuugacggacugcucaccuucgugcugguugaagaggagcagaagcugccucggacacucuacagccaaaagcugcccaaaggcccuucccaggcucuuuuucccguggggcccgucaccccuagcugucgcuggagauuccggugcuauuacuacuaucgcaagaacccccagguguggucuaaucccuccgaucugcucgaaauucuggugccuggagucagcagaaaacccucucuucugaucccucagggcuccguuguggcccgcgggggaagccucacgcugcaaugucggucugacgugggcuacgauauuuuuguccuguauaaggagggcgaacaugaccucgugcagggguccggacagcagccccaagcuggccugagccaggccaacuucacacuugggccgguuuccagaucucacggaggccaguaccggugcuauggggcgcauaaucugagcccucgcugguccgcccccagcgauccucucgacauccugaucgcuggacuuauucccgauaucccugcccugucugugcaacccggcccgaaagucgcuuccggcgagaacgugacccuccugugucagagcuggcaccagauugacacauuuuuccugaccaaggaaggggccgcccauccuccccucugccugaagucuaaauaccagagcuauagacaccaagcugaguuuuccaugucucccguuaccagcgcgcagggaggcacauaccgguguuacuccgccaucagaagcuauccuuaccuucugucuuccccgagcuauccccaggagcucguggucucugggccuuccggagaucccagccuguccccuacgggcucuacccccacacccgcugggcccgaagaccagccgcugaccccuacaggccuugacccccaaagcggacucggccgccaccuggggguggucaccggaguguccguugccuucgugcugcuccuguuucuucuccuguuccugcugcuucggcauagacaccagucuaagcaucgcacgagcgcccacuuuuaccggccugcuggcgccgcggggcccgagccgaaagaucagggacuccagaagagagcuuccccugucgccgacauucaagaagagauccugaaugccgcugugaaagauacacagcccaaggacggcguugaaauggaugcccgcgcugccgcgagcgaggccccucaggacgugaccuaugcucagcugcacucucucacccugcggagagaggccacagaaccgcccccuucccaagagcgcgaaccgcccgcugagccuagcauuuacgccccucuugcgauccauuga

SEQ ID NO: 71500 - RNA, 522 nt, Artificial Sequence
  derived and/or modified sequence opt5 from LIM2__Homo_sapiens__NP_001155220
auguacagcuucaugggcgggggacuguuuugcgccugggugggcaccauccuccuggucguugcuauggccacagaccacuggaugcaguauagacuuuccgggucuuucgcgcaucaaggacuguggcgguacugucucggcaacaagugcuaucugcagacggauagcauugcuuacuggaaugccacccgcgccuuuaugauccuuuccgcucugugugccauuucugggaucauuaugggaaucauggcuuucgcccaccagcccacauuuagcagaaucucccggccuuucucugcgggcauuauguuuuucagcuccacccucuuuguggugcuggcccuggcuaucuauacaggcgucaccgugagcuuccucgggcgcagauuuggagacuggcgguucucuugguccuacauucugggcuggguugccgugcuuaugacauuuuucgcugggaucuucuauaugugcgccuaccgcguccaugaguguagacggcugagcaccccgcgcuga

SEQ ID NO: 71501 - RNA, 1374 nt, Artificial Sequence
  derived and/or modified sequence opt5 from LIMA1__Homo_sapiens__NP_001230704
auggagcagaaggaaaacgugcccccuggcccggaggucugcaucacccaccaagaaggggagaaaauuagcgccaaugaaaacucccuggcuguuagaucuacacccgccgaggacgauagccgggacucccaggugaagucugaggugcagcagccuguccaucccaaaccucucagccccgauucccgcgcgucuagccuguccgaaagcucuccuccgaaggcuaugaaaaaguuccaagcccccgccagagagacguguguggaaugccagaagaccguuuacccuauggagcggcuucuggcuaaucaacagguguuucacaucuccuguuuccgcugcagcuauuguaacaauaaacucucucugggaacauacgccucccuucauggcagaauuuauugcaagccccacuuuaaccagcuguucaaaagcaaggggaauuacgacgagggauuuggccaucggccucacaaagaucucugggcuucuaagaacgaaaaugaggaaauccuggagcgccccgcccagcuggcgaacgccagagaaaccccgcacuccccuggggucgaggacgcucccauugccaaggugggaguucucgcugccagcauggaggcgaaagccuccucucagcaggaaaaggaggauaaaccugcugaaacaaagaaacugcggaucgccuggcccccucccaccgagcuuggcagcuccggcagcgcucuggaagaggggaucaagaugucuaaaccgaaguggcccccugaggacgaaauuuccaagcccgaggugccugaagaugucgaccucgaucugaaaaagcugcgcagaagcucuagccuuaaagagcggucccgccccuucacaguggccgccucuuuucaaagcaccuccgucaagagcccgaaaacggugucuccucccaucagaaagggaugguccaugagcgaacagucugaggaguccguuggcgggcggguggcugaacgcaaacagguggagaaugcgaaggccagcaagaaaaacggaaaugucggcaagaccacauggcaaaacaaagaauccaagggggagaccggaaagagaucuaaagagggccauagccucgaaauggagaaugaaaaccugguggagaacggcgcugacuccgaugaagacgacaauucuuuccugaagcagcagagcccucaggagcccaaaucccucaacuggagcucuuuuguugauaauacauucgccgaggaauuuaccacgcaaaaccagaagucccaggacguggagcugugggaaggggaggucgugaaagaacuuagcguugaggagcagauuaagcggaauagauauuacgaugaagacgaggaugaagaguga

SEQ ID NO: 71502 - RNA, 3174 nt, Artificial Sequence
  derived and/or modified sequence opt5 from LIMCH1__Homo_sapiens__NP_001106188
auggccugccccgcucugggccucgaggcccugcagccucuucaaccggaacccccucccgagccugcguucagcgaagcucagaaguggaucgaacaggugaccgggagauccuuuggagacaaagauuuccggacaggccuggaaaacgggauucuccugugugagcuucugaaugccaucaagcccggacucgucaaaaagauuaaccgccugccuacgccgaucgccggccuggacaauauuauccucuuucugagagggugcaaagagcuuggacugaaggaaucucaacucuucgaucccagcgaccugcaggauaccuccaaccggguuacagugaagucucuugacuacagccgcaaacugaagaaugugcucgucaccaucuauuggcugggcaaagcugccaacuccuguacaucuuacagcggcaccacacugaaucucaaggaguuugaagggcugcuugcucagaugagaaaagauaccgacgauauugaguccccuaagcggagcauccgcgacucuggauauauugauugcugggacuccgagagaagcgauucucuguccccuccccggcacggccgcgacgacagcuucgauucucucgacuccuuugggagcagaucccggcagacgcccucuccggaugugguucugcgcggaagcuccgacggcagagggagcgauucugaauccgaccuuccucaucggaagcugcccgaugugaaaaaggacgauaugagcgcccgcagaaccucucacggagagccuaaaagcgcgguccccuucaaccaguaccuccccaauaaguccaaccaaacagccuaugugccugcuccgcugcggaaaaagaaagccgaaagagaggaauaccgcaagucuuggagcaccgcuacaagcccccugggcggcgagcggccuuuuagauaugggccccgcaccccuguuuccgacgaugccgagucuacguccauguucgacaugcggugugaagaggaagcggccgugcagccccauagcagagcucgccaggagcagcuccaacugaucaauaaccagcuucgggaagaggacgauaaguggcaggacgaucuggccagauggaaaucucgccggagauccgucagccaagaccucauuaagaaagaggaggagcgcaagaaaauggaaaagcugcuugcuggagaggauggcacauccgaacggagaaagucuaucaaaaccuaccgggagauugugcaggagaaggaacgcagagagcgggaacugcacgaggccuacaaaaaugccagaagccaggaggaagcugaggggauccuccagcaauauaucgaacgcuuuacaauuuccgaggcggugcuggaacggcuggagaugccgaagauccucgagagaucucauagcaccgaaccuaaccuguccagcuuccuuaaugaccccaacccuaugaaauaccugcgccagcagucucugcccccucccaaguuuaccgccacagucgagacgaccauugcuagagccuccguucucgauacaagcaugucugccggauccggcagcccgucuaagaccgugacaccuaaagcugugcccaugcugacccccaagccuuauagccagccgaaaaacucccaagacguccuuaagacguucaaaguggaugggaagguuagcgugaauggagaaacaguccaccgggaggaagagaaggagcgcgaaugccccaccguggccccugcgcacucucucaccaaaucccagauguucgagggcguugcuagagugcauggcagcccccuggaacugaagcaggacaacggguccaucgagauuaauaucaaaaagccuaacucugucccccaggaacucgccgccacaaccgagaaaacagagccuaauagccaagaagauaagaacgacggaggcaaaucccggaaggggaauaucgagcuggcuucuagcgaaccccagcacuuuacgaccacagugacccgcuguuccccgacagucgccuucguggaguuuccuucuagcccccagcuuaagaacgauguuuccgaggaaaaagaccagaagaaaccugagaaugaaaugagcggaaagguggagcugguccucucucaaaaagugguuaagcccaaguccccggaaccugaggcuacccugacguuccccuuucuggacaaaaugccugaggccaaccagcuucaucuccccaaucugaacagccagguggauucucccuccagcgaaaagucuccugucaugaccccgcaauucaaauuuugggcgugggaccccgaggaagagagacggcgccaggaaaaguggcagcaggagcaagagagacugcuccaggaacgguaccagaaagagcaggauaagcugaaggaagagugggaaaaagcccaaaaggagguggaggaagaggaacgcagauauuacgaggaggaacggaaaauuaucgaggacacagugguuccuuucaccgucuccagcuccagcgcugaucagcuuucuacaagcuccucuaugaccgaaggcagcgggacgaugaauaagauugaccugggcaacugccaggaugagaaacaggacagacgcuggaagaaguccuuucaaggagaugacucugaucuccugcugaaaacacgggaaagcgacagacuugaggagaagggcucccucaccgaaggggcccuggcucacucuggaaaucccgugagcaaaggcgugcacgaggaucaucagcuggacacagaagccggggcgccucacuguggaaccaacccccagcucgcccaagacccuucccagaaccagcagaccagcaauccgacacauucuuccgaggaugucaagcccaaaacgcugccucuugacaagagcaucaaccaccaaauugaaucucccuccgagcgccggaaaagcaucuccggcaagaagcugugcucuagcugugggcucccucugggcaaaggagcugccaugaucauugagacccugaaucuuuauuuccauauccagugcuuuagaugcggcauuuguaaggggcagcucggagaugcuguguccggcacagacguucgcauccggaacgggcugcugaauugcaacgauuguuacaugagaagccgcucugccggacagcccaccacacucuga

SEQ ID NO: 71503 - RNA, 2031 nt, Artificial Sequence
  derived and/or modified sequence opt5 from LIMD1__Homo_sapiens__NP_055055
auggacaaguacgaugaccugggccucgaggccagcaaauucaucgaagaucugaacauguaugaggcuuccaaggacgggcuuuuuagaguggauaaaggagccggcaauaaccccgaguucgaagaaacccggcgcgucuuugcgacaaagauggcuaaaauucaucugcagcaacagcagcagcaacuccugcaggaggagacgcuuccuagagggucucggggaccgguuaauggcgggggacgccugggcccccaggccagaugggaaguggugggcagcaagcucaccgucgacggggccgcuaagccuccccuggccgcuuccacaggagccccuggcgcggugaccacacuggccgcugggcagcccccuuacccgccccaagagcagcggucucgcccuuaucuccacggaaccagacacggcagccaggauugcgggucccgggaaucucuggccacaagcgagauguccgcuuuccaucagcccggaccuugugaggaccccagcugccuuacccacggcgauuacuaugacaaccugucucucgccuccccgaaauggggcgauaagccugggguuagccccucuaucggacuguccgugggcagcggguggccuucuucccccggaagcgaucccccucuuccgaaacccuguggcgaccauccucugaaucaccgccaacucucccugucuagcuccagaagcucugaagggucccugggaggccagaacagcggcauugggggacggucuagcgagaagcccacgggccucugguccaccgcgucuagccagcgcgucuccccugggcugcccagcccgaaucuugaaaacggagccccugcugugggccccguucaaccuagaacacccucuguguccgccccucuggcucucagcugcccccggcaagggggccugccgcgcucuaauuccggacuuggcggggaggucagcggagugauguccaaaccuaacguggacccccagcccugguuucaggacggcccuaagucuuaccugagcuccucugccccgagcuccagccccgccgggcucgauggaucucagcagggcgcugucccugggcugggccccaagccuggauguaccgaccugggcacagggcccaaacucuccccuaccagccugguucaccccgugaugucuacgcuuccggaacuguccugcaaggagggaccucucggcuggagcucugaugggagccugggauccgugcuucuggacagccccucuuccccuagaguccggcuccccugucagccgcuggugccuggccccgagcugagaccuagcgcggccgaacucaaacuggaggcucuuacacagcgccuggaacgggagauggaugcccaucccaaggccgacuauuucggggcuugcguuaaauguuccaagggcguguuuggagccggccaagcgugccaggcuauggggaaucucuaccacgauaccuguuucacaugcgccgccugcucuagaaaacugcgcggaaaggcuuuuuacuucgucaacggcaagguguuuugugaagaggacuuccuguauagcggguuucagcaguccgccgaucggugcuuccuuuguggacaucucaucauggacaugauucugcaagcucugggcaaaucuuaccaccccgggugcuucagauguguuaucugcaaugagugucucgauggcgugccuuuuaccgucgacagcgaaaacaagaucuauugcgugcgcgacuaccacaaaguccuggccccgaagugugcggccugcggacuucccauucugccucccgagggcuccgaugaaaccauccgggugguuucuauggacagagauuaucauguggaguguuaccacugcgaagacugcgggcucgagcugaaugaugaggacggacaucgcuguuauccucuggaagaucaccuuuucugccauagcugucacgucaaacggcucgagaagagacccuccagcacagcucugcaccagcaucacuuuuga

SEQ ID NO: 71504 - RNA, 384 nt, Artificial Sequence
  derived and/or modified sequence opt5 from LIMD2__Homo_sapiens__NP_085053
auguuccaggccgcuggcgccgcgcaagcuacccccagccacgacgccaaagggggaggcuccucuacagugcagagaagcaaguccuuuucucugcgggcccaggucaaggagacgugcgcugccugucagaaaaccguuuacccuauggaacgccucguggcugauaagcugaucuuccauaacagcugcuuuuguugcaaacacugucauacaaaacuuucccuggggucuuaugccgcgcuccacggagaguucuacugcaagccgcauuuucaacagcuguucaagagcaagggcaauuaugacgaaggguuuggaagaaaacagcacaaggagcuuugggcccacaaagaaguggaucccggcaccaagacagcuuga

SEQ ID NO: 71505 - RNA, 1842 nt, Artificial Sequence
  derived and/or modified sequence opt5 from LIMK1__Homo_sapiens__NP_001191355
augcugcucgccagcgcucccagacggcgcagauuccugcagcgggccaagugcugugacugcuccgcgucucuuagccaccaauacuaugagaaagauggccagcuguuuuguaagaaagacuacugggcucgcuauggggaauccugccauggauguucugagcagaucaccaagggccucgugauggucgccggggaacugaaauaccacccugagugcuucauuugucuuacaugcggaacguuuaucggcgauggggacaccuauacacugguugaacauagcaagcucuacuguggacacugcuauuaccagaccguggugacaccggucauugagcaaauccugcccgauuccccuggcucucaucugccccacaccgugacacucguuagcauuccugccuccagccacggcaagagagggcugucuguguccaucgaucccccucauggaccgcccggcugugggaccgagcacagccauacgguccgggugcagggaguugacccuggcugcaugucucccgacgugaaaaacuccauccacgucggggaucgcauucuugaaaucaauggaaccccuauuagaaacgugccccuggacgagaucgaucuccugauucaggaaacaagccggcuucugcagcucacccuggagcacgacccgcaugauacacugggccacggccucgggccugagaccucuccccuguccagcccugcuuacacgcccuccggagaagccggcucuagcgcucgccaaaagcccgugcuuagauccugcagcaucgaccggucuccuggggccggaucccugggcagcccggcgucucagcgcaaagaccucgggagaagcgagucccugcgggucguuugucgcccccauagaauuuuccggccuucugaucuuauccacggagaagugcugggcaagggcugcuuugggcaggccaucaaagugacacauagagagaccggagaagucauggugaugaaggagcucauucgcuucgacgaggaaacacagcggaccuuucugaaggagguuaaagugaugagaugucuggaacaccccaauguccucaaguucaucggcgugcuguauaaagauaagcgccuuaacuuuauuaccgaguacaucaaagggggaacacugcggggcauuaucaagagcauggacucccaauauccuuggagccagagaguuucuuucgcuaaagauaucgccuccgggauggcuuaccuccacagcaugaauauuauccaucgcgaccugaacucucacaauugccuugugcgggaaaacaagaaugucguggucgccgauuuuggccuggcgagacucaugguggacgagaagacgcagcccgagggacugcgcucccugaaaaagccggaucggaaaaagagauauaccguugugggcaacccuuacuggauggcccccgaaaugauuaaugggcgcagcuaugacgagaaagucgauguguucuccuuuggaaucguucucugugaaauuaucggccgggugaacgcugacccugacuaccugcccagaacaauggauuucgggcuuaauguccggggauuccuggaccgcuacugcccucccaacuguccgccuagcuuuuuccccaucaccgugagaugcugugaucucgaccccgagaagcggccuucuuuugugaagcuggaacauuggcuggagacacuuagaaugcaccucgccggccaucugccgcuggggccccaacucgagcagcuggaucgcggcuucugggaaaccuaucggagaggagaguccggccuuccugcucaccccgaaguuccugacuga

SEQ ID NO: 71506 - RNA, 2061 nt, Artificial Sequence
  derived and/or modified sequence opt5 from LIMK2__Homo_sapiens__NP_001026971
augggcagcuaccuguccgugcccgccuauuucaccucuagagaccucuuucggugcagcgagugucaggauucccugacaaacugguacuaugaaaaggacgggaaacuuuacugcccuaaggauuauuggggaaaauucggcgaguuuugucacgggugcucucugcucaugacgggaccguucauggucgcuggcgaauuuaaguaccaucccgaguguuucgccugcaugagcuguaaaguuaucauugaagacggggaugcguaugcucuggugcaacacgccacccuuuacugcggaaagugucauaaugaggugguccuggccccuauguuugagcgccucuccacagaaucugugcaggagcagcugcccuacagcguuacccugaucuccaugccugcuacaaccgaaggcagacggggcuucagcgugucugucgaguccgccugcagcaacuaugcuacaaccgugcagguuaaggaggugaaucgcaugcacauuucucccaacaauagaaacgccauccauccuggggaccggauucucgaaaucaauggaacgccgguccgcacccugagaguggaggaaguggaggaugcgaucucccaaacaagccagacccuucagcugcucauugaacacgaccccgucucucagcggcuggaucaacuucgccuggaggccagacucgcuccucacaugcagaacgccggccauccccacgcucuguccacacuggacaccaaagagaaucucgaagggacgcugcggcgcagaagccuucggcgcuccaacucuaucagcaaguccccuggacccagcucuccgaaagagccucugcucuuuuccagagauauuagccggucugaaagccugagauguuccucuagcuacucccagcagaucuuccgccccugcgaccuuauucauggcgagguucuggggaagggauuuuucggccaagccaucaaagugacacacaaggcgaccggcaaggugauggucaugaaagaacucauucggugcgaugaggagacacagaagaccuuucugaccgaagugaaaguuaugagaagccuggaccacccuaaugugcucaaguucaucgggguccuguauaaagacaagaaacuuaaccugcucacagaguacaucgaaggaggcacgcugaaggauuuccuucgcucuauggaccccuuucccuggcagcaaaaggugcgguucgccaaagggauugcuuccggaauggccuaucugcauagcauguguaucauucacagagaucucaauucucauaacugccugaucaagcuggacaaaaccguuguggucgcugauuuuggccucucccgccugauuguggaggaacggaagagagccccuauggagaaagccacaaccaagaagcgcacacuucggaaaaaugacagaaagaaacgcuacaccgucguggggaacccguauuggauggcucccgagaugcugaacggaaagagcuacgaugaaacgguugacaucuucuccuuuggcaucgugcucugugagauuaucggccaggucuacgcggauccugacugccugccccggacacuggauuucgggcuuaaugugaaacucuuuugggaaaaguucguuccuaccgacugucccccggccuuuuucccucuggcugccauuugcuguagacuggagcccgagucucgggccccucccggagcugccggcgaagggccuggaugcgcggacgaugagggccccgugcgcagacaggggaaggucaccaucaaauaugacccgaaggaacuccggaaacaccugaaccuugaggaauggauucuggagcagcucacaagacuguacgauugucaagaggaagagaucagcgaacuggagaucgacguggaugaacuucucgacauggaguccgaugacgcuugggccucucgcgugaaggagcugcugguugauugcuauaaaccuaccgaagccuuuauuagcggccuccuggacaagauccgggcuaugcagaaacuuuccacaccccagaagaaguga

SEQ ID NO: 71507 - RNA, 990 nt, Artificial Sequence
  derived and/or modified sequence opt5 from LIMS1__Homo_sapiens__NP_001180411
augaccugcaacauggccaaugcucuggccagcgcgacaugugagagaugcaagggcggguucgcucccgccgagaaaaucgugaacuccaauggagaacucuaccacgaacaguguuuugucugcgcccaauguuuccagcaguuuccugagggccuguucuaugaauuugaggggcggaaguacugcgagcaugacuuccagaugcuuuuugcuccguguugccaccaauguggagaguucauuaucggccgcguuauuaaagccaugaacaauucuuggcaucccgaaugcuuuagaugugaucugugccaggaagugcucgcugacaucggguucgugaagaacgccggacggcaccugugccgcccuugucauaauagagagaaagcgcggggccuuggcaaguauauuugccagaagugucacgccaucaucgaugagcagccccugauuuuuaaaaacgacccuuaccaccccgaucauuucaauugcgcuaacugugggaaggaacucacggccgacgcucgcgagcugaaaggagaacuguauugccucccuugucacgauaagaugggcgucccgaucugcggggccuguagacggcccauugagggacgcgugguuaaugcgaugggcaaacaauggcauguggaacacuuugucugcgccaagugugagaagccuuuccuggggcacagacauuacgagcggaaaggacuugcuuauugcgaaacccacuacaaccagcuguucggcgacgugugcuuucauuguaaucgcguuaucgagggcgauguggucagcgcccucaacaaggcuuggugcgugaauuguuucgccugcuccacauguaacaccaaacugacacuuaagaacaaauuuguggaguucgacaugaagcccgucugcaaaaaguguuacgaaaaguuuccucuggaacucaaaaagagacugaaaaagcuggccgagacccucgggcggaaauga

SEQ ID NO: 71508 - RNA, 1092 nt, Artificial Sequence
  derived and/or modified sequence opt5 from LIMS2__Homo_sapiens__NP_001129509
augaccggcagaaagcggaaauggggagagacagggacgggcagcggggccgcucccgccgcggcucugcgcugguccaacaugucugacgcccucgccaaugcugugugccagagaugucaagcccgguucagcccugcugaacgcaucgucaacuccaauggagagcuguaccacgaacauugcuuuguuugugcccagugcuucagaccguuucccgagggccuuuucuaugaauuugaggggcggaaguacugugagcacgauuuccagaugcuguuugcgccuugcuguggaucuugcggcgaguucauuaucggccgcgugauuaaagccaugaacaauaacuggcaucccggguguuuuagaugcgaacucugugacguggaacuggcugaucuuggauucgucaagaaugccggccggcaccugugccgcccuugccauaacagagagaaagcuaaggggcucggaaaguauaucugucagcggugccaccuggugauugacgagcaaccccugauguuucgcagcgaugccuaccacccugaccauuucaauuguacccacugcggcaaagaacucacagcggaggccagagaacugaagggggagcuuuauugucugccgugccaugauaaaaugggaguucccaucuguggcgcuugccggcgcccuaucgaaggcagaguggucaacgcccucgggaagcaguggcacguggagcacuuuguuugugcuaaaugcgagaagcccuuccugggacaucggcacuacgaaaagaaaggccuugccuauugugagacccauuacaaucagcuguucggggacgugugcuacaacugcucccacgucauugaaggagauguggugucugcccucaauaaggcuuggugugucagcugcuuuuccuguagcacaugcaacucuaaacugacccugaagaauaaauucguugaguuugacaugaagccuguguguaaaagaugcuaugaaaaguucccccucgagcugaagaaacgccuuaagaaacuguccgagcucacaagccggaaggcgcagccgaaagccaccgaucugaacucugcuuga

SEQ ID NO: 71509 - RNA, 753 nt, Artificial Sequence
  derived and/or modified sequence opt5 from LIN28B__Homo_sapiens__NP_001004317
auggccgagggcggggcuagcaagggaggcggggaagaacccggaaaacugccugaaccggccgaggaagagucccaggugcucagaggcaccgggcacugcaagugguucaacguccggaugggauuuggcuucaucucuaugauuaaucgcgagggcagcccccuggacaucccuguugauguguuugugcaucaauccaaacuuuucauggaaggguuuagaucucugaaggagggagaacccgucgaguucacauuuaaaaagagcuccaagggccucgagucuauucgggugacggggccuggaggcagccccugucugggguccgaacgcagaccuaaaggaaagacccuucagaaacggaagccgaaaggcgaccgcugcuacaacuguggcgggcuggaucaccaugcgaaggagugcagccugcccccucagcccaagaaaugucacuauugccagucuaucaugcauaugguugcuaauuguccucacaagaacguggcccaacccccggccuccagccagggaagacaggaagcugagucucagccuugcacauccacccucccccgggaagucggcgggggacacggcuguacaagcccucccuucccccaagaggcccgcgcugagauuucugaaagauccgggcggagcccucaggaggccuccucuaccaaaagcuccaucgcgccggaggagcagagcaagaaaggacccucugugcagaagcgcaaaaagacauga

SEQ ID NO: 71510 - RNA, 351 nt, Artificial Sequence
  derived and/or modified sequence opt5 from LIN52__Homo_sapiens__NP_001019845
augggcuggaagauggccagccccaccgacgggacagaucuggaggcuucccuccugucuuucgaaaaacuugacagagccagcccugaucuguggccggagcagcuccccggaguggcggaauuugcugccuccuucaagucuccuaucacgagcucucccccuaaauggauggccgagauugaacgggacgauaucgacaugcugaaggagcuuggcucccugaccacagcuaaccucauggagaaaguccgcgggcugcaaaaucuggccuaccagcucggacuggaugaaagcagagagaugacccggggcaaguuucuuaacauucuggaaaagcccaaaaaguga

SEQ ID NO: 71511 - RNA, 702 nt, Artificial Sequence
  derived and/or modified sequence opt5 from LIN7A__Homo_sapiens__NP_004655
augcugaagcccagcgugaccuccgccccuacagcugacauggccacgcucaccgucguucagccgcugacacuugauagagacguggcgcgggcuaucgagcugcucgaaaaacugcaagagucuggcgaagugcccguccacaaacuucagagccugaagaaggugcuccaguccgaguucugcaccgccauucgcgaaguuuaccaguauaugcaugagacaaucaccgugaacggguguccugaguuuagagcccgggcuacagccaaagcuaccgucgccgcguucgccgcuucugaaggacacagccauccccgcgugguugagcugccuaagacggaugaaggccugggguuuaaugugaugggaggcaaggagcaaaacucccccauuuacaucucuagaauuaucccugggggagucgccgagcggcacggcggccucaaacgcggggaccagcugcuuagcgugaauggaguguccgucgaaggcgagcaucacgaaaaggcuguugagcugcucaaagccgcgaaggauagcgugaaacugguggucagauauaccccgaaggugcuugaagagauggaggcccgguucgaaaagcugcgcacagcuagacggcgccagcagcaacagcuccugauccagcagcaacagcagcaacagcagcagcaaacccagcagaaccacaugucuuga

SEQ ID NO: 71512 - RNA, 624 nt, Artificial Sequence
  derived and/or modified sequence opt5 from LIN7B__Homo_sapiens__NP_071448
auggccgcucugguggagccccucggccuggaaagagacgucagccgggccguugagcuucuggaacgccuccagagauccggggagcugccuccgcaaaaacuucaggcgcugcagcgggugcuccagucucgcuucugcagcgcuaucagagaaguguacgagcaacuguaugauacccuggacauuacaggauccgccgagauccgggcccacgcuacggccaaggcuaccgucgccgcguuuacagccucugaaggccaugcucacccccgcgugguugagcucccuaagaccgaugaagggcugggauucaacauuaugggcgggaaagagcagaauagccccaucuacauuuccagagugaucccuggaggcgucgccgaccggcauggcgggcuuaagcgcggagaucagcugcucucugugaacggcguuagcguggagggggaacagcacgagaaagcugucgaacugcuuaaggccgcgcaaggauccgugaagcugguggucagauauacaccccggguucucgaggaaauggaggcccgcuuugagaaaaugagaagcgcucggcgcagacagcagcaucagucuuacuccagccuggaaucucggggcuga

SEQ ID NO: 71513 - RNA, 594 nt, Artificial Sequence
  derived and/or modified sequence opt5 from LIN7C__Homo_sapiens__NP_060832
auggccgcucugggcgagcccgugagacucgaacgggacaucugccgcgccauugagcugcuugaaaagcugcagagaagcggggaggucccuccgcaaaaacuccaggcgcugcagcggguucuucaguccgaguucuguaacgcugugcgcgaaguguacgagcacgucuaugaaaccguggauaucucuagcucccccgagguuagagccaaugccacagcuaaggccacgguggcugccuuugcggccucugaaggacauagccacccucgggucguggagcugcccaaaaccgaggaaggccucggguucaacauuaugggaggcaaggagcaaaauuccccuaucuacauuucucgcaucauccccgggggaauugcugacagacauggcggccugaaacgcggggaucagcugcucagcguuaacggaguguccgucgaaggcgagcaccaugaaaaggccguggagcugcuuaaggcugcccaggggaaagugaagcuggucguucgguauacaccuaaagugcucgaggaaauggagagcagauuugaaaagaugcggucugcgaaacgcagacagcaaaccuga

SEQ ID NO: 71514 - RNA, 1572 nt, Artificial Sequence
  derived and/or modified sequence opt5 from LIN9__Homo_sapiens__NP_001257338
augcacagaggcgggcagccccugaagaaacggcgcgggagcuucaagauggccgagcucgaccaacugccugaugaauccucuagcgcuaaagcccuugugucccugaaggagggcucucucagcaacaccuggaaugaaaaauacuccucucugcagaagacaccggucuggaaggggagaaacacgagcuccgcgguugagaugaaauuuaccgcuacaaugagcacccccgacaagaaagccucucagaagaucggauuccggcuucgcaaucugcucaaacugccuaaggcccauaaguggugcauuuaugaaugguuuuacuccaacaucgauaaaccccuguucgagggcgacaaugauuuuugugugugccucaaggagagcuucccuaaccugaaaacaagaaaacuuacccggguggaaugggggaagauucgcagacugaugggaaagccccggcgcuguucuuccgcuuucuucgaggaagagagaagcgcccucaaacagaagcggcaaaagauccgccugcuucagcagagaaaagucgcugacgugucucaguuuaaggaucugccugacgagauuccgcucccccugguuaucggcacaaaagugaccgcccggcugcgcggcguccacgauggacucuucacgggacaaaucgacgcgguggauacccugaaugccacauauagaguuaccuuugaccggacaggccuugggacccauacgauuccugauuacgaagugcuguccaacgagccccacgaaacaaugccuaucgcugccuucggacagaagcagagacccagccgcuuuuucaugaccccgccucggcuccauuauacacccccucugcagucccccauuaucgacaaugacccccuucugggccaaucuccuuggagaagcaaaauuuccgggagcgauaccgagacccucggaggcuucccggucgaauuucugauccaggugacacgccugucuaagauucucaugaucaagaaagagcacaucaagaaacugcgggagaugaacacggaagcugagaaacuuaaguccuacagcaugcccauuucuaucgaauuucagagacgcuaugccaccauugugcuggagcucgaacaacugaauaaggaccuuaacaagguccugcacaaaguucagcaguacugcuacgagcucgcgccugaucagggccugcaacccgccgaccagccuacagauaugcggagacgcugugaggaagaggcucaggaaaucgugcggcaugccaauagcuccaccgggcagcccugcguggagaacgaaaaucugacagaccucauuucuagacugaccgcuauccuucugcaaaucaagugucucgccgagggaggcgaucugaacagcuuugaguucaaaucccugacggacagccuuaacgauauuaagucuacaaucgacgccuccaauauuagcugcuuucagaacaaugucgaaauccacguggcucauauucagucugggcucucccagaugggaaaccugcacgcguucgccgcuaauaacaccaaucgcgauuga

SEQ ID NO: 71515 - RNA, 1845 nt, Artificial Sequence
  derived and/or modified sequence opt5 from LINGO1__Homo_sapiens__NP_001288126
augcuggccggcggggugagaagcaugcccuccccucuccuggcuugcuggcagccgauccuucugcucguccugggaucuguucuuagcggcuccgccaccgggugucccccucggugcgaguguucugcgcaagaccgcgcugugcugugccacagaaagcgguucguggccguccccgaaggaaucccuacagagacgcgccuccuggaucugggcaaaaacagaauuaagacccucaaucaggacgaauuugccagcuucccccaucuggaggaacuugagcugaacgagaauauuguguccgcuguugaaccuggggccuuuaacaaucucuucaaccugcggacacuuggacugcgcucuaauagacucaaacugaucccgcugggcguguuuaccggccucagcaaccugacaaaacuugauauuuccgagaauaagaucgucauccugcucgacuacauguuccaggaucuguauaaccuuaagagccuggaagugggggacaaugaucucguuuacauuucucaccgggcuuuuuccggacugaacagccuggagcagcucacccuggagaaguguaaucuuacaucuauccccaccgaagcccugucccaucuccacggccugauugugcuucgccugagacaucucaacaucaaugcgauucgggacuauagcuucaaacgccuguacagacugaagguccucgagaucucucacuggccuuaucuggauacgaugacccccaacugccuuuacgggcugaaccucacaucccugagcauuacccacuguaaucugacagccgugccuuaucuugcugugcggcaucucgucuaccugcgcuuucugaaccucuccuacaaucccaucucuaccaucgaaggaagcaugcugcacgagcuucugagacuccaagaaauucagcugguuggcgggcagcuggccgugguggagccguaugcuuuccggggacuuaacuaccucagaguccugaauguguccggcaaccagcugacgacacucgaggaaagcguuuuucauucugugggcaaucuggagacccuuauccuggacuccaacccucucgccugcgauugucgccugcugugggucuuccggagacgcuggcggcuuaauuuuaacagacaacagcccacaugcgcgaccccugaauuugugcaggggaaagaguucaaggacuuccccgauguucuccugcccaauuauuucaccugucgccgggcccgcauuagagaccggaaagcucagcaaguguuugucgacgaaggacacacagugcaguucgucugcagagccgauggcgacccuccgcccgcuauccuguggcucagcccucgcaagcaccuggugucugccaagagcaacgggcggcuuacgguuuuucccgauggaacccuggaggugagauacgcccagguccaagacaauggcacauaucucugcauugcugcgaacgccgggggaaaugauuccaugccugcucaucugcacgugcggucuuacagccccgacuggccgcaucagccuaacaaaaccuucgccuuuaucuccaaccagcccggcgagggcgaagccaauagcacacgcgcuaccguuccuuuccccuuugauaucaagacgcugauuaucgccacaaccaugggguucauuucuuuucuuggagugguccucuucugucuggugcugcucuuucugugguccagaggcaaagggaacaccaagcacaauaucgagauugaauaugugccucggaaaagcgacgcgggaaucucuuccgcugaugcccccagaaaguucaacaugaaaaugaucuga

SEQ ID NO: 71516 - RNA, 1821 nt, Artificial Sequence
  derived and/or modified sequence opt5 from LINGO2__Homo_sapiens__XP_011516032
augcugcacaccgccaucagcugcuggcagcccuuccucggccuggcugugguccuuauuuuuaugggguccacaaucggauguccugccagaugcgaguguucugcgcaaaacaagagcguuuccugccaucggcgcagacugauugcuaucccggaaggcauucccaucgagacgaaaauccucgaccugucuaagaaucggcuuaaaagcgugaacccugaagaguucauuuccuacccccugcucgaagagaucgaucugucugacaauauuaucgccaacguggagccuggggccuuuaauaaccuguucaaucuccgcagccugagacuuaagggaaaccggcugaaacucgucccccugggcguguuuaccgggcuuuccaaucugacaaagcucgauauuagcgaaaacaagaucguuauucugcuggacuauauguuccaggaucuccacaaucugaaaucucuugaggugggagacaacgaucuggucuacaucucccaucgcgcuuuuagcggccuccugucucuugaacagcugacccucgagaaguguaaucugacagccgugccuaccgaggcucugucccaccucagaagccugaucucucuucaucugaaacaccucaacauuaauaacaugccgguuuaugccuucaagcggcuguuucaccuuaaacaucuggaaaucgacuacuggccccuccuggauaugaugccugcgaacucccuguauggccucaaucugacaagccuuuccgugaccaacacgaaucugucuaccguccccuuccucgccuuuaagcaccugguguaccugacacaucuuaaccucagcuauaauccuauuuccaccaucgaggcugggauguucagcgaccugauucgccugcaggaacuccacaucgugggagcccaacugagaacaaucgagccccacucuuuucagggccuucgguuccugcgcguccucaacguuucccagaaucugcuggaaacccuugaggagaacguguucagcucuccgagagcucucgaagugcugagcauuaauaacaauccucuggccugcgauugucggcuccuguggauccuucagcgccaacccacgcugcaguuugggggacagcagccuaugugcgcgggccccgacacaauuagagagcgguccuucaaggauuuucauucuaccgcccucagcuucuacuuuacauguaaaaagcccaaaaucagagaaaagaaacugcaacaucugcuugucgacgaggggcagaccgugcagcucgaaugcuccgcugacggagauccucaaccgguuauuagcugggugacaccccgccggagauucaucaccacgaagucuaacggccgcgccaccguccugggcgacgggacacuggagauccgguuugcucaggaucaggacuccggaauguacguguguauugccagcaaugccgcuggcaacgauaccuucacagcgucucucaccguuaaaggguuugccuccgacagauuccuguaugcuaaucgcacgccuauguacaugacagauagcaacgacaccaucuccaacggaaccaaugccaacacauuuucucuugaucugaagaccauucucgugagcacagccaugggcugcuucacguuucugggggucgugcuguucugcuuccuucuccuguuugucuggucccggggaaagggcaaacacaaaaauucuaucgaccuggaguaugugcccagaaagaacaauggcgcuguuguggaaggggaggucgccggaccucgccgguucaacaugaagaugauuuga

SEQ ID NO: 71517 - RNA, 1782 nt, Artificial Sequence
  derived and/or modified sequence opt5 from LINGO4__Homo_sapiens__NP_001004432
auggacgccgcuaccgcccccaagcaggcguggccuccguggcccccucuccucuuccugcuucugcuccccggcgggagcggaggcuccugcccugcugugugugauugcacaucucaaccccaggccguccugugugggcacagacagcuugaggccguuccuggaggccugccgcucgacacggaacugcuggaucucagcgggaaccggcuguggggacuucagcaaggcaugcugucccgccucucucugcuucaggagcuggaccucagcuacaaucagcuguccacccuggaacccggcgcuuuucaugggcuccagucucugcuuacacugagacuccaaggaaaccggcugcgcaucaugggcccugggguguucagcggacuuuccgcccugacccuccuggaucugagacucaaucagauugugcuguuucuugacggcgcuuucggggagcugggaagccuccagaaacuggaagucggcgauaaccaccuuguguuuguugcccccggcgcguucgccgggcuggcuaagcucucuacacugacccuggagcggugcaaucucuccacagugccuggacuggcccuugcucgccugcccgcccucgucgcgcugagacugcgggagcuugacaucggccgccucccggccggggcucugagaggacugggccagcucaaagaacuggagauucaucuuuggccuagccuggaagcccucgaucccgggucucuggugggacugaaccuuuccagccucgcuaucacccgguguaaucugucuuccguuccuuuucaagcccuguaucaccucagcuuccugcgcgugcuugaccugucccagaaccccauuucugccauccccgcuagacggcucagcccucugguccgccugcaggagcuuagacucuccggcgcgugccugacgagcaucgccgcucaugccuuucacggccugaccgccuuccaccuccuggauguggcugacaaugcccuucaaacacuggaggaaaccgcguuuccgucucccgauaagcucgugacacugcggcuguccgggaacccucuuaccugugacugcagacuccuguggcugcuccgccugcggagacaucuugacuucggaaugucucccccugcuugugccggcccccaccauguccaggggaaaagccugaaggaguuuagcgauauucucccgccuggacacuucacgugcaagcccgcccugauccgcaaauccggcccucgguggguuauugcugaagaagggggccacgccguguucucuuguagcggagacggcgaucccgcuccuacaguguccuggaugagaccccauggggccuggcugggacgcgcgggccgggucagagugcuugaggacgggacccuggagauccgcagcguucagcuccgggauagaggagccuacgugugcgucgugucuaauguugcuggcaacgacucccugcgcacauggcucgaggugauucaggucgaaccgccuaaugggacccugagcgaucccaacaucaccgugcccggcauuccuggaccguuuuuccuugacucucggggcgucgccauggugcuggcuguuggguuucuccccuuccugacauccgugacgcugugcuuuggacuuaucgcccuguggagcaagggcaaagggagagucaagcaccauaugaccuucgauuuuguggcgccucggcccuccggagacaaaaauucuggcgggaaccgcguuacagccaagcuguucuga

SEQ ID NO: 71518 - RNA, 2274 nt, Artificial Sequence
  derived and/or modified sequence opt5 from LINS__Homo_sapiens__NP_001035706
augaagguguucugcgagguccuggaggaacucuacaaaaagguucugcuuggcgccacccuggaaaacgacagccacgauuauaucuuuuaccucaaucccgcuguguccgaccaagauuguucuacagccacgagccuggagugggcgaauaccugcgggauucaaggaagacaucagccuaucuccgugggcgucgcuccgauugccguggcccccguuugucuuaaaacaaauucucagaugagcgggucccgggaagugaugcugcuccagcugaccgucaucaaggugaugacaacccgcauucugucuguuaaaacagaguuccacgcuaaggagcaauauagagacgugaucaagauccuccuggaaagcgccaaagucgauuccaaacuuauuugcauguuucagaacagcgacaaacugcucucucauauggcugcccagugucuggcgcuucugcucuacuuccagcugcgggagaagaucacccuguccaauagcuggauugccuuuugccaaaagaaccucucugaauauuccgagagcaauaaggcuaucuacugucuguggacgcuuaccgccauuaucaaggagauuuucaaagauucuugcucccagaagacagaaauccugaaacaguuucucacccacuucgacacaaucuuugagguguucuauaacagccuguuuucccagcauuucgaaaauugucgcgauaccucuaagauugugaacauccuuaugugcuuucuggaccuccuggagcugcucauugcuagcagaauccaccugaaacuucacuucacgugucaacggauucuguuccucaagccuuccugcaugcuggaagucaucacauggcccauccaggccuuuguuaaacgcaaggugauuaucuuccuuaagaaaugccugcucuguaaggugggagaggaucugugcagaggcagcgucccugcgcugaugcccccugaccaucacguggccguugauaugcucgcucuggccaaugcugugcuucaggccgucaacucugggcugcucaaaacccuguccguguacgagaagcauagcuuuuucggaggcgacgaaguucaaccggagugugaacugauuacaucucccgaccacgugauccuucgggccgcuagccucgucauuaugaaaucccuggagaucaaguuucagaauuacucuagcgcguccgaaaugaagguggaucugcagcgcuucaugagcgagcuccugaccuuucuuaaaccucaucugcagcccucucuccaacugcacaacccuugcaaguggcuguccagagucuucaucgagcaggacgaugacaugcuugaagccgcuaaagccagccucggcauuuaucugacccugacacgggggugugaggccacggaaucucucacccagggaaaggagaugugggaucaccauacacacgaaaauggcuacaacccccauugcaucuuucuguucuuucuuaaaaacauuggguucgacuccaccgugcugcucgauuuucugaucagcuccgagacauguuuccuggaguauuucguucgcuaccuuaagcuccugcagaaggacugggauaacuuuuucaccauuugcaacaauuuugacgcuacggaaucuaaauaugauaucagcauuuguggaugcgugccgucccugguccaagaccagucuagcaaccagacaaucccucacagacucaccgcgccccacucccaucgggacgugugugcccgccacagcugggcuucugaugccccuuccgagccccugaaggccguuaugagcaaaggcgcucauaccaugugcgccucuucccuuagcucucccagagcuagccagucccugguggacuacgauagcucugacgauuccgacgucgaaagcacagagcaaugccucgccaauuccaagcagaccucucugcaccagcaggcgacaaaagagauccaagaugccgcugggacgagccgggacaagaaggaguucucccuggaaccuccgucuagaccccuugugcucaaagaauuugauaccgccuucagcuuugacugugagguggcuccuaacgauguugucuccgaagugggaauuuucuaucgcaucgugaagugcuuucaggagcugcaggacgccauuugucggcugcagaaaaagaaucucuuccccuacaacccuacagcgcugcuuaaacugcucaaguacaucgaggucauuucuaauaaaaccaugaacacacuguga

SEQ ID NO: 71519 - RNA, 1200 nt, Artificial Sequence
  derived and/or modified sequence opt5 from LIPA__Homo_sapiens__NP_000226
augaagaugagauuccugggccucguggucugccugguucuuuggacccugcacagcgagggguccggaggcaaacucacagccguggaccccgaaacgaacaugaaugugucugagaucauuagcuacuggggguuuccuuccgaagaguaucuggucgaaaccgaggauggauacauccuuugucugaaccggauuccgcauggccgcaagaaucacucugacaaagggcccaagccugugguuuuccuccagcauggacugcuggcugauagcuccaacugggugacaaaucucgccaacucuagccugggcuuuauccuugcggacgcuggcuucgaugucuggaugggaaauuccagagggaacaccuggagccggaaacacaagacacugucugugucccaagacgaguuuugggccuucagcuaugaugaaauggccaaguacgaccuccccgcuucuauuaauuuuauccugaacaaaaccggccaggagcagguuuauuacguggggcauucccagggaacaaccaucggcuucauugccuuuagccaaaucccugaacuugcuaagcgcauuaaaauguucuuugcccuggggcccgucgcgucuguggccuucugcacguccccuauggcuaagcucggaagacugccggaucaccugaucaaagaccucuuuggcgauaaggaguuccugccccagagcgccuuccuuaaguggcugggcacccacguguguacacaugucauucucaaagagcugugcgggaaucuuuguuuucugcucugcggauucaacgaacggaaucugaacaugucccgcguugacguguauaccacacacucuccugcuggcaccagcgugcagaauaugcugcauuggucccaggccgucaaguuucaaaaauuccaggcguuugauugggggagcucugccaagaacuacuuccacuacaaccaguccuaucccccuacguacaaugugaaagacaugcucguucccacagcuguguggagcggaggccacgacuggcuggccgaugucuaugacgugaacauccuucugacccagauuacaaaucucguuuuucaugagucuaucccggaaugggagcaccuggauuucaucugggggcuugacgcuccuuggagacuguacaacaagauuaucaaucucaugcggaaauaucaauga

SEQ ID NO: 71520 - RNA, 1500 nt, Artificial Sequence
  derived and/or modified sequence opt5 from LIPC__Homo_sapiens__XP_005254429
auggacaccagcccccugugcuucuccauccuccuggugcuuuguauuuuuauccagucuagcgcccugggccaaucccucaagccugagccguucgggagacgggcucaggccgucgaaacaaacaaaacgcugcacgagaugaagacccgcuuucuucuguucggagaaacaaaucagggcugccagauuagaaucaaccaucccgauacccuccaagaguguggguuuaauucuagccugccucugguuaugauuauccacggaugguccguggacggcgugcucgaaaacuggaucuggcagauggucgcggcucugaaaucucagcccgcccagccugugaauguugggcuuguggauuggauuacacuggcccaugaccacuacaccaucgcuguccggaacacacgccucgugggaaaggagguugccgcucugcuuagauggcuggaggaaagcgugcaacucucccggagccauguccaccugauuggcuauucucugggcgcccacguguccggguucgcgggaagcucuaucggcgggacccauaaaauuggacgcaucacgggccucgaugccgcugggccccuguuugagggauccgccccuagcaauagacuuucuccggacgaugcuaacuucguggacgccauucacaccuuuacacgggaacauaugggccuguccgucggcaucaagcagcccaucgggcacuacgauuucuauccuaauggaggcagcuuucagcccgggugccacuuccucgagcuguaccgccauauugcgcagcacggauuuaacgccaucacccaaacaauuaaguguucccaugagagaucuguucaccuuuucaucgacagccugcuccaugcuggcacccaguccauggccuauccuugcggggauaugaauagcuucucucagggacugugucuguccugcaaaaagggccgguguaacacgcucggcuaccacgugcgccaagaacccagaagcaaaucuaagcggcuguuucuugugacacgcgcucagagcccguucaaagucuaucacuaccaguuuaagauucaguucaucaaucaaaccgagacaccuauccagaccaccuuuacaaugucccugcucgggacgaaggagaaaaugcagaagauucccaucacccugggaaaaggcauugccucuaacaagacauacagcuuccuuaucacccuggacguggauauuggggaacucaucaugaucaaauuuaagugggaaaauuccgccguuugggcuaacgugugggacacaguccagaccauuaucccuuggagcacgggacccagacauucuggccuggugcugaaaacaauucggguuaaggcgggggagacccaacagagaaugaccuucugcuccgagaacacagacgaucuccugcuucgccccacccaggaaaagaucuuugugaaaugugagauuaagagcaaaacaucuaagcggaaaaucagauga

SEQ ID NO: 71521 - RNA, 3231 nt, Artificial Sequence
  derived and/or modified sequence opt5 from LIPE__Homo_sapiens__NP_005348
auggagcccggcagcaaguccgugucuagaagcgacuggcagccugaaccgcaccaacggcccaucaccccucuggagcccgggccugagaaaacacccauugcccagccugaauccaagacgcuccagggaucuaacacccagcaaaaaccggcuagcaaucagcgcccccugacacagcaggaaaccccugcccaacaugaugcggagucccagaaggagcccagagcucagcagaaaucugccagccaagaagaguuccuugccccucagaagcccgcuccgcagcaauccccuuacauccagcggguccugcucacacagcaggaagccgcuagccaacagggccccgggcugggaaaggagucuauuacccagcaggagccugcccuucgccaaagacacguugcgcagcccggccccgggccuggagaaccgcccccugcccagcaggaggcugaauccacacccgccgcucaagccaaaccuggcgcgaagcgggagcccagcgccccgaccgaaucuacgucccaggagaccccugagcagagcgacaaacagacaacccccgugcaaggcgcuaagucuaaacaggggucccugacagaacucggauuucugaccaagcugcaggagcucagcauccaacgcuccgcccuggaauggaaggcucuuucugagugggugacggauagcgaauccgagagcgacgucgggucuuccagcgauacagacucuccugccaccaugggcggaaugguggcccagggcguuaaacugggguucaagggaaaaagcggcuauaaggugauguccggcuacucugggacaagcccccaugagaaaaccuccgcuagaaaccaccggcauuaucaggauaccgcgagccgccucauucacaauauggaccugagaacaaugacgcagucucuugucacccuggccgaagauaacaucgccuuuuucuccagccaaggaccuggcgagacagcucagcggcucucugggguguuugccggaguucgcgaacaggcucugggccuggagcccgcccucgggagacugcuuggaguggcgcaccuguucgaccucgauccggaaaccccugcuaauggcuaccggucccugguccauacagcccgcugcugucuugcccaccuucuccauaagagcagauauguggcuuccaaccggagaucuaucuuuuuccgcaccagccacaaucuggccgagcuggaggcuuaccucgccgcgcugacgcagcuucgggcccugguguauuacgcucaaagacuccuggucacaaaccgccccggcguucuguuuuucgaaggggacgagggacugaccgccgauuuucuccgggaauacgugacccugcacaaaggcugcuucuaugggagaugucugggauuucaguucacacccgcuauucgcccuuuccuccagaccaucuccauuggccuggugucuuuuggggagcauuacaagcggaaugagacaggccuuagcgucgccgcguccagccuguucacgucuggaagauuugccaucgacccggaacuccgcggcgcugaguucgaacggauuacccagaaccuggacgugcacuuuuggaaggccuucuggaauaucacagagauggaaguucuguccagccuugcuaacauggccucugccaccgugagagucucccgccuccugagccugcccccugaggcuuuugagaugccccucacagcggauccuacccugacggugaccauuucucccccucuugcccauacagggcccggaccgguucuggugcggcucaucagcuaugaccugagagaaggccaagauuccgaggaacugagcucucuuaucaaauccaaugggcagcggagccucgagcuguggccucgcccccagcaagcuccuagaucccggucucugauuguccacuuccauggaggcggguuuguggcccagaccagcagaucccacgaacccuaccucaagucuugggcccaggagcugggcgcuccgaucauuagcaucgacuauucccuugccccugaggcgcccuucccucgcgcucuggaagagugcuuuuucgccuacuguugggccauuaaacacugcgcucuccugggaucuacaggcgaacggaucugucuggccggggauagcgcgggaggcaaccuuugcuuuaccgucgcucucagagccgccgcuuauggggugcgcguucccgacggaaucauggccgcuuaccccgccacgaugcugcagccugcggccuccccgagcagacugcucucucugauggauccccuucugccucucuccgugcugagcaagugugucucugcuuacgccggcgcuaaaacagaggaccauuccaauagcgaucaaaaggcccuggggaugaugggccuugugcggcgcgacaccgcccuccugcugagagauuuccggcucggagcuucuuccuggcugaacagcuuccuugaacuguccggccgcaagagccagaaaaugucugagcccauugcggagccuaugagacggagcguuuccgaagccgcucucgcccagccccaggggccucugggaacagacucucugaagaaccuuacccugcgcgaccucagccugagaggcaauuccgagaccucuagcgauacaccggaaaugucccucucugccgagacgcugagccccuccaccccuagcgacgugaacuuucuucugcccccugaggaugcuggggaagaggccgaagcgaaaaaugagcucucucccauggaccggggacugggcguccgcgcugccuucccggaaggguuucacccuagacgguccagccaaggcgccacacagaugccccuguauucuucccccaucgugaagaacccuuucaugagcccccuucuggcuccugauuccaugcucaaaucucugccgcccgugcauauuguugccugcgcgcucgacccuaugcuggaugacagcgucaugcuugcuagacgccugcggaaucucggacagcccgugacccugagaguggucgaggaucugccucacggcuuucuuacacuggccgcccucugucgcgagacccggcaggcugccgaacugugcguggagagaauccgccucguucugacgcccccggcuggggccggaccuuccggcgaaacaggggcggccggaguggacggcggcugcgggggacggcacuga

SEQ ID NO: 71522 - RNA, 1098 nt, Artificial Sequence
  derived and/or modified sequence opt5 from LIPF__Homo_sapiens__NP_001185757
auguggcugcuccugaccauggccagccuuaucuccgugcugggcacaacgcacgggcuuuucggaaagcugcaucccggcucuccugaggucaccaugaacauuagccagaugaucacauacuggggguauccgaaugaagaguacgaaguugugaccgaggacggauauauucuugaagugaacagaauccccuacggcaaaaagaacuccgggaauacagaugccggauaugacgucuggcugggcaauucucggggcaacaccugggcccgcagaaaucucuacuauagcccugauuccguggaguuuugggcguucucuuuugacgagauggcuaaauacgaucugcccgccacaauugacuucaucguuaagaaaaccgggcaaaagcagcugcacuacgugggacauagccagggcacgaccaucggguuuauugccuucuccacaaacccuagccucgcuaagcggaucaaaaccuuuuaugcccuggcucccgucgccacagugaaguacaccaaaucucuuauuaauaagcugcgcuucguuccucagucccucuuuaaauucaucuuuggagauaagauuuucuauccgcacaacuuuuucgaccaauuccuggcgacggaagugugcagcagagagaugcuuaaucugcucuguucuaacgcccuguuuaucauuugcggcuucgauuccaagaauuuuaacacaagccggcuggacgucuaccucucucauaaucccgcugggaccuccgugcagaacauguuccacuggacacaggccgugaaaagcggaaaguuucaggcuuaugauuggggcuccccuguccaaaaccgcaugcacuacgaccagucucagcccccuuauuacaauguuaccgccaugaacgugcccaucgcgguguggaauggcgggaaagaucugcuugccgacccgcaggacgucggacugcuccugccuaagcuccccaaccugaucuaccauaaagaaauuccuuucuauaaucaccucgauuuuaucugggcuauggacgcuccccaagagguguacaacgauauuguuagcaugaucuccgaggacaagaaauga

SEQ ID NO: 71523 - RNA, 1503 nt, Artificial Sequence
  derived and/or modified sequence opt5 from LIPG__Homo_sapiens__NP_006024
augagcaacuccgugccccugcucugcuucuggucucuguguuacugcuuugccgcuggcagcccugucccguucgggcccgagggaagacuugaagacaagcugcacaaaccuaaggccacccagacagagguuaaacccuccgugcgguuuaaucuccgcacgucuaaggauccugaacaugagggcuguuaucugagcguggggcacucccaaccccuugaagacugcucuuucaacaugaccgcgaaaacauuuuucaucauucauggauggaccaugagcggcaucuuugagaauuggcugcacaagcucgucuccgcucugcauacaagagagaaggaugccaacgugguuguggucgacuggcugccucucgcccaccagcuguacaccgaugcugugaauaacacacggguuguggggcacagcauugcccgcaugcuugacuggcugcaggaaaaagaugacuucucucucggaaauguccaucugaucggcuauucccuuggcgcucacguggccggguacgcgggaaacuuugugaagggcaccgucgggagaauuacgggacuggauccggccggccccauguucgagggggcugacauccauaaacggcucagcccugaugacgccgauuuuguugacgugcugcacaccuauacacgcucuuucggacuguccaucggcauucagaugcccgugggccacaucgacauuuacccuaaugggggagauuuucaacccggcugugggcucaacgacguccugggaagcaucgcuuauggcaccauuacagaagugguuaagugcgagcaugagagagccgugcaccuuuucgucgauucucuggugaaucaggacaaaccguccuucgcguuucaguguaccgauagcaaccgguucaagaaggggaucugccucuccugucgcaaaaauagaugcaacucuauuggauacaaugccaagaaaaugcggaacaagcgcaacagcaaaauguaccugaagacgagagcuggcaugccuuuucggguuuaucauuaccagaugaaaauccacguguucuccuauaagaauaugggcgaaaucgagcccacauuuuacgucacccuuuaugggacaaacgccgacagccaaacccugccucucgaaauuguggagcgcaucgaacagaaugcuaccaacacauuccuggucuacacggaggaggaucugggagaccuccugaagauucagcuuaccugggaaggcgccucucaguccugguauaaucuguggaaagaguuuagaagcuaccucucucaaccccggaaccccgggagagaacugaauauccgccggauuagaguuaagagcggagagacacagcgcaaacuuaccuucuguacagaagauccugagaacaccuccaucucuccgggccgggagcugugguuuagaaagugccgcgacggguggcggaugaaaaaugaaacgagccccacaguggagcucccuuga

SEQ ID NO: 71524 - RNA, 1356 nt, Artificial Sequence
  derived and/or modified sequence opt5 from LIPH__Homo_sapiens__NP_640341
augcugagauucuaccucuuuaucagccugcuuugccugucccggucugacgccgaggaaaccugucccagcuucacacgccucuccuuucacucugcuguggucggcacggggcugaacguuagacuuaugcuguauacccggaagaaucucacaugcgcccagaccauuaacagcuccgcguucggaaaucugaacgugaccaaaaagacaacauuuaucgugcauggcuuccgcccuaccgggucuccgcccgucuggauggaugaccuggugaaaggacuccugagcguugaggauaugaauguggucgugguugacuggaacagaggcgcuacgacccuuauuuacacacacgccuccagcaagacccggaaaguggccaugguccugaaggaauuuaucgaucaaaugcucgcugagggggccucucuggacgauauuuauaugaucggagugucccuuggcgcucauaucagcggcuucgugggggaaauguacgacggauggcugggccgcauuacagggcucgauccugccggaccccuguuuaauggcaagccucaccaggacagacuggaucccucugacgcgcaguucgucgauguuauccauuccgacaccgacgcccucggguauaaagagccucugggaaacauugauuuuuacccgaauggcggccuugaccagcccggguguccuaagacgauccugggaggcuuccaauauuuuaaaugcgaucaccagcggagcguguaccucuaccugucuucccuucgcgagagcuguacaauuaccgcuuaucccugcgacuccuaccaggauuauagaaacgggaagugugugucuugcggaacaagccagaaagaauccuguccucugcucggcuacuaugccgacaauuggaaggaucaucugcgggggaaggaucccccgaugaccaaggcuuucuucgacaccgccgaggaaagcccuuuuugcauguaccacuauuucgucgacaucauuacauggaacaaaaaugugcgcagaggagauaucacgaucaaacugcgggacaaggcgggcaacaccacagagucuaaaauuaaucacgagcccaccacauuucaaaaguaccaucagguuucccuccuggcccgcuucaaccaggaccuugauaaaguggcugccaucagccugauguuuucuaccggcagccucauugggccuagauacaagcugcggauccuuagaaugaagcugcgcucccucgcucaccccgaacggccccagcuguguagauaugaccugguccucauggagaacguggaaacgguuuuccaaccuauucugugcccggagcuucagcuguga

SEQ ID NO: 71525 - RNA, 1383 nt, Artificial Sequence
  derived and/or modified sequence opt5 from LIPI__Homo_sapiens__NP_001289927
augagaguguacaucuuccugugccucauguguuggguccggagcgacaacaagcgccccugccuggaguuuucccagcuuucuguuaaagauagcuucagagaccuguuuauuccucggaucgaaaccauucucaugauguauacacgcaauaaccugaauugugccgagccgcuuuucgaacaaaacaauucccugaacgugaauuuuaacacgcagaagaaaaccguguggcucauccacggcuacagacccgucgggucuauuccucuguggcugcagaauuucgugcggauccuccugaacgaggaagauaugaauguuaucguggucgacuggagccgcggagcuacaaccuuuauuuauaacagagccgugaagaauacacggaaaguugcggugucccuuucuguccauaucaagaaccugcucaagcacggcgcuagccuggauaauuuccauuuuauuggggugucccuuggagcccacaucagcggcuucguggggaaaauuuuucauggacagcugggccgcaucaccggccucgaccccgccgggccuagauucucucggaagcccccuuacucccgccuggauuauacagacgcuaaauuugucgauguuauucacagcgacucuaacggacugggcauccaagagccgcucgggcacaucgauuucuaccccaacggaggcaauaagcagccugggugccccaaauccauuuucagcggaauccaguuuauuaaguguaaccaucagagagccgugcaccuguucauggcuucucuugagaccaauugcaacuuuaucuccuucccuugucggagcuauaaggacuacaaaacgucccugugcguggauugugacugcuuuaaggaaaaaucuuguccccgccucggcuaccaagccaagcuguucaaaggcguccuuaaggagagaauggaagggcggccgcugagaaccacaguguuucucgacaccagcggaacauauccuuucugcaccuacuauuuuguucuguccauuaucgugcccgauaaaacgaugauggacggcagcuucucuuuuaagcugcucaaucagcuggggaugaucgaggagccucgccuuuacgaaaagaacaaacccuucuauaagcugcaggaggucaaaauucucgcgcaguuuuacaaugauuucgugaacaucuccagcauuggacugacauauuuccaaucuagcaaucuucagugcuccaccuguacauacaagauccagucucugaugcucaaaagccugaccuaccccgaacggccuccgcugugcagauauaacauuguucucaaggaccgcgaggaaguguuucugaaucccaacaccuguacaccuaagaauacguga

SEQ ID NO: 71526 - RNA, 1197 nt, Artificial Sequence
  derived and/or modified sequence opt5 from LIPN__Homo_sapiens__NP_001095939
augauguggcugcuccugaccacaacgugccuuaucuguggcacccugaacgccgggggauuccucgaccuggagaaugaagugaaccccgaggucuggaugaauacaagcgaaauuaucauuuacaacggcuauccuuccgaggaauacgagguuaccacagaggauggguauauccuucuggugaaucggauuccguacggaagaacccacgcucgcucuacaggccccagaccuguggucuauaugcagcaugcccucuuugcggacaacgcuuacuggcuggaaaauuaugccaacgggagccugggauuccuccuggccgaugcuggcuacgacguguggaugggcaauucccgggggaacaccuggucucgcagacacaagacgcuuagcgagaccgaugaaaaauuuugggccuucuccuuugacgagauggcuaaguacgaucugcccggaguuaucgacuucaucgugaauaaaacaggccaagagaagcucuauuuuauugggcauucucugggaaccacaaucggcuucgucgccuuuagcaccaugccugaacuugcgcagcggauuaaaaugaacuucgcccuggggcccacgaucuccuuuaaguacccuacaggaauuuucacccgcuuuuuccuccugccgaauagcaucauuaaggcuguguucggcacaaaaggcuuuuuccuggaggauaagaaaaccaagaucgccucuaccaaaaucugcaacaauaagauucucuggcugaucuguuccgaauuuaugagccuuugggcugggucuaacaagaaaaacaugaaucaguccagaauggacguuuauaugagccacgcccccacaggaucuuccgugcauaacauucugcacaucaagcagcucuaccacagcgaugaguuccgggcguaugacuggggcaaugaugccgacaacaugaaacauuacaaucaaucccacccucccauuuaugaccugacggcuaugaaggucccuaccgccaucugggcugggggacaugaugugcuugugacaccccaggacgucgcccgcauccugccgcagauuaaaucucuccacuacuuuaagcugcugccugauuggaaccacuucgacuuuguuuggggccucgaugcuccccagagaauguacagcgaaaucauugcccugaugaaagcguauuccuga

SEQ ID NO: 71527 - RNA, 1122 nt, Artificial Sequence
  derived and/or modified sequence opt5 from LIPT1__Homo_sapiens__NP_057013
augcugauccccuucagcaugaagaacugcuuucagcuccuguguaauugccaagugccugccgcuggcuucaaaaagaccgucaaaaacgggcuuauucugcaguccaucucuaaugacguuuaccagaaccucgccguggaggauuggauucacgaccauaugaaucuggaaggaaagccgauccuguuuuucuggcagaacagccccuccguggucauuggcagacaccaaaauccuuggcaggaguguaaccuuaaucucaugcgggaagaggggaucaaacuggcgcgcagacggucuggaggcgggacaguguaucaugauaugggaaacaucaaucugacguuuuucaccacaaagaagaaauacgaccgcauggaaaaccucaagcugauuguuagagcucuuaaugccgugcagccccagcuggauguccaagccaccaaacgguuugaccuccugcuugauggccaguucaagaucagcggcacagcuuccaaaauugggcgcaccacagccuaucaccauugcacccugcucuguucuacggacggaaccuuucugagcucccugcucaagagcccuuaccagggcaucagaucuaacgcuacagccuccauucccagccuggugaagaaucuucuggagaaagauccuacccucacaugcgagguucugaugaacgcgguggccaccgaauaugcugccuaccaccagaucgacaaccacauucaucuuaucaauccgacggaugagacacuguuccccgggaucaacucuaaggcuaaagaacuccaaaccugggaguggauuuauggaaagacaccuaaauuuuccaucaauaccagcuuccacguccuguacgagcagucucaucuggaaauuaagguguuuaucgacauuaaaaacggccggaucgagaucuguaauauugaagcccccgaucacuggcucccucuggagauccgcgacaaacuuaacuccagccugauuggguccaaguucugccccaccgaaacaacgaugcucaccaauauccugcuuagaacauguccgcaggaccacaagcugaacucuaaguggaauauucucugcgagaaaaucaagggaaucauguga

SEQ ID NO: 71528 - RNA, 696 nt, Artificial Sequence
  derived and/or modified sequence opt5 from LIPT2__Homo_sapiens__NP_001138341
augagacagcccgccgugcggcugguccgccucggcagaguuccuuacgcugagcugcuugggcugcaagaccgguggcuccgcagacugcaggccgaaccgggaaucgaggcgcccagcggcaccgaagcuggggcccuucugcucugcgagccugccggacccguguauacagcuggccugcgcgggggacugacgccugaagagaccgcccggcucagagcucugggcgccgaggugcgggucacaggccgcgggggacuugcgaccuuccacggccccgggcagcugcucugucauccugugcuggaucuuagacggcugggacuccgccugagaaugcacguugccucccuggaggcuugcgccgugcggcucugugaacugcagggccuucaagacgcucgcgccagaccgcccccuuacacaggggucuggcuggaugaccggaagauuugcgcgaucggagugagauguggccgccauauuaccucucacggccucgcccugaacugcagcacagaucuuaccugguuugaacauaucguucccugugggcuggugggaacgggcgucaccucccucucuaaagagcugcagcggcacgugacaguggaggaagucaugccucccuuccugguugcuuuuaaggagauuuauaaaugcacccucaucagcgaagacuccccgaauuga

SEQ ID NO: 71529 - RNA, 459 nt, Artificial Sequence
  derived and/or modified sequence opt5 from LITAF__Homo_sapiens__NP_001129945
augagcgugcccggcccuuaccaggccgcuaccgggccguccucugcccccagcgcgccucccuccuaugaggaaacagucgcuguuaacucuuacuauccuacgcccccugccccgaugcccggaccuaccacaggccuggugaccgggcccgacggaaagggcaugaauccucccagcuacuauacacaaccggccccuauccccaacaauaacccuauuaccgugcagacagucuacgugcagcaccccaucaccuuccucgauagacccauucagaugugcuguccuuccugcaauaaaaugaucguuucucaacugagcuauaacgcuggggcccuuacguggcuguccuguggaagccucugccugcuuggccaggaguguucuggcaccauuguggcucugcgguccuuugaccuccuggggagcugcaauccgcccucuuccgccagcuga

SEQ ID NO: 71530 - RNA, 849 nt, Artificial Sequence
  derived and/or modified sequence opt5 from LIX1__Homo_sapiens__NP_694966
auggacagaacccuggagagccuccggcacaucauugcccaggugcugccccaucgcgauccugcucuugucuucaaggaccugaacguuguguccaugcuccaagaauuuugggagucuaaacagcagcagaaggccgcguucccgagcgaaggcguggucguguacgagucccugcccgcuccugggcccccuuuuguuucuuaugugacacuucccggaggcagcugcuucgggaauuuucaauguugccuguccagagccgaagcccggcgcgaugcugccaaagucgcucucaucaacucucuguucaaugagcugccuagcagacggauuacgaaggaguuuaucauggaauccgugcaggaggccguugcgagcaccucuggaacacucgacgaugccgacgauccguccaccagcgugggcgcuuaccacuauaugcuggaaucuaacauggggaaaacaaugcuugaguuccaggagcugaugaccauuuuucagcuccugcauuggaauggaucccuuaaggcccugcgcgaaacaaaguguagcagacaagaggucaucucuuacuauucccaguacagccucgacgagaaaaugcggucccacauggcucuggauuggaucaugaaggaacgcgacucucccggcauugugagccaggaacugagaauggcccuccggcagcuggaggaggcgcgcaaagccggccaagaacuuagauucuauaaggagaaaaaggaaauccugucccucgcucugacccagauuugcagcgauccugacacgucuucccccagcgaugaccagcuuucucugaccgcccucuguggguaccauuga

SEQ ID NO: 71531 - RNA, 3195 nt, Artificial Sequence
  derived and/or modified sequence opt5 from LLGL1__Homo_sapiens__NP_004131
augaugaaguucagauuucggcgccagggcgccgacccccaaagagagaaacugaagcaggaacucuucgcuuuuaacaaaaccguggagcacggguucccuaaucagccgagcgcccuggcguuugaucccgaacuucggaucauggcuauuggaacacgcuccggcgccgucaagaucuacggggccccuggaguugaguucacgggccugcauagagacgcugccaccgugacacagaugcacuuucucaccgggcaaggacggcugcuuucucugcucgaugacagcucccugcaucugugggaaauugugcaccauaacggcugcgcucaccucgaggaggcccugucuuuccagcuucccagccgcccuggcuuugauggggcguccgcuccccugucucucacaagagucaccgugguucugcuuguggccgccggagacaucgcugcccugggcacagaagggagcuccgucuucuuucucgaugugaccacgcugacccugcucgagggacagacacuggcgccuggcgaaguucuucggagcgugccggacgauuaucgcugugggaaagcccugggacccgucgagucucuccagggccaccugagagacccuaccaagauucuuaucggcuacucccgggggcugcucgugaucuggaaucaagcuagccagugcguggaucauauuuuccugggaaaccagcagcuggagucucucuguuggggccgcgacuccagcacagucguuucuucccacagcgauggguccuaugccguguggucuguggacgcugggagcuuucccacccugcaaccuacggucgccacaacccccuacggcccguucccuugcaaggccaucaauaaaauucuuuggagaaacugugaauccgggggacauuucaucauuuuuagcggcggcaugccccgggcuucuuauggggaccgccacugcguguccguucugagagcggagacacucgugacccuggauuucaccagccggaucauugacuuuuucacaguccacucuacgagaccugaagaugaguuugacgauccccaggcccuugcugugcugcucgaagaggagcugguugugcuggaccuccagacccccggauggccugccgucccggcccccuaccuggcuccucuucauagcuccgccaucacauguucugcgcacguggcuagcguccccgccaagcugugggcccgcaucguguccgcuggcgaacaacagagcccucagcccguuucuuccgcccucagcuggccgauuaccgggggacggaaucuggcucaggagccuucucaaagaggccugcuucucacagggcaugaagauggcaccgugcgcuucugggacgccuccggagucgcgcugcggccccuguauaaacucagcacggccggccuguuucagacagauugcgagcacgcugacucccuugcccaggcugccgaagaugacuggccucccuucagaaaggugggguguuuugacccuuacucugaugacccccgccugggaguucagaaaguggcgcucugcaaguacaccgcccaaauggucguggcuggcaccgccggacaggugcugguucuggagcuuagcgaugucccgguggagcaggcuguguccgucgccaucauugaccuccugcaggaucgggaaggauucacauggaagggccaugagagacugucuccucgcaccgggccccuccccuggccugccggcuuucaaccgcgggugcugguucagugucuucccccugcugcggugacagccgucacgcugcacaccgaauggagccucguggcuuucggaacaucccacggcuuugggcuguucgacuaucagagaaaaagccccguucuggcccgcugcacccuucauccuaacgauucucucgccauggagggaccccugucccgggucaagagccugaaaaagucucucagacaguccuuccggcgcaucagaaaaagccgggugucuggcaagaaaagagcugccaaugcgagcuccaagcugcaagaagcuaacgcccagcuugccgagcaggcuugcccucacgacguggagaugacacccguucaacgccggauugaaccgagaagcgccgaugacucucuguccggggugguccgcugucucuacuuugcggauaccuuccugagagacggagcucaucacggcccuacgaugugggccgggaccaauagcggcuccguguuugccuaugcucuggaggugcccgccgcugccgucggaggcgaaaagcggccugagcaggcgguugaggccgugcuugggaaagaagugcagcucaugcaccgcgcucccgucguggccaucgcuguucuggauggaagaggccggccgcugccugagcccuacgaagccucucgcgaccucgcccaggcuccugacaugcaagggggacaugcggugcugaucgccagcgaggaacaguucaaggucuuuacacuucccaaaguguccgcuaagaccaaauucaagcugacagcccacgagggcugcagaguucggaagguggcccucgcuaccuuugccucugucgcgugugaggauuaugcugaaacgugccuggccugucugacaaaccuuggggacgugcauguuuucagcgugcccggccugcgcccucagguccacuacuccugcauuagaaaagaggauaucucuggaauugccagcuguguguuuacccggcauggccagggguucuaucucaucuccccgagcgaauuugagcgcuucucucuguccgcuagaaauauuacagaaccccucugcagccuggacaucaacuggccucgggaugccacccaagcgucuuacagaauccgcgagucccccaaacuuagccaggcuaauggaaccccuucuauucugcucgcuccccagucccuggacggcagcccugauccggcccacuccauggggcccgacacaccugagcccccugaagccgcccugagccccaugucuaucgauagcgcuacguccgccgacaccacacuugauaccacaggagacgugaccgucgaggauguuaaggacuuucugggcucuagcgaagaguccgaaaagaaccuccggaaccuggcggaggacgaggcccacgcuugugccauucucaucaaauga

SEQ ID NO: 71532 - RNA, 1071 nt, Artificial Sequence
  derived and/or modified sequence opt5 from LLGL2__Homo_sapiens__NP_001015002
augagacgguuccugcgccccggccacgacccugugagagagcggcucaagcgcgaucuguuucaguucaacaaaaccgucgaacauggguuuccgcaccaacccagcgcccuuggauacuccccuucucugagaauccucgcuauuggcacacggagcggggccaucaagcuguauggagcgcccggcguugaguucauggggcuucaucaggaaaauaacgcugugacgcagauucaucugcucccuggacagugccaacuggugacccugcucgacgauaauucccugcaccuuuggucucugaaagucaagggcggcgccagcgagcuccaggaagacgaguccuuuacacugcgcgggcccccuggagccgcuccgucugccacccagaucacagugguucuuccccacagcuccugugagcugcucuaccugggcaccgaaagcgggaacguguucgucgugcagcugccugcuuuuagagcccucgaggaucggacaauuucuuccgacgcgguucugcaacgccuucccgaagaggccagacaccggcgcguguucgagauggucgaagcucugcaggagcauccuagagaucccaaucagauccucaucggauauagccggggccugguggugauuugggaccuucaggggucucgcguccuguaccacuuucucuccagccaacagcuggaaaacaucugguggcagagagauggacggcugcucguuucuugccauuccgacggcagcuauugucaauggccgguguccucugaggcccagcagccugaaccccugagaagccuugugccuuacggccccuuccccugcaaagcuauuacccgcauccuguggcucacgacccggcaggggcugccuuuuacaauuuuccaaggaggcaugccgagagccuccuauggggaucgccacuguaucagcgucauucacgacggacagcagaccgcguuugauuucacaucucgggugaucggcuucaccguucuuacggaggccgaccccgcugccuccagacgcgcuagcggggugggagcccagggcuga

SEQ ID NO: 71533 - RNA, 1533 nt, Artificial Sequence
  derived and/or modified sequence opt5 from LMAN1__Homo_sapiens__NP_005561
auggccggcagcagacagcgggggcugcgcgcuagagugcggccccucuucugcgcccugcuucugucccucggacgcuuugucagaggcgacgggguuggaggcgauccugcgguggcucugccgcaccggcgcuucgaguacaaguauucuuuuaaagggccccaucuugugcaaagcgacggaaccgucccuuucugggcccacgccggcaacgcuauccccuccucugaucagauuagaguggccccuagccugaagucccagcggggcucuguuuggacaaaaacgaaggcugccuuugaaaauugggagguggaagucaccuuccgcgugacagggagaggacggaucggcgcggacgggcucgccauuugguacgcugagaaccagggacuggaaggccccguuuuugggagcgccgaucuguggaauggagugggcaucuucuuugacuccuucgauaacgacggcaaaaagaauaacccugcuauugucaucaucgggaauaacggacaaauucauuaugaucaccagaaugacggcgccagccaggcgcucgccucuugucagcgcgauuuuagaaacaagccguaccccgugcgggcuaaaaucaccuauuaccaaaauacacugaccgugaugauuaacaauggguucacaccugacaagaacgauuaugaguuuugcgccaaagucgagaauaugaucauucccgcucagggacauuucggcaucuccgccgccaccgggggacuugcugacgaccacgauguucugagcuuccucacguuucagcugaccgaaccuggcaaggagcccccgacaccugacaaagaaauuucugagaaggagaaggaaaaauaccaggaggaguucgaacacuuucaacaggaacuugauaagaaaaaggaggaguuccagaaaggccaucccgaccugcaagggcagccugcggaagagaucuuugaauccgugggagaucgcgagcucagacagguguucgaaggccagaaccggauccaccuggagauuaagcaacugaacagacagcucgacaugauccuggaugagcagcgccgguacgucagcucucuuaccgaagagauuuccaaaagaggggccggaaugcccggccagcaugggcaaaucacacagcaggaacuggacaccgugguuaagacgcagcacgagauucuccgccaagugaaugaaaugaagaacagcauguccgagacaguccggcuggugucuggcaugcagcaccccggaagcgcuggcgggguuuaugagaccacacagcauuuuaucgauaucaaagaacaccuucauauugugaagagagacaucgauaaucugguccagcgcaacaugccuuccaaugagaaaccgaagugucccgaacucccucccuucccuagcugccugucuaccgugcacuuuauuaucuucgucgugguucaaaccgugcuguuuauuggauacaucauguaucggucccagcaggaggccgccgcuaaaaaguucuuuuga

SEQ ID NO: 71534 - RNA, 1581 nt, Artificial Sequence
  derived and/or modified sequence opt5 from LMAN1L__Homo_sapiens__NP_068591
augcccgccgugagcggcccugggccgcuguucugccuccugcuucugcuccuggacccccacuccccugagaccggaugucccccucuuagacgguuugaauacaagcugucuuucaaaggcccccgccucgcucugccuggggccggaaucccguuuuggagccaucacggcgaugcgauucuggggcucgaggaagucagacugacacccuccaugcggaaccgcucuggagcuguuuggagcagagccuccgugccuuucucugccugggagguggaaguccagaugcgggugacgggccuuggccgcagaggggcucaaggaauggccguuugguauacccggggccgcgggcaugugggaagcguccugggcgggcucgcuuccugggacggaaucggcaucuuuuucgauagccccgccgaggacacacaggauucuccugcgauuagagugcuggccuccgacggccacauucccagcgagcagccgggggauggagcuucucagggccuuggguccugccauugggacuuucggaaucgcccucaccccuucagagcccggaucaccuacuggggacaacgccugagaaugagccucaacucuggccugacaccuuccgaucccggggaauuuuguguugacgugggaccccugcuccuggucccuggcggcuucuuuggggugagcgcugccaccggaacacuugcggaugaccacgaugugcuguccuuccucaccuuuucucugagcgagccgucccccgaagucccuccccagccuuuccuugagaugcagcagcugcggcucgccagacaacuggagggccugugggcucgccucgggcugggaacgcgggaagacguuacccccaagagcgacucugaggcccagggcgaaggggagagacuuuucgaucuggaagagacacucggccgccaucggagaauccugcaggcccuucgcggacuguccaaacagcucgcccaagccgagcggcaguggaagaaacagcugggcccgccugggcaagcuagacccgacggaggcugggcgcuggaugccagcugccagauuccuucuacccccgggcgcggaggccaccucagcaugucccugaauaaggacucugcuaaggugggggcccuucugcauggccaguggacacuccugcaggcccugcaagaaaugcgggaugcugccgugagaauggcggcugaggcccaggucagcuaucuuccugugggaaucgaacaccacuuucucgagcuggaccauauucugggccuccugcaggaggaacuucgcgggcccgccaaagcugccgcuaaggccccgcggccucccggacagcccccuagagcguccagcugucugcaaccgggcaucuuccucuuuuaccugcugauucagaccguuggguucuuuggauaugugcacuuccggcaggagcuuaacaaaucucuccaggaaugccuguccacgggcagccugccccucgggccugcuccccauacaccucgcgcucugggcauccuuagacggcaaccccugccugccucuaugcccgcuuga

SEQ ID NO: 71535 - RNA, 1080 nt, Artificial Sequence
  derived and/or modified sequence opt5 from LMAN2L__Homo_sapiens__NP_001135764
auggccgcuacccugggcccccucgggagcuggcagcaauggagacggugccuguccgcccgcgacggaucuagaaugcuucugcuccugcuucugcucggcagcgggcagggaccucaacaggugggcgcggggcagacauucgaguaccugaagcgggaacacucccugucuaaaccguaucagggagucggcacgggcagcuccucucucuggaaccugauggggaaugcuaugguuaugacccaguacauccgccuuacacccgauaugcagagcaagcaaggagcccuguggaacagagugccuuguuuucuccgggacugggagcuccaggugcauuucaaaauucacggccaggggaagaaaaaucuucauggagauggccuggccaucugguauaccaaggaccgcaugcagcccgggccugucuuuggaaacauggauaaguucgugggccucggcguuuuuguggacacauaccccaaugaagagaaacaacaggaagcucagaagagacgguauuccccugggguccaacgcguguucccguacauuagcgccaugguuaacaauggaucucuguccuaugaucacgagagagacggccggcccaccgagcucgggggaugcacagcuaucgugcgcaaccugcauuacgauaccuuucuggucauuagauacgugaaacggcaccuuacgaucaugauggacaucgauggcaagcacgaauggcgcgacuguauugaggugccuggggucagacugccccggggauauuacuucggcaccagcucuaucacaggcgaucucuccgacaaucaugacguuauuagccugaaacuuuuugaacugaccguggagagaacaccugaggaagagaagcuccaccgcgauguguuccugcccucugucgacaacaugaagcugccggaaaugaccgccccucugcccccucuguccgggcuugcgcuguuucucaucguguucuuuagccugguuuucuccguguucgccauugucaucggaauuauccuuuauaauaaauggcaggagcagucucggaagagauuuuacuga

SEQ ID NO: 71536 - RNA, 1473 nt, Artificial Sequence
  derived and/or modified sequence opt5 from LMBR1__Homo_sapiens__NP_071903
auggagggccaggacgaagugagcgccagagagcaacacuuccauucccagguccgggaaucuaccaucugcuuucugcucuuugcuauucuguacguugugagcuauuuuaucauuacacgcuacaagagaaaauccgaugagcaggaagacgaggaugccaucgugaaccggauuucucuuuuccugagcacguuuacccucgcggucuccgcuggggccgugcugcuucugcccuucucuaucaucagcaaugagauucuccuguccuuuccucagaacuauuacauccaauggcugaauggaagccucauucacggccuguggaaccuugccucucuguucuccaaucucugucuguuuguucuuaugccguucgcuuucuucuuucuggaaagcgagggguucgccggacucaagaaaggcauccgcgcucggauucuggaaacacuggugaugcuccugcuucuggcccuccugauccuugggauugucuggguggcgucugcccugaucgacaacgaugcugccuccauggagagccucuaugaccugugggaguucuaccugcccuaucucuacucuugcaucucccugaugggaugucuucugcuccugcuuugcaccccuguuggccugagcagaauguuuacagugaugggccagcuccuggucaagcccaccauucuggaagaucucgacgagcagaucuacauuaucacacuggaagaggaagcucugcagcgcagacugaaugggcucuccucuagcguggaguauaacauuauggagcuggaacaagagcuggaaaaugugaaaacccuuaagacgaagcucgagcggcgcaaaaaggccuccgcgugggaaagaaaccuggucuacccugccguuauggugcugcuccugaucgagaccagcaucucugugcuucuggucgcuuguaauauucucugccugcugguggaugagacagccaugcccaaaggaacccggggcccugggaucggaaacgcuucccuuagcacauucggcuuuguuggggccgcccucgaaauuauccugauuuucuaucugauggugucuagcgucgugggauuuuacucccuccgcuucuuuggcaauuucaccccgaagaaagacgauacgacaaugaccaagaucaucggcaacuguguuucuauucuggugcuuagcuccgcucugcccgucaugagcagaacacucgggaucacccgguuugaccugcugggagauuucggccgcuuuaauuggcuugggaacuucuauauugugcucucuuacaaccugcuguuugcgaucgucaccacacucugccuggugagaaaguucacguccgccguucgggaggaacuuuucaaagcucugggacuccauaagcugcaccuuccuaauaccagcagagacucugagacagccaaacccuccgugaacggccaucagaaggcccuuuga

SEQ ID NO: 71537 - RNA, 1623 nt, Artificial Sequence
  derived and/or modified sequence opt5 from LMBRD1__Homo_sapiens__NP_060838
auggccaccagcggcgcugccuccgcggagcuggugaucggguggugcauuuucggacuccugcuucuggcuauccucgccuuuuguuggauuuacgucagaaaguaucagucucggcgcgaaagcgagguuguguccacaaucacggccauuuucucucuggcuaucgcccuuaucaccagcgcucugcuccccguggacauuuuucuggucuccuacaugaaaaaccaaaauggcacauucaaggauugggccaacgcgaaugugucuagacagaucgaagacaccguucuguauggguacuauacacucuacagcgugauucuguuuugcgucuucuuuuggaucccuuucguguauuuuuacuacgaggaaaaagaugacgaugacaccuccaaguguacacagauuaaaaccgcccuuaaguauacgcugggauucguugugaucugcgcucuccugcuucuggucggcgccuuugugccgcucaacgugcccaauaacaagaauagcaccgagugggagaaagucaagucucuguucgaggaacugggguccagccacggacucgcugcccugucuuuuuccauuagcucucuuacacugaucggcaugcucgcggccaucaccuacacagcuuauggcauguccgcccugccucuuaaccugauuaaagggacccggagcgcugccuacgaacgccucgagaauacggaggauaucgaagagguugaacagcauauucaaacaaucaaguccaaaucuaaggacggaagaccccugccugcccgggauaagcgcgcucugaaacaguucgaggaaagacuccggacccugaagaaacgcgagagacaccuugaguucauugaaaacagcugguggacaaaguuuuguggcgcgcugcggccccucaaaaucgugugggggaucuucuuuauucugguggcccuucuguucgucaucucccucuuucugagcaaucuggacaaggcucuccauucugccggaauugauuccggcuucaucauuuuuggggccaaccugagcaauccucuuaacaugcugcucccgcugcugcagaccguguucccccuugacuauauccucaucaccauuaucauuauguacuuuaucuucacaucuauggcuggcauucgcaauaucggaauuugguuuuucuggaucagacuguauaaaauccggcgcggcagaacgcggccucaggcccugcucuuucugugcaugauucuucugcucaucguucugcacaccagcuacaugauuuacucccuggcgccccaauaugugauguacgggucucagaacuaucuuaucgagacaaacauuaccagcgauaaucauaagggaaacuccacacucagcgucccuaagagaugugacgcugacgcccccgaagaucagugcaccgugacgcgcacauaccuguuccugcacaaauucugguuuuucucugccgcuuauuacuuuggcaauugggccuuccucgggguuuuucugaucggacuuaucguguccuguugcaagggcaaaaagagcgucauugaggggguggacgaagauucugacaucuccgaugacgagccgagcgucuauuccgcuuga

SEQ ID NO: 71538 - RNA, 2088 nt, Artificial Sequence
  derived and/or modified sequence opt5 from LMBRD2__Homo_sapiens__NP_001007528
augagcggcgccgcucuggggcucgagaucguguucgucuuuuuccuggcccuuuuucugcuccacagauacggagacuucaagaaacagcaucggcugguuauuaucggcacccuucuggcgugguaucucugcuuucugauuguguucauccugccccucgauguguccacaacgauuuacaaccgcuguaagcacgcugccgccaauucuagcccuccggaaaacuccaauaucaccgggcuguaugcuacagccaaccccgucccuucucaacaucccugcuuuaaaccuuggagcuacauccccgacggaauuaugccuaucuucuggagagugguuuauuggaccucccaguuucuuacauggauucugcucccguucaugcagucuuacgcucggagcggcggguuuuccaucaccggaaagauuaaaacagcccugaucgagaaugcgauuuauuacggcaccuaccuucugaucuucggcgccuuucucaucuauguggcugucaacccccaucugcaccuggaauggaaucagcuccaaacgauugggaucgccgcugccaacaccuggggacuguuccuucuggugcuccugcuuggcuacgggcugguugagauuccucgcagcuauuggaauggagcgaagagaggcuaccuccugaugaagacauauuucaaagccgcuaagcugaugaccgaaaaagccgaugcugaggagaaccucgaagacgccauggaggaagugcggaaggucaaugagucuaucaaauacaaccacccccugcgcaaguguguggauacaauucuuaagaaaugcccuaccgaguaucaggaaaagauggggagaaauauggacgauuacgaggacuuugaugaaaaacacuccaucuaccccagcgagaagucucuggugaaacuccauaagcaggucaucuauuccguucagcggcaccgcagaacgcaagugcaguggcagauucugcuugaacaggccuucuaccuggaggacguggcuaaaaacgagacaagcgcgacccaucaauuuguccacacauuccagucuccggaaccugagaaucgguuuauccaguauuucuacaaccccaccuuugaaugguauugggagugucuccugcgcccuugguucuacaagauucuggccgugguucucuccaucuuuagcgugauugucgugugguccgaaugcaccuucuuuucuacaacgcccguucugagccuuuucgcuguguuuauccaacuggccgagaagaccuauaacuacaucuacauugagaucgccuguuuccucuccauuuucuuucugagcaucugcgucuauucuacaguguucagaauuagagucuuuaauuacuauuaccuggcuucccaccaucagaccgaugccuauagccuucucuucucuggaaugcuguuuugucgccugacacccccucucugccugaacuuccuuggccugacccacauggacagcuccaucucucauaaaaauacgcagccgacagcguacaccagcauuaugggcuccaugaaggugcucagcuuuaucgcugauggguucuauaucuacuaccccaugcugguugugauucuguguaucgccaccuauuuuucucuuggaacaagaugccucaaccugcugggcuuccagcaauuuaugggggacgacgauaugaccuccgaccucgucaaugaaggaaaagagcugauucggaaggaaaaacggaagcgccagcggcaggaggaaggcgagaacagacgccgggaguggaaggaaagauacgggcacaaucgcgaggauagcacacggaacagaaauauccauacggacccuaaagaaucuaacuucuccgaugugaauaccaaccgcagcgccuuuaaguauacacgggcuaauaacagaaccgagcgcgaccggauugagcuucugcaggaugccgaaccccucgacuucaaugcugagacauucaccgaugacccucuggaauccgagucuggaagauaccaacccggcggccgguaucugagcaugucccgcucugauaucuuuaacgacguuuga

SEQ ID NO: 71539 - RNA, 879 nt, Artificial Sequence
  derived and/or modified sequence opt5 from LMCD1__Homo_sapiens__NP_001265162
auggacagcaaguacuccacccugacagccagagugaaaggcggggauggaauccggauuuauaagcgcaacagaaugaucaugacgaaucccauugcuaccggcaaagacccuacauucgauaccaucacauacgagugggccccgcccggggucacccagaagcucggacugcaauauauggaacuuauuccuaaagagaagcagcccguuacaggcaccgaaggggcguuuuaccggcgcagacagcugaugcaccagcucccuaucuaugaccaagaucccucucggugccgcggacugcuugagaacgaacugaagcucauggaggaguucgugaaacaguacaagagcgaagcucugggcgugggcgaggucgcccugccugggcagggaggccucccgaaagaagaggggaagcagcaagagaaacccgaaggagccgagacgaccgcugccacaaccaauggcucccugucugacccuagcaaggaaguggaguauguuugugaacuuugcaagggggcugcgcccccugauucccccguggucuacucugacagagccggauacaacaaacaguggcauccgacauguuuugugugcgccaaguguagcgagccucugguugaucucaucuauuucuggaaagacggcgcucccuggugcggccggcacuacugugagucccugcgcccuagaugcagcgggugugaugaaauuaucuuugccgaggacuaucagcggguggaagaucuugcuuggcaucgcaagcacuucgucugcgagggaugugaacagcugcucucuggcagagccuacauugugaccaaagggcaacugcugugccccacgugcuccaagagcaaacggucuuga

SEQ ID NO: 71540 - RNA, 1704 nt, Artificial Sequence
  derived and/or modified sequence opt5 from LMF1__Homo_sapiens__NP_073610
augagacccgacagcccuaccauggccgcuccggccgagucccugcggcgcagaaagacaggcuacucugaucccgaaccugagagcccucccgcgcccgggcggggaccugcuggcuccccggcccaccuccauacggggaccuucuggcugacacgcaucgugcuucugaaagcccucgcuuuugucuauuucguugccuuucugguggcuuuccaccagaacaagcaacuuauuggagacagaggccugcuccccugccggguguuucugaaaaauuuccagcaguacuuucaggaucgcaccucuugggaagucuucagcuauaugccuacaauccuguggcucauggacugguccgauaugaacucuaaucuggaccuucuggcccuccuggggcuuggaauuagcuccuuugugcugaucaccggcugugcgaacaugcuccugauggccgcucuguggggccucuacaugagccugguuaauguggggcaugucugguauucuuucggaugggagucccaacuucuggaaacaggcuuucucgggauuuuccugugcccccuuuggacccugagcagacucccucagcacacgcccaccucucggaucgugcuguggggauuucgcuggcugaucuucagaauuaugcucggcgccgggcugaucaagauucggggagaucgcuguuggagagaccuuacaugcauggauuuccauuacgagacccagccgaugccuaaccccguugcuuauuaccugcaccacuccccuuggugguuucaucgguucgagacacucagcaaucacuuuaucgaacugcuugugcccuucuuucuguuccucggccgcagagccuguauuauccauggcguccugcagauucuguuucaagcggugcucaucgugucugggaaccuguccuuccuuaauuggcugaccaugguccccagccucgccugcuuugacgaugcuacgcugggauuccuguuuccuuccggcccggggucucuuaaagaccggguucuccagaugcagagagauauccgcggagcccggcccgagccuagauucggcagcguggugcgccgggcugccaacgucucccugggggugcugcucgccuggcugagcguucccgugguccuuaaucugcucucuuccagacaggugaugaacacacacuuuaauagccugcacauuguuaacaccuacggagcuuucggcucuaucacaaaggaacgcgcggaggugauucugcaaggcaccgccagcuccaaugcuucugccccugacgccaugugggaggacuaugaguucaaguguaaacccggggauccgagccggagaccuugccuuaucucccccuaccauuaucgccucgacuggcugaugugguuugcugccuuccagaccuacgaacacaacgauuggauuauccaucuggcgggaaagcuccuggcuagcgacgccgaagcccuuucucugcucgcucacaacccuuuugccggccggcccccucccagauggguccgcggggagcauuaucgguacaaauucuccagaccgggaggccggcacgcugccgaagggaaguggugggugcgcaaaagaaucggcgcguauuuuccuccccugagccuggaggagcuucggcccuacuucagagaucgcggauggccucucccgggcccccuguga

SEQ ID NO: 71541 - RNA, 2079 nt, Artificial Sequence
  derived and/or modified sequence opt5 from LMLN__Homo_sapiens__NP_001129521
auggugaccacacugggccccaagauggccgcugaguggggagggggcgucggguacagcggauccggcccugggagaucucgguggcgcuggagcggauccguuugggugagaucugugcuccugcuucugggcggccuccgggccagcgcgacguccaccccggucucucuggggagcuccccucccugccgccaccaugugcccagcgacacagaaguuaucaacaaagugcaccuuaaggcuaaucaugucgugaaaagagauguugacgagcaucugcggauuaagaccguguaugauaaaucugucgaggaacuccugccugaaaagaagaaccuggugaaaaauaaacucuucccccaggccaucuccuaccuggagaagacauuucaagugcgcagaccugccggaaccauucuucugagccggcagugugcuacaaaccaguaucuccgcaaggagaaugacccgcacagauacugcaccggcgaaugugccgcucacacgaaaugcgggcccgucaucguuccugaggaacaucugcagcaaugucggguguaucgcggaggcaaguggccccacggggccgugggagucccugaucaggagggcauuucugacgcggauuucgugcuuuacguuggcgcccuggcuaccgagagaugcucccacgaaaacaucaucagcuaugccgcuuacugucagcaggaggccaauauggaccggcccauugcgggguacgccaaccucugcccgaauaugaucucuacacaaccucaggaauuugugggaaugcuguccaccgucaagcaugaggugauucacgcucugggcuucagcgccgggcucuuugcuuucuaucacgauaaagacggaaacccccugacaucccgcuuugccgauggccuuccucccuucaauuacucucuggggcucuaucaguggagcgacaagguugugagaaaagucgaacggcugugggaugugagagacaacaagaucguccgccauaccguguaccuucugguuacgccccggguggucgaggaggccagaaaacacuuugacuguccugugcucgaaggaauggagcuggaaaaucagggcggcguugggacagagcugaaccauugggaaaagcgccuccuggagaaugaggcuaugaccggaucccacacacaaaaccgggugcuuagcagaauuacccuggcgcucauggaagauaccggcugguauaaagccaacuacucuauggcugagaagcuggacugggggcgcggaaugggcugcgauuucguccggaaguccuguaaauuuuggaucgaccagcagagacaaaagcgccagaugcuuagcccguauugcgauacacugcggucuaauccccuccagcugacgugcagacaggaccaacgcgccguggccguguguaaccugcagaaauucccuaagccccucccucaggaauaccaguacuuugaugagcugagcgggauucccgcugaagaccuuccguauuacggcggauccguugagaucgccgauuauugcccuuucucucaagaguucagcuggcaucuguccggcgaauaccagcggagcucugacuguagaauccucgagaaucagcccgaaauuuuuaaaaacuauggggcggagaaguacggaccucacuccgucugccugauccaaaagagcgcuuucgugauggagaaaugugaacggaagcugucuuaucccgauuggggcuccgggugcuaccaggugagcuguuccccucagggacuuaaagucugggugcaggacaccucuuaccucugcagccgcgccggccagguucugcccguguccauucaaaugaauggguggauccacgacggcaaccugcucuguccgucuugcugggauuuuugugagcugugcccucccgaaacagaucccccugccaccaaucuuacaagagcucugccgcucgaccugugcagcuguuccagcucucuggucgugacccuuuggcuccugcugggaaaccucuucccccugcuugccggcuuucugcucugcauuuggcauuga

SEQ ID NO: 71542 - RNA, 1725 nt, Artificial Sequence
  derived and/or modified sequence opt5 from LMNA__Homo_sapiens__NP_001244303
augggcaacagcgaggggugcaauaccaagaaagaaggagaccugaucgccgcucaggccagacucaaggaucuggaggcgcuucugaacuccaaagaagcugcccucucuacagcccugagcgagaagcggacgcuugaaggcgagcugcacgaccuccgcgggcaaguggcuaaacuggaggccgcucugggagaagccaagaagcagcuccaggaugagaugcugagacgggucgacgcggaaaaucgccuucagaccaugaaagaggagcuggauuuccaaaagaacauuuacuccgaggaacucagagaaacaaaacggcgccaugagaccagacugguugaaaucgacaauggcaagcagcgggaguuugagucucgccuugccgaugcucugcaggaacucagagcccagcacgaggaccaaguggaacaguauaaaaaggagcuggaaaagacauacagcgcuaaacuggauaacgcccggcaguccgcggagcgcaauucuaaccucgugggggccgcucaugaggaacugcagcaaagccggauuagaaucgacucccuuagcgcccagcugucucagcuccaaaagcagcuggcugccaaagaggccaaacuucgcgaucuggaagacucccucgcuagagagcgggauaccagcagacgccugcuggcggaaaaggagcgggagauggccgaaaugagagcucgcaugcagcagcaacucgacgaguaucaggaacugcuugacauuaagcuggcccucgauauggagauccacgccuaccggaaacugcuugagggagaagaggaaagacugcgccucucucccuccccuacaagccagcggucuagaggccgcgcuuccagccauuccucucagacccaaggcgggggaagcgucacgaagaagcggaaacuggaguccaccgaaagcagaucuuccuucagccagcacgcccgcacaucuggccggguggcgguugaggagguggacgaagaggggaaguuugucagacugcggaauaaaagcaacgaagaucaguccaugggaaauuggcagaucaagcgccaaaacggcgacgauccgcuccugaccuauagauuucccccuaaauucacacuuaaggcuggacaggugguuaccauuugggccgccggggcuggcgccacgcacucucccccuacagaccugguguggaaggcucagaauaccuggggcugugggaacagccuccggacagcccugaucaauuccaccggagaggaagucgcgaugagaaaacuggugcgcagcgugaccgucguugaggaugacgaggaugaagacggcgaugaccuucuccaucaccaucacgggucucacugcuccagcucuggagaccccgccgaguacaaccugcgguccagaacagugcuguguggcacgugcgggcagccugcugauaaggccagcgcuuccggaucuggcgcccaagugggcgggccgauuagcuccggaucuagcgcguccagcgucaccgugacacgcucuuauagauccguuggcgggagcggaggcgggucuuucggcgacaaccucgugacccgguccuaccugcuuggaaauagcucuccccgcacacagagcccucagaacuguuccaucauucaagaaaugggcaugagaugggaggucgaagaggggcggcgcaaagugagccugucuugccuccccuga

SEQ ID NO: 71543 - RNA, 1761 nt, Artificial Sequence
  derived and/or modified sequence opt5 from LMNB1__Homo_sapiens__NP_005564
auggccaccgcuacccccgugccuccgagaaugggcagccgggccgggggacccacgaccccucugucccccacacgccucucuagacugcaggagaaggaagaacuucgggaacugaacgaccgccucgcggucuacaucgauaaaguuagaagccuggagaccgaaaauuccgcccuucaacuucaggugacagagcgggaggaagugcgcggcagagagcucaccgggcugaaggcucuguaugaaacagagcucgccgacgcucggcgcgcccuggaugacaccgcuagagagcgggccaaacuucagauugaacugggaaagugcaaagcggagcacgaucagcuccugcuuaacuacgccaagaaggaaucugaccugaauggcgcucaaaucaaacuccgcgaguaugaagccgcucugaacagcaaggaugccgcgcuggccacggcucucggggacaaaaagucccuggagggagaucuugaggaccugaaagaucagauugcccagcucgaggcuucucuggccgccgcuaagaagcagcuugcggacgagacccugcucaaagucgaucuggaaaauagaugucaaagccugacagaggaccucgaguuccggaaguccauguacgaagaggaaaucaacgagacccgcagaaaacaugaaacacggcugguggagguugacagcggcagacagauugaauaugaguacaagcuggcccaggcucugcacgagaugcgcgaacagcaugaugcccaagugcggcucuauaaagaggaacuggagcagaccuaccacgccaaacuugagaaugcuagacugucuuccgaaaugaacacgagcacagucaauucugcccgcgaggaacucauggagucccggaugagaaucgaaagccugucuucccagcugagcaaccuccaaaaggagucccgcgcgugccuggagcggauccaggaacuugaggaccugcucgcuaaggaaaaggauaauucuagacgcaugcugaccgacaaagagcgggaaauggccgagauuagagaucagaugcagcaacagcugaacgacuacgagcagcuucucgaugugaagcuggcccuggacauggaaaucagcgcuuaucgcaaacuccuggagggcgaagaggaacggcuuaagcuguccccuagccccucuuccagaguuacagugagccgggccucuagcucccgcucugucagaaccacccgggggaaaagaaagcgcguggauguggaggagagcgaggcuuccagcucugucuccauuagccauucugccuccgcgacaggaaauguuuguaucgaagaaauugacguggauggcaaguuuauccggcucaaaaacacgagcgagcaggaccaaccuaugggagggugggagaugauuagaaagaucggcgacaccuccgugucuuacaaauauacaagccgcuacguccugaaggccgggcagaccgugacaaucugggcugccaaugcuggaguuaccgccuccccgcccacggaucugauuuggaaaaaccagaacucuuggggcacaggcgaagacgugaaggucauccuuaagaauagccagggggaggaaguggcgcaaagauccaccguuuucaaaaccacaauuccugaggaagaggaggaagaggaagaggccgcuggaguggucguggaagaggagcucuuucaccagcagggcacaccccgggccagcaaccgcucuugcgcuaucauguga

SEQ ID NO: 71544 - RNA, 1863 nt, Artificial Sequence
  derived and/or modified sequence opt5 from LMNB2__Homo_sapiens__NP_116126
augagcccucccuccccgggcagacggcgcgagcagagacggccccgcgccgcugccaccauggcgacaccucugcccgggagagcuggaggcccugccacgccccucucuccuacccggcugagccgccuucaagaaaaggaggaacugagagagcucaacgaccggcuggcccacuacaucgaucgcgugagagcucuugaacuggagaaugaccggcuccugcugaaaauuuccgagaaggaagaggucacaacccgcgaaguuucugggaucaaagcccucuaugagagcgagcuggcugaugccagacgggugcuugacgaaacagcgcgcgagagagcccggcugcagauugaaaucggaaagcucagagcugagcuggaugaagugaacaaauccgccaagaagcgcgagggcgagcuuaccgucgcucaggggcgggugaaagaccuggaaucucucuuccauagaagcgagguugaacuggccgcggcccuguccgauaagcgcggacucgagagcgacguggcugaacugcgggcccagcuugcuaaagccgaggauggccacgccgucgcuaagaaacaacuggagaaggaaacacucaugagaguggaccuggagaaucgcugccagucucuucaggaagaacuggauuuucggaaguccguuuucgaagaggaggugagagaaacccgccggagacaugagcgccggcucgucgaaguggacagcucuagacagcaagaguacgauuuuaaaauggcgcaggcccuggaggaacugcggucccagcacgacgaacaggugcgccucuauaagcuggaacuugagcaaacguaccaggcuaaacuggacagcgccaagcucucuuccgaucagaacgacaaagccgcuagcgccgcgagagaggagcugaaggaggcucggaugagacuugaaucccugucuuaucaacucagcggccugcagaaacaggccuccgccgcugaggaucgcauucgggaacuggaggaagccauggcuggggagagagacaaguuccgcaagaugcucgaugccaaagagcaggaaaugaccgagaugagagacgucaugcaacagcagcuggcggaauaccaggagcuucuggauguuaagcucgcccuggacauggaaaucaaugcuuaucggaaacugcuugagggagaggaggagcgccucaagcugagcccgucucccuccagcagagugacagugucucgggccaccagcuccucuagcggcucccugagcgcuacagggcgccucggaagaucuaaacggaagcgccuggaagucgaggagccucuuggcuccgggcccagcgugcugggaaccggcacgggcgggucuggaggcuuucaucucgcccaacaggcguccgccagcggguccguuucuaucgaagagauugaucuggaaggaaaguucgugcagcugaaaaacaauagcgacaaggaucagucccuuggcaacuggagaaucaaacggcaaguccucgagggggaagagauugcuuacaaguuuacaccuaaauacauccugcgcgccggacagauggugaccguuugggcugccggcgccggcguggcucacucucccccgagcacacuggucuggaaggggcaguccagcuggggaaccggcgagucuuucagaaccgugcucgucaaugcggacggggaagagguggccaugcggacaguuaagaaauccagcgugaugagagaaaacgagaauggagaagaggaggaagaggaagcugaguuuggcgaagaggaccuguuccaccagcaaggggauccucgcacgaccucucggggcuguuaugucauguga

SEQ ID NO: 71545 - RNA, 978 nt, Artificial Sequence
  derived and/or modified sequence opt5 from LMNTD1__Homo_sapiens__NP_001139199
augcagcaacccgugagagccggcgacaucggggucagccggguucagacccaccauaacgcuuccccuuucucugugccgaagaaacaggaugagagccccaugaucggagacggcgaagauuacuuucugucccucuucggggacucuaagaaacugacagcccacagcaauuauacgcagaagacccuuaaauacuuuuccaugauccuggaggaagugggacaauucacaucuagcucccucggcgaugucgagauugcggaagugaacguuaaggggcuguuugugaaacuuaucaauagcucucuggacaaggagauggcuauuggagaucauauccuccagcagaacgucaauggccagaccaucucccuguaucgcuuccugccuaacauugugaugcaagccaauagcacaguuaccgugugggccgcugccucugaggcuaagcaccagcccccuuccgacuuucucuggaaagaacaggauaaguucagagccagccccgacugcaucacaauucuguguaaaccuaacggccaggcgaucgccugguacaccccgauucauuggaagcaagcgugggagaaacuugaugccgacgucgaauuuaaucggugcucuguggugucccccacguuccgcaagagagucuuucaguggaccgcuagcacagccaccaucacaaaggagaaacaggaucaaccuaagaaagacauuuccaacuaucagguugagcaggcucaggugcugcucaagcgggaaaaagagauucccccuaccguguuccccaaucgcucuccguggugucaaaacccuuacgucagcgcccaccccuauugcccucugaucgaaccccacaauacguccacagcugggggaagacuugaccggcagccccgcaccagaagcacacggccuaaccgcgccucuggcuccaagaagaaaaagaccagcgagucucagaaacaguga

SEQ ID NO: 71546 - RNA, 468 nt, Artificial Sequence
  derived and/or modified sequence opt5 from LMO1__Homo_sapiens__NP_001257357
auggugcuggaccaggaggauggcguccccaugcucagcguucaaccuaaggggaaacagaagggaugcgccggcuguaacagaaaaaucaaggaccgguaccugcuuaaagcucuggauaaguauuggcacgaagacugccucaagugugccugcugugauugccgccugggggaggugggauccacccuuuacacaaaagcgaaucugauucucuguagacgggacuaucugcgccuguucggcacgaccgggaacugcgcugccuguucuaagcucaucccggccuuugaaauggugaugagagcucgggauaaugucuaccaucuggacugcuucgccugucagcuuugcaaccagcgcuuuugcgugggagauaaauucuuucugaagaauaacaugauucucugucaaauggacuaugaggaaggccagcugaauggcacauucgagagccagguucaguga

SEQ ID NO: 71547 - RNA, 477 nt, Artificial Sequence
  derived and/or modified sequence opt5 from LMO2__Homo_sapiens__NP_001135787
augagcuccgccaucgagagaaagucucuggaccccagcgaggaaccuguggaugaaguccuccagauuccgcccucccugcuuaccugcggcgggugucaacagaacaucggagaccgguacuuccugaaagcuauugaucaguauuggcacgaggacugccucucuugugaucugugcggcugucgccuuggggaaguuggaagacggcuguacuauaagcucggccgcaaacugugcagacgggacuaccugcgccucuuugggcaggauggacugugugccagcugcgacaagagaauccgggcguaugagaugacaaugcgcgugaaagauaagguguaccaucuugaguguuucaagugcgcugccugucaaaaacacuuuugcgucggcgacagauaucugcucauuaauuccgauaucgugugcgaacaggacaucuacgaguggacgaagauuaacggcaugaucuga

SEQ ID NO: 71548 - RNA, 438 nt, Artificial Sequence
  derived and/or modified sequence opt5 from LMO3__Homo_sapiens__NP_001001395
augcugagcgugcagcccgacaccaagccuaaaggcugcgccggguguaacagaaagaucaaagaucgguaccuccugaaggcucuugacaaauauuggcacgaggauugccugaagugugccugcugugacugccgccucggagaagucggcuccacacuguacacgaaggcgaaucuuauucuguguagacgggauuaucuccgccuguucgggguuaccggaaacugcgcugccuguucuaaacugaucccggccuuugagauggugaugagagcuaaggacaauguguaccaucucgauugcuucgccugucaacugugcaaccagcgguuuugcgucggcgacaaauucuuucuuaagaauaacaugauucugugucagacagauuaugaagaggggcucaugaaagaaggauacgcuccccaggugcgcuga

SEQ ID NO: 71549 - RNA, 4050 nt, Artificial Sequence
  derived and/or modified sequence opt5 from LMO7__Homo_sapiens__NP_005349
augaagaaaaucagaauuugccacaucuucaccuuuuacagcuggauguccuaugacgugcuguuccagcggacagagcucggcgcccuggaaauuuggcgccaacuuaucugugcucaugucugcauuuguguuggguggcuguaccucagagaucgggugugcucuaagaaagacaucauccugcgcacggagcagaacagcggaagaaccauucuuaucaaggccgugacagagaaaaauuuugagaccaaggauuuccgggcgucccuggaaaacggcguccuccugugugaccugauuaauaagcucaaacccggggugaucaagaaaauuaaccgccugucuacaccuaucgcuggacuugauaauauuaacguuuuucugaaggccugcgagcagaucggccucaaagaggcccagcuguuccacccgggggaccuucaagaucugagcaauagagugaccgucaagcaggaagagacagaccggcgcgugaagaacguucucaucacccuguauuggcugggaagaaaagcucaguccaaucccuacuauaacggcccucaucucaaucugaaggccuuugaaaaccuucugggccaggcucucacgaaagcccuggaggauucuagcuuccuuaagcgguccgggcgcgacagcggauacggcgauauuuggugucccgagagaggggaauuucuggcgccuccccggcaccauaaacgcgaggacucuuucgaaucccucgauagccugggaucuagaucccugaccagcuguucuuccgacaucacacuccggggcgggagagagggauuugaaagcgacaccgauuccgaguucacauuuaagaugcaagacuauaauaaagaugacaugucuuaccgccggauuagcgccguggagccuaagaccgcucugccguucaacagauuccuucccaauaagucccgccagccuagcuacguccccgccccucugcggaaaaagaaacccgauaagcacgaagacaacagacgcucuugggcuuccccgguguauacggaggccgauggcacauuuagcagacucuuccagaaaaucuacggcgaaaacgggucuaagagcauguccgacgugucugcggaggauguccagaaucugagacaacuucgcuaugaagagaugcagaagauuaaaagccagcugaaggagcaagaccagaaauggcaggaugaccucgccaaguggaaagaccggagaaaguccuacaccagcgaucugcagaagaaaaaggaggaacgcgaagagaucgaaaaacaagcucuggagaagucuaaacgguccagcaagacauuuaaggagaugcuccaggacagagaaucucagaaccagaaauccaccguuccuagccggcgcagaauguauuccuucgaugacgugcuggaggaaggaaagcggcccccuaccaugacagugucugaggccagcuaccaauccgagagagucgaagagaaaggcgcuacguaucccucugaaauccccaaggaggauagcaccacauuugccaaacgcgaagaccgggugaccacagagauucagcuuccuucccagagcccgguugaggaacagucucccgccucccugagcucucucagaucccgcagcacccaaauggagucuacgagagugagcgcuucccugccucggagcuaccgcaagacagauaccgucagacugaccucugugguuacaccccggccuuucgggucccagacccgcggaaucagcucccuucccagaucuuacacaauggacgaugcguggaaauauaauggcgacguggaagauauuaagcggacgccgaacaaugucgugagcaccccugcccccuccccugacgcuucucagcucgccagcucccugucuagccagaaggaggucgccgcuacagaagaggaugugacccgccugcccuccccuacaagccccuuuucuucccucagccaagaccaggccgcgaccucuaaagcuacgcuguccagcaccucugggcuugaccugauguccgagagcggagaaggcgagaucuccccgcagagagaaguuagccggucucaagaucaguucagcgacaugcgcauuuccaucaaccagacaccuggcaagucucucgauuuuggguucaccaucaaaugggacauucccggaaucuuuguggccagcgucgaggccggcucccccgcugaguucucucagcugcaaguggaugacgaaauuaucgccauuaauaacacaaaguuuagcuacaaugauuccaaagagugggaagaggcuauggccaaggcgcaggaaaccgggcaccugguuauggacgugagacgguauggaaaggccggcucuccugagacgaaauggaucgaugcuacaagcgggauuuacaacuccgaaaagagcucuaaucuuuccgucaccacagacuucagcgaaucucuccaguccagcaacaucgaguccaaagaaaucaauggcauucaugaugagucuaacgccuucgaaagcaaggcuuccgagagcaucucucugaaaaaucugaagagacgcucccaguuuuucgagcaaggaagcucugacagcguggugccggaucuccccguuccuaccauuuccgcccccucucggugggucugggaccaggaagaggaaagaaagcgccaggagcgguggcagaaagaacaagacagacugcuucaggagaaguaucagcgcgagcaagaaaaacugcgggaggaauggcagagagcgaagcaggaggccgaacgcgagaacagcaaauaccucgaugaggaacugauggugcuguccucuaacagcaugucccuuaccacacgggagccuagccucgcuacgugggaagccaccuggucugagggcuccaagagcuccgacagagaggggacacgggcuggagaagaggaacgcagacagccccaagaggaagugguccacgaggaucagggcaagaaaccucaggaccagcuggugaucgagcgggaacgcaagugggagcaacagcugcaggaggaacaggaacaaaaacggcuccaggccgaggccgaggaacagaagcggcccgcugaggaacagaaaagacaagcggagauugaacgcgagaccucuguucggaucuaucaguacagacgcccgguggauagcuacgacaucccuaagacagaggaagccuccucuggguuucugcccggagaucggaauaaaagcagauccaccacggagcuugacgauuauagcacaaacaagaauggcaacaauaaguaccuggaccagauugggaacaugaccucuucccaacgccggagcaaaaaggaacaggucccuucuggcgcugagcucgagagacagcagauccugcaagaaaugcgcaaaagaacaccccugcauaaugauaacuccuggauucggcagcgcagcgccucugugaauaaggagccgguuagccuuccuggaaucaugagacggggcgaaucccucgacaaccuggacucuccccgcagcaauuccuggagacagccucccuggcugaaccagcccaccggguucuaugccagcuccucugugcaagauuuuagccggccuccgccccagcucgucuccaccucuaauagagcuuacaugcgcaacccuagcuccucugugcccccucccagcgccggauccguuaaaacaagcacgaccggcguggcgacaacccagucuccuacaccgcggucccacagccccucugcuucccagagcgggucucaacugagaaaucgcuccgucagcggaaagcggauuugcuccuauugcaacaacauccuuggcaagggggccgccaugaucauugagagccugggccucuguuaccaucugcacugcuucaaaugcguggcuugugaaugcgaccugggaggcucuagcuccggggccgaggugagaauccggaaucaccagcuuuauuguaacgauugcuaccugcgcuuuaagucuggaagaccuaccgcgauguga

SEQ ID NO: 71550 - RNA, 1803 nt, Artificial Sequence
  derived and/or modified sequence opt5 from LMOD1__Homo_sapiens__NP_036266
augagcagaguggccaaguaccggcgccaggucuccgaggaccccgauaucgacucucugcucgaaacccugagcccugaggaaauggaggaacuugagaaagagcuggauguuguggacccggauggcuccgugcccgucgggcucagacaacggaaccagacagaaaagcagucuacgggaguguauaaucgcgaggcuaugcugaacuucugcgaaaaagagaccaagaaacuuaugcagagagagaugagcauggacgaauccaagcaaguugagacaaagaccgaugccaaaaauggcgaagaacgggggcgcgacgcgucuaagaaagcucugggaccuagacgggauagcgaccucggcaaggaacccaaacgcgggggacugaagaaguccuuuagcagagaucgggacgaggccggcggcaaaucuggggagaagccuaaagaagagaagauuauccgcggaauugauaaaggcagagugcgggccgcugucgacaagaaagaagccgggaaggacggacgcggcgaggaaagagcuguggccacaaagaaagaggaggaaaagaaaggguccgaucggaacaccggacugagcagagacaaggauaaaaagcgcgaggaaaugaaggagguugcgaaaaaggaagacgaugagaaagugaagggcgagcggagaaauacagacacccgcaaagaaggcgagaagaugaagcgggccgggggaaacacggauaugaaaaaggaagacgagaaagucaagagaggcaccgggaauacagauaccaaaaaggacgaugagaaggugaaaaagaacgaaccccuccacgagaaagaagcuaaggacgacucuaaaacaaagaccccugagaaacagacgccguccggacccacaaagccuagcgaaggccccgccaagguggaggaggaagcugccccuucuaucuucgaugagccccuggaacgcgucaaaaauaacgacccggagaugaccgaaguuaaugugaacaauuccgauuguauuacaaacgagauccuugugcgguuuaccgaggcgcuggaguucaauaccgucgugaagcucuuugcccuggcuaacacaagagccgacgaucauguugcuuucgccaucgccauuaugcuuaaagcuaacaagacgaucaccagccugaaucucgacuccaaccacauuacagggaaaggaauccuggcgauuuuucgcgcccugcuccagaauaacacccugacagagcuucgguuccauaaucagagacacaucugcggcggcaagaccgaaauggagauugcuaagcugcucaaagaaaacacgacacugcuuaagcugggguaccauuuugagcucgccggaccucgcaugaccgugaccaaucugcugucucggaacauggauaaacaaagacagaagcggcuccaggagcagcgccaagcccaggaagcuaaaggcgagaagaaggaccugcuugaaguccccaaagccggggcgguggcuaagggaagcccuaaacccagcccccagccuuccccgaagcccucuccuaaaaauucccccaagaagggcggggccccugccgcucccccgccucccccucccccucuggcucccccgcucaucauggagaaccugaaaaauagccuuucuccugccacacaaagaaagaugggcgauaaaguucugcccgcccaggagaagaacagccgggaccagcuccuggcggccaucagauccucuaaucugaaacagcucaagaaaguggaaguccccaagcugcuucaauga

SEQ ID NO: 71551 - RNA, 1683 nt, Artificial Sequence
  derived and/or modified sequence opt5 from LMOD3__Homo_sapiens__NP_001291347
augagcgagcacuccagaaacucugaccaggaggaacugcucgaugaagagaucaaugaagacgagauucuggccaaccuuagcgcugaggaacugaaggagcuccaauccgaaauggaggugauggcccccgauccuucucugccggucggcaugauccagaaagaccagaccgauaagcccccuacagggaauuucaaccauaaaagccuuguugacuacauguauugggagaaggcgucccggcgcaugcuggaagaggaaagagugcccgugacguuugucaaaucugaggaaaagacccaggaggagcacgaagagauugaaaagcggaauaaaaacauggcucaauaccucaaggagaaacugaauaacgaaaucguggccaauaagcgcgagagcaaaggauccagcaacauucaggagacagaugaagaggacgaagaggaagaggaugacgaugacgaugacgagggcgaagacgauggggaggaaucugaggagaccaauagagaagaggaaggaaaggccaaggagcagauccggaacugcgaaaauaacugucagcaaguuacagacaaggcuuucaaagagcagcgcgauagaccugaggcccaggaacaguccgagaaaaagaucagcaaacuggaccccaagaaacucgcucuggauaccucuuuucuuaagguguccacacggccuagcggcaaucaaaccgaccuggaugggucucuccgcagaguccggaagaacgacccggauaugaaagaacugaaccuuaauaacauugagaauauccccaaggaaaugcugcucgacuucgugaacgccaugaaaaagaauaaacauauuaagacguuuucccuggcgaacguuggagccgaugagaauguggcuuucgcccuggcuaacaugcuccgcgagaauagaagcaucaccacacugaacauugaauccaauuuuaucaccggcaagggcauugucgccaucaugcggugccuucaguucaacgagacacugaccgaacuccgcuuucacaaucagagacauaugcuggggcaccacgcggagauggaaaucgcccggcuucugaaagcuaacaauacgcuccugaagaugggauaucauuucgagcugccuggccccagaaugguggugacaaaccuccugacccgcaaccaagacaaacagcggcagaagagacaggaggaacaaaaacagcagcagcuuaaggagcaaaagaaacugauugccaugcucgaaaaugggcugggacuuccucccggcaugugggagcugcucgggggaccgaagccugacucucgcaugcaggaguuuuuccagcccccuccuccccggcccccgaacccccagaaugucccuuuuagccaaagauccgaaaugaugaaaaagcccagccaggcuccuaaauaccgcacagaucccgacucuuuccggguugugaagcugaagagaauccagcgcaaaucccggaugccggaggccagagaaccucccgagaagaccaaccugaaagaugugauuaagacccucaaaccugucccccgcaaucggccucccccgcugguggaaaucacaccuagagaccagcuucugaacgauauucggcacagcucuguugccuaucucaagcccgugcaacugcccaaagagcuggcuuga

SEQ ID NO: 71552 - RNA, 4512 nt, Artificial Sequence
  derived and/or modified sequence opt5 from LMTK2__Homo_sapiens__NP_055731
augcccggcccuccggcccugagacggcgccuccugcuucugcuccuggugcuucugaucgcugggagcgccggagcggcuccccucccucagaccggcgccggggaggcucccccugcugccgaagucuccucuagcuucguuauucugugcguguguucccugaucauucucaucgugcugauugcuaacugcgucucuuguugcaaggaccccgagaucgauuuuaaagaguucgaagacaauuuugaugacgaaaucgauuucacaccuccggccgaggacacgcccagcgugcaauccccugcggagguuuuuacccuuucugugcccaacauuagccugccugcccccucccaguuccagccgagcgucgaaggacucaagucucagguggcuagacacucccugaauuacauccaagagauuggcaacgggugguuuggaaaaguucuucugggcgaaaucuauacaggcaccagcguggcccgggucauugugaaggagcucaaggcuucugccaauccuaaggagcaggauacauuccugaagaacggggaacccuacuauauccugcagcauccuaauauucuccagugugugggacaaugcgucgaggcgauccccuaccugcuuguuuuugaguucugugaccugggcgaucucaaagccuaucugcgcuccgaacaggaacacaugagaggggacagccagaccaugcuucugcagcggauggcuugcgagguggccgcuggacucgccgccaugcauaagcugcacuuucugcauucugaucucgcucugcgcaacuguuuccuuacauccgaccugaaugugaaagucggcgauuacgggaucggauuuagcagauauaaggaggacuacauugaaaccgacgauaaaaagguguucccccuccgguggacggcgccugagcugguuaccuccuuccaagaccgccuucugacagccgaucagaccaaguacucuaacaucuggagccucggcgugacacugugggaacuguuugacaaugcugcccagccguauuccaaccucagcaaucuggauguccuuaaccaagugauuagagagcgggacaccaaacugcccaagccucagcucgaacagcccuacucugaucgcugguaugagguucugcaguucugcuggcuguccccugagaaaagacccgccgcugaagacgugcaccggcuucucacguaccugcgccugcaaagccagagagauucugaggucgacuuugaacagcaguggaaugcccucaagccgaacacaaacagccgggauuccucuaauaacgcggcuuucccuauccuggaccacuuugccagagaccgccuuggccgggagauggaagaggugcugaccgucacagagaccagccaagggcucuccuucgaauaugugugggaggccgcuaaacaugaucacuuugacgaaagaagccgcggacaucuggaugagggccugucuuacaccuccauuuucuaucccguugagguguuugaaagcucucuuuccgacccugggcccggaaagcaggaugacagcggccaggaugucccucuccgggugcccgggguugugccggucuucgacgcccacaaucuguccgugggaucugauuacuacauccagcuggaggagaaaagcggcuccaaccucgaacuggacuauccucccgcccuucugacaacggauauggacaaucccgaaagaaccggcccugagcucucucaacugacagcccugcgcagcguggagcuugaagaguccagcaccgaugaagacuuuuuccagucuuccacagacccgaaggauagcucucuccccggggaccugcacguuaccuccggaccugagagccccuuuaacaauaucuucaacgaugucgacaagucugaagaucugccuagccaucagaaaauuuucgaccucauggagcugaauggcgugcaggcggauuuuaagcccgccacgcuuuccagcucucuggacaacccuaaagaguccgugaucacagggcacuucgaaaaggagaaaccccggaagauuuuugauagcgaaccgcucugucuguccgacaaucugaugcaucaagauaacuucgacccucuuaauguccaggagcucucugaaaacuuucuguuccugcaggagaagaaucuccugaaaggaagccuuuccucuaaggagcacaucaacgaucugcaaaccgaacucaaaaacgcuggcuuuaccgaggccaugcuggaaacaagcugcagaaauucccuggacaccgagcuucaguucgcugagaacaagcccgggcugucucuccugcaggaaaaugugagcacaaaaggcgacgauacggacguuaugcucaccggagauacacuguccaccagccuucagucuuccccugaggugcaagucccgcccaccagcuuugaaacagaggaaacgccucgccgggugcccccugacucucugcccacccagggcgagacacagccuaccugccucgauguuauugugcccgaggacugucugcaucaggauaucuccccggacgccgucacagugcccguugaaauccugagcaccgaugcgagaacgcacucucuugacaaccgcucccaagauagcccuggggaguccgaagagacacugcggcucaccgaaagcgacucugugcuggccgacgauauucucgcuagcagagucuccgugggaucuagccugcccgagcuuggccaggagcugcacaauaagccuuucuccgaagaccaucacucucaucggcgccucgagaagaaccuggaagccguggagacacugaaucagcuuaacagcaaagaugcugccaaggaagccgggcuggucuccgcucucucuagcgacuccaccagccaggauucucugcucgaggacucccugagcgcgcccuuuccugccucugagccgucccuugaaacccccgauagccuggaguccguugacgugcacgaagcucugcucgauucucugggaagccacacaccucaaaaacuugugcccccugacaagcccgccgauuccggcuacgagacggagaaucuggaaagcccggaguggacccuccauccugcccccgaagggacagcugacucugagcccgccaccacaggcgauggaggccacuccgggcugccucccaacccugucaucgugauuagcgacgcgggagacggccauagagggaccgaaguuacgccggagacauucaccgcuggaucucagggcagcuaucgggauuccgccuacuuuucugacaaugauagcgagcccgagaaaagauccgaagaagugccugggaccucucccagcgcccucguccuggugcaggagcaaccucuucccgaaccgguucugccugagcagucccccgcugcccaggacagcugccuggaggcgcgcaagucucagccugaugaauccugucucagcgcucugcacaacuccucugaccuugagcugcgggccacacccgaaccugcccaaaccggcgugccccagcagguccauccgacagaggaugaagcuagcuccccuuggucugugcucaaugccgagcugagcuccggagacgauuucgagacgcaggacgauagacccugcacccucgcuagcacaggcaccaacacaaaugaacugcuugccuauaccaacucugcgcuggacaagucccugagcucucacuccgaggggcccaaacucaaggaaccugauaucgagggaaaauaccugggcaaacuugggguuagcggaaugcuggaccucucugaggacggcauggaugccgacgaagaggaugaaaacagcgacgauuccgacgaggaucugcgcgcuuucaaucuccacucucugagcuccgaaagcgaggacgagacggaacauccggugcccauuauccuuuccaacgaggaugggagacaucugcggucucugcucaaaccuaccgccgcuaaugcccccgacccucugcccgaagauuggaagaaagagaagaaggccgucacauuuuucgacgacgugaccguguaucuuuuugaucaagaaacaccuaccaaagagcugggcccguguggaggcgaggcuugcgggcccgaccucagcggaccugcgcccgccuccggcucuccuuaccugagccgcuguauuaacuccgaaucuagcacagaugaggaagggggaggcuucgagugggacgaugacuuuucccccgauccguucaugagcaagaccacgucuaaucugcucuccagcaaaccuucucuucagacauccaaguacuuuagcccuccuccgcccgcuagaucuaccgaacaguccuggccccacagcgcccccuauucccgguucagcaucucucccgccaacaucgcuagcuuuucccugacccaccugacagacucugauauugagcagggcgggagcuccgaggacggagaaaaagauuga

SEQ ID NO: 71553 - RNA, 4470 nt, Artificial Sequence
  derived and/or modified sequence opt5 from LMTK3__Homo_sapiens__NP_001073903
augagacaggugcuguggcucugcaacgucuguguuaccgcccgggagacacgccaccaucugcaccuucccgcuauccuggacaagaugccugccccgggcgcgcucauucugcuugcugccgugagcgccuccgggugccuggcuucucccgcccauccugauggauucgcucucggcagagcuccccuggcgccucccuacgccgugguccugaucagcuguuccgggcuccuggcuuuuauuuuccuucugcucacgugccuguguugcaaacggggagacgugggcuuuaaggaguucgaaaauccugaaggggaggauuguucuggagaauauaccccgcccgccgaggagacaagcuccucucaaagccuuccugacguuuacauccugccccucgcugaagugucccugccuaugcccgccccgcagccuagccacucugauaugaccacaccccugggccucucccgccagcaucugagcuaucuucaggagauuggcucugggugguuuggaaaagucauccugggcgaaaucuucuccgacuacaccccugcgcaagugguugugaaggagcucagagccagcgcugggccccuggagcagcggaaauuuauuucugaagcccagcccuaucgcucccuucagcacccuaacguccugcaaugccucggacuguguguggagacacugccguuccuccugaucauggaauuuugccagcuuggcgaucugaagagauaccuccgggcucagagacccccugaggggcugagccccgaacuuccuccccgcgaccugcggacccuccagcgcaugggacuggagauugccagaggccuggcccaccuccauucccacaauuaugugcauucugaucuggcccuucggaacugucugcucacgagcgaccugaccguccgcaucggcgauuacgggcuggcgcacuccaauuacaaggaggacuauuaccuuacaccggaaagacucuggauuccucugcggugggccgcucccgagcugcucggagaacugcacggcaccuucaugguuguggaucaaagcagagagucuaacaucuggucccuuggggugacacugugggaacucuuugaguucggagcccagccuuaucgccaucugagcgacgaggaaguccuggccuuugugguucggcagcaacacgugaaacuugcuagaccccgccucaagcugccuuacgccgacuauugguacgauauucugcagucuugcuggcggcccccggcgcagagaccuagcgcuuccgaccuccagcugcaacuuaccuaucugcucucugagcgcccuccccggcccccgcccccucccccucccccuagagauggccccuucccguggccuuggcccccugcccauagcgcuccccgcccggggacgcuguccagcccuuucccccugcuugacggauuuccuggcgccgaucccgacgauguccucacagugaccgaaucuucccggggccugaaucuggagugccucugggaaaaagccagacgcggggcuggacggggcgggggagcccccgcguggcagccugccagcgcuccgcccgccccucacgcuaaccccucuaauccuuucuacgaggcccuguccacacccagcguucuuccugugaucuccgcgagaucuccgagcgucuccucugaguacuauauccggcuggaggaacauggcagcccucccgaaccccucuuuccuaacgacugggauccccuggacccgggggugccugccccucaggcuccccaggcccccuccgaggucccccaacuggugagcgagaccugggcuucuccucuuuucccggcuccccgcccuuuucccgcccaguccagcgccucuggcuccuuccuccugagcggaugggauccugaaggcagaggggcgggagagacccuggccggcgaccccgcugaaguucucggggagcggggaacagccccguggguggaagaggaggaagaggaagaggaaggcucuagcccuggggaggacuccagcucucugggcggaggccccuccagacgcgggccucuucccuguccucugugcagccgggagggagccuguuccugccucccccuggaaagaggcgaugcugucgccggguggggaggccacccggcgcugggguguccucacccucccgaggacgauucuagccuucgcgcugaaagaggcucccuggccgaccuccccauggccccgcccgcuucugccccucccgaguuucuggauccucucaugggagcggcugcuccccaguacccuggccgggggccgcccccugcucccccucccccgccuccuccuccccgcgcccccgccgaccccgccgccagcccggaucccccuuccgcgguggccucucccggaagcggccuguccagcccugggcccaagccgggagacucuggcuaugaaacggagaccccuuucucccccgagggggcuuuuccuggcggaggcgccgcugaagaggaagggguucccagaccucgggcucccccggagccucccgaucccggagccccucgcccgcccccugaccccggcccucuuccccugccugggcccagagagaaaccgacauucgugguccaggugagcaccgaacaacuccugaugucucugcgggaggaugugacacgcaaucuucugggagaaaagggcgccaccgcgagagagacgggcccucggaaggccgggcgcggacccggcaacagagaaaaaguuccugggcucaaucgggaccccacaguccugggaaacggcaagcaggcuccgucccucagccugccugugaauggggugaccguccuugagaacggagaucagagagcccccggcauugaggaaaaagccgcugagaacggcgcccuggggucucccgaacgcgaggaaaaggugcucgagaauggagagcugaccccuccccggagagaagagaaagcgcuggaaaacggcgagcuucgcuccccugaagcuggggagaagguucuggugaauggaggccucacaccgcccaaaagcgaggacaaggucuccgaaaacgggggacugcgguuuccuagaaauaccgagcggcccccugaaacaggccccuggcgcgccccuggcccgugggagaagacgcccgagagcugggggccugcccccaccaucggagaaccugcucccgagacaucucucgaaagagccccggcgccuagcgcugugguuuccucucgcaacggcggggagaccgcccccggaccccugggcccugcccccaaaaaugggacacuugaaccuggaaccgagcggagagcuccggagacgggcggcgcuccccgggccccuggggccggacgccuggaccugggcagcgggggcagagcgcccgugggaaccgggacagccccuggaggcggccccggguccggagucgaugcuaaggccggcuggguggacaacacccggccgcagccucccccucccccgcucccuccuccucccgaagcucaaccccgcagacuggagcccgccccgccccgggccagaccugaaguugcucccgagggggaaccuggagcgcccgauucucgcgccggcggggacacagcucuuagcggagauggcgacccuccgaaacccgagcggaagggcccugagaugcccagacuguuccucgaucuggggccuccccagggaaauuccgaacagauuaaagcccgccucucucggcugagccuugcccugccgccucugacccucacgcccuuucccggcccugggcccagacgcccuccgugggagggagcugacgccggcgcggcugggggagaagccggcggcgccggggcucccggaccugccgaggaagauggcgaggacgaggaugaagacgaggaagaggaugaggaagcggccgcucccggggccgcugccggaccucggggccccgggagagcucgcgccgcgccggugccugucgugguguccagcgccgacgcugacgccgcuagaccccugcggggccuucugaagucuccucgcggagccgaugagcccgaagacuccgagcucgaaagaaagcggaaaauggucagcuuccauggcgauguuacaguguaccuguucgaccaagagaccccuacaaacgagcucucugugcaggcucccccggaaggggauaccgaccccuccaccccucccgccccuccgacacccccucaccccgcgacgccuggagauggcuuucccagcaaugacuccggguucggaggcucuuuugagugggccgaagauuucccucugcuucccccgccugggcccccucugugcuuuagccgcuucuccgucagccccgcucuggagaccccgggcccucccgccagagcccccgacgcucggccugccggacccguggaaaacuga

SEQ ID NO: 71554 - RNA, 1149 nt, Artificial Sequence
  derived and/or modified sequence opt5 from LMX1A__Homo_sapiens__NP_001167540
augcuggacggccucaagauggaggaaaacuuccagagcgccaucgauaccuccgcuucuuuuagcucccugcuugggagagccgugucucccaaaagcgucugcgagggaugucagcggguuauucuggaccgcuuccuccugagacuuaaugauuccuuuuggcacgaacagugcgugcagugugcgucuugcaaggagccucuggaaacaacguguuucuaccgggacaaaaagcucuauugcaaauacgauuaugagaagcuguuugcugugaaguguggcgggugcuucgaggccaucgccccgaacgaauuugucaugcgcgcucagaaaagcguguaccaucuguccuguuucugcuguugcguuugcgagagacaacuccagaagggagacgaauuugugcugaaagagggccagcuucuguguaagggggauuaugagaaagaacgggagcuccugagccuugucucucccgccgcuuccgacagcggaaagucugaugacgaagagucccugugcaagagcgcccacggcgcgggcaaagggaccgccgaagagggaaaggaucauaaacgcccuaagagaccccggacaauucucaccacacagcaacgcagagcuuucaaagccucuuuugagguguccagcaagccuugucggaaaguucgcgaaacccuggcugccgagacaggccuguccgugagagucguccaggugugguuccagaaucagcgggcgaagaugaagaaacucgcccgcagacaacagcagcaacagcaggaccagcaaaacacccagcggcugucuagcgcucagacgaaugggggaggcuccgccgggauggaaggaaucaugaaccccuacaccgcccuuccuacaccgcagcaacugcucgcuauugagcagagcguguauucuuccgaucccuuuagacagggccugaccccuccccagaugccuggcgaccacaugcaucccuacggggccgaaccgcuuuuccacgaccuggauagcgacgauacaucucucagcaaucugggagacugcuuccuggcuaccuccgaggcgggcccucuccaaucucgcguugggaaccccaucgaucaccuguacagcaugcaaaauuccuauuuuacgagcuga

SEQ ID NO: 71555 - RNA, 1221 nt, Artificial Sequence
  derived and/or modified sequence opt5 from LMX1B__Homo_sapiens__NP_001167617
auggacaucgccaccggccccgagagccuggaaagaugcuucccucgggggcagacagauugugcuaagaugcucgacggaauuaaaauggaggaacacgcccugcgcccgggccccgcgacgcuuggggugcugcucggauccgauugcccucaucccgcugucugugagggcugccaaagaccuaucucugaccgguuucugaugcgcguuaacgaaagcuccuggcacgaggagugucuucagugcgccgccugucagcaggcucugaccacaucuugcuacuucagagaucggaagcucuauuguaaacaagacuaccagcagcuguuugccgcuaagugcagcggguguauggaaaagauugcccccaccgaguucgugaugcgcgcgcuggaaugcguguaucaucucggaugcuuuuguugcugugucugcgagagacagcugcggaaaggcgaugaguucgugcuuaaggaaggccaacugcucuguaaaggggacuacgagaaggaaaaagaucugcuuuccucuguuagcccugacgaguccgauagcgugaagucugaagacgaggauggagacaugaaaccggccaagggccaggggucccagagcaagggaucuggcgacgaugggaaagacccccgcagaccuaagcggccccgcacaauccugaccacacagcaaagacgggcuuuuaaagccuccuucgaggucagcucuaagccuugccgcaaagugagagaaacccucgcugccgagacgggacuguccguucgggugguccaggugugguuucagaaucaaagagcgaagaugaaaaagcuggcccgccggcaccagcagcagcaagaacagcagaacagccagagacucggccaaggcgagcccgggccgggacagggccuggggcaggaagugcuuuccucucgcauggagggaaugauggcuagcuauaccccucuggcucccccucagcaacagauugucgccauggagcagucccccuacggcagcucugaucccuuccagcaagggcucacaccuccgcagaugcccggaaaugacuccaucuuucaugauaucgacagcgauaccucucugacaagccuuuccgacuguuuccugggcucuagcgauguuggcucccuccaggcccggguggggaacccuauugacagacuguauagcaugcaaucuuccuacuuugccagcuga

SEQ ID NO: 71556 - RNA, 3078 nt, Artificial Sequence
  derived and/or modified sequence opt5 from LNPEP__Homo_sapiens__NP_005566
auggagcccuucaccaacgacagacugcagcucccucggaauaugaucgaaaacagcauguuugaggaagaaccggauguggucgaccuggccaaggaacccugccuucacccucuggagcccgaugagguugaauacgagccucgcggcuccagacuccuggugcgggggcuuggagaacaugagauggaggaagacgaggaagauuaugagucuagcgcuaaacugcucggcauguccuucaugaaucgcucuagcgggcugagaaacuccgccacaggauaccggcaaucucccgacggcgcguguagcgugccuuccgcucgcacgauggucgugugcgccuuuguuauuguggucgccgugagcguuaucauggugauuuaucugcucccgagauguaccuucacaaaggaagggugccacaaaaagaaucagucuaucggacugauucagcccuuugcuaccaacggcaaacuuuucccuugggcccagauccggcugcccacagcugucgugccucuccgcuacgagcugucccuucaucccaaucugaccagcaugacauuuagaggcucugugaccaucuccguccaagcccuccagguuacguggaacauuauccugcacagcaccgggcauaauauuucucgggugacauucauguccgcggugagcucccaggagaagcaggccgaaauccuggaguaugcuuaccacggacaaauugccaucgucgcuccggaagcccuccuggcgggccacaacuauacccuuaagauugaguacucugccaauaucagcuccagcuacuauggguuuuacggauucucuuauacagaugaauccaacgagaaaaaguacuuugcugccacccaguucgagccucuggcugcccgcagcgccuuucccuguuucgacgaaccugcuuucaaagcgacguuuaucauuaagaucauuagagaugagcaguauacagcccucucuaauaugcccaaaaagagcuccgugguucuggacgauggccuugugcaggacgaguucucugagagcgucaagauguccaccuaccugguggcuuuuaucguuggggaaaugaaaaaccucagccaagaugugaauggaacacuggucucuauuuaugccgugcccgagaagaucggccagguccauuacgcccuggagaccaccgugaaacuccuggaguucuuucagaacuacuucgagauccaauauccucuuaagaaacuggaccucguugcuauuccggacuuugaagccggcgcgauggagaacugggggcugcuuacauuccgggaggaaacgcugcucuacgauuccaauaccagcucuauggcugaccgcaagcuggugacaaaaaucauugcccacgagcuggcccaucagugguuuggaaaccucgucaccaugaagugguggaaugaucuguggcuuaacgaaggcuucgcuacauuuauggaguauuucucccuggaaaagaucuuuaaagagcucagcuccuacgaggacuuccuggaugccagauucaagaccaugaaaaaggacucucugaauagcucccaccccauuucuagcuccgugcagagcucugaacagaucgaggaaauguuugauucccuuagcuauuucaaagggucuucccuccugcugaugcucaagacguaccugagcgaggacguuuuucaacacgcugugguccuuuaucugcauaaccacucuuacgccagcauccaguccgaugaccucugggauagcuucaaugaagugacaaaccagacccuggacgugaagcggaugaugaaaaccuggacacugcagaagggauuuccucuuguuaccguccaaaagaagggcaaagaacucuucauucagcaggagagauuuuuccugaauaugaagcccgaaauccagccuucugacacauccuaccuguggcauauuccccucagcuaugugacggaggggcgcaacuacuccaaguaucaaucugugagccugcuugauaaaaaguccggagucaucaaucugaccgaagaggugcucuggguuaaagugaacauuaauaugaacggcuacuauaucguccacuacgcggacgaugacugggaagcccugauucaucagcugaagaucaauccguaugugcuuucugauaaagaccgggcuaaccucaucaacaauauuuuugagcuggccggccuggggaagguuccucucaagagagcuuucgaucugaucaacuaccuuggaaaugagaaccacacagcccccauuaccgaagcgcuguuucagacagaccucaucuacaaucugcuggagaaacuuggcuauauggaucucgccagccgccuggugacccgggucuucaagcugcuccagaaccaaauucagcagcaaacguggaccgacgaagggacaccuuccaugagagagcugcgcucugcccuucuggaguuugcuugcacccacaaucucggaaacuguagcacaaccgcuaugaaacuguucgaugacuggauggccuccaauggcacgcagagccugcccacagaugugaugaccacaguuuucaaggugggggccaaaaccgacaagggcuggucuuuucuucugggaaaauacaucuccaucggcagcgaagcugagaagaacaagauucucgaagcgcuggccucuuccgaggacguccggaaacucuauuggcugaugaaaagcucucuuaauggggauaacuucagaacccagaaacuguccuuuaucauucgcacagugggacggcauuucccuggccaccuccuggcuugggacuuugugaaggaaaauuggaacaaacugguccagaaguucccccuugggagcuacacgauccaaaauauuguugccggauccaccuaucuguuuagcacaaagacccaucucucugaggugcaggccuucuuugagaaccagagcgaagcuacauucagacugcgcugcgugcaggaggcccucgaagucauccaacugaacauccaguggauggagaaaaaucuuaagucccugaccugguggcucuga

SEQ ID NO: 71557 - RNA, 1899 nt, Artificial Sequence
  derived and/or modified sequence opt5 from LNX1__Homo_sapiens__NP_116011
augaaggcccugcuccugcuugugcugcccuggcucagcccugcuaacuacaucgacaaugucggcaaccugcacuuccuuuauuccgagcugugcaaaggggccucucauuacggacucaccaaggauagaaaacggcgcagccaggacggcuguccggaugggugcgcgucccugacagcuacggcccccucuccugaaguuagcgccgcugccaccauuucccugaugacagacgagcccggacucgauaauccugcuuaugugucuagcgccgaagacggccaacccgcgaucuccccuguggauagcgggagaucuaaccggacccgcgccagaccguuugagcgguccacaauucgcagcagaucuuucaagaaaaucaaucgggcucuguccguccuucgcagaaccaagagcggaucugccguggcuaaccacgccgaccagggccgggaaaauuccgagaacacaaccgcgcccgagguuuuuccucgccuguaccaucucauucccgauggcgaaaucacgagcaucaagauuaauagaguggacccuuccgagucucugagcauccggcuugucgggggauccgaaacaccccuggugcacauuaucauucagcauaucuaucgcgauggcguuauugccagagacgggcggcuccugccgggagauaucauccugaaagugaacggcauggacauuagcaaugucccucacaacuacgcugugagacuccugcgccagcccugucaagugcuuuggcugaccgucaugcgggagcagaaguucagaucucgcaauaacgggcaggccccugacgcuuaucggcccagagaugacuccuuucacguuauccucaauaaaagcucucccgaggaacagcugggaauuaaacuugugcgcaagguggaugagccuggcgucuucaucuuuaacgugcuggacggcgggguugccuaccggcauggacaacucgaagagaacgauagagugcuggccauuaauggccacgaccugcgcuacgggagcccggaauccgcugcgcaucucauccaggccucugagcggagaguccaccuggugguuagccgccaggugcggcagagaucccccgauaucuuccaagaggcuggauggaacagcaauggcucuugguccccugggcccggagaacggagcaacaccccuaagccccuucacccgacaauuaccugccaugagaaggucgugaauauccagaaagacccuggcgaaucucugggcaugacggucgccgggggagccucccaccgcgagugggaucuccccauuuaugugaucagcguugaaccuggcggggugauuuccagagacggacggaucaagacaggcgauauccugcuuaacgucgacgggguggagcugaccgagguuucuagaagcgaagcuguggcccuccugaaacgcacauccucuagcauuguccugaaggcgcucgaggugaaagaauacgagccccaggaagacuguuccagcccugcugcccuggauucuaaucauaacauggcucccccguccgacuggagcccuucuugggugauguggcuugagcugccccggugccucuauaauuguaaggauaucguucugagacgcaacaccgccggcucccugggauuuugcauugucggcggguacgaggaauauaauggaaacaaacccuucuuuaucaagagcauuguggagggcaccccugccuacaaugacgggagaauccgguguggagauauucuucucgcugugaacggccgcucuacaagcgggaugauccacgccugccuggcgagacugcucaaggaacugaaaggccggaucacgcuuaccauugucuccuggccgggaacauuccuguga

SEQ ID NO: 71558 - RNA, 2073 nt, Artificial Sequence
  derived and/or modified sequence opt5 from LNX2__Homo_sapiens__NP_699202
augggcaccacaagcgacgagaugguguccgucgaacagacgucuagcuccucucugaacccccucugcuucgagugugggcaacagcacuggaccagagaaaaucaucuguacaacuaucagaaugagguugaugacgaucuugugugccacaucugucugcagccucuccugcaaccgcuugacacacccugcggacauaccuuuuguuacaagugccugcggaacuuccuccaggaaaaagauuuuuguccucuggaccgcaagagacugcacuucaaacucugcaagaaaagcuccauucuggugcauaagcugcuggauaagcuccugguccuuugucccuuuucuagcgugugcaaagacguuaugcagcggugugaucuggaggcccaccucaagaaucgcugcccuggcgcuucccacagacggguggcccuggagcgcagaaaaacaagccggacccaggcggaaaucgagaacgaaaaugggcccacacugcucgacccugcuggaacccugucuccggaggccgauugccuuggcacgggggccguccccguggagcgccaucugaccuccgcuagccucucuacaugguccgaagaaccuggacuggacaaccccgccuucgaagagagcgcuggcgccgauaccacacaacagccucuuucucugcccgaaggcgagauuaccacgaucgagauucacagauccaauccguauauccagcucgggaucagcauuguuggaggcaacgaaacaccucugaucaauauugugauccaggaggucuaccgggacggggugauugcgcgcgacggaagacugcucgccggcgaucaaauccuucaggugaacaauuauaacauuuccaaugucucucauaacuacgcucgggccguucuuagccagcccuguaacacccugcaccucacagugcugcgcgaaagacgguuugggaauagagcucacaaccauuccgacagcaauucuccucgcgaggaaaucuuccaaguggcccuucacaagcgggauuccggagagcagcugggcaucaaacucgucagacgcaccgacgagcccggcguguuuauucuggaucugcucgaagggggacuggcggcccaggacggccggcuuagcucuaacgauagaguucuggcuaucaaugggcaugaccucaaguauggaacccccgagcuggccgcucagauuauccaagccagcggcgaacgcgugaaccugacaauugcccggccugggaagccgcagcccggaaauacgaucagagaggcuggcaaccacuccucuagcucccagcaucacaccccucccccuuacuacagccgccccucuucccacaaagaucuuacacagugcgucaccugucaagaaaagcauaucacagugaaaaaggagccgcacgagagccucggcaugaccguugccgggggacggggcucuaaauccggggaacugccuauuuucgugacgagcgucccuccucauggaugccuggcgagagacggccgcaucaagagaggggaugugcuccugaauauuaacggcaucgaccuuacaaaucugucccacucugaggcugucgccaugcucaaagccagcgcugccucccccgcgguggcucugaaggcccuggaaguucagauuguggaggaggccacccagaacgcugaggagcagccuucuaccuuuagcgaaaaugaguaugacgccuccuggagccccucuugggucauguggcuuggacucccguccacacugcacagcugucaugauaucgugcugcggcggucuuaccucggcuccuggggguucagcaucguuggaggcuaugaagagaaccacaccaaucaacccuuuuucauuaagacaaucgugcuggggacgcccgcuuacuaugacggacgccuuaaaugcggcgauaugauugucgccgugaacgggcugucuaccgugggcaugagccauuccgcgcucguucccaugcugaaggagcagagaaacaaagucacacugaccgugaucuguuggccuggaagccuuguguga

SEQ ID NO: 71559 - RNA, 1755 nt, Artificial Sequence
  derived and/or modified sequence opt5 from LOC100288966__Homo_sapiens__NP_001244291
augguggccgaggucugcagcaugcccaccgcuuccacaguuaagaaaccuuucgaccugagaucuaagaugggcaaauggugucaccaucgguuuccgugcugucgcgggagcggaaaguccaacaugggcacgucuggggaucacgacgauagcuucaugaaaaugcucagauccaagaugggaaagugcugucggcauugcuuucccuguugccgcggcucugggaccagcaaugugggaacauccggcgaccacgaaaacagcuucaugaaaaugcugagaucuaagaugggcaaaugguguugccauuguuuuccuugcugccggggguccagcaagucuaaugugggagccuggggcgauuacgaccacuccgcguucauggagccccgcuaucacgucagacgggaagaucuugacaaacugcaucgcgcugccuggugggggaaggugccuagaaaggaucucaucguuaugcugcgggacaccgauaugaacaaacgcgacaaggagaaaagaacagcccuucaccuggcuagcgccaauggaaacucugaagugguccagcuccugcuggaucggcgcugucaacucaaugugcuggacaacaagaaaagaaccgcucuuauuaaggccauccagugccaggaggacgaguguguucugaugcuccuggaacauggcgcggaucggaauauucccgacgaguacgggaacacagcccuucacuaugcuaucuacaaugaagauaaacugauggccaaggcucuccugcuguauggagccgacauugaguccaagaacaaaugcggccucaccccucugcuucugggcgugcacgagcagaagcaacaggucgugaaauuucucaucaagaaaaaggcgaaucugaacgugcuugauagauacgggcgcacggcccugauccucgcugucuguugcggaagcgccuccauuguuaaucugcugcucgaacagaacguggacgugucuagccaggaucuguccggccaaaccgcucgggaguaugccgucagcucucaucaccaugugaucugugaacuucuguccgacuacaaggagaaacagaugcucaagauuagcucugaaaacagcaauccggagcaggaucugaaacuuacauccgaggaagagucucagagacugaagguuagcgaaaacucccaacccgagaaaaugagccaggaaccugagaucaauaaggacugcgaucgcgagguggaagaggaaauuaagaaacacgggucuaaccccgucggacucccugagaaucugaccaacggcgccuccgcugggaauggagacgacggccugaucccccagcggagaagccgcaagccggaaaaccaacaguucccugauacagagaaugaggaauaccauucugacgagcagaacgauacccggaaacagcucuccgaggaacaaaauacgggcauuagccaggacgagauccugacaaacaagcagaaacagaucgaaguggcggagcaaaagaugaacuccgaacuuucucugagccacaagaaagaggaagaucuccugagagaaaauuccguucugcaggaggagauugccgugcuucgccucgagcuggacgaaaccaagcaccagaaucagcugcgggagaacaaaauccucgaagagauugagucugucaaggagaaaacagauaagcugcuuagagcuaugcaacugaacgaagaagcccucaccaaaaccaauaucuga

SEQ ID NO: 71560 - RNA, 1650 nt, Artificial Sequence
  derived and/or modified sequence opt5 from LOC101060321__Homo_sapiens__NP_001278391
auggacguggucgagguugccggcagcuggugggcucaggaaagagaggauaucauuaugaaguacgaaaaagggcaccgggccggacugcccgaggacaagggcccuaaaccguuccgcuccuauaauaauaacguggaucaucucgggaucgugcacgaaaccgagcugcccccucuuacagcgagagaggcuaagcaaauucggcgcgaaaucucuagaaaaagcaagugggucgacaugcugggagauugggagaaguacaaauccucucggaagcucauugaccgcgccuauaaaggcaugcccaugaauaucagagggccuauguggagcgugcugcuuaacaucgaagagaugaagcugaaaaaucccggacgguaccagauuaugaaggagaagggcaaacgcuccucugaacauauccagagaauugaucgggacaucagcggcacgcuccgcaagcacauguuuuucagagaucgguaugggaccaaacagcgcgagcugcugcauauucuccuggccuacgaagaguauaacccugaaguuggauacugcagagaccuuucccacaucgcugcccuguuucuccuguaccuuccggaggaggaugcuuucugggcccuggugcaacuccuggcgagcgaacggcacucucugcagggcuuucauucccccaaugggggaacaguccagggccuccaggaccaacaggagcacgugguugccaccagccagccuaagacaauggggcaucaggauaaaaaggaccuguguggacaaugcucuccccuuggcugucugauuagaauccucaucgacggcauuucccuggggcuuacccugcgccucugggauguguaucuggucgaaggagagcaggcucugaugccuaucacacggauugccuucaaagugcagcaaaagagacucaccaagacgagccgcugcggccccugggcucgguuuuguaacagauucguggacaccugggcccgcgaugaagacacaguccugaaacaccuucgggcgucuaugaagaaacugaccagaaagcagggggaucucccgccucccgccaaaccugagcagggauccagcgcuucccgccccguucccgccucucggggcgggaagacacugugcaagggagacagacaggcuccuccggggcccccugcccgcuuuccccggccuaucuggagcgccuccccgcccagagcuccucggagcucuacccccuguccuggcggggcggugcgcgaggauacguaccccgugggaacacaaggcgucccuucccccgcccuugcucagggcggaccgcagggcagcuggagauuccugcaguggaacucuaugccucggcuccccaccgaccuggauguggaagggcccugguuuagacacuaugacuuccgccaaagcugcuggguucgggccauuucccaggaggaucagcuggccccuuguuggcaggcugaacauccggccgagagagugcgcucugcguuugcugcccccagcacagacuccgaccaaggcaccccuuucagagcccgggaugaacagcagugcgcucccaccagcggaccuugucucugcggccugcaccuugagucuucccaguuucccccuggguucuga

SEQ ID NO: 71561 - RNA, 453 nt, Artificial Sequence
  derived and/or modified sequence opt5 from LOC102723475__Homo_sapiens__XP_006724009
auggccuaccuggaggugugccucggcagccuguccuguucuagcgggacccuuaugcccagaaugauccuguccaacacaacggcugucaccccuuuccucacaaagcuguggcaggaaaccguucaacagggaggcaauaugucugggcuugcccggcgcagcccgagauccggagacggcaaacuggaggcgcucuaugugcugauggugcugggguuuuucggauuuuucacacucggcauuaugcugucuuacauccggagcaagaaacuugaacacuccaacgaucccuuuaaugucuauauugagagcaacgcuuggcaggaaaaggacaaagccuacgugcaggcccgcguucuggagucuuauagauccugcuacguggucgagaaucaccucgcuaucgaacaaccuaacacccaucugcccgagacaaagccuagccccuga

SEQ ID NO: 71562 - RNA, 1551 nt, Artificial Sequence
  derived and/or modified sequence opt5 from LOC102723996__Homo_sapiens__XP_006723962
augagacugggcagccccgggcuccuguuccuucuguuuuccucucuccgggccgacacccaggagaaggaagugcgcgcuauggucggaagcgauguugagcuguccugcgccuguccugaaggcucuagauucgaccuuaacgauguguacguguauuggcaaacaagcgaguccaaaacggucgugaccuaccacaucccgcaaaauucuagccuggaaaacguugacucccgguaucgcaauagagcgcucaugagccccgcugggaugcugcggggagauuuuucucugcgccucuucaacgugacaccucaggacgagcagaaguuucauugccugguccuuucccagagccugggcuuccaggaggugcucucuguugaagugacccugcacgucgccgccaauuuuuccgugcccguggucagcgcuccucauucucccucccaggaugagcuuacauucaccuguacaagcauuaacggguacccuagaccgaauguuuauuggaucaacaaaaccgacaauucccugcucgaucaggcccugcaaaacgacacgguguuucugaauaugcggggacucuacgauguggucucugugcugcgcauugcuagaacccccagcguuaacaucggcugcuguauugaaaaugugcuucugcagcagaaccucacagucggcucccagaccgggaaugacaucggagagcgggauaagaucacagagaacccugugagcaccggcgagaaaaacgccgcgacguggucuauucuggccguucuuugccugcucguggucguggcugucgccaucgggugggugugucgcgacagaugccugcaacacuccuaugcuggagccugggcgguuagccccgaaacagaacugaccggcgaguucgccguggggucuagccgguuuuggggagcucagggccgccucggcugucagcuguccuucagagucucuaagaauuuucaaaaggccgaagugccuugccuugagcagcuccuguuccuggagacacagcggagccccagauggugugcucgccauuuccuucagccgccucuggggaugggauggcaccccggcguucacuuugugacccuccggugggacuucccuaacaugcauagaucccgcgaaaccagcgcccggcugcccagaucucccgucccuuccccggaucaaggggugcagggaggcagccgccaccggagacccgccccuauggggugccccgagugggugcaggcuccugcgcccucuccgcgcggaguuucccgggccggcccuggcacaggggcucagcccccuuggggaguccaaggcgggagcagacaucgccggcccgccccuaugggaugccccgaaugggugcaggccccggcuccuucccccagaggcgugugucgggccgggcccggcacgggagcgcagccucuguggggcguccgcucugggagcggacacagacagcuccuguccguggcugccaccccggccgcucuuguuugccccucugugccuggcgccacauga

SEQ ID NO: 71563 - RNA, 399 nt, Artificial Sequence
  derived and/or modified sequence opt5 from LOC102724127__Homo_sapiens__XP_011544335
augagagccagccccugcaucucccagccugcugccucuuggcacccgcggcccagcgcgcugcgcccuaccgcuggcuccgggcccgacacaagaacgccuggaaccguggaggauggcucugcccccuguccugccuuccggagcccggcugucucccccugcggggaggaaccuuguugcuuucaaauuucucccgccgaagagacacucgaacugggacgccuuguuagcccuggcaacugugacacccugucccccagagcugccggguucuacgcgugccaugugcggagccucaucccgugucgcucuacaaagggaagauggccucugaccgccuccgcugccggccuuagccggcacgcucagugcggccccucucuggggcucggauga

SEQ ID NO: 71564 - RNA, 1656 nt, Artificial Sequence
  derived and/or modified sequence opt5 from LOC102724560__Homo_sapiens__XP_011544402
augcccagcgagaccccucaggccgaagugggcccgacagggugcccccacagauccggaccucauucugcuaagggcagccuggagaaagggucccccgaagacaaggaggccaaagaaccucucuggauccggcccgaugcgccuucucgcuguacguggcaacugggaagaccggcuagcgagucuccccaccaucacaccgccccugccaagucccccaaaauucuuccugacauccugaagaagauuggcgauacacccaugguccggaucaacaaaauugggaagaaauucggacucaagugcgagcugcuugcuaaaugugaauuuuucaaugccggcggcagcguuaaggaccgcaucucccugagaaugaucgaggaugcugaacgggacgggacccucaagccgggagauacaauuaucgagccuaccagcggcaacacagggauuggacuggcccuggcggccgcugugcgcggcuacagaugcaucauugugaugcccgagaaaaugucuuccgaaaaggucgacgugcuccgggcccugggggcugagaucguucgcaccccuacgaaugccagauuugauagccccgaaucucaugugggagucgcguggcggcuuaaaaacgagauucccaauucccacauccuggaccaguaucgcaacgccagcaauccucucgcucacuacgauaccacagccgacgaaauccugcagcagugugauggcaaacuugacaugcugguggcuucuguuggcaccgggggaacaauuaccggcaucgccagaaagcucaaggagaaaugcccggggugucggauuaucggaguggaccccgagggcuccauucuggccgaaccugaggaacugaaccaaacggagcagacaaccuaugaagucgaggggaucggauacgauuucauccccacagugcucgaccgcaccguggucgauaagugguuuaagagcaaugacgaggaggcuuucaccuuugcgagaaugcugauugcccaggaaggccuucugugcggcggguccgcuggaucuacaguugccguggccgugaaagcugcccaggaacuccaagagggccagcggugugucgugauccugccugauagcguuagaaacuauaugacgaaguuccuuuccgaccgcuggaugcugcagaaaggguuucucaaggaagaggaucugaccgagaaaaagcccuggugguggcaucugcgggugcaggaacucggacugagcgcgccgcuuacaguccugccuaccauuacaugcggccacaccaucgagauucucagagaaaagggguucgaccaagcucccgugguugaugaggccggcgugauccugggaauggucacgcuuggcaauaugcugucuucccuccuggccgggaaagugcagccuagcgaccaggucggaaaggugaucuacaaacaauuuaagcagauucgccugacagauacccucggccggcugucucauauccuugagauggaccacuucgcucugguugugcacgaacagauucaguaucauagcaccgggaaauccucucaaagacagauggucuuuggagugguuacagccaucgaccuccugaacuucguggcugcccaggagcgcgaucagaaguga

SEQ ID NO: 71565 - RNA, 663 nt, Artificial Sequence
  derived and/or modified sequence opt5 from LOC102724770__Homo_sapiens__XP_006724997
auggagagauacgccggcgcucuggaagagguggccgacggggcgcggcagcaagaacgccacuaucagcuccugagcgcccuucagucccuggucaaggagcuccccucuagcuuccagcaaagacuguccuacaccacacuuucugaucuggcucucgcccugcuggacggaacgguuuuugaaaucgugcagggccuccuggagauucagcaucuuaccgagaaaagccuguauaaccagcggcuccgccugcaaaaugaacacagagugcuucggcaggcucugcgccagaagcaucaggaggcccaacaggcuugcagaccucacaaccucccgguccugcaggccgcgcaacagcgggaacuggaggccguggagcaucgcaucagagaggaacagcgggcuauggaucagaaaauuguucucgaacuggaccgcaagguggccgaucaacaguccacacuugagaaagcuggggucgccggauucuacgugaccacaaauccccaggaacugaugcuccagaugaaccugcuugagcugaucagaaagcuccaacagcggggcuguugggcggggaaggccgcucugggacugggcggcccuuggcagcuccccgccgcucagugcgaccaaaaagggucuccuguucccccuuga

SEQ ID NO: 71566 - RNA, 2292 nt, Artificial Sequence
  derived and/or modified sequence opt5 from LOC102725016__Homo_sapiens__XP_006725712
augcacggcgccugcagcaugagacgguuccauccccugcucgcucuggccgggacccacugugcgugcucccauuuucgcucuagcagaacagcuacgccuccgugggccgccccucuuaagauccugaacgcugagcgggcccgcgcugugagaccuccccagccucucccccggccucaccgcuccagaucugccccgcccaaaccucccgcgaaggccccucgggcugccggacgcgcuuggcuggccgcggccagccccagagacgauauugucgcuaugacccggcgcuccgacguuaaugccggcgcucuugugugggaaagagggcggcgcgccagauucgaggccgcucugucuagcgcgggacggacagccccgccucccagauccccucgccccgcuagcccccggucuuccagaggcgccgggccugugccgugugccgcucccccucaacgcgccguccucgcgagcccccggucugugagaggaggcccuaaacccccgggccgcgggggagcucgggccuccggcggggccgcuggaccugcccccgcuaugccucccggcaagguucugcagccugugcugaaaaugaaggucgaugaacucuuucuguacuggcuuagcgaggccucuacccagagaaugcugcaggacugccuccgccggaucaaggcgcccgggagagaucaaccgacaccuggagacggcgaacagcccggcgccuggcccaccgcuccucuggccgcuccgcgccccuccgggcuugagccucccggaacaccuggccccgggccugcccugccccucggagcggccagcuccccgcggaacgcuccucaugugagaggcacccggcgcucugccgggacgagaguugugcagacccggaaagaggaaccccugccucccgcuacaagccaguccauuccgaccuucuauuuuccuagaggacgcccccaagauagcgucaauguggacgccgugaucucuaagauugaguccacauucgcccgguuuccucacgaaagagcuaccauggaugacaugggccuggucgcgaaagccuguggcugcccccucuacuggaaggggccccuguucuauggagcuggcggggagcgcacgggaagcguuucugugcacaaauuuguggccauguggagaaagauccuucagaacugucaugaugacgccgcuaaguucguccaucugcucaugagcccuggcugcaauuaccuggugcaggaggauuuuguuccguuccuucaggacguggucaacacacaccccgggcuguccuuucucaaagaagccucugaguuccacagccgguauaucaccacagugauucaacgcaucuucuacgcgguuaauagauccuggagcggccggauuaccugugcugaacugcgcagaucuuccuuucugcagaacguggcccuccuggaggaagaggccgacaucaaucagcuuaccgaguucuuuagcuaugaacacuucuacgucauuuacugcaaguuuugggagcuggauacagaccaugaucuccugaucgacgcugaugaccuugcccggcacaacgaucaugcgcugucuacgaaaaugauugaccgcaucuucuccggagcugugaccagaggccggaagguccaaaaagaagggaagaucagcuaugccgauuuugugugguuccucauuuccgaggaagacaaaaagacaccuaccucuaucgaguacugguuucgcuguauggaucuggacggagacggcgcccugagcauguucgagcucgaauauuuuuacgaggaacagugcagacggcuggauuccauggcuauugaggcccuucccuuccaggacugccugugucagaugcucgaucugguuaagccuagaacagaagggaaaaucacccugcaagaccuuaagcgcugcaaacucgcuaauguguuuuucgauacguucuuuaacauugagaaguaucuggaccacgagcagaaagaacagaucucucugcuccgggauggagacagcggcgggcccgagcuguccgauugggaaaaguacgccgcggaggaguaugacauccuugucgccgaagagacagugggcgaaccuugggaggauggauucgaagcugagcugagcccgguugagcagaagcucucugcccugagaagcccccuggcucaacgccccuuuuucgaagcccccuccccucuuggcgccguggaccucuacgaguacgcuuguggggaugaagaccuggagccccuguga

SEQ ID NO: 71567 - RNA, 1899 nt, Artificial Sequence
  derived and/or modified sequence opt5 from LOC102725035__Homo_sapiens__XP_006726376
augacccccgcccugacagcucuccugugccuuggccugagccucgggccuagaacgcgggugcaggccggaccguuccccaagccuacccugugggcggagcccggcuccgucaucucuugggggagcccuguuacaauuuggugucaaggaucccuugaagcucaggaguaccgccuggacaaagaaggcucucccgagccucucgauagaaacaauccgcuggaacccaagaacaaagcccgguuuagcaucccuuccaugaccgagcaccaugccgggcgcuauagaugccacuacuauucuagcgcuggaugguccgagcccagcgacccucuggaacucgugaugacaggcuucuacaauaagcccacccugucugcccuuccguccccuguggucgcuagcggcgggaacaugacacugcgguguggaucucagaaaggcuaucaucacuuugugcucaugaaggagggggaacaucagcugccccgcacccuugauucccaacagcugcacagcggaggcuuccaggcccucuuuccuguugggcccgugaaucccucucacagauggcgguucacgugcuacuauuacuacaugaacaccccucaggucuggucccauccgagcgacccccuggagauucugccuuccggagugucucgcaagcccagccuccugacacuucaaggcccuguucuggcgcccggccagucccucacccugcagugugggagcgaugugggauaugacagauuuguccuuuacaaagagggcgaacgggauuuccugcagcgcccggggcaacagccucaggccggacucucucaagcuaauuuuacacugggccccguguccccuagccacgggggacaguauagaugcuacggcgcccauaaccugucuagcgagugguccgcucccucugacccucucaauauccugauggccggccagauuuaugauaccgugagccuuuccgcgcagcccgggccgacggucgccagcggagaaaacguuacacugcucugucaaucuugguggcaguucgacaccuuucugcuuacaaaggagggcgcugcccacccuccccugcggcuccgcuccauguacggggcucacaaauaucaggccgaguuccccaugagcccugugaccucugcccaugcuggaaccuacagaugcuacggcuccuauagcuccaauccgcaucugcugucuuuucccagcgaaccucucgagcugaugguguccgggcacucuggcggaagcucccuucccccuacagggcccccuagcacgcccggccugggacgguaccucgaaguccugaucggcgugucuguugcguucgugcugcuucucuuccugcugcucuuucugcuucugagacgccagcggcacuccaagcauagaaccagcgaucaacgcaaaacagacuuccagcggccggccggggcugccgagaccgaaccuaaggauagaggacuccugcgccggucuucccccgccgcugacguccaggaggaaaaccuguaugccgcggugaaggacacacagagcgaggauagaguugagcuugacucucaacagagcccucacgaugaagacccccaggcugugaccuacgccccggucaaacacuccagcccucgccgggagauggccucucccccuuccagccucuccggcgaauuucuggauacgaaggacagacagguggaggaagaucgccaaauggacacagaggcugccgcuucugaggccagccaggaugucaccuaugcgcagcugcauucccucacccugcggagaaaagccacagaacccccucccucucaagagggggaaccgcccgcugagccuagcaucuacgccacccuugcuauucacuga

SEQ ID NO: 71568 - RNA, 9861 nt, Artificial Sequence
  derived and/or modified sequence opt5 from LOC400499__Homo_sapiens__XP_006721060
augaccgccugcaccggcagcgcugggccccaucugccugugggaacgagauacaccuaucacuucuccacaaacaccucuacaagccuccaggacguccugguugagggcuccgggcuuggacugcagggccucgccgugcuggaugugcuugggcugugucagauggcgcucuggcugcaggacuuucaggugaccucuauccugggagcuaagguggaacuccugaaggagagcgaaucccuuucugccacacugggccggaauccgcuccgcuucauucugcacagcggcagaguugcccaucuuugcccccacccuaccgagccccggugggugcugaacgucaagcgcgcugugcucucccugcugcaagggcauccuggagcccacagccccaagacguuugaugaaguugacauccucggcagauguccuaccacauaccagcaccauggggauuggcugcacaagaccaaggaccuugcucggugcucucugcgcagaggacgguccagccuccauucucaggcccugccgggcguggcgcccgggcuuacaucccgccugaccuguguccagagcuucagagccggagugcuccgggaggcuucuugcacggagcuggauuccgccggcccucugcccgcuaaggccagcgcggugcaaaugcgcacacucuccucucugagccuucugcacgaaaugccucaggaccccgccggcaccgauccggacgauagagacgaugaggacaugacaccuuccagccuccuguaugaaugggaggagacccccucucaggcuauggucgccaccgcugccacacuuguucggcgccugugucucgcccagacgaccucccuggaagcuauggaccuguuucucacacuggugagccaacuucaggggcugucuggaggcgagcucauggaacuguggcaguacagcuccuucaagugcagagauaaugggcaaccucugcuugacgcgcuccccucuuguggaaccgagcacugcgugggccugaugaaagaacugauugccagcgcugccgucgaggccgaugagguggaggcuuggcucuccagccuggccuuucuuccccagccuacagacgcgaugguucauaugcugcucccgcugcugcagacaccccgggcuucuccuggggccuuccuuggaaucuccgcccucgugcacaaccugugugcuagccuggauggccccugcggccagcucccuggggucggaucucuggugcggauucuuggcgacgcccugggggagaauugcacgauccaagaacccuccgaugacgauaagcuccagcugguucugaaagcugugggaaacgccggccuugcggccauggcucucacaccgacccugagcgccugugcuucccugcgcucuagcaccccugagauccggcucggggccauucaggcguuuagacgcguccccugcuccgccgaccggucugugcugagcagacuuuaucagucccuggaagaggaugcugagauccgcauuaaugccuaccucgcucugaugcgguguccuagcgaagaggucuucgcccaagugagacgcacacaggccggcgaacugucuacccagguuggauccuuuguguggagccauauccuucagcuccuggagacacacgacccccugaagcgggcucucagagacacgcugccugaagauauucuuucucaagaguuccaucccgagauguggaaacacuccagcuauucugacgucaccuuucgcagcguguccggcagccugggggcgaaccucgaaggaacacugcuguucucuccggccuccuuccuuccucggagcgcuaccguuaaucugacaauccacaccaugggcagagccuuuaaccuccuggagcucgggcugcggcuugaaaaugccgaggagauugcucaucgccuguucggaagaaaguccuuuuggggccaggaagaugggcgggagcccgaacccgaggaaccuccgggccccgagccuggacccgccccucagcccgcgucuccugagugccccggcgacagagaucgccggaugagauaccuccagcaaaaggugacgcgcagaagaggggcucgccaggcccugagaugugaacugagcgucaaacuucugggacaggagcucuccuucgugaacugcggcgccaccgggucucacgugaaucauuggccgcugaaccucgcugaacuggccaucaaacuuaugaaaggacaagagguucagaugaaucggcgccugagccucgcggcucaggaacuggucuuuccuacaguguccggccugcccgccagacuuacccugaacgccucugcugccaucagcauucgggugcgcgggacaaccgacuuccagcaaagauccgauuuuagcgucaacggcuacgugaagccuucugcucuccugcagaucuccgcccagaugggaacggcgggcauucucgggcaggccggacugcgguggguuacaagcgugcgcucugcugccucccuugacggcgggauccaaguccagaaaggaagagugcugaagguucaccugaauacccccgaggaggcuguggaacuccugagcuucucuucccagcuuuaucugauuacacgggauggcgucagaagccuccgccacgugccggggccuuccgagguucagagcuguaccggcgaagaggugucuuacaccuggggauggcggcugugcacaggcgucacguggcccgugccugggcaacccuaucuccugagccuucccguguuugccgccgucacccugcagaaaagagacccuggacugcgccaguaccuccuggaagcugcguauacacuucaaccgcagaagggcuccugguucccccaggaggccaccgcucauguuuuuauggggacaccuggaucugaggugcugcgggaugugggcgucgacaugagcuacucccucccccagaacaaguucagacugaaacuccugcacccuaagaaaaagaucgaacuugauggcaaaauggaggcccuggggucugcccauaccggacaccuggaacucgugcuggacgaccgcgauguuuauuacaucaagggcuggagcgaccuucaacccgcuaugggaggggaggccgagcgguuucaggcgcagcuggaagugaagcucgucacgggcggguccccugugguuuucacaggaaaucugaccagacaggugggcucuaaacucgcuuucagcgccucccugagccaucuucugucugaucaagccaacgucaccgcucugcucgagcgcaaggaagagaauggccggagaguggccgcgcugggggcugaacuuuuuguuccgggacuggugggccuccgggcccuggggcugcuccagcagcgcggacagcuuuggacaaacucccugcggauucaauacagccugcucggccaggccaaacaggcugcccacgaguguucuaccucccagaagcugagagcugacagcggguccgauggagccuaucgccuugagcugagacacgaacuccauugcacacaaauccuggcguucucucacaaaguccagcuguggcaugaggaagacagcggccaccuccauucccagcuugaggugagcuacggcaagcacugggauaaaaauucuaacaaacggcaccugagagugucccaaacguuuaagaaugacagcgggcccgcccugucuaaccauuucauggaauuuguccuccagguuccugagcgccagguggauugucgggugcagcuguaucaccuuagccugagacuccccuacgucgaguccucuagccaucugaaagugcaauauaauggacgcccucuguucguugcuggcgggcaguggaaggacaccucccgggccacacucuggaaaugggaaggagcucuuaaccuggauucucccuggcugauggugagcgccgcccacagacucuacuggccgcaccgcgcugucuuucaggcggugcuggagcuuacccugggcaaggccuggacacucaaggaccugguuguguccgucgggugccggagccagggaccuaauagagaaggcaaaauucaaguguauaccgcugccacgaccuaccugcgcgucucuacagugaccguucucgcccagucccuuuuccauagcugguccgagcuggaaucugcuuggaacgccgcggugcagggcgagauccacgcugagaauagcagagaucggaagauucugaacugcuggcucaaagggccccagcaagaacugaaccuuacagccgccuaccgccaucuggaguggcccagaaagacccaggucucccucacagcugugcggaucggagcccagggccaaccucgcgggcugcagcuggaaggagagcucgaggaacuuagacaggaccggacccuguauagaaaacgcggcgcgcugcuccugcggcacccccuucaucugccuaucccgcagucucuccugcugcaagagacguuuacagccgacagacgccaccagcgguacagccucgaaaccagaguugugcuuaaugggcgggaggaaacccugcagacaaugguccugggaugucaggcuggccaccccuaugugugcgccggccucaugcauccuuacgaugggaaggugauuccccgcaacaccgagggaugucugguuacguggaaucaacacacagcuaaaaacagagaggucgaagccacccuuaaggugcaucggaaggugguccugcaccucaaaggccugcaccaugaccgcucccagcacggggagaucagacauagccuggcucucgaucuugcccacucuuaucagcuguccuucccucaggcgcugagccucgacggaggcauuaucuuucggcaaucuccccaggggacauucaauuuuggaauggaugcccgcgcugccgugaaccauaauguuaccucccaggcuagcgugcagcugaacggcucugacagcgauuucgccuucuuuuuccaacuuagacacccgcacggcccuacauuucccccuaauuuccagguccaggccgcugcggggcgguaccgcgugagaucccugaacggaucucucagcguucaaauguccggccgggaacuggugcugcucgaggucgacgccagccaggauaccagacgcuccucucggggguggggagugagcguucuucugcaucaggcugugcuguccgcccccagagccguccgccuccagcugucugcuaagauuacgccugcccggaucuggcuuuuuagcaaagcgcugcucgaccaaaauaccgcccagcugcugcucaaggcuuccgaagaguggagaggcgggcgcauucuuacauuccagucucagacccggcacacaguggccggaugggcugccaugcccagacugcugacccucacgggccgccugaaacaaaaggagacacuucaggaaggcacccugagcgugacagcggauuccgccguccucggguuucugcugcgggaccagcaugagaaggcuggaaacggcaccagcguuagaucugugaccugcgugcucgcccaaaauagcagccaagcucugccgggggaacuucagcugaaaggacgccuccaggcccaaacacggaaccugagagcucaggccucuauccgcgcgcacgccgcuucccuugcccugggcggggcuuguagcuggggcccuagacacggacagcucgccggcgggcccacgcauaauaucucuacccuguccgacgccggacugcccagcgaggcgggcaugcuccugucccuuacacacgucgcuagcaacugcucugcccggcuggcucucuggaacgccggggcccagcuggauggagcuauuggccuugaagacgugaccccugagagcuccgggcugcaacuccaugccucucugcgccacacacauaccaugccgagccugaagcacuggggccuccccuucucccuggauggacacggccauuuucagucuguugggagaagccuugcggccggacugacggugauccucgacggcgagcagcugcgggcugcccuugaaagaaaagcugaagggggacggcagggccugguccucgggcugcaccauggccuguccggacuccaaggcacacugccuucucagcuugaagugaauuguagcggggaugccucccccacccagcugcucggauggugccgcggcgacauugcggggcagccucuggagguuagcguggauauccacaacggaucuuccggcuucgagcauagcggccggauucuuauggggcccaccuuucugaauuauucugucuccuguuacuaccacgacggacaccucgaacugagcggcagauccuggcauaacucugaggcccugcucugggcuggguucccuggagaagccugccugagcgcugagcuucaaauccacgaaacacagacccaggcccgcguggcucugcauggcggggauuccggagucagcauggaccucgccgcgcugguggccagaccgcggcgcggcccccuucaacugguugcuucugccucccacacagugccugcucuccagagacugggccugcccuucacgaaucagcucguguuucaggggcugugggaggccgaggaaaugagcucuagccuucaacugaccugugauucccaggccacacucguccuggacguucggggacagaaccaggcggugucuaaggagcuucuguucagcggccgccacagacucccuuuucugcuggggcucugccccuccucugcuagcgccuccgccaaacugcauuauagcaagggagaagugcaaucuauguucgcucuuggcgucgaggaacggcacuuucauaucuccacccgccagguggccgcuaaggccgggcugaauaacuucauuaaacucgagcagacauuucugcagcuuagcgcgcugccgagagaacucuuccugcaaaccgccuacgaacgggcucacggaacgcgcguucugagacaggugguccuuugggauggccaggagguggcccugaccggcucccucucugggccuuuucccaagcccacacggaaucugagccuccaggucgaacugacccauccucuuccccugccucugccgagacacugcucccuccgccugucuagcgagcaccuuggaggcucccaucgggacgggcuggugguuggaugggacggcagagaucaagugcucgucuccucuucccuguggcucgggaaaagcgaacuggcugcccgccuggcgcuugcccaccccuucaaccugccuuggcggcaggcugaggccucuggacucgcugaguccagaggcggccgccagagccggcaagugcagcugacauggaauagagggcagcccgccacccuucagcugacaugggcugacggaucucucgcccauuccacggcgugggauggcugucuggccgcuagcccugggcaacuccaggaaaccuggggacugaacucucugcaggccugcggcgccuuuacacagacccccgcuguuuucguggagcaacuuaaugucagcugggggcagcaccgcaugcggcagaaccugaccuaugaaagacacuggccgucccagccugacaagaucauuauggaggccacacucgagcaugugcugggagcgagcuguacgcgccaauccuuuuggggcgaagugcagaccgauuacgcucgguggcuuagacacucucugcaucucggccugugcgaccugccccgggcccuccugguugucggggagcacacacuuggacagggcgggcugcuccugagaagccgcugucaucuuggacuggccccugaucccgaccacggccuccaccugucccugacccuccaaaaucauucucggccuagaagcgcugauuucuccggggcccuggaacuucgcggaucuaaagcucagagagugggccugcucggccgggugagcacauccaccagccagucucugguccgccuugagggguccguugacaacagagaagagaaggugcggcugagcguguuccgcgcccccucuugccuccaggcguccgucgcccacgaggaaggaggcagagaggaaagcgugguucugcgggcuugugcccaugggcgcacggcugaggccgaagugcuguuuagagauggacggcaaccgucucagccucucggccgccugacacuucaggcggccaaccagucccugcuccuggcugccagagggugccaaggaggccuucugggccacgucgagagccggaucgcugccguggggucucagguucaggcccgccucgaggaaaaggugcagggacugggcgcuuccgucagacgguuccaacagcuggugcagcccgcggggacccucgacggaguggccggccugcuucugcagcucagccaagcugggagagaggccaugcaggccagcggcugggcugucgccacccugugggcgcgcucccaggcucuuacacaacaucugccccucuaucuggaauggcugcagguuggacucgagcagcugcgggaggaacuugaguggccucuggccacccucaaagaugccuaccuggaagugacacuuagaccgcuggaggaaguguggcgcgagcgggcugaggaagccaugagacgccuccaggcuuggguccccggcaugccugggaagggaggcccccggccuauuagagccgcgcugggggccaugaaaggagcucuggagcucgccgcucaacagaugcugucuugggccgaagcgaccuuuagccgcgcccuuaagcggcuguguaaaccccuccuggaccuguauucccucucugcuagaaaucggagcgugguugugaugcuuccucugcugcccgccggcgacgagccgcucgaugucgcucgcgugacguccuaccugauggaagagaaacuucugagaccucuccgggagcugucuggggccaacguucuggccgaauacuauuggcuucgcagacggcuccuggcuggccccugggaguaccacgcgcugguggccggagcucagcacgucgugacauucgacggcagaguuugggaucucagcacccagugcggguccauccugcuugcccaagacuuugcccauaauacauucagccugacccucucucgcacgggauccggccugaccgcucuguuuguggaacuuaaccacaaaacacucauccuguauccuagccugcaggccuaccggcucuauaauucuucccugcccggggauagcuguccggaccuuaagcugcauccugcgaccacaagaaaggaugucucccgcauugagcucgcuucugaagacggagugagcgucuccugcgaugugcccaccggccugugcucucugacacuugggcucuggcagcacggcaucagcgccggacugcugggcaccaacgacaaugaggccgggaacgagcucaugcugcccgauggauccauggcucggagccuugaggagcugucucucgccuggcagguuggcggggacuguagagcuacggaaaaaccucaacaggagcaggccugccccggacaacugccugcguguugggccuucuuugaaggcccgcacuccagccugcgcgacugcuucagaguggucgaucccacaccuuuucuuucucucuguguccaggugcccugcgggacccaggagcugcagccugcuuguaaucuggccgcugccuacauucaucucugcgcgcggggcuucguuccccuggccccuccgccccaaugugcuccuuga

SEQ ID NO: 71569 - RNA, 1251 nt, Artificial Sequence
  derived and/or modified sequence opt5 from LOC400927-CSNK1E__Homo_sapiens__NP_001276841
auggagcugagagugggcaacaaguaccggcucgggcgcaaaaucggaagcggcuccuucggggacauuuaucugggagccaauaucgcuucuggcgaagaggucgccauuaaacuugaaugcguuaagaccaagcacccccagcugcauaucgagagcaaauuuuacaagaugaugcaagggggagugggcauuccuuccaucaagugguguggcgcggaaggggauuauaacgugauggucauggagcuccugggaccgucucuugaggaccuguucaauuuuugcagcagaaaauucucccucaagacagugcugcugcucgcugaucagaugaucucucggauugaauacauccacagcaaaaacuuuauucaucgcgacguuaagcccgauaauuuccugaugggccuugggaaaaagggaaaccugguguauaucauugacuuuggccucgccaagaaauacagagaugcccggacgcaccagcauaucccuuaucgcgagaauaagaaccugaccgggacagcuagauacgccuccauuaauacccaccuuggaaucgaacagagccggcgcgacgaucuggagucucucggcuacguccugauguauuucaaccugggcucccuccccuggcaagggcugaaagcugccacaaagagacagaaauacgagcggaucagcgaaaagaaaaugucuaccccuauugaggugcuuuguaagggauaucccuccgaauuuagcacauaccugaauuucugccgcucucucagauuugacgauaagccugacuauuccuaccugcggcagcuuuuccgcaaccuguuucacagacagggcuucagcuaugauuacguuuucgacuggaauaugcucaaauuuggggcggcccggaacccggaggacguggauagagaacgccgggagcaugagagagaggaacgcaugggacaacugcggggcuccgcuaccagagcccugcccccugggcccccuacgggagcuaccgccaaucgccuccggucugcggccgaacccgucgcuagcacaccggccuccagaauccagccugcuggcaacaccagcccccgcgccauuucucggguggacagagagcgcaagguguccaugcggcugcacagaggcgccccugcuaacgucagcucuagcgaucuuacagggcggcaggaaguuucccgcauccccgcgucucagaccagcgugcccuucgaccaucugggaaaauga

SEQ ID NO: 71570 - RNA, 2583 nt, Artificial Sequence
  derived and/or modified sequence opt5 from LOC645177__Homo_sapiens__XP_011519208
auggccagccccagaaaggugaccgagaaacggcacaacccugucgaauccaucugccgcaagauuagagcuauccauaaacgggaggccauuucuaauccgauccagcaaauuaucaaguaccagagcuccucuuucgacagcccccagacaaacacgaaaaaguauuuugaagagguucugcgcaagaugaccgcggcuugugugccuacacccggcucccacuggucuagcuccgaagagguggaugccuucaucagcucuccucagauuaucucccccagaaccccuagcacaucucaucucuccagcccggagaccgccacauacucugucauucugaccuccagcgaaaauguguccaaacccaagucucaaagcaacaaaaauuauacgucccuuaugagccagauccggaaggcugaguuuuucucuaacaaagaccugaauaacuacugcuccgaaaauaacuuuagcacccucacacuggauuucgacucuaccuuuguucagagccuuaaguguuucgauccucaggacuccguggucaagaaacugucucucaaugaggauggguggaagcaagaggccgacgauggaaaagaagacgugauuuauagcaucaaccgcgcuugcaaggaggaagcccugacauccauuuuuaaugcgugugauaucaaaagaaagggcagcguugggguggccaaaaucauuaacuuccugcggcagaccacgucucaaaauuccgaggacagcggacucgaacagcuguggaacaugcuugaucccgagaagcgcgacccucacgucgaccuggagacauuucaggcuaugaugaaggauuggauggccuacugcggcaacaccugggaaggggugaaucauagacucucuuccaucauugacgauagcgugugugagcaggacggaaucaaauccgauggcacaaugaagaugucuaccgacauuaccgauagcacacugggcuccuucgaagcucuugggggagagacgucuaaaggcguccuggaaguuagcgaccucaucgccuauguggcggaucugcacuuuaacaagcggaaacuggaggaggaaaauaacaaguucaagcucgcccuggagacccuugaagagacaaauucccagcugagcgaagacugcaccgagcuccgccugcaagugaaaucugcucaccaggccaucaugagaacaaaccuucugaaggaggaacucgaggaacugaaacuguccaugaaugcuagcgaggagcagaagucuaugauugucgcccaguccaaacaacucgaaaccgagaaccgggcccugauccuuaagauucgcauccugcaggaagagaauuucaagaacauuauggauaucgacagacucgaaaagaagaucgaggaccugagcaaaacggagacagaacaucaggugucuaccagccagauucuuaugcaacugcacaccuacgagaauacacuccugaacaaggauaccucccugcagaaaaaggggcucuacaucgaagaacugaaaagcacaauuaucgaauauggaucuauuaucgagaaucuucggggcgagaaauccaagcuggcucaugaacuccagcaucugcagcaagcgcugauuacgaacgggauccagcuuaauguuaacggagaguguaacagcaucauuuccgaaggcgagaaaucucuccacuacgaacugacccuggcccagagcgcugagaauacagagaccgaaagacagcacaacgugaucaaucucuccucucuggacgccaugauggaucaagagaugcuucugcuccugcgcgaacccgcccagaaggcugucgaguuuacagccacccugcagaaacuucacgaggaaauuagcaagaucgcgacgcucauugagaacucccggagaugggugaccaauccggaaaucacaguuaaagagaagugggaggagcaacugaccgaguucaacaauaucauggaagagaagcuggaccucugcauucugaugcuuaacauccugggcaaucauaaagaaucucucgauaaggaguuugcuaaacugauugaaauccugaagcgcuuccggcaggaguauuuuuacuucagaaaagaguuucuugcccgcaacccuacaagcgggcagaagcagcucgaagccauuaagcaacugcaggaggacgcugugaaucaggaaggaauccugcggaaaagacuccaggagaccucccaacgccuggaagaugucgaggagcagggcaaggaccgggauagagaagcccacacggcuagcgagaaagccacaucucuucugcauaagcucgaagaggcgaucuccgagcagcgcaaccugcagaccauuaauacagaacugagcaacaccugucaagcccuucagcagaaaacccggaagcucaagaaugcucugucucuggacuccuucacagccgugcccacgcucgagagcaccccuuuuucuggggucgcuaaccaaauccacacacugugcgaaagacccaccuauggagaggugaaagauggcgcccuugacguuaagcggcagcacaaauga

SEQ ID NO: 71571 - RNA, 2688 nt, Artificial Sequence
  derived and/or modified sequence opt5 from LONP1__Homo_sapiens__NP_001263408
auggccgcuagcaccggcuacgugagacuguggggagccgcgcggugcuggguccuccgcagacccaugcuggcugccgccgggggccggguuccuacagcugccggggcuuggcuucugcgcggaccggugaucacggcccucacccccaugacaauuccugacguguucccccaucugccucuuaucgcgauuaccagaaaccccgucuuuccucgguucaucaagauuaucgaggugaaaaauaagaaacugguugaacuccugcgcagaaaggugcggcuggcccagccguaugucggcguguuucucaaacgcgaugacuccaacgagucugauguuguggaaagccuggacgagaucuaccacacagggaccuucgcucaaauucacgaaaugcaggaucuuggagacaagcugagaaugaucgucaugggccaucggcgcgugcacauuuccagacagcucgagguggagcccgaggaaccugaagccgagaauaagcauaaaccccggcgcaagucuaaaagaggcaagaaagaggcugaagaugagcugagcgcccggcacccugcggaacuugccauggagcccacaccggaacugccugcugagguccucaugguugagguggaaaacgugguccacgaggacuuucaggugaccgaagagguuaaggcccugacggcugaaaucgugaagaccauuagagauaucauugcccugaauccccucuaucgcgaguccguccugcaaaugaugcaggccgggcagcgggugguugacaacccuaucuaccuuucugauaugggagcugcgcugacaggcgccgagagccaugaacuccaggacgugcuggaggaaaccaauauccccaaaagacuuuauaaggcucugucccuccugaaaaaggaguucgaacugagcaaacuccaacagcgccuggggcgggaggucgaggaaaagauuaaacagacacacagaaaguaccuucugcaggagcaacucaagaucauuaaaaaggaacugggacuugagaaagaugacaaggacgccaucgaggaaaaauuucgcgagcggcugaaggaacucgugguccccaagcaugugauggauguuguggacgaggaacugucuaaacugggccuccuggauaaccacuccagcgaguucaaugucaccagaaacuaucuugacuggcugacgucuauuccuugggggaaguacuccaaugagaaccucgaucuggcccgcgcucaggccgugcuggaagaggaccacuacggaauggaagauguuaaaaagcggauccuugaguuuaucgcggugagccagcucagaggcucuacacaaggcaaaauucuguguuucuaugggccgcccggagucggcaagaccuccaucgcucgcagcauugcccgggcccugaauagagaauacuuucgguucuccguugggggaaugacagacguggcugagaucaagggccaucgcagaaccuaugugggggccaugccuggaaaaauuauccagugccucaagaaaaccaagacagagaacccccugauccuuauugaugaagucgacaaaaucggccggggcuaccagggggauccuucuagcgcucugcucgagcugcuggaccccgaacagaaugccaacuuucuugaccacuaucucgaugugccgguggaccuguccaagguccuguucauuuguacggcgaacgugaccgauacaaucccugagccccucagagaccgcauggaaaugauuaauguuagcggauacguggcccaagagaagcuggcuaucgccgagcgguaucuugucccucaggcuagagcccugugcggccucgaugaaucuaaagcgaagcuguccagcgacgugcugacccuucucauuaaacaguacugucgcgagucugggguuagaaaccugcagaagcaaguggaaaaaguccugcgcaagagcgccuacaaaaucguguccggagaggcugagucuguugaagugacacccgagaaucuccaggauuucgucggcaagccuguguuuaccguggaacggauguaugacgucacgcccccggggguugugaugggccuggccuggacagcuaugggaggcagcacccuuuucguggagaccucccugagacggccucaggauaaggacgccaaaggggauaaggacggaagccucgaagucacaggccagcugggggaggugaugaaagagucugcccgcaucgcuuacaccuuugcgagagccuuccugaugcaacaugcucccgccaacgauuaucuuguuacaucccacauucaucuccacgugcccgaaggagccacgccuaaggacggcccgagcgcugggugcaccaucgucacagcccugcugucucucgcgaugggccggcccgugcgccagaaucuggcuaugaccggagagguuucccuuacaggcaaaauucugccugucgggggaaucaaggaaaagaccauugccgccaaaagagcuggcgugacguguaucgugcuccccgccgagaacaagaaagacuuuuacgaucuggcggcuuucaucaccgaagggcuggagguucacuuuguggagcauuaucgggaaauuuucgacaucgccuuuccugaugagcaggccgaagcucuugccgucgagcgcuga

SEQ ID NO: 71572 - RNA, 2322 nt, Artificial Sequence
  derived and/or modified sequence opt5 from LONRF1__Homo_sapiens__NP_689484
augagcucccccgccguggcuagaaccucuccuggcgggagccgggagauggccccggcgccccagggacgcggcagauucugggaagucgggggaggcuccgggcaccggcuggagcgcgcugccgccgaaucugagagaugggaacuccugcuucggcgcggagagcugcucgcucugggcggccaucuuaagggggcccuggaggcuuuugccgcggcccucagacggggagcuccugcccgccccgaaugccugggcgcucugguugacugucucguguucaacuacagacugcggcacgggcuuggauggagcgccgcgccuguggccggcgcugaugggggagccggcggccugcuccgcugccugggguguagaggauuucuuuccgagcccgucacagugccuugcggccauucuuauugucggcgcugccugagacgggaacucagagcucgcugucggcugugcagagaccgccugccgcccgccacggccagcgcuaccgaugcggaggggacagccccucggcccccuccccucgcugccgccaucgcugccuccgacuucagaaccagcguugugcugaaucaccuugcggagaaaugguuuccgggacaacgcgaacgggcuagagccgccggccgccugggggagcuccugcaucagggacgguacagagaagcucuugccgcugccugugaggcgcugcgcgccgaaccuucugaucucauugucaagaucuaucgggcugaguccuacgccggccugcaggaguucaaagcugccauugaagaccugaacgcggugcucuuucagcugcccgauuggccugagguuuauuucagaaagggcaaagugcuuugcgacgccggguuucugggagaugcucuccaacuguuccuucagugucuggcccucgacgaagauuuugcucccgccaagcugcagguccagaagauccugugcgaccuccugcuucccgagaaucugaaagaaggccucaaggagagcucuugguccagccugccuugcaccaaaaaccggccguucgauuuucacucugugauggaggaaucccaaagccugaaugagcccuccccuaagcagucugaagagauucccgaagugacaagcgagccugucaaagggucccuuaaccgcgcccagagcgcucagucuaucaauuccacagagaugcccgcgagagaagacugucucaagcggguuagcucugagccggugcugagcgugcaagaaaagggaguccugcucaaaagaaagcugucccuucuggagcaggacgugaucguuaacgaggauggccgcaauaaacucaagaaacagggggaaaccccuaacgaggugugcauguucucucuggccuacggcgacauucccgaagaacugaucgaugucagcgacuucgaauguucccuuugcaugcggcucuuuuucgagccugugacgacccccuguggacacagcuuuugcaagaauugucuggagagaugccuggaucaugcuccuuauuguccccucugcaaagaaucucugaaggaguaccuugccgaccgcagauacuguguuacacaacugcucgaggagcugauugugaaguaucugccggaugaacuuuccgagcggaaaaagaucuacgacgaggaaaccgccgagcucagccaccugaccaaaaacgucccuauuuucgugugcacaauggcuuaucccacgguccccugcccucugcauguguuugaaccgcgcuacagacucaugauccggcgcucuauucagacaggcaccaagcaguucgggauguguguuuccgauacacagaauagcuuugccgacuauggaugcaugcugcaaaucagaaacgugcacuuccuucccgauggccgguccgucguggacaccguugggggaaaacgcuuuagagugcugaagcggggcaugaaggacggguacuguaccgcggauaucgaguaucucgaagacgucaaaguggagaaugaggaugaaauuaagaaccugcgcgagcugcacgaccuuguguacucucaggcuugcagcugguuccagaaccucagagaucgguuuagaucccagauccugcaacauuucggcucuaugccugaacgcgaggagaaucugcaggccgcccccaacggaccugcuugguguugguggcuccuggccguucuucccgucgacccucgguaccagcugagcgugcucuccaugaaaagccugaaggaaagacugacaaaaauucagcacauccuuacguauuuuucucgcgaucaauccaaguga

SEQ ID NO: 71573 - RNA, 939 nt, Artificial Sequence
  derived and/or modified sequence opt5 from LOR__Homo_sapiens__NP_000418
augagcuaccagaagaaacaacccaccccucagccgcccguggacugcgucaagacauccggcgggggaggcgggggaggcgggucuggaggcggcggguguggauucuuuggcgggggaggcagcgggggaggcuccucuggcagcgggugcggauauuccggcgggggaggcuacucugggggaggcuguggcgggggaagcuccggcgggggaggcgggggcggaaucggcgggugcggaggcgggagcggaggcucuguuaaauauuccgggggcggaggcagcucugggggaggcuccggguguuucagcucuggaggcgggggcuccggaugcuuuagcuccggcgggggaggcucuagcgggggaggcuccggguguuucagcucuggcggaggcggguccagcggaggcgggucuggaugcuuuagcuccggcggcgggggauucucuggccaggccgugcagugucaaagcuacgggggaguguccagcggcgggucuuccggaggcggcagcgggugcuuuucuuccggaggcgggggaggcagcgucuguggguauuccggaggcggcucugggugcggaggcgggagcuccggaggcucugggagcggauacguguccagccagcagguuacgcagaccucuugcgcuccucaacccuccuauggcggcgggagcucuggaggcgggggauccggcgggagcggauguuucucuagcggcggcgggggaggcuccagcgggugcggaggcgggucuuccggaauuggcagcggcuguaucauuuccgggggaggcucugugugcgggggaggcagcuccgggggaggcggcgggggaucuagcgucggcggguccggaucuggcaagggggugccuaucugucaccagacacagcagaaacaagcccccaccuggccuagcaaguga

SEQ ID NO: 71574 - RNA, 3345 nt, Artificial Sequence
  derived and/or modified sequence opt5 from LOXHD1__Homo_sapiens__NP_001138944
augaacaaugagaucaccuacuauuuccccugccagagauggcuggccguggaagaggacgauggccaacucagccgggaacugcuuccugucgacgaguccuacguucugccgcagucugaagaggggcgcggaggcggggauaacaauccccucgacaaccuggcucuugagcagaaggauaaaagcacaacguuuuccgugaccauuaagacaggagugaaaaagaaugccggcaccgacgcgaacgucuucaucacacuguuugggacccaggaugacacaggaaugacccuccugaaaucuagcaagaccaauuccgauaaguucgaaagagacucuauugagaucuuuacgguggaaacacuggaucucggcgaccuguggaaaguucggcuuggccacgauaacaccgggaaggcuccuggaugguucguggacugggucgagguggacgcccccagccugggcaaauguaugacauuuccuugcgggcgcuggcucgccaagaaugaggaugacggauccauuaucagagaucuguuccaugcugaacuucaaacccggcuguauacgcccuuuguuccuuacgagaucacacucuauaccagcgacguguucgccgcuggcacagaugccaacauuuuuaucauuaucuacgggugugacgcggucugcacccagcagaaauaucuguguaccaauaagcgcgaacagaagcaauucuuugagagaaaaucugccucccgguucauuguggaacuggaggaugugggagagaucauugaaaagauccgcaucggccacaacaauacaggcaugaacccgggguggcauugcagccacgucgacauuagacggcuccugcccgauaaagacggagcugagacgcuuaccuucccuugugaucgcuggcuggccacaucugaagacgacaagaaaaccaucagagagcucguucccuacgauauuuuuacagaaaaguacaugaaagacggcucccugagacagguguauaaggagguggaggaaccucuugauaucguccuguacagcgugcagauuuucaccgggaauauccccggagcuggcacggacgccaagguuuauaucacaauuuacggggaucucggagacaccggcgagcgcuaucugggcaaaucugaaaacagaaccaacaaguuugagcgggggacagcggauaccuucaucauugaagccgcugaccugggagugaucuacaaaauuaagcucagacaugauaauuccaaauggugcgccgacugguaugucgagaagguggagaucuggaacgauacaaaugaagacgaguuucuguuccuuuguggccgcuggcugagccucaagaaagaagaugggcggcuggagagacuguuuuacgagaaggaauacacgggagaccgcuccucuaacugcagcuccccggcugacuucugggagaucgcccuuagcucuaaaauggccgauguugacauuuccaccgugacaggcccuauggcugauuauguccaggaagggcccaucauuccuuacuaugugagcgucaccacaggcaagcacaaagacgcggccaccgauucucgggcuuuuaucuuccucauuggagaggacgaugaaagaagcaagcgcaucuggcuggacuacccccggggcaagagaggguuuucccgcggaucuguggaggaguucuauguugccggccuggauguggggauuaucaaaaagaucgaacucggacacgacggcgccagccccgaguccuguuggcuggucgaggaacuuugccuggcugugccuacgcaagggaccaaauacaugcucaauugcaacuguuggcuggccaaggaucggggcgacggaauuacaagcagaguuuuugaucugcuugacgcgaugguggucaauaucggcgugaaagugcucuaugaaaugaccguuuggacaggggacgucgugggaggcgggaccgauucuaacauuuucaugacgcuguacggaaucaauggcuccacagaggagaugcagcuggacaagaagaaagcucgcuucgaacgggagcagaacgauaccuuuauuauggaaauccucgacaucgccccguucacaaagaugcggauucggaucgaugggcugggcagccgccccgagugguuucuugaacggauucugcucaaaaauaugaacaccggagaccugaccauguucuacuauggcgauuggcugucucaaagaaaggggaaaaagacacuugugugcgagaugugugccgucaucgacgaggaagagaugauggaauggacguccuacaccguggcuguuaaaacaagcgauauucucggagccggcaccgacgcuaauguguuuaucaucauuuucggggagaacggagauuccggcacacuggcccugaagcagucugcgaauuggaacaaguuugagagaaacaauaccgacacguucaacuuuccugacaugcucagccuggggcaucuuugcaaacugcgcgucuggcacgauaauaagggcaucuuccccggauggcaucucuccuauguggacguuaaagauaacucucgggacgaaacauuucacuuccagugugauugcuggcugagcaaguccgagggcgacgggcagaccgugagagauuuugccugugcuaauaacaaaauuugcgacgaacuggaggaaaccacauacgagaucgucauugagaccggaaauggcggggaaacacgcgagaacguguggcuuauccucgaaggaagaaagaaucggagcaaggaguuccugauggaaaacucuucccgccaaagagccuuccggaaaggcacgaccgauacauuugaguucgacagcaucuaucugggcgauauugcuucucucuguguugggcaccuggcccgcgaggacagauuuaucccuaagcgggaacuugcguggcaugugaaaaccauuacaaucaccgagauggaauacggaaaugucuauuucuuuaacugcgauugucugauuccccucaagcgcaaaagaaaguacuucaagguguuugaggugacgaaaaccacagaauccuucgccagcaagguccagucucugguuccggugaaauacgaggugaucgucaccacaggcuaugagccuggggcuggaaccgacgccaauguguuuguuacaauuuucggcgcuaacggggacaccggaaagcgggaacugaaacagaagaugcgcaaucuuuuugagagaggcagcacggaucgguucuuccucgaaacacuggagcugguggucaccagacucggccuggccgccgagugcggguga

SEQ ID NO: 71575 - RNA, 1254 nt, Artificial Sequence
  derived and/or modified sequence opt5 from LOX__Homo_sapiens__NP_002308
augagauucgccuggaccgugcugcuccugggcccccuucagcugugcgcucucguccacugugccccuccggcggcugggcaacagcagcccccucgggagcccccugccgcccccggagcuuggcgccagcaaauccagugggaaaacaauggccagguuuuuagccugcuuucccuggggucucaguaccaaccucagagacggcgcgacccgggagccgcugugcccggcgccgcgaacgccagcgcucagcagccuagaacacccauucuccugauccgggauaaucgcacggccgcugccagaacccggacagcgggguccucuggagugaccgccggccgcccuagacccacagcucggcauugguuccaagccggcuauagcaccucccgcgcuagagaggccggggccucucgggcugaaaaccagacagcgccgggagaggucccugcccugagcaaucucagacccccuucccgcguggacggcaugguuggggaugaccccuacaaccccuauaaguacagcgaugacaauccuuauuacaacuauuacgauaccuacgaacggccgagacccggaggccgcuaucggccuggguacggaacgggcuauuuucaguacggccugcccgaccuuguggcugauccuuauuacauucaagccucuaccuauguccagaaaauguccauguacaaucugagaugcgccgcugaggagaacugucucgccagcacagcguaccgcgcugacgugcgggauuaugaccacagaguucugcuucgcuucccccagcgggugaagaaucaggggaccucugauuuucugccguccagaccucgcuacagcugggaauggcauucuugccaccaacauuaucacuccauggacgaguucagccacuacgaccuccuggaugccaacacacagcggagagucgccgaaggacauaaggcuuccuuuugucuggaggacaccucuugcgauuauggcuaccaccgccgguucgccuguacggcucauacacaggggcucagccccggaugcuaugacaccuacggcgccgauaucgacugucaguggauugauaucacagacgugaaaccugggaauuacauccugaaaguguccgucaaccccagcuaucuuguuccugagucugauuacaccaauaacguggugagaugcgacauucgguauaccggacaccacgcguacgccuccggcuguacaaucagccccuauuga

SEQ ID NO: 71576 - RNA, 1725 nt, Artificial Sequence
  derived and/or modified sequence opt5 from LOXL1__Homo_sapiens__NP_005567
auggcccuggcuagaggcagccggcagcucggggcccugguguggggagcgugccuuuguguccugguucacggccaacaggcucagcccgggcagggauccgacccugcccgcuggagacaacucauccagugggagaacaauggccagguguacucucugcuuaacagcggguccgaauaugugccggccggaccccagcggucugagagcuccucucgcguccugcucgcuggcgccccucaagcucagcagagacggagccauggcagcccccgcagacggcaggccccuucccugccccugccugggcgcgugggaucugauaccguuagaggccaagcgcggcacccguucggguuuggacaggugcccgacaauuggcgcgaagucgccgugggcgauuccacagggauggcuagagcccggacgagcguuucucagcaacgccauggaggcuccgcuagcucuguguccgccagcgcguucgccuccaccuacagacagcagccuucuuauccccagcaauuuccuuacccccaggcuccguucgucagccaguaugagaacuacgacccugccucccggacauaugaucagggcuuuguguacuacagacccgcugggggaggcgugggggccggagccgcugcggucgccagcgcuggcguuauuuauccuuaccaaccccgcgcccgguaugaagaguacgggggaggcgaggaacuccccgaguauccuccgcagggcuucuaccccgccccugaaagacccuaugugccucccccgccucccccucccgacgggcuggaucgccgguacucucacucccuuuacagcgagggaaccccuggcuuugagcaggcuuaucccgacccggggccugaagccgcgcaggcucauggaggcgaucccagacuggggugguaucccccuuacgccaauccgcccccugaggccuacggacccccucgcgcucucgaacccccuuaucugcccgugcggucuagcgacacaccgccucccggcggcgagagaaacggggcccaacagggacgccuuuccgucggcucuguguaccggccuaaucagaacgggagaggacugcccgaucucguuccggacccuaauuaugugcaggcuagcaccuacguccaacgcgcccaccuguacucccugcggugcgcggccgaagagaagugucucgcuagcacagccuaugcucccgaggccaccgauuacgacgugagaguucugcuucgguucccucagcgcgugaaaaaccagggcacggcggacuuucugcccaauagaccccggcacaccugggaauggcauucuugccaccaacauuaucacuccauggaugaguucagccacuacgaccuccuggaugccgcuacagggaagaaagucgccgaaggccauaaggcuucuuuuugucuugaggacuccacaugcgauuucggaaaccugaaaagauaugccuguaccagccacacccagggccucuccccugggugcuacgacacguauaaugccgauaucgacugucaguggauugauaucacagacgugcagccgggaaacuacauucugaagguccaugugaaucccaaguacaucguucuggaaucugauuuuaccaacaacgugguccgcugcaauauccacuauacaggccgguacgugagcgcuaccaacuguaaaauuguucaauccuga

SEQ ID NO: 71577 - RNA, 2325 nt, Artificial Sequence
  derived and/or modified sequence opt5 from LOXL2__Homo_sapiens__NP_002309
auggagagaccccugugcagccaccucuguuccugccuggccaugcuugcucugcucucuccucugagccuugcccaguacgacuccuggccgcauuaucccgaauacuuccaacagccugcgcccgaguaucaccagccucaggcucccgccaacguggccaagauccaacugcggcucgcuggccagaaacgcaagcauucugaagggagagucgagguuuacuaugauggacaguggggcaccgugugugacgaugacuuuagcauucacgccgcucauguggucugccgggaacugggguacguggaggccaaauccuggacagcgucuagcuccuauggaaagggcgaggggccuaucuggcuggauaaucuccacuguacgggaaacgaagccacccuggcugccugcacaagcaauggcuggggcguuaccgacuguaaacacacagaggaugugggggucgugugcucugacaagcgcauuccgggauucaaguuugauaacucccuuaucaaucagauugaaaaccugaauauccaaguugaggacauccggauuagagcuauccucagcaccuaccgcaaaagaacacccgugauggagggcuacgucgaagugaaggaggggaaaaccuggaagcagauuugugauaaacauuggacggccaagaacucucggguggucugcggaauguucggcuuuccuggggaacgcaccuauaauacaaagguuuacaaaauguucgcguccagacggaagcagcgcuauuggcccuuuagcauggacuguaccggaacagaggcccacaucucuuccugcaaacugggcccucaggugagccuugaucccaugaagaacgugaccugcgaaaauggccugccggcugucguguccuguguuccugggcaaguguucucucccgacggaccuagcagauuucggaaagccuacaagcccgagcagccccucguccgccugagaggcggggcuuauauuggagagggccggguggaaguucugaaaaacggggaguggggaacggugugcgacgauaagugggaccucgucuccgccagcguggucuguagagaacugggcuucggcucugccaaggaggcugugacagggucccgccuuggacagggcaucgggccuauucaucugaaugaaauccaaugcaccggaaacgagaaaagcaucauugauuguaaguuuaaugcggagucucagggcugcaaccacgaagaggacgccgggguucgguguaacacaccggcuaugggccuccagaaaaagcugagacuuaauggaggccgcaaccccuacgaagggcggguggagguccugguggaaagaaauggaagccucguuuggggcauggugugcgggcagaacuggggaaucgucgaggccaugguggugugucgccaacugggccugggguucgccuccaaugcuuuucaggagaccugguauuggcacggcgauguuaacucuaauaaagucgugaugagcggagugaagugcuccggcaccgaacucagccuggcccauugucggcacgacggggaggaugucgcgugcccucagggaggcgugcaguacggggcuggaguugccugcucugaaacagcccccgaccuugugcugaacgcugagaugguccaacagacgaccuaccucgaggauagaccuauguucaugcugcagugugccauggaagagaauugccuuuccgcuagcgccgcgcagacagaccccaccacaggcuaucgccggcugcucagauucucuucccaaauucauaacaaugggcagagcgauuuucgcccgaagaacggccggcacgccuggaucuggcaugacugucacagacacuaccauuccauggaaguguucacccacuaugaccugcugaaucucaacggaacgaaaguugcugagggccauaaggccucuuuuugccuggaagauacagagugugagggggacauucagaaaaauuacgaaugcgcuaacuucggagaucagggcaucaccaugggguguugggacauguaucggcacgauaucgacugccaauggguggauauuaccgacgucccucccggagauuaccuuuuucaggugguuaucaacccuaauuucgagguggccgaaagcgacuauuccaacaauauuaugaagugucgcucuagauacgauggccaccggaucuggauguacaacugccauauugggggcagcuuuuccgaggaaacagagaaaaaguucgagcacuuuagcggacugcucaauaaccagcugucuccccaauga

SEQ ID NO: 71578 - RNA, 1827 nt, Artificial Sequence
  derived and/or modified sequence opt5 from LOXL3__Homo_sapiens__NP_001276093
augagacccgugagcgucuggcagugguccccuuggggccugcuccugugccuucuguguucuagcugccucggguccccgucucccagcaccggaccugagaagaaagccggcucccaagggcugcgguuccgccuugcuggauuucccagaaagccuuacgaaggccggguugagauccagcgcgccggggaauggggaacaauuugugacgaugacuucacgcugcaggcggcucacauccucugcagagagcugggcuuuaccgaagccacaggcuggacccauucugccaaauaugggcccggaacaggccggauuuggcuggauaaccucagcuguuccgggaccgagcagagcgugacagagugcgcuucucgcggauggggcaauuccgacuguacccacgaugaagacgccggggugaucugcaaggaucaaagacugccuggauucagcgacucuaacgucauugaggcucgggugcgccuuaaaggcggcgcccauccgggggaaggaagaguugaggugcugaaggcguccacguggggcaccgucugugaucggaagugggaccuccacgccgcuagcgugguuugccgcgagcugggguuuggaucugccagagaagcucuuuccggcgcccggauggggcagggaaugggcgcgauccaucugagcgaggugcgcuguuccggccaggaacucucucuguggaaaugcccccacaagaauaucacagccgaggauugcagccacucccaggacgcuggggucagauguaaccugccuuacaccggagccgaaacacggauuagacucagcggcgggcgcucucaacaugagggacggguggaggugcagaucggcgggcccggcccucugagauggggacuuauuugcggcgaugacugggggacccuggaagcuauggucgccugucgccagcucggacugggcuaugccaaucacgggcuucaggagacgugguacugggacuccggaaacaucacagaaguugugaugagcggcgugcggugcaccgggacagagcugucucucgaucaaugugcucaucacggcacccacauuaccugcaaaagaacaggaacgcgcuucaccgcgggcgucaucuguagcgaaacagccuccgaccugcugcuccauucugcucuggugcaggagaccgccuauauugaggaucggccccuucacaugcuguacugcgccgcugaagagaauugucucgccagcuccgcgagaagcgcuaacuggccguaugggcaucgccggcugcuuagauuuucuucccagauccacaaucugggacgcgccgacuuccggccuaaggccggcagacauagcuggguuuggcacgaaugccacgggcauuaccacucuauggauaucuuuacacauuacgacauucucacccccaacggaacgaaaguggcugagggccacaaggccuccuucugucuggaagauacagagugccaagaggacgucagcaagcgguaugaaugcgcuaauuuuggggagcagggcaucaccgugggauguugggaucuguaccgccacgacauugauugccaguggaucgacauuaccgacguuaaaccuggcaacuauauccuccagguggucaucaaucccaacuucgaaguggccgaguccgauuuuacaaauaacgcgaugaaguguaacugcaaauacgacgggcauagaauuuggguccacaauugucauaucggagaugccuucucugaggaagcuaaccggagauucgagcgcuaucccggccaaaccagcaaucagauuaucuga

SEQ ID NO: 71579 - RNA, 2271 nt, Artificial Sequence
  derived and/or modified sequence opt5 from LOXL4__Homo_sapiens__NP_115587
auggccuggagcccucccgcuacccuguuccucuuucugcuucugcucggccagccgcccccuuccagaccccaaucucuggggacaacgaaacuucggcuggugggaccugagagcaaacccgaagagggccgccucgaaguccugcaccaggggcaguggggaaccguuugcgacgauaacuucgccauccaggaggcgacaguggcuuguagacaacugggcuuugaagccgcccucaccugggcucauuccgccaaguacgggcagggagagggcccuauuuggcuggacaaugugcggugcgucggcacagagucuagccuugaucaguguggguccaacggauggggcgugucugacugcagccacuccgaagauguuggggugaucugucauccgcgcagacaccggggauaucugagcgagaccgucucuaaugcucucggcccccaggggcgcagacuggaagaggugcggcuuaaaccuauucuggccuccgcgaagcaacauagccccguuacagagggagccguggaagucaaauacgagggccacuggcgccaggugugcgaccagggcuggaccaugaacaauucuagaguggucugugggaugcucggauucccuuccgaaguucccguggauagccacuauuaccggaaggugugggaccugaagaugcgcgauccgaaaucuagacugaagucccucacgaacaaaaauagcuuuuggauccaucaggugaccugccugggcacagagccucacauggcuaacugucaaguccagguugcccccgcucgggggaaacuucgcccugccugccccggaggcaugcaugcgguggucuccuguguggccgggccccacuucagaccuccgaagaccaagccccagcggaagggaucuugggcugaggaaccuagaguucgccugcggagcggcgcccaagugggcgaggggagagucgaagugcucaugaaucgccaguggggaacagucugcgaccaccgguggaaccugauuuccgcuagcgugguuugcagacagcuuggcuuugggucugcccgcgaggcccuguucggagcucggcucggccaggggcugggccccauccaucuguccgaagugagaugucgcggauaugagcggacccucagcgauugcccugcgcuggaaggcucucaaaaugggugucagcacgagaacgacgccgcugucagaugcaaugugcccaacaugggauuucagaaucagguucgccuugccggcgggcggaucccggaggaaggacugcucgaggugcaagucgaagugaacggcgugccuagaugggggagcguuuguuccgagaacuggggccugacggaagccauggucgcuugccggcagcuuggacugggcuucgccauucaugcguacaaagagacaugguuuuggucugggacaccccgcgcucaggagguggugaugagcggagucagauguuccggcaccgaacucgcccugcagcaaugccagcggcacgggccugugcauuguagccacggaggcgggagauuccuggccggcguuucuugcauggauuccgcucccgaccucgugaugaaugcccagcugguccaggagaccgcuuaucuugaagaccgcccucugagccaacucuacugugcccacgaggagaacugccugucuaaguccgcggaucauauggacuggcccuacggauaucggagacugcuucgcuuuagcacccagaucuacaaucucggcagaacagauuuccggccgaaaacggggcgcgacuccuggguguggcaccagugccauagacacuaucacucuauugaaguuuucacccauuacgaucugcugacacucaacggaagcaagguggccgagggccacaaggcuuccuuuugucuggaagacaccaauugcccuacagggcuucaacggcgcuaugccugugcuaacuucggagagcagggcgucaccguggggugcugggauacguacagacaugacaucgauugucaguggguugacauuacagaugugggccccggaaauuauaucuuucaggucauugugaacccccacuacgaaguggccgagucugacuucagcaauaacaugcugcaaugccgguguaaguacgacggccaucgcgucuggcuccacaauugccacaccgggaacuccuauccugcgaaugccgagcugagccuggaacaggagcagagacuucggaacaaucucaucuga

SEQ ID NO: 71580 - RNA, 6123 nt, Artificial Sequence
  derived and/or modified sequence opt5 from LPA__Homo_sapiens__NP_005568
auggagcacaaggaaguggugcugcuccugcuucuguuccucaaaagcgccgcucccgagcaaucccauguugugcaagacugcuaccacggagaugggcagucuuaucgcggaaccuacagcaccacggugaccggccggaccugucaggccugguccucuaugaccccucaucagcacaaccgcaccaccgaaaauuaucccaacgcggggcugaucaugaauuacugcagaaaccccgacgcugucgccgccccuuauuguuacacccgggaucccggagugcgcugggaguauugcaaucuuacccaauguagcgacgcugaaggcacggccguugcuccucccaccgugaccccugucccgucccuggaggcccccucugagcaggccccuaccgaacagagacccggggugcaggagugcuaccauggaaacggccaaagcuaccggggcacauauuccaccacgguuacagggcgcaccugucaggccuggagcucuaugacaccucacucccacagcagaacccccgaauacuauccgaaugcuggacucauuaugaacuacugccggaauccugaugccguggcugcccccuauuguuacacccgcgacccuggcgucagaugggaguauugcaaccugacacaguguucugaugccgaggggacggccguggcuccgcccaccgugacaccugucccgucccuggaagcccccagcgagcaggcuccuaccgaacaacggcccggaguucaggagugcuaccauggcaaugggcagucuuaccgcggaacauauuccaccacggugacaggcagaaccugccaagccuggagcuccaugaccccucacucucauagccggacacccgaauacuauccgaacgccggccucaucaugaauuacugucgcaacccugacgcuguggccgcccccuauugcuacaccagagauccugggguccggugggaguauuguaaucugacacagugcuccgacgcugagggaacggccguggcgcccccuaccguuacacccgugccgagccuugaagcuccuucugagcaggcccccaccgaacagagacccggcguccaagaguguuaccacgggaacggacaguccuaccgcggcacauauagcaccacggugaccgggcggacaugccaggcguggucuagcaugaccccucacucccauucuagaacaccggaauacuaucccaacgcuggacugauuaugaauuacugucgcaacccugaugccguugccgcucccuauugcuacacccgggacccuggcgugagaugggaguauuguaaucucacgcagugcagcgaugccgagggcacagcugucgcgcccccuaccgugacacccgucccgucccuggaagcgccuagcgagcaagcccccaccgaacagcgcccuggggugcaggaguguuaccacggaaacggccagucuuaccgggggaccuauuccacaacgguuaccggaagaacaugccaggcuuggagcucuaugacaccccauucccacagccgcacaccggaauacuauccuaaugccggccuuaucaugaacuacugccggaaucccgacgcuguggccgcgccuuauuguuacaccagagaccccgggguccgcugggaguauugcaaccugacgcaguguuccgaugccgagggcacagcuguggcgcccccuaccguuaccccggugcccucucucgaagcuccuagcgagcaggcccccacagaacagcggccuggaguccaagagugcuaccauggcaaugggcaguccuacagaggaaccuauucuacaacggugaccggccggacaugucaggccuggagcuccaugacaccccacagccacucucgcacaccugaguacuauccgaacgcugggcugauuaugaauuacugcagaaaccccgacgcgguggccgcuccuuauuguuacacccgggaucccggaguuagaugggaauauugcaaucugacgcaauguuccgacgccgagggcaccgccgucgcuccucccacagugaccccggugccuagccucgaagcccccucugagcaggcgcccacagaacagcgcccugggguccaggagugcuaccauggcaacggacaauccuaccggggcaccuauagcacaaccgugacggggagaacaugucaggcuuggucuagcaugacaccccacucccauagccgcaccccugaguacuauccgaaugccggacugaucaugaacuacugcagaaaccccgaugccguugcugccccuuauugcuacacacgggaccccggcgugcgcugggaauauuguaaucuuacccagugcucugaugcggaggggacggcugucgccccucccacagugaccccgguuccuucccuggaagcccccagcgagcaggcuccuacagaacaaagacccggagugcaggaguguuaccacggcaacgggcaguccuaccggggcaccuauucuacaaccgucacgggaagaaccugccaggccuggagcuccaugacaccucacucucauagcagaacccccgaguacuauccgaaugcuggccucaucaugaacuacugucggaauccugaccccguggccgcgcccuauugcuacacacgcgauccuuccguuagaugggaauauuguaaccugacccaaugcucugacgccgaggggacggcuguggccccgcccacaauuaccccuauccccagccuugaagcuccuuccgagcaggcccccacagaacagcggccuggaguccaagaguguuaccacggcaaugggcagagcuaccagggaaccuauuuuauuaccgugacaggccgcacgugccaggccuggucuuccaugaccccgcauagccacucuagaacacccgcuuacuauccuaacgcggggcugaucaagaauuacugucggaaccccgauccuguggccgcucccuggugcuauaccacagacccguccgucagaugggaguacugcaaucucacccgcuguagcgacgccgaauggacggccuucguuccucccaacgugauucuggcucccucucuggaggccuuuuucgaacaagcgcucacagaggagaccccuggcgugcaggauugcuauuaccauuacggacaguccuaucggggcaccuacagcacaaccgucacagggagaacgugucaggcuugguccagcaugacaccccaccaacacucucgcacaccugaaaauuauccgaacgccggacugacccggaauuacugcagaaaccccgacgccgagauccgcccuugguguuauacaauggaucccagcgugcggugggaauacugcaaccuuacccagugucugguuacggaguccucugugcucgcuacccugacagucgugccugaccccagcaccgaagccuccucugaggaggcgccgacagaacagagcccuggcguucaggauugcuaucauggggacggacaauccuacagaggcucuuuuagcaccacagugacgggccgcaccugucaguccuggagcucuaugacaccccacuggcaucagcggaccaccgaguacuauccuaaugggggacuuacaagaaacuacugccggaaucccgaugcugaaauuuccccuugguguuauacgauggaccccaacguccgcugggaguacugcaaucugacccagugcccggugacagaaagcucuguucucgccaccuccacagccgugagcgagcaagcuccuaccgagcagucccccacgguccaggauuguuaucacggcgacgggcaaucuuacagaggcagcuucuccacaaccgugaccggccggacaugccagagcuggucuuccaugacaccccauuggcaccagcgcacaaccgaauauuacccuaacgggggacugacgagaaauuacugucggaacccggaugccgagaucagacccuggugcuauacaauggacccuagcgugcgcugggaauacuguaaucugacccagugccccgucauggagucuacacuccugaccacgccuaccguugugcccgugccuagcacagaacuucccuccgaggaggcuccgaccgaaaacucuacaggcguccaagauuguuaucggggcgacgggcagagcuacagaggaacccuguccacaaccaucacgggccgcacaugccagucuuggagcuccaugaccccucacuggcaucggcgcauuccccucuauuacccuaaugccgggcugacccgcaacuauugucggaaucccgacgcggagaucagaccguggugcuacacaauggauccuagcgugcgcugggaauacuguaaccugaccagaugccccguuacagagucuuccgugcuuacgacccccacagucgccccugugcccagcaccgaggcuccuuccgaacaggccccgcccgagaaaucuccuguugugcaagacugcuaucacggagauggccggagcuaccgcgggauuuccucuacaaccgucacgggaagaaccugucagagcugguccagcaugaucccccauuggcaccagcggacaccugaaaauuaucccaacgcuggccucaccgagaacuacugccgcaauccugacucuggcaagcagccgugguguuauacaaccgaucccugcgugagaugggaauacuguaaccugacgcaaugcuccgagacagagagcgggguccuggaaaccccuacagugguucccgugccuucuauggaggcccacuccgaagccgcucccaccgagcagaccccggucgugcggcaguguuaucauggaaauggccaaagcuacagagggacauuuucuacgaccguuacaggaagaaccugccagagcugguccucuaugacaccucaccggcaucagagaacccccgaaaacuaccccaaugacggccucacgaugaacuauugucgcaauccugaugcggacacagggcccuggugcuucaccauggauccuagcauucggugggaguacuguaaccugaccagaugcuccgacacagagggaaccguggucgccccgcccacagugauccaggugccuagccuugggcccccuuccgaacaagauuguauguuuggcaauggcaaaggauaucggggcaagaaggcuacgaccguuacagggacccccugccaggagugggccgcccaggaaccgcaccgccauucuacauucaucccuggaaccaacaaaugggcuggccuggagaagaauuacugcagaaaccccgacggggauauuaauggaccuugguguuauacgaugaacccccggaaacucuuugacuacugcgacaucccgcugugugccagcuccucuuucgauugcggcaagccucaggucgaacccaaaaagugucccggcagcauugucgggggaugcguggcgcacccucacuccuggcccuggcaagucucucugcgcaccagauuuggcaagcauuucugugggggaacacuuaucagcccugagugggugcucaccgcugcccacugccugaaaaaguccagccggccgucuuccuauaaaguuauucugggcgcccaucaggaggugaaucucgaaagccacguccaggagaucgaagugucucgccuguuccuugagcccacacaggcugacaucgcccugcucaagcuguccagaccugcgguuauuaccgauaaagugaugcccgccugucugccuagccccgacuacauggucacagcucggaccgagugcuacaucacgggguggggagaaacacaaggcaccuuuggcaccgggcuucucaaggaggcccagcugcuggugauugaaaacgagguuuguaaucacuauaaauacaucugcgcugaacaucucgcccgcggaacagauucuugccagggcgacuccgggggaccucugguguguuucgagaaggauaaguauauucuucagggcgucacgagcugggggcugggaugcgcuagaccgaacaaacccggcguguacgcccggguguccagauuugucaccuggaucgagggcaugaugcgcaacaauuga

SEQ ID NO: 71581 - RNA, 1095 nt, Artificial Sequence
  derived and/or modified sequence opt5 from LPAR1__Homo_sapiens__XP_005251839
auggccgcuaucagcaccuccauucccgugaucucucagccucaauucacagccaugaacgagccgcagugcuuuuacaaugaaagcauugcguucuuuuauaacagauccggcaagcaccuggcuacggaguggaauaccgucucuaaacucguuauggggcugggaaucacaguguguauuuucaucaugcuugccaaccugcucgugauggucgccaucuacgugaaucggcgcuuucauuuccccauuuauuaccugauggcuaaccuugccgcugccgacuuuuucgcgggccuggccuauuuuuaccucauguucaauaccgggccuaacacaagacggcugaccguuagcacauggcugcuccgccagggacugaucgauaccucccuuacggcuucuguggccaaucugcucgcuauugccaucgaaagacacauuaccgucuuucggaugcagcugcauacacgcaugagcaacagacgggugguuguggucaucguggugauuuggaccauggcgaucgucaugggcgccauccccuccguuggguggaauugcauuugugacaucgagaacugcagcaauauggcuccucuuuauucugauuccuaccugguguucugggccauuuuuaaccucgugacauucgucgugaugguugugcuguacgcucacaucuucggauauguccgccaaagaaccaugcggaugagccgccauucuuccggccccagacggaaucgcgacacgaugaugagccugcucaagacagugguuauugugcugggcgccuuuaucaucuguuggaccccugggcuuguccugcuccugcuugaugugugcuguccgcagugcgacguccuggccuacgaaaaauucuuucuccugcuggcugaguucaacucugcgaugaaccccauuaucuauuccuacagagauaaggagaugagcgccacauuucggcagauucucuguugccagagauccgaaaauccuaccggacccaccgagggcucugaccgcagcgcuuccagccugaaccacacaauccuugccggggugcacucuaaugaucauuccguuguguga

SEQ ID NO: 71582 - RNA, 1056 nt, Artificial Sequence
  derived and/or modified sequence opt5 from LPAR2__Homo_sapiens__XP_011526723
auggugaucaugggccagugcuacuauaacgagaccauuggguucuuuuacaauaacagcggaaaggaacuguccucucacuggagacccaaagacgucguugugguggcccucggccugacagucagcgugcuuguucugcucacgaaucugcuugugaucgcugccauugcguccaaccggcgcuuccaucagccuaucuauuaccugcucgggaaucuggcugccgccgaucuguuugcuggagucgccuaucucuuccugauguuucacaccggcccgagaacagcucggcuuucucuggaggggugguuccuccgccagggacugcuugacaccagccugacagccuccguggcgacccuccuggccauugcuguugaaagacaucggucugugauggccguccagcugcacagccgccuccccagaggccggguggugaugcugaucgucggcguuuggguggcugcccuugggcugggacuccugccugcgcauuccuggcacugucuuugcgcccuggaucgcuguagcagaauggcuccccuccugucucgguccuaccuggccgugugggcucucagcucucugcuugucuuucugcucaugguggccguuuauacacgcaucuucuuuuacgugagacggcgcguccagagaauggccgagcacguguccugccauccucgguacagagaaaccacgcugagccuuguuaagaccguggucauuauccugggcgcuuucguggucuguuggacacccgggcaagugguucuccugcuggacggacucggcugcgagucuuguaacgugcuggcggucgagaaauauuuucuucugcucgccgaagcuaauucccuggugaacgccgccguuuacagcugccgcgaugcugagaugcggagaaccuuccgccggcugcuuuguugcgccugucucagacaguccacacgcgaaucugugcacuauaccagcuccgcgcaagggggagcuagcacgcggauuaugcugccugagaauggccauccgcugauggacucuacacucuga

SEQ ID NO: 71583 - RNA, 1062 nt, Artificial Sequence
  derived and/or modified sequence opt5 from LPAR3__Homo_sapiens__XP_011539451
augaacgagugccacuacgacaagcauauggauuucuuuuauaauagaagcaacaccgacacaguggaugacuggacgggcaccaaacuggucaucguucucuguguggggacauucuuuugccuguucaucuuuuucuccaauucucuugugauugccgcugucauuaagaaccggaaauuucacuuccccuuuuacuaucugcucgccaaucuggcggcugccgauuucuuugccggaaucgcuuacguguuccuuauguuuaacaccggcccuguuagcaagacacugaccgugaaucgcugguuccucagacaggggcugcuggacuccucucucacagccagccugaccaaccuucuggucauugcuguggaacggcauauguccaucaugcgcaugagaguucacucuaaucucacgaaaaagcgggugacccugcuuauccugcucgucugggccauugcgaucuucaugggagccgugccgacacugggcuggaacugucugugcaauauuagcgcuuguuccagccucgcccccaucuauucucgcuccuaccugguguuuuggaccgucagcaaccuuauggcuuuccugauuaugguugugguguaucucagaaucuacgucuacgugaagcggaaaacaaauguucugucuccucauaccuccgggagcauuucucgcagacggacgcccaugaaacuuaugaagacagugaugaccguccugggagccuuugugguuugcuggacaccuggccucgugguccugcugcucgauggccugaacugucgccaaugcggggugcagcacgucaagagaugguuccuucugcucgcgcugcuuaauuccgugguuaaccccaucaucuauagcuacaaagacgaggauauguauggaaccaugaagaagaugauuuguugcuuuucccaggaaaacccugagcggcgcccgucuagaauccccagcaccgugcugucccggagcgacacaggcucucaguacauugaagauuccaucagccaaggggccgucuguaauaaaucuacgagcuga

SEQ ID NO: 71584 - RNA, 1035 nt, Artificial Sequence
  derived and/or modified sequence opt5 from LPAR6__Homo_sapiens__NP_001155970
auggugagcgucaacuccucucacugcuucuacaaugacagcuuuaaguauacccuguacggcuguauguucuccaugguuuuugugcucgggcugaucucuaacugcguggccauuuauaucuucauuuguguccuuaaagugagaaaugagacaacgaccuacaugaucaaccuggcuaugagcgaucuccuguuuguuuucacacuucccuuucggauuuucuauuuuaccacacgcaauuggccuuucggagaccugcucugcaagaucuccgugaugcuguuuuacaccaacauguauggcucuauccuguuccucacauguauuagcgucgauagauuucuggccaucguguacccguucaaauccaagacccuucggacgaaacgcaaugcgaagauuguuugcaccgggguguggcugacagucaucggaggcagcgcucccgccguguucgugcagucuacccauucccaagggaacaaugccagcgaggcuuguuuugaaaacuucccugaagccacauggaagaccuaccucucuagaauugucaucuuuauugagaucguuggauucuuuaucccccugauucuuaaugugacgugcuccagcauggugcugaaaacacucaccaagccugucacacugucucgguccaaaaucaacaagaccaaagugcugaagaugauuuucguucaccucaucaucuuuuguuucugcuuugugcccuauaauauuaaccugauccuuuacagccugguccgcacccagacauucgugaauuguuccguuguggcugccgucagaacgauguauccuauuacccucugcaucgcggugucuaacugcuguuuugacccgauugucuacuauuucacaagcgauaccauccagaacuccauuaagaugaaaaauuggagcgugcggcgcucugacuuuagauucuccgaaguucauggcgccgagaacuucauccagcacaaucugcaaacacuuaagagcaaaaucuuugauaacgagucugcugccuga

SEQ ID NO: 71585 - RNA, 1605 nt, Artificial Sequence
  derived and/or modified sequence opt5 from LPCAT1__Homo_sapiens__NP_079106
augagacugcggggcugcgggccccgcgccgcuccugccagcuccgcgggagcuucugacgccagacuccuggccccgcccggccggaacccuuucgugcacgagcuucgccugagcgcucuccagaaggcccaagucgcucugaugacccuuacacuguuucccguuagacuccugguggccgcggccaugaugcugcucgcuuggccucuggcccuuguggcuucccuggggucugccgaaaaggagcccgaacagccuccggcgcucuggcggaaggucguggauuuccugcuuaaagccaucaugcgcacgaugugguuugcuggaggcuuccauagaguugccgugaaggggcggcaggcucugcccaccgaggccgccauucucacacuggcuccucacagcuccuacuuugacgcgauccccgucaccaugacaaugucuagcauugugaugaaagccgaaucccgcgauaucccuauuuggggaacccugauccaguauaucagacccguuuucgugagccggucugaccaagauucccgcagaaagacagucgaggagauuaagcggcgcgcucagagcaauggcaaauggccgcagaucaugauuuuuccugaaggcaccuguacgaacagaaccugccucaucacauucaagcccggggccuuuauuccuggagcccccgugcagcccgugguccugcgguacccuaauaaacuugacaccaucacauggaccuggcaaggcccgggggcucuggagauucucuggcugacgcuuugucaguuccauaaccagguugaaaucgaguuucugcccguguauucuccuuccgaggaagagaagagaaaucccgcccucuacgcgagcaacgugcgccgggucauggcugaagcccugggagugucuguuacagauuauaccuucgaggacugccagcuggcccucgcugaaggccaacugagacuuccugccgauacaugucugcucgaguuugcucgccuggugcgggggcuuggacugaaacccgagaagcucgaaaaggaccuggauagauacuccgagcgcgcccggaugaaaggcggcgaaaagaucgggauugcggaguucgccgcuagccuggaagucccgguguccgaccuccuggaggauauguucucucuuuuugacgagagcggauccggcgaaguugaccugagagagugcguggucgcccucagcguggucugucgcccugcucggacccuggauaccauccagcuggccuucaaaauguauggggcgcaggaagacggaucugugggcgagggggaucuuuccugcauucucaagacagcccugggaguugcugaacugacggugaccgaccucuuuagagccaucgaucaagaggagaaaggcaagauuacauucgcugacuuucaccgcuucgccgaaauguaccccgccuuugcugaggaauaccuguauccugaucagacccauuucgagagcugugcggagacaucucccgccccuauccccaauggcuuuugcgcugacuucagcccggaaaacuccgaugccgggcggaaaccugucagaaagaaacuugacuga

SEQ ID NO: 71586 - RNA, 1635 nt, Artificial Sequence
  derived and/or modified sequence opt5 from LPCAT2__Homo_sapiens__NP_060309
augagcagaugcgcccaggcugccgagguggcggcuaccguccccggcgccgggguuggaaacgugggccugcggccuccgauggugccccgccaagccuccuucuuuccucccccuguccccaauccuuucgugcagcagacacagaucgggucugcuagacggguucaaauugugcuccugggaaucauucuucugccgauccgcguccuccugguggcccuuauucugcuccuggcuuggcccuuugccgcgaucagcacgguuuguugcccugaaaagcugacccaccccaucacaggcuggagacggaaaauuacccagacagcccucaaguuccuggggcgcgcuauguuuuucuccaugggauuuaucguggccgucaaaggcaagauugcuucuccucuugaggcccccguguucguggcggccccgcauagcaccuuuuucgacggcaucgcuugugucguugccgggcugccuuccauggugucuagaaacgaaaaugcucaggugccccucauuggacggcugcuucgcgccguccagccugugcugguuagcagaguggaucccgacucccggaaaaacacaaucaaugagauuaucaagcgcaccacgagcggcggggaauggccccaaauccucgucuuuccugagggaaccugcacaaacagaucuugucugauuaccuucaagccgggcgccuuuauccccggggugccuguucagcccgugcugcuccgguacccuaauaaacuggauacagucaccuggacguggcagggauauacauucauucagcuuugcaugcugaccuucugucaacucuuuacaaagguggaggucgaguucaugcccgugcagguuccgaacgacgaagaaaagaaugauccugugcuguuugcuaacaagguccgcaaucuuauggcggaggcccugggcauccccgugaccgaccacaccuacgaggauugcagacucaugauuuccgcuggccagcugacacugccuauggaagccgggcucguugaguucacgaaaaucagccggaagcugaaacuugacugggauggagugagaaaacaucuggacgaauaugccucuaucgcuuccagcucuaagggcgggcgcauuggaaucgaggaauuugccaaauaccucaagcugcccgucuccgaugugcuucggcaacuguucgcgcucuuugacagaaaccacgauggcagcauugacuuccgcgaguaugugaucgggcuggcuguucuguguaauccuuccaacaccgaggaaauuauccaggucgccuuuaaacucuucgacguggaugaggacggauacaucacagaagaggaauuuucuaccauucugcaggccagccuuggcgugcccgaucuggacgucuccggccucuucaaggagaucgcucagggggauagcauuucuuaugaggaauuuaaauccuucgcccugaagcauccggaguacgcuaagaucuucacaaccuaccuggaccuucaaacgugccacguguuuagccucccuaaagaaguucagacaacccccucuaccgccagcaauaaggugucccccgagaaacacgaagagucuacaagcgauaagaaagacgauuga

SEQ ID NO: 71587 - RNA, 1464 nt, Artificial Sequence
  derived and/or modified sequence opt5 from LPCAT3__Homo_sapiens__NP_005759
auggccagcuccgcugagggcgacgaagggaccguggucgcccuggcgggaguucuccagucuggcuuccaagagcugagccuuaacaagcuggcuacaucccucggggccucugaacaggcccugagacuuaucauuagcaucuuucugggauaccccuucgcucucuuuuaucggcacuaccuguucuauaaagagacguaccugauucaucucuuucacaccuucacaggccuguccaucgccuauuuuaauuucgggaaccagcuuuaccauucucugcucugcauugugcugcaguuucuuauccugcgccucaugggaagaaccaucacagcugugcugaccacauucuguuuucaaauggccuaucugcucgcgggcuacuacuauaccgccacgggcaauuacgauauuaaguggaccaugccucacugcguccugacacuuaaacugaucgggcucgcuguggacuauuucgauggaggcaaggaccagaacagccuguccagcgaacagcagaaauacgccauucgcgggguuccgucucuucuggagguggcuggauuuuccuauuucuacggcgccuuccucgucgggccccaauuuagcaugaaucauuauaugaagcuggugcagggagagcugaucgauauuccuggcaagauccccaacucuauuaucccugcgcucaaacggcugucccuuggccuguucuaccucguuggguacacccugcuuagcccccacaucacagaagacuaucugcucaccgaggauuacgacaaucacccuuuuugguucagauguauguauaugcugauuuggggaaaguuugugcuguacaaauaugucacgugcuggcucgugacagaaggcguguguauccugaccgggcuuggauucaacggcuuugaggagaaggggaaagccaagugggaugcuugcgccaauaugaaggucuggcuguucgaaacaaacccgcgguuuaccggaaccauugcuucuuucaauaucaacacaaaugccuggguugcccgcuacauuuuuaaaagacucaaguuccugggcaacaaagagcugucccagggccuuagccuccuguuucuggcucucuggcaugggcugcacuccggauaucuuguguguuuccagauggaguuccugaucgugaucgucgaacggcaagcggcccgccucauucaggaaucucccacgcugagcaagcuggcugccaucaccgugcuucagccuuuuuacuaccucguucaacagacaauucauuggcuguucaugggcuauuccaugaccgccuuuugccuguucacaugggacaaauggcucaagguguacaaaagcaucuauuuucuggggcacauuuucuuucuuucucuccuguucauccugcccuacauccacaaggcuauggucccuagaaaggagaaacugaagaaaauggaguga

SEQ ID NO: 71588 - RNA, 1575 nt, Artificial Sequence
  derived and/or modified sequence opt5 from LPCAT4__Homo_sapiens__NP_705841
augagccagggcucccccggggacugggccccucuggauccgacccccggaccucccgcuucuccuaaccccuucgugcacgagcuccaucugagcagacuucaacgggucaaguuuugccugcucggcgcccugcuugcgccuauccgcguucugcucgcuuucauugugcuguuucugcucuggccguucgccuggcuucagguggccgggcuguccgaagaacagcugcaggaacccaucacaggauggagaaaaacggucugucacaauggcgugcucgggcugucucggcuucuguuuuuccuccugggauuucugcgcauuagaguucggggccaacgcgcuagcagacuccaggccccugugcuggucgcugcgccccauuccaccuucuuugacccuaucgugcuucugcccugcgaucucccgaagguugugucucgggccgagaaccugagcgucccugugauuggcgcccuucugcgcuucaaucaggcuauccucguguccagacacgaccccgccagccggcgcagagucguugaagaggugcggcgcagagcuacaucugggggaaaauggccucaggugcuguuuuuccccgagggcaccuguuccaacaagaaagcccugcucaaguuuaagcccggggcguucaucgccggagucccugugcaaccgguucugauucgguaccccaauagccuugauacaaccucuugggcuuggagaggcccuggggugcugaaaguccucuggcugacagccucccagcccugcagcaucguggacguugaauuucuuccuguguaucaucccucuccggaggaaucccgcgauccuacccuguacgcuaacaauguccagcgggugauggcccaggcccucggcauucccgcuacggagugugaguucgucggaagccugccugugaucguugugggcagacugaaggucgcgcucgaaccccaacugugggagcuugggaaagugcugcgcaaggccggacucuccgcuggcuauguugacgccggggccgaaccuggacggucuagaaugauuagccaggaggaguucgcucgccagcugcaacuguccgauccccagaccguggccggcgcguuuggguacuuccagcaggacacaaaaggacuugucgauuuucgggacguggcucucgcccuggccgcucuggauggcggcagaagccucgaggagcugacccgccuugccuucgaacuguuugcugaggaacaagccgaggggccgaaccggcuccuguauaaggacggauucucuacaauccugcaccuucuccugggcuccccucaccccgcggccaccgcucugcaugccgaacucugccaggcugggagcucucagggacugagccuuugucaguuucaaaauuucucccugcacgacccccucuacggcaagcuguuuucuacguaucugagaccuccgcauacaagccgcgggaccucccagacacccaacgccagcucuccuggcaaucccaccgcgcuugccaacggaaccgugcaggcuccuaaacagaagggcgauuga

SEQ ID NO: 71589 - RNA, 1113 nt, Artificial Sequence
  derived and/or modified sequence opt5 from LPGAT1__Homo_sapiens__NP_055688
auggccaucacccuggaggaagcucccuggcucggcuggcugcuugugaaggcccugaugagauucgcguuuauggucguuaacaaucucguggcuauuccuagcuacaucugcuaugugauuauccugcagccgcuucggguccuggacuccaaacgcuucugguacauugaggggaucauguauaaguggcuccugggaaugguggccucuuggggcugguacgccggguauacaguuauggaauggggagaggauaucaaagcugugagcaaggacgaagccgucaugcuggugaaccaccaagcuacgggcgauguuuguacccucaugaugugccugcaggacaaagggcuuguggucgcccagaugauguggcugauggaucauauuuuuaaguacacaaauuucggaaucgugucccucgugcacggcgacuuuuucauuagacagggccggucuuaucgcgaucaacagcugcuucugcucaagaaacaucuggagaacaauuacagaagccgggaccgcaaguggaucguccuguuucccgaagggggauuccucagaaaacggcgcgagaccucccaggcguuugccaagaaaaacaaucugccuuuccuuacaaacguuacccugcccagaucuggcgcuacaaagauuauccucaaugcccugguggcucagcaaaagaacgggagcccugccggaggcgaugcgaaagagcuugacuccaagagcaaagggcugcaguggauuaucgauaccacgaucgccuaccccaaggcugaaccuauugacauccagaccuggauucucggauaucggaaaccgacagugacccacguccauuaccgcaucuuucccauuaaggaugugccucuggagacagacgaccugaccacguggcucuaucagagauucguugagaaagaagaucugcuuucucacuuuuacgagacaggcgccuuucccccuuccaagggccacaaggaagcugugagccgggagaugacccugucuaaucucuggaucuuccugauccaauccuucgccuuccuuagcggguauaugugguacaacauuauccaguauuuuuaccauugucuguucuga

SEQ ID NO: 71590 - RNA, 2691 nt, Artificial Sequence
  derived and/or modified sequence opt5 from LPIN1__Homo_sapiens__NP_001248356
augagcagagugcagaccaugaacuacgucggccaacuggccgggcagguuuucgugacagugaaggagcucuauaaaggacugaaucccgcuacgcuuuccggcugcaucgacauuaucgucauucggcagccuaacgggaaucugcaguguucuccguuucacgugcgcuucggaaagaugggcguucucagaagccgggaaaaaguggucgauaucgagauuaacggggaauccguggaccugcauaugaaacuuggagauaauggcgaggccuuuuucguucaagaaaccgacaacgaucaggaggugauccccaugcaccuggcgacaucuccuauccucagcgagggcgcuucccgcauggaaugccagcugaagagagggucugucgaccggaugcgcggacuggaucccagcaccccugcccaggugauugcccccuccgagacaccuagcagcuccagcguggucaagaagagacggaaacgcagacggaagucucaacucgacucccugaaacgcgaugacaauaugaacaccagcgaagaugaggacauguuuccgaucgagaugucuuccgaugaagcuauggagcuucuggaaagcuccagaacacuccccaaugacauuccucccuuccaggacgauaucccugaggaaaaccugucucuugccguuauuuacccccagagcgcuuccuauccgaauagcgaccgggaguggucuccuacccccuccccuagcggcucucgccccagcacgcccaaguccgauucugagcuggugagcaaauccaccgaaagaacagggcagaagaacccugagaugcucuggcuguggggagaacugccgcaagccgcgaagucuucuagcccccauaaaaugaaggagagcucuccucucuccagccggaaaaucugugacaagucccacuuucaggccauucauucugaaagcuccgauaccuucucugaccagagccccacacuggugggcggggcccuucuggaucaaaauaaaccucagaccgagaugcaguuugucaacgaggaagaccucgagacgcugggagccgcugcuccccuucugccgaugaucgaggaacucaagccucccuccgcgagcgugguucagacagccaauaaaaccgauucuccuuccagaaagcgcgacaagcggagcagacaccugggcgcugauggcguguaccuggacgaccucacagauauggaccccgaagucgccgcucuguauuucccuaaaaacggggaucccucuggacuugccaagcacgccuccgacaacggcgcucgcagcgcgaaucaaucuccgcagagcgugggguccagcggaguugauucuggcguggaguccaccagcgacgggcugcgggaucucccuuccaucgccauuucucugugcggaggccuuagcgaccauagagagaucaccaaagaugcuuuucuggaacaggccgucuccuaccagcaauucguggacaaccccgccauuaucgaugaccccaaucucgucgugaagauuggcucuaaauauuacaacuggacaacggcugccccucugcugcucgcgaugcaggcuuuucagaagccgcugcccaaggccaccguugagagcaucaugcgcgauaaaaugccuaagaaagggggacgguggugguucuccuggagaggccgcaauacaaccaucaaggaagagucuaaacccgagcagugucuugccgggaaggcucacagcacaggagaacaaccuccccagcugucccucgccacccgggugaagcaugaguccucuuccagcgacgaagagagagcugccgcgaaaccuucuaacgccggccaucugccccugcuuccgaaugucuccuacaagaaaacgcuccgccugacaagcgaacagcugaagucucucaaacugaagaacgggccuaaugacgugguuuucuccgugaccacccaguaucaaggcacaugccggugugagggaaccauuuaccuuuggaacugggaugacaaggucaucauuagcgauaucgacggcacaauuacgagauccgauacccuggggcacauccuccccacacugggaaaagacuggacccaccagggcaucgcuaagcuguaucacaaagugagccagaauggguacaaguuucuuuauugcucugcccgggcuauuggaauggccgauaugacacgcggcuaccuccauugggugaacgagagagggaccguucugccucaaggcccccugcuccugagcccguccucucuuuucagcgcgcugcaccgggaagucaucgagaaaaagccugaaaaauuuaaggugcagugucucacggacauuaagaaucuguucuuucccaacaccgagccuuucuaugccgcuuuuggaaauagacccgccgauguguacuccuacaaacaggucggcgugucucugaaccgcaucuucacaguuaaccccaagggggaacuugugcaggagcaugcuaaaaccaauauuagcuccuauguccggcucugcgaggugguugaccacguguuuccucugcugaagagaucucacagcuccgauuucccguguagcgacacauuuucuaacuucaccuuuuggcgcgaaccccucccucccuucgagaaucaagauauccauuccgccagcgccuga

SEQ ID NO: 71591 - RNA, 2691 nt, Artificial Sequence
  derived and/or modified sequence opt5 from LPIN2__Homo_sapiens__NP_055461
augaacuacgugggccagcuggccgggcaagucaucguuaccgugaaggagcucuauaaaggaauuaaucaggcuacacugagcggcugcaucgacgugauugucgugcagcagcaagauggguccuaccaguguucucccuuccacguuagauuuggaaaacuuggcgugcugcggagcaaggaaaaggucaucgacauugagaucaacggguccgccguggaucuccauaugaaacugggagacaauggcgaagcguucuuuguugaggaaacggaggaggaauaugagaagcugccugcuuaccuugccaccucuccgauccccacagaagaucaguucuuuaaggacauugauaccccucucgugaaaagcggcggggacgagacacccucccagucuagcgauaucucccacguccuggagaccgaaacaauuuucaccccuagcucugugaagaaaaagaaacgcagacggaagaaguauaaacaagacuccaagaaagaggaacaggccgcuagcgccgcugccgaggauacgugcgacgugggagucucuuccgaugacgacaagggcgcgcaggccgcucgcgggagcucuaacgccucccugaaagaagaggaguguaaggaaccccuccuguuucauagcggagaucacuacccucuuuccgacggcgauuggucuccgcuggagaccacauauccccagaccgcuugcccuaaaagcgacuccgaacucgagguuaagcccgccgaaagccugcuuagaucugagucccauauggaguggacauggggaggguucccugaaagcaccaaggugucuaaacgggagcgcagcgaucaccaccccagaacggcgacaaucaccccguccgaaaauacacauuuucgggugauuccuucugaggacaaccugaucagcgaagucgagaaggaugccuccauggaggacaccguguguaccauuguuaaacccaagccucgcgcucucggcacacaaaugagcgaucccacgucuguggccgaacugcuggagcccccucucgaauccacccagaucagcucuaugcuggacgcugaucaccuuccgaaugccgcccuggcugaggcgcccuccgagagcaaaccugccgcuaaggucgacucccccucuaagaaaaagggcgugcauaaaagaagccagcaccaagggccugacgauaucuaccucgacgaucugaagggacuugaacccgagguugccgcccuguacuucccgaaauccgaaucugagccuggcagccggcaguggcccgaauccgacacacucagcgggucucaguccccucagagcgugggaucugcugccgcggauuccggcaccgagugccugagcgacucugcuauggaucugcccgacgucacacucagccugugugggggacuuuccgagaacggcgaaauuagcaaggagaaguuuauggaacacaucauuaccuaucaugaguucgccgaaaauccuggccugaucgauaaccccaaucucgugauucgcaucuacaacagauauuacaauugggcccuggcugccccgaugauccuuucucugcaagucuuucagaaaucccucccuaaggcuacgguggagagcuggguuaaagacaagaugcccaaaaaguccgggcgguggugguucuggcgcaagagagagucuaugacaaaacagcugcccgaaagcaaggagggaaaauccgaagccccuccggcgucugaucugcccagcuccucuaaggagccugccggcgcucggcccgccgaaaacgacagcuccagcgaugaggggucucaggagcucgaagaguccauuaccguggacccuauccccaccgaaccucugagccacggaucuacaaccuccuauaaaaagagccuuagacugucuuccgaccaaauugcuaaacucaagcugcaugauggccccaaugacgucguguucagcaucacaacgcaguaccaggggaccugccgcugugccggcacaauuuaucuguggaacuggaacgauaagaucaucauuuccgacaucgauggaaccauuacaaaaagcgacgcgcuuggccagauccucccgcaacuggggaaggauuggacccaccagggaauugccaaacuguaccauucuaucaaugagaacggcuacaaguuucucuauugcagcgcucgggccauugggauggcugacaugacgagaggauaccugcacuggguuaaugauaaaggcaccauccuuccucgcgggccccugaugcucuccccuucuagccuguucuccgccuuucaccgggaggugaucgaaaagaagcccgagaaauucaagauugaaugucugaacgacaucaaaaaucuuuuugccccgucuaagcagccuuucuaugcugcguuuggcaacagacccaaugaugucuacgccuauacacaggugggagugccugacugccgcauuuucaccguuaaccccaaaggcgagcucauccaagaacggacaaaggggaauaagagcuccuaccauagacugucugagcuggucgagcacguguuuccccuccugagcaaagaacagaacuccgcuuucccuugcccggaguuuagcucuuucuguuauuggcgcgaucccauuccugaaguggaccuugacgaucuguccuga

SEQ ID NO: 71592 - RNA, 1428 nt, Artificial Sequence
  derived and/or modified sequence opt5 from LPL__Homo_sapiens__NP_000228
auggagagcaaggcccugcucgugcugacccuugcugucuggcugcagucccucacagccucuagaggcgggguugcggcugccgaccaacggcgcgauuucaucgacauugaaagcaaauuugcccugagaacgcccgaggauaccgcugaagacacaugccaccuuaucccuggaguggccgaguccguggcuaccugucauuucaaccacucuagcaagacauuuauggucauucauggcuggaccgugacagggauguacgaauccuggguuccgaaacugguggccgcgcucuauaagcgggagcccgauucuaaugucaucgugguugacuggcugagccgcgcccaggagcacuacccuguguccgcuggauauaccaaacuggucggccaggauguggccagauucauuaacuggauggaagaggaauuuaauuacccccucgacaacgugcaucugcuuggguauagccugggagcucacgccgcgggcaucgccggcucucucacgaauaagaaggucaaccggaucaccgggcuggauccugcuggacccaauuucgaguacgccgaggcuccuucccgccuuagcccggacgaugccgacuuuguugaugugcugcacacauucaccagaggcucucccgggcgguccauuggaauccagaaaccugugggccaugucgacauuuaucccaacgggggaacauuucaaccuggcugcaauaucggcgaagccauucgcgugaucgcugagagagggcucggagacguugaucagcuggugaaguguagccacgaacggucuauucaucuguucaucgacucccuccugaacgaggaaaaucccagcaaagcguaccgcugcuccucuaaggaggccuuugagaaaggccuuugucugagcugcagaaagaaccgguguaauaaccucggguacgaaaucaauaagguccgcgcuaaaagauccagcaagauguaucugaaaacccggucucagaugccguacaagguguuccacuaucagguuaaaauucacuuuuccggaacggagagcgaaacacauaccaaccaagccuucgagaucucucuuuacggcacaguggccgaaagcgagaacauuccuuucacccugcccgaggucuccaccaauaagacauauucuuuucucaucuacacggaaguggauauuggggagcugcugaugcucaaacugaaguggaaaagcgacuccuauuucagcuggucugauuggugguccagcccuggauuugcuauccagaagaucagagucaaggccggcgaaacccagaaaaaggugauuuucugcucucgcgagaaaguuucccaccuucagaagggcaaggcgcccgcuguguuugucaaaugucaugacaagagccugaacaaaaaguccggguga

SEQ ID NO: 71593 - RNA, 1890 nt, Artificial Sequence
  derived and/or modified sequence opt5 from LPO__Homo_sapiens__NP_001153574
augagagugcugcuccaucugcccgcccuucuggcuagccucauccugcuucaggccgcggcuuccaccacacgggacccuucucuggaucucacgagccugucccuggaggucggcugcggggccccggcccccguugugcgcugugacccuugcucucccuacagaaccauuacaggagauuguaacaaucggcgcaagccugcucucggcgccgcuaacagagcccuggcgcgguggcuucccgccgaauaugaggacgggcugagccucccuuucggauggaccccgggcaaaacacgcaauggguuuccccugccucuugcuagagaaguguccaacaagaucgucggauaccugaaugaggaaggcgugcucgaucaaaaccggucucugcuguucaugcaguggggccagauuguugaccacgaucucgacuuugcccccgauaccgagcuggggagcuccgaguauagcaaagcucagugcgacgaauacuguauccaaggagauaauugcuucccuauuauguuucccccgaacgacccuaaggccggcacacaggggaaauguaugcccuucuuucgcgcgggauucgugugcccuaccccucccuauaagucucuugccagagagcagaucaaugcucugacguccuuucucgaugccagcuucgucuacucuuccgaacccagccuggcuucucggcuucgcaaccuguccagcccgcucggccugauggccgugaaucaggagguuuccgaccacgggcugcccuaucucccuuacgacucuaagaaacccagcccuugugaguuuaucaacaccacagccagagugcccugcuuccuggcuggagauucccgggcgagcgaacauauucuucuggccaccucucacacacucuuucugcgcgagcauaauagacuugcucgggaacugaagagacucaacccgcaaugggacggcgagaaacuguaccaggaagcccgcaagauccugggcgccuucguccagauuaucaccuuccgggauuaucucccuauucugcuuggggaccacaugcagaaauggauucccccuuaccaaggauauuccgagagcguggaucccagaaucucuaauguguuuacguucgcuuuucgcuucggccaccuggaggucccuagcuccauguuucggcucgacgaaaacuaccagcccugggggccggagccugaacugccccugcauacacuuuucuuuaacaccuggagaaugguuaaggauggaggcaucgacccccucgugcgcgggcugcuggccaagaaaucuaagcucaugaaacagaauaagaugaugacaggagagcugcggaacaaacuuuuccaaccuacccacagaauccauggcuuugaucuggcggcuauuaauacccagcgcugucgggaccacggccagccgggguauaacagcuggagagccuucugcgaucucucccagccccaaacacuggaggaacugaauacggugcuuaagagcaaaaugcucgccaagaagcugcugggacucuacggcaccccugacaacaucgacauuuggaucggggcuauugccgagccccuggucgaacgcggacgggugggcccucuucuggcuugccuccuggggaaacaguuucagcagaucagagauggcgaccgguucuggugggagaaucccggaguuuuuacaaacgaacaaaaggauucucugcagaaaauguccuucagccgccuugugugugacaauaccagaaucacaaaggucccucgggaucccuucugggccaacucuuauccguacgacuuuguggauugcuccgcgauugacaaacucgaucugagcccuugggccuccguuaagaauuga

SEQ ID NO: 71594 - RNA, 1839 nt, Artificial Sequence
  derived and/or modified sequence opt5 from LPP__Homo_sapiens__NP_001161143
augagccaccccuccuggcugccuccgaagucuaccggcgagccccucgggcaugugccugccagaauggaaacaacgcacagcuucggaaaccccuccaucucugucagcacccagcaaccucccaaaaaguuugcuccuguuguggccccgaaacccaaguacaauccuuauaaacagcccggcggggagggagacuuccugccucccccgccucccccucuugaugacuccucugcgcugcccagcauuuccggcaacuuucccccuccgcccccucucgaugaagaggcuuucaaggugcaggggaaucccggaggcaagacacuggaggaacggcgcagcucucuugacgccgagaucgauucccugaccagcauucucgccgaccuggaaugcagcuccccuuacaaacccagaccgccucagagcucuacaggcuccaccgcuucucccccugucuccacacccgugaccgggcauaagcggaugguuaucccuaaccaacccccgcugacggccaccaaaaagucuacacucaaaccucagcccgcuccccaggccggaccuauuccgguggcgcccaucggcacccugaagccucagccccaaccuguccccgccagcuauacaaccgcuuccacgagcucucgcccuacauuuaaugugcagguuaaguccgcccagcccagcccgcacuacauggcugccccuucuagcgggcagaucuauggauccggcccccaaggguacaacacccagccugugcccgucucuggacaguguccgccucccagcacaagaggcggcauggauuaugcguacauuccuccucccgggcuucaacccgagccgggauacggcuaugcccccaaucaggggcgguacuaugaaggauacuaugcugccggcccuggguacggaggccgcaacgacuccgaucccaccuauggccagcaggggcauccuaauaccuggaaaagagagcccggauacacaccuccgggcgcugggaaccaaaaucccccuggaauguaccccgugacgggcccuaagaaaaccuauaucacagaccccgugagcgccccgugcgccccuccccugcagcccaaagggggccacucuggacagcucggcccuuccagcgucgcucccucuuuccggccugaggaugaacuggagcaccuuaccaagaagaugcuguacgacauggaaaacccgcccgcggaugaguauuuugggcgcugugccagaugcggagaaaauguugugggcgaggggacaggauguaccgcuauggaccagguguuccaugucgacugcuuuacguguauuaucugcaacaauaaacuccggggccaaccuuucuacgccguggagaagaaggccuauugugaacccugcuacauuaacacacuggagcaguguaacguuugcuccaaaccuaucauggaacgcauucugagagcuaccgggaaggccuaucacccccauugcuuuaccugugugaugugccaccggagccucgauggcaucccguucacagucgacgcgggaggccugauccacuguauugaggauuuucauaaaaaguucgcuccucgcugcuccguguguaaagaacccaucaugccugcccccgggcaggaggagaccguuagaauuguggcccuugaccgggauuuccacguccauugcuacagaugugaagacugcggaggccugcucucugagggggauaaucagggauguuacccucuggacggccacauccuuugcaagacauguaacagcgcucgcauucgggugcugacggccaaggcuuccaccgaucucuga

SEQ ID NO: 71595 - RNA, 1284 nt, Artificial Sequence
  derived and/or modified sequence opt5 from LPPR2__Homo_sapiens__NP_001164106
auggccggcgggagaccccaccugaagcggagcuucuccaucauuccuugcuuuguguucgucgagggauuuuucuguuacgacucuaccuaugcuaaaccguaccccggcccugaagccgcgagccgcguucccccugcucucguguaugcccuggugacagccgggcccacgcuuaccauccugcucggagagcuggcuagagccuuuuucccugcuccgcccuccgccgucccugugauuggcgaaucuacaaucguuagcggggcgugcugucgguuuucucccccugugcgcagacuuguccgguuccugggaguguacuccuuuggccucuucaccacaaccauuuuugccaacgcuggccagguugugacagggaaucccaccccgcauuuccugagcgucugccgcccuaacuauacggcccugggaugucuucccccuucccccgauagacccggcccugaccgguuugugaccgaucaaggggcuugcgccggaagcccgucucugguggcggccgcucgcagagccuuccccuguaaggacgcugcccuuugcgccuacgcugucacauauaccgcgauguacguuacacugguguuccgggugaaaggcucccgccucgucaagccuagccugugucuugcccugcucugccccgcuuuucugguggggguugugagagucgccgaguaccggaaucacuggucugaugugcuggccggauuccucaccggcgcugccaucgcgacguuucugguuacaugugugguccauaacuuccagucccgcccucccagcggcagacggcuuucuccgugggaagaccuggggcaggcuccuaccauggauagcccccucgagaaacuguccguggcccaggagccugaagucugcagaccccacuccaccccugcccgccuuacccccucuaagagccaaaauugcgcucggagaggacaucugaucccguccugugugagcucucgcgccccugcuaugugcuccagcccccggguucccagaccucgccuccggucugagccgacaccccugccucugccccucccucugcccgccccuacacccagccagggcccguccccuucuagccccgggccuggaggccccgggggaggcggcgggagaggacgcaagcuccugcucccgacgccucugcuucgggaccuguauacccucuccggccuguaccccagcccuuuucacagagauaacuucucucccuaucuguuugcgucccgcgaccaccuccuguga

SEQ ID NO: 71596 - RNA, 1965 nt, Artificial Sequence
  derived and/or modified sequence opt5 from LPPR4__Homo_sapiens__XP_011540800
augcccuacaucgagccuacccaggaagccauuccguuccugaugcuccugagccuugcuuuugccggccccgcgaucacaauuauggugggggagggaauccuguauugcugucucuccaagagacggaacggcgucgggcuggaaccuaauauuaacgcuggaggcugcaauuucaacucuuuucuucgcagagccguucgguucgugggggugcacgucuuuggacuguguagcacggcccucaucaccgacaucauucaacuguccacaggcuaccaggcucccuauuuccugaccgugugcaaaccuaauuacacaucucucaacguuagcuguaaggagaauagcuauaucguggaagauauuugcucuggcagcgaccugaccgucaucaacuccgggcgcaaauccuuucccucucagcaugccacacuugcugccuucgcggccguguacguuuccauguauuuuaauagcacccugacggauucuuccaagcuccugaaaccucuucugguguucaccuuuauuaucuguggaauuaucugcggccucacaagaaucacccaguacaagaaccacccggucgacguguacuguggguuccugauuggaggcgggaucgcucuguaucucggacuguacgccgugggcaauuuucuucccagcgaugagucuauguuccaacaucgggacgcucugcgcucccucacagaucugaaccaggacccuaauagacuucugagcgccaagaacggcuccucuagcgaugggauugcgcacaccgagggaauccucaaucggaaccaucgcgacgccuccagccugacgaaccugaaaagagcuaaugccgaugucgaaauuaucacaccccggucuccuaugggcaaggagaacaugguuaccuucuccaauacacucccccgcgcuaacaccccgagcguggaagacccugugagacggaaugccucuauccacgccagcauggauuccgcucgcucuaaacagcugcuuacccaguggaagaacaaaaaugagagcagaaagcugucccuccaagucauugagcccgaaccugggcagagcccuccccggucuaucgagaugagauccagcucugaacccucccgcgugggaguuaacggcgaccaccaugggccgggaaaucaguaucugaagauucagcccggcgcggugccuggcugcaacaauagcaugcccgggggaccucgggucuccauccaaucuagacccggcagcucccagcuugugcacauuccggaggaaacacaggagaacaucucuacgagcccuaaauccagcucugcccgcgcuaaguggcugaaagccgccgagaagaccguugcuuguaaucgguccaacagccaacccagaaucaugcaagugauugccaugucuaaacagcaggggguccuccaguccagcccuaagaauacagaaggaucuaccgugagcugcacaggcuccauccgcuacaaaacccugacggaccaugagcccagcgggauuguccggguggaagcgcacccugagaacaacagacccaucauucagaucccgucuacagaaggcgagggauccggcagcuggaaguggaaggcuccugagaaagggucccugcgccagaccuaugaacucaaugaucugaaccgggacucugagagcugcgaaucccuuaaggauucuuuuggaagcggcgacagaaaacgcuccaauauugauucuaacgagcaccaucaccaugggaucaccacaauccggguuacccccguggaaggaagcgagauuggcuccgagacacugagcaucucuuccagcagagacucuacgcuccggcgcaaggggaauauuauccugauucccgaaagauccaacagcccugagaauacccggaacaucuucuacaaaggcacaucuccgaccagagccuauaaggauuga

SEQ ID NO: 71597 - RNA, 1176 nt, Artificial Sequence
  derived and/or modified sequence opt5 from LPXN__Homo_sapiens__NP_001137467
augagcacccugcucaucuccucuagcgacgcccugcuugaggaacuggagagauccacacuccaggauucugacgaauacagcaaccccgcuccucugccgcuugaucaacacucccggaaggagacgaaucuggacgaaaccucugagauucucagcauccaggauaacacauccccucugccugcccagcugguguauaccacaaauauucaggagcucaacgucuacagcgaagcgcaagagcccaaagaaucuccucccccuuccaagaccagcgcugccgcccagcuggacgagcuuauggcucaucugacagagaugcaggccaaaguugcugugcgcgccgaugcgggcaagaaacaccucccggacaagcaggaucauaaggccucucuggacuccaugcuugggggacuggaacaagagcuccaggaucugggcaucgcuaccgugcccaaagggcacugcgccagcugucagaagccuauugcuggaaaagucauccaugcccugggccagucuuggcaccccgaacacuucgugugcacgcauuguaaggaggaaaucggguccagccccuuuuucgagagauccggacucgcguauugccccaaugacuaccaccaacuguuuucuccgcggugugccuauugcgcugccccuauucuugauaaaguucugaccgcuaugaaccagacauggcaucccgagcacuucuuuuguagccacugcggcgaaguguucggcgccgagggguuucaugaaaaggacaagaaaccuuacugucgcaaggacuuccucgccauguuuucccccaaaugcggaggcuguaauagacccguccuggagaacuaucuuagcgcuauggauaccguguggcacccugaaugcuucguuugcggggacuguuuuacaucuuucuccaccggcagcuuuuucgagcuggauggacggccguucugcgagcuccauuaccaccaucgcagagggacgcugugucacggaugcggccagcccaucacaggccgguguauuucugcgaugggguacaaguuucacccugaacauuucgugugcgccuuuugucugacccaacucagcaaaggaaucuuccgcgagcagaaugacaagacauauugccagcccuguuuuaacaaacuguucccucuuuga

SEQ ID NO: 71598 - RNA, 693 nt, Artificial Sequence
  derived and/or modified sequence opt5 from LRAT__Homo_sapiens__NP_001288574
augaagaaccccaugcuggagguggucagccuccugcuugaaaaacugcuccugaucuccaauuucacccuguuuucuagcggcgccgcuggggaggacaagggaagaaacuccuucuacgaaacaucuagcuuucaccggggcgauguucuugaggugccucgcacgcaucucacccacuaugggauuuaccugggagacaauagaguggcccauaugaugccggauauccugcucgcgcugacagacgauaugggccggacccagaaagucguguccaacaagcgccuuauucuggggguuaucgugaaagucgcuucuauuagaguggacacaguugaagauuucgccuauggagccaauauccucgugaaccaccuggacgagagccuucaaaagaaggcucugcucaaugaggaagucgcccggcgcgcugagaaacugcugggcuuuacccccuacucccuccuguggaacaauugcgaacauuucgugacauauuguagauacggcaccccuaucagcccccagucugauaaguuuugcgagacggugaaaauuaucauucgggaccagcgcuccguccuugccagcgcgguucuggggcucgccucuaucguguguaccggacugguguccuauacaacccuuccugcuauuuucauccccuuuuuccuguggauggccggcuga

SEQ ID NO: 71599 - RNA, 8592 nt, Artificial Sequence
  derived and/or modified sequence opt5 from LRBA__Homo_sapiens__NP_006717
auggccagcgaggacaacagagugcccuccccuccgcccaccggcgaugacgggggaggcgggggacgggaagagacaccuacggaaggcggggcucugucucucaagcccggacugccuauccgcggcauuagaaugaaauucgccguccuuaccggccugguugaggugggggaagugagcaaucgggauaucgucgagacaguguuuaaccuccugguuggaggccaguucgaccuugagaugaauuuuauuauccaagaaggggaguccauuaacugcaugguggaucugcucgaaaagugugacaucaccugccaggcggaggucuggucuauguucacagcuauccugaaaaagagcauucgcaaucugcagguguguaccgagguuggacucguggaaaaaguccugggcaagaucgagaagguggauaacaugauugccgaccuucugguggauaugcucgggguccuggccuccuacaaucuuacaguuagagaacugaaacucuuuuucucuaagcugcagggagacaaaggccgguggcccccucacgcuggcaagcugcucagcgugcugaaacauaugccgcaaaaguaugggcccgaugccuuuuucaacuuuccuggaaaguccgcugccgcgaucgcccuucccccuauugcuaaauggcccuaccagaauggcuucaccuuucacacguggcugcgcauggacccggugaacaauaucaacgucgauaaggacaaaccuuaucucuacugcuucagaaccagcaaggggcugggauauucugcccauuuugugggcgggugucuuauuguuacauccaucaaaagcaagggaaaaggcuuccagcacugcgugaaguucgacuuuaagccccagaaaugguacauggucaccaucgugcauauuuauaaucgguggaagaacucugagcugcgcuguuacguuaauggcgaacucgcuuccuacggggagaucacaugguucgugaacaccagcgauacguuugacaaaugcuuccugggaucuuccgagacagccgaugcgaacagagucuuuuguggccaaaugaccgccguguaucuguucagcgaagcucucaaugccgcucagauuuuugccaucuaccagcuggggcuuggauauaagggcacauucaaauuuaaggccgaguccgaccuguuccucgcugaacaccacaagcugcuucuguacgaugggaaacucucuagcgcgauugccuuuaccuauaacccucgggcuaccgacgcccagcugugccuggaguccagccccaaggauaaucccucuaucuucguccauuccccucacgcccucaugcugcaagacgugaaagcuguucuuacacauagcauccagucugccaugcacagcauuggcggagugcagguccuguuuccgcucuucgcgcaacuggauuaccgccaguaucuguccgacgaaaucgaucuuacgauuuguucuacccuccuggcuuucaucauggagcugcucaagaacagcauugccaugcaggagcagaugcuggccugcaaaggcuuucuugugaucggguacucccuggaaaagagcucuaagucccacguuagcagagcugugcucgagcugugccuggccuucucuaaauaccuuuccaaucuccaaaacggaaugccccugcugaagcagcucugugaccauguccugcuuaauccugcuaucuggauucacacacccgccaaagugcagcugaugcucuauaccuaccugagcacagaauuuaucggcaccgugaacauuuauaauacgauccggcgcguugggacaguccugcuuauuaugcauacccucaaguacuauuacugggcggugaacccucaggacagauccggaaucacccccaaaggccuggaugggccgcggccuaaucaaaaggagaugcugucucucagagccuuccugcuuauguuuauuaagcagcuggugaugaaagacagcggcgucaaggaagaugagcuccaggcuauccugaacuaucugcuuacaaugcacgaggacgauaaucucauggacgugcugcagcugcucguugcccugauguccgaacaucccaacucuaugaucccugcuuucgaucaacgcaauggacuucgggugauuuacaaacugcucgccagcaaguccgagggcaucagaguccaggcgcugaaagccaugggguacuuucugaagcaccuugcucccaaacgcaaggccgaagugaugcugggacacggccucuucagccugcucgcugagcggcugaugcuucagaccaaccugauuacaaugacgaccuauaacguucucuuugagauccugauugaacagaucgggacacaagugauccauaagcagcacccugaccccgauucuuccgucaaaauucagaauccgcaaauccugaaggugauugccacccuucugagaaacagcccucagugccccgagucuauggaaguucgccgggccuuccucuccgacaugaucaaacuguuuaauaacagcagagagaaucgccggucucuccugcaguguagcguguggcaggaauggaugcuuucccugugcuacuucaaccccaagaauagcgaugagcaaaaaauuacagagauggucuaugcuaucuuuagaauccuccuguaccaugcggugaaguaugaauggggaggcuggcgcgugugggucgacacccugucuauuacgcacuccaagguuaccuucgagauccacaaagaaaaccuugccaauauuuuccgggagcagcaggggaagguggaugaagagaucggccuguguagcuccacaucugugcaggcugccagcggaauuagacgggacaucaacgucuccgugggcucucaacagccugacaccaaagauagcccgguuugcccccauuuuacaaccaaugggaacgagaauuccucuaucgaaaagacgagcucccucgagagcgccucuaacauugaacugcagacaaccaauacauccuacgaggaaaugaaagcugagcaggagaaccaagaacucccugacgagggaacccuggaagagacccuuacaaacgagacgcgcaaugccgaugaccuggaagugagcucugauaucauugaggcggucgcuaucuccagcaacucuuucauuaccacaggcaaggacuccaugaccgugagcgaaguuacagccuccaucagcucucccagcgaggaagaugccuccgagaugccugaguuucuggacaagucuauuguggaagaggaagaggaugacgauuaugucgaacucaaaguggaggggagccccaccgaggaagcuaaucugccuacggagcuucaggacaacucccugucucccgccgcgagcgaagcuggagagaagcucgauauguucggcaaugacgacaaacugaucuuucaggaagggaagccgguuacagagaaacaaaccgauaccgagacacaggacuccaaggauucuggcauccagaccaugacagccagcggauccagcgccaugucuccugaaacgaccgugucccagauugcugucgagagcgaccucggccaaaugcuggaagaggggaagaaagccacaaaccuuaccagagagacaaagcugaucaaugauugucacggaucuguguccgaagcuagcuccgagcagaaaauugccaagcuggacgugucuaacgucgcgaccgauacggaacggcucgagcugaaagccagccccaauguugaagcuccucagccccauagacacgugcuugagaucucccgccagcaugagcaaccgggccaggggauugccccugacgcugugaacggacagcggagagauagccgcucuaccgucuucagaauccccgaauuuaauuggucccagaugcaccaacggcugcucacagaccugcucuucagcaucgagaccgauauucagauguggcgcucucacagcacaaagaccgugauggacuuuguuaacuccucugacaaugugaucuucguccauaacacaauucaccugaucagccaggugauggauaauaugguuauggccugcggcggcauucuuccucugcuguccgccgcuaccucugcgacgcaugaacucgagaacaucgaacccacacaggggcugagcaucgaggccuccgugaccuuucuucaaagacugauuagccucgucgacgugcugaucuucgcuucuucccucggauucaccgagauugaagccgagaaaagcauguccucuggcgggauccugcggcagugucuucgccuggucugcgccguggcuguuagaaacugucuggaaugccagcaacacagccagcucaagacacggggagauaaggcccugaaacccaugcauucccuuauuccucugggcaagucugcggcuaaaagcccgguggacaucgucaccgggggaauuucccccgugcgcgaucucgacagacugcugcaggauauggacaucaaucggcuccgcgccguuguguuuagagauaucgaggacagcaagcaggcccaauuccuugcucuggccgucguguacuuuauuucugugcugaugguuuccaaauaccgggauauccucgaaccucagaacgagagacacagccagucuugcacggagacaggcuccgaaaaugagaacgucagccugucugaaauuacccccgcggcuuucagcacacuuaccacagccuccguggaggagucugaaagcaccuccagcgcccgccggagagacuccggcaucggggaggaaacggcuaccggacugggcucucacguggaggucacaccucauaccgcccccccuggggugagcgcuggaccggaugccauuuccgaaguucucucuacacugagccuggaggugaauaagucccccgagaccaagaacgaccgcggcaaugaccucgauacgaaagcgacaccuucugucagcguguccaagaacguuaaugugaaagacauccuucggagccuggucaacauccccgccgauggggugaccguugacccugcucugcuccccccggccugucugggagcucuuggcgaucugucuguggaacagccuguccaauuuagauccuucgaccgcagcgugauuguggccgccaagaaaucugcugucucccccagcacauuuaauaccucuauccccaccaacgcgguuuccguggugagcuccgucgauagcgcccaggcuucugacaugggcggggagagcccuggaucccggucuagcaaugccaagcuccccuccgugccuacaguugauucugugagccaggacccggucuccaacaugucuauuacggaaagacuggagcacgcccuggaaaaggcugccccccuccuucgcgagaucuucguggauuuugcgccuuuccugagccggacccugcucggcucccaugggcaggagcugcuuauugaaggaacaagccugguuugcaugaaaucuuccagcucuguggucgagcucgugaugcugcuguguucccaagaauggcagaauagcauccagaagaacgcuggccucgccuuuaucgagcuugucaaugaagggagacugcugucccaaaccaugaaagaccaccucgugcggguugccaacgaggcugaguucauucugucucgccagagagccgaagauauccaccggcaugcggaguuugaaagccuuugcgcccaguauuccgcugacaagcgcgaggacgagaaaaugugugaucaccugauuagagccgcuaaguaccgggaccaugugacagccacccagcucauccaaaagauuaucaacauucugacggauaaacacggagcuuggggcaauagcgccgugucuagaccccuggaauucuggcgccucgacuauugggaggaugaccuucggagacgccggagauucguccgcaacccucugggcuccacacaucccgaagcgacccugaagaccgccguugagcacgugugcaucuuuaaacuccgggaaaauagcaaggcuacagaugaggacauccuggccaaagggaagcagucuauuagaagccaggcucuuggaaaccagaauuccgagaacgaaauccugcucgagggcgaugacgauacccugucuagcguggacgaaaaggaccuggagaaucucgccgggccggucucccuuucuacaccugcccaacugguggcucccagcguuguggucaaaggaacgcuguccgugaccagcucugaacucuacuucgaggucgaugaggaagacccuaacuuuaagaaaauugaucccaagauccuggcguauacagagggccuucacgggaaauggcuguucaccgaaauucgcuccaucuuuagcagacgguaccuccugcagaauacagcccuggagaucuucauggcuaaccgcguggccguuauguuuaauuucccugaccccgccaccgugaagaaagucgugaacuaucucccgagaguuggagugggcacguccuuuggccuuccucagacccggcgcauuucucuggcuagccccagacagcuguucaaggccuccaauaugacacaacgguggcagcauagagaaaucucuaacuuugaguaccucauguuccugaauaccauugcggggcgcagcuacaacgaucuuaaccaguaucccgucuuuccuugggugaucacaaauuacgaguccgaagagcuggaccucacccugccgacaaacuuccgggaucugagcaagcccauuggagcccucaauccuaaaagagcugccuucuuugcugaacgcuaugagucuugggaggacgaucaggugcccaaguuccacuacggcacgcauuauuccaccgccagcuuuguucuugcguggcugcugcggaucgaaccuuucacaaccuacuuucucaaccugcaagggggaaaauucgaccacgccgauagaaccuuuucuuccaucagccgggcuuggcgcaauucucagagagacacauccgauauuaaggagcuuauccccgaauucuauuaccugccugagauguuugucaacuucaauaacuacaaucucggcgugauggacgacgggacgguggucagcgauguugaacugccgcccugggccaaaaccucugaggaguuugugcacauuaaccggcuggcucucgaaagcgaguucguguccugucagcuucaucaauggaucgaccugauuuuuggauauaagcagcagggcccugaagccguccgcgcucugaauguguucuacuaucucacauacgagggcgccguuaaccugaauagcaucaccgaucccgugcuuagagaagcggucgaggcccagauucgguccuucgggcaaacaccuucucagcugcucaucgagccccacccgccucgcggaagcgcuaugcagguguccccccugauguuuaccgacaaggcccagcaagauguuaucauggugcugaaauuccccucuaacagcccugucacgcauguggcugccaauacacagcccggccucgccaccccugcggugauuaccgucacagcuaacagacuguuugccguuaacaaguggcacaaucuuccggcucaucagggggccgugcaggaccaacccuaucagcugccuguggaaaucgauccccucauugccuccaacaccggaaugcaccggcgccagaucacagaccugcuugaucaaucuauucagguccacagccagugcuucgugaucaccuccgacaauagauacauccugguuuguggcuuuugggauaaaagcuuccggguguauucuacggacacagggagacucauucaggucguguuuggacauugggacguugugaccugccuggcucgcuccgagagcuacaucggcggcaacuguuacauucugucugggucccgggaugccacacuccugcuuugguauuggaauggaaagugcagcggcaucggggacaacccuggaucugaaaccgcggcccccagagcuauucugacgggccacgauuacgaggucaccugcgccgcugugugugccgaacucgggcugguucuuuccggcagccaagagggaccgugccugauccauucuaugaauggcgaccuccugcgcacacuggaggggccugaaaacugucucaaacccaagcugauccaggcgucccgggagggacacugcgugauuuucuaugaaaauggccuuuuuuguaccuucagcgucaacgggaagcugcaggccacaauggagaccgaugacaauaucagagcuauucagcucagccgcgauggacaauaccugcuuacaggcggggaccggggcguggucgugguuagacagguguccgaucugaaacagcucuuugccuauccuggaugcgacgcuggcauccgcgccauggcucugucuuacgaucagcgguguauuaucagcgggauggccuccggaucuauuguccuguucuauaacgacuuuaauagauggcaccaugaguaccaaacccgcuacuga

SEQ ID NO: 71600 - RNA, 2292 nt, Artificial Sequence
  derived and/or modified sequence opt5 from LRCH1__Homo_sapiens__NP_001157683
auggccacccccggcagcgagccucagccguucgugcccgcucuguccgucgccacacuccacccucugcaucacccccaucaccaucaccaccaucaccaacaucacgggggaacgggcgcgccugggggagcuggcgggggaggcggcgggucuggaggcuuuaaccuuccccugaauagagggcucgaacgggcccuggaggaagccgcuaacagcggaggccuuaaucuguccgcccgcaagcucaaagaguucccuagaaccgcugccccggggcacgaccugucugauacaguucaggcggaccugagcaagaaccggcucguggaagugcccauggagcugugccauuuugucucccuugagauccugaaucucuaccacaacuguauucgcgugaucccugaagccauuguuaaucugcagaugcuuaccuaucugaaccucucuagaaaucagcugagcgcucugcccgccugccucuguggacugccucuuaaagugcugaucgcuuccaacaauaagcucggcagccugcccgaggaaauuggccaacuuaaacagcugauggagcucgaugucucuugcaacgagaucacagcccugccgcagcagaucgggcaacugaagucccuccgggaacugaaugugcgcagaaacuaccuuaagguucugccucaggagcucguggaccugccccuugucaaauucgauuuuagcuguaauaaggugcuggugauuccuaucugcuuccgggaaaugaaacagcuccagguccugcugcucgagaacaacccccugcaaucucccccugcgcagauuuguaccaagggaaaaguucauaucuuuaaguaucuuuccauucaggccugccaaaucaagacagcugacagccuguaccuccacaccauggaacgcccgcaucugcaccagcacguggaggauggcaaaaaggacucugauuccggggugggaagcgacaauggcgauaaaagacuguccgccacggagcccucugacgaagauaccgucagccuuaacgugccuauguccaauauuauggaggaggagcagaucaucaaggaagacagcugucaucggcucucucccguuaaaggggaguuccaccaggaguuucaaccugaacccucccugcugggagacagcacaaacucuggcgaggaacgcgaucaguucaccgacagagcugauggccuccauagcgaguuuaugaauuauaaggcccgggccgaagacugcgaggagcugcuucgcauugaagaggaugugcacuggcagacagaagggaucauuuccucuagcaaagaccaggauauggacaucgcuaugauugagcaacugagagaggcggucgaucuccugcaggacccgaacggacuguccaccgauaucacggaacggagcgugcuuaaucucuacccuaugggcucugccgaggcucuggaacugcaggacuccgcccucaacgggcagauccaacuggagacaagccccguuugugaagugcagucugaccuuacccugcaguccaauggaagccaguauuccccuaacgagauuagagaaaauucucccgccgucagcccuacaaccaacuccaccgcucccuucggccucaagccgcgcucugauccugcccugauccugccucccauuagcuuuaauacacuuacgcaagcgcagaccugggacuccagcucuuacuccgugcccagcgaaggggauucugacaacgucuuccuccggccgcagagaaaucuggaguccaucgauccccaauucacaauucgccggaagauggaacagaugagagaggaaaaagagcugguggagcagcuccgcgaaagcaucgagaugcggcugaagguuucucuucacgaagaccugggcgcugcccucauggauggagugguccugugccaucuggugaaccacaucagaccucgcagcguugccuccauucaugugcccagcccugcuguccccaaacuuucuauggccaagugccggagaaacguggagaauuuucucgaggcuugucgcaaacugggcgugccugaagccgaccugugcucccccugugauauccuccagcuggacuuccggcacauuagaaagaccguugauacacuucuggcgcucggggagaaggccccgccucccaccagcgcucugcggucccgcgaccugaucggauuuugccuuguccauauucuguucaucgugcucguguacauuacguaucacuggaacgcccugucugcuuga

SEQ ID NO: 71601 - RNA, 2052 nt, Artificial Sequence
  derived and/or modified sequence opt5 from LRCH4__Homo_sapiens__NP_002310
auggccgcugccguggcggcuccccuggccgccggcggggaggaagcugccgcuaccacaagcgucccuggauccccgggccuccccgggagacggucugccgagcgcgcgcuggaagaggccguugcuacgggaacccuuaaccugagcaauagacggcucaagcacuucccucgcggcgccgcuagauccuacgaccugucugauaucacacaggccgaccuuagccggaaccgcuuucccgaagugccugaggcggccugccaacuggugucccucgaggggcugucucuguaucauaauugucucagaugccugaaccccgcucuuggaaaucugaccgcccucacauaccugaaccuuagccggaaucagcugucccuccugccuccguauauuugucagcugccccuccgcguccugaucgugagcaacaauaaacuuggcgcucugccucccgauauuggcacccucgggucucugagacagcuugacguuuccagcaacgaacugcaaucucucccuuccgagcugugcggacugagcucucuccgggaucugaaugugcgcagaaaccagcuuuccacacugcccgaagaacucggcgaccugccgcuuguccggcuggauuucagcuguaaucgcguguccagaaucccuguuucuuuuugccggcucagacaccuccaggugauucugcuggacagcaacccccugcaguccccucccgcccaagucugucuuaaggggaaacugcauaucuucaaguaccucagcaccgaggccggacagcgcggcucugcucugggggaucuggcgcccucccggccuccgagcuuuucucccugcccugccgaagaccuuuuccccggacacagauaugauggcggccucgacagcggguuucauuccguggauucuggaagcaaacgcugguccggcaaugagagcacggacgaguucucugagcuguccuuucggaucagcgaacuggcuagagagccucgcgggccccgggagagaaaggaagacggaucugccgauggcgacccggugcagauugauuucaucgacucccacgucccuggggaggaugaagaacgcggaaccguugaggagcagcggcccccugagcucagccccggcgccggcgacagagaacgcgcuccuuccucucggagagaggaacccgccggggaggaacggcgcagaccggauacacugcaacuuuggcaggagcgggagagacgccagcaacagcagagcggagcguggggcgcuccucggaaggacucccugcucaaacccgggcugagagccguggugggaggcgccgcugccgucucuacccaggcuaugcacaacgggagccccaaguccagcgccucucaagcgggcgccgcugccggacagggcgcuccugccccggcgcccgccucccaggaaccucugcccauugcugggccugccacagcucccgccccucgcccccuuggaagcauccagagaccgaacucuuuucucuuccgguccagcucucaaagcggcuccgggccuagcucucccgauuccgugcugcgcccuagacgguacccccagguuccggacgagaaagaucugaugacccagcuccgccaggugcuggaaagcagacuucaacggccucugcccgaggaccucgccgaggcucuggcguccggagucauucugugucagcuugccaaucagcuccgcccuagaucugugcccuuuauccauguucccagcccugcugugccgaagcuguccgcccugaaagcccggaagaacgucgaaucuuuccucgaggcuugccgcaagaugggcgugcccgaagccgaccuguguagcccuuccgaucuucugcaggggacggcgagaggccuccggacagcucuggaggccgucaaaagagugggaggcaaggcccugcccccucuuuggcccccuucugggcucggaggcuucguuguguuuuaugucgugcugaugcugcuccuguacguuaccuacacacgccuucuggggagcuga

SEQ ID NO: 71602 - RNA, 2370 nt, Artificial Sequence
  derived and/or modified sequence opt5 from LRFN2__Homo_sapiens__NP_065788
auggagacccugcucggcgggcugcuugccuucggaauggcuuuugccguggucgacgcgugccccaaguacuguguuugccagaaccugagcgaaucccucggcacacuguguccuucuaaagggcuucuguucgugccgcccgauaucgacagacggacgguggagcuccgccugggaggcaauuuuauuauccacauuagcagacaagauuucgcuaacaugaccgggcuggucgaccucacacugucccggaauaccaucucucauauucagccuuuuagcuuccuugaucuggaaucccuccgcucucugcaccuugacagcaacagacugcccucccucggagaggauacacugcggggccuggugaaucuccagcaucugaucguuaacaauaaccagcuuggcgggaucgccgacgaagccuuugaggauuuccugcucacccuggaggaccuugaucugagcuauaauaaccuccacggacugccuugggacucugugcgcagaauggucaaucugcaucaacucucccuggaucacaaccuucuggaccacauugcugaaggcacauuugccgaccuccagaagcuggcucggcuugaucugaccagcaaucgccuccagaaacugcccccugacccgaucuucgccagaucucaggcguccgcccugacggcuacccccuuugccccuccccucagcuucucuuuugggggaaacccucugcauugcaauugugagcuucuguggcuccggcgccuggaaagagaugacgaucuggagacaugcggcucccccgggggacuuaagggccgguacuucuggcacgugcgcgaggaagaguucguuugugaaccgccucucauuacccaacauacacacaaacugcuggugcucgagggccaggcugccacccugaagugcaaggcgaucggggaccccagcccucuuauucacugggucgcccccgaugacagacuggugggaaacuccucucggacggcuguguaugauaacggcacacucgacaucuuuauuaccacaagccaggauuccggggccuucaccuguaucgcugccaaugccgcuggagaagcgaccgccauggucgagguuagcaucgugcagcugccccaucugucuaacuccacaagcagaacggcuccuccgaaaucucgccuuagcgacauuaccggcuccucuaagacaagccggggcggaggcggcuccgggggaggcgagcccccuaaaagcccuccugaaagagccgugcucgucucugaggugaccacaaccuccgcccugguuaaguggagcgugucuaaauccgcuccccgcgucaagauguaccaacugcaguauaauugcagcgacgaugaagugcucaucuaccggaugauuccggccuccaacaaggcguuuguugugaauaaccuggucucugggacgggauaugaccuuugugugcuggcuaugugggaugacacagccaccacccucacagccaccaauaucgucggcugcgcucaguucuuuacaaaagccgauuacccucaaugccagagcaugcacucccagauucuugggggcacgaugauccuggugaucggaggcauuaucguugcuacccugcucguguucauugucauccugauggugagauacaagguuuguaaccaugaggcccccucuaaaauggcggccgcugugagcaaugucuauucccagacaaacggggcccaaccucccccucccagcucugcuccggccggagcgccuccccaggggcccccuaagguggugguucgcaaugaacugcucgacuuuaccgccucccuggcucgggccagcgauucuuccagcucuagcucccuugggagcggagaggcugccggccuggggagagccccguggcgcauucccccuucugcuccccggccuaaacccucccucgacagacugaugggcgcguucgccagccuggaucuuaagucccagcgcaaagaggaacuccuggacucucggacacccgcuggaagaggcgccgggaccagcgcccggggacaccauuccgaucgcgagccccugcucggcccgccugcugccagagcgcggucucugcuuccccugccucucgaagggaaggcuaagagaagccacuccuuugacaugggagauuucgccgccgcugccgcgggcggggucgugcccggcggauacucuccgccucgcaaagugagcaacaucuggacgaagcggucccugagcgucaauggcaugcugcuucccuuugaggaaucugaccuggugggggcuagaggaaccuucggcuccagcgaguggguuauggagucuacaguguga

SEQ ID NO: 71603 - RNA, 2160 nt, Artificial Sequence
  derived and/or modified sequence opt5 from LRFN5__Homo_sapiens__NP_689660
auggagaagauccuguucuaccucuuucugauuggcaucgccgugaaagcucagauuugccccaagagaugugucugccaaauccuuagcccuaaccuggccacccucugugcgaaaaaggggcugcuuuucguuccgcccaauauugaccggcgcacaguggaacugagacucgcugauaacuuugugacgaauaucaaacggaaggacuucgccaacaugaccucccuggucgaucugacacucucucgcaauaccaucagcuuuauuacaccucacgccuucgcugaccugagaaaccuucgggcccugcaucucaauuccaaccgccugaccaagaucacaaaugauauguuuucuggacuuagcaaccugcaccaucucauucugaauaacaaucagcugacccucaucuccucuacggcuuucgacgauguguuugcccuggaggaacuugaccugagcuauaacaaucucgagaccauucccugggaugcgguugaaaagauggugucccugcacacacuuagccuggaccauaacaugaucgauaacauuccuaagggcaccuucucucaccuccacaaaaugacaagacuggacgucaccuccaauaagcugcagaaacugcccccugauccgcucuuucagcgggcccaagugcuugcuacgagcgggaucaucucucccuccacauucgcccugagcuuuggaggcaacccucuccauugcaauugugagcugcuuuggcugcgcagacucucucgggaggacgaccuggaaaccugcgcuucucccccucugcucacagggcgcuacuucuggagcauucccgaggaagaguuccugugugagccgccucuuaucaccagacacacccaugaaaugcggguucuggagggacagcgcgccacacucagaugcaaggcgcggggcgaucccgaaccugccauucacuggaucucccccgagggcaagcugauuucuaacgcuacgagaagccugguguaugacaaugggacccuugauauccucaucacaaccgucaaagacacaggagccuuuaccuguauugcuuccaaccccgccggcgaagccacgcagaucguggaucugcacauuaucaagcugccucaucuccugaauagcacaaaccacauucaugagccggaccccgggucuuccgauaucagcaccucuaccaaaagcggauccaauacaucuagcuccaacggcgacaccaaacuuagccaggauaaaaucguggucgcugaggcgacaucuuccacggcccugcucaaguucaauuuucaacgcaacauuccugggauccggauguuccagauucaguacaauggaaccuaugacgauacacugguuuacagaaugauucccccuaccagcaaaacauuucuggugaacaaucuugcugccggcaccauguaugaccucugcgugcuggccaucuacgacgauggcaucacgucucugaccgcuacacgcgucgugggguguauucaguucaccacagaacaagacuacguucggugccacuuuaugcagucccaguuccucggaggcaccaugaucaucauuaucgggggaauuaucguggccagcguccugguguuuauuaucauccuuaugauuagauauaagguuugcaacaacaauggccaacauaaggugacgaaagucuccaacguguacucucagacaaauggggcgcagauccagggauguagcgucacccugccccaauccgugucuaagcaggcuguuggccacgaggaaaacgcccagugcuguaaagccacaagcgauaaugugauucaguccagcgagaccugcuccucccaagacagcucuaccacaacguccgcucucccgccuagcuggaccucuagcacauccgucagccagaagcagaaacgcaagaccggcacaaagcccucuaccgaaccucagaacgaggccgugacgaauguugagucccaaaacacaaaucggaacaauagcaccgcucugcagcuggccuccagacccccugauucugugaccgaagggcccacaagcaaacgcgcgcacaucaagccgaacgcccuucucaccaaugucgaccagauugugcaggagacacaacggcuggaacugaucuga

SEQ ID NO: 71604 - RNA, 1044 nt, Artificial Sequence
  derived and/or modified sequence opt5 from LRG1__Homo_sapiens__NP_443204
augagcuccuggucuagacagcggcccaagagcccuggcgggauccaaccgcacgugucccgcacccuguuccuccugcuucugcucgccgcuucugccuggggagucacacugagccccaaagacugccagguuuuuagauccgaucauggcucuagcauuuccugucagccucccgcggagaucccuggguaccuucccgcugacacggugcaccuggccguggaguucuuuaaccucacccaucugccugccaaucugcuccagggagcuagcaagcugcaagaacuucaccugucuuccaacggccucgaaagccugucuccggaguuccuucggcccgucccucagcugcgcgugcucgaucugacaagaaaugcccugaccgggcugcccccuggacuguuucaggcuuccgccacacuugacacccugguucucaaagaaaaccagcuggaggugcuugaggucagcuggcugcauggccucaaggcgcugggccaccuggaucucucugggaaucggcugcgcaaacuucccccgggacugcucgccaacuucacacugcuuagaacccuggaccucggcgaaaaucaacuggagacgcugccucccgaucuccugcgggggccucuucagcuggaacgccuccaccuggagggaaacaagcuccaggugcuuggcaaggaccuccugcugccccagcccgaucucagauaucuguuucuuaaugggaacaaacuggcucggguugccgcuggagccuuccaaggccuccgccagcuggacaugcuggaucuuuccaauaacagccucgcguccgugccugagggccugugggccucucuggggcagccgaauugggacaugagagauggauuugacauuagcggcaaccccuggaucugcgaccaaaaucucuccgaucuguaccgguggcuucaggcucagaaggacaaaauguucagccagaacgauacccgcugugccgggccugaagcugucaagggacaaacacugcucgccguggccaaaucucaguga

SEQ ID NO: 71605 - RNA, 2478 nt, Artificial Sequence
  derived and/or modified sequence opt5 from LRGUK__Homo_sapiens__NP_653249
auggccaccagcgagagagcucugcuccggacacgcgccgcgucccugcuuagaggccuggggcggucucgcacgggagcuagaagccuccaguuccgggccgaaaaggagcgccaacccugcugguccuuuccuaugggccagaaaaccaaggggucuagcaacaucgccuccucuuaccugcuucagcagcugaugcacagauaucaagaacucgacagcgauggagacgaggaucagggcgaaggggaggcuggauccgaggaaagcucugaguccgaaaugcugaaucuggaggaggaguucgacggcgugcuccgggaggaagccgucgcuaaagcccugcaucaccuuggccgcagcgggucuggaacagagcagguuuaccugaaccucacccuguccggcuguaaucuuauugaugugagcauccugugcggguaugugcaucuccagaagcuggaccugucugcgaacaaaauugaagaucucuccugugucagcugcaugccguaccugcuugagcugaaugccucccaaaacaaucucacaaccuuuuucaacuuuaagcccccuaagaaucugaaaaaggcugacuucucucacaaccagaucagcgagauuugugaucuuuccgccuaucaugcucugacaaaacucauccuggacggaaaugaaaucgaggaaauuagcggccuggagaugugcaacaaucucauccaccugucucuugccaacaauaagauuaccacgaucaacgggcugaacaaacuccccauuaagauccugugucuuuccaauaaccagauugaaaugaucaccggacuggaggaucucaaggcgcugcagaaucuggaccucagccacaaccaaaucucuagccugcagggccuugagaaucaugaucugcucgaagugauuaaccuggaggacaauaaaaucgccgaacugagagagauugaauacaucaagaaccuuccuauucuccggguucugaaucugcucgagaaccccauccaggagaaauccgaauauugguuuuucgugaucuuuaugcugcuucgccugacagagcucgaccaaaagaaaauuaaggucgaagagaaagugucugcuguuaauaaguacgauccuccgcccgagguggucgccgcucaggaccaccugacccauguggugaacagcgucaugcagccucagagaaucuucgauuccacacugcccagccuugacgccccuuaccccaugcucauucuggccggcccggaggcuugcgggaagcgggaacuggcgcaccgccucuguagacaauuuucuaccuauuuccgguacggagccugccacacgacaagaccucccuauuuuggcgaaggggaucgcguugacuaccauuucaucucccaggauguguucgacgagauggugaauaugggaaaauuuauucugaccuucagcuauggcaaccacaaguacgggcuuaaucgggauacagucgaaggaaucgcuagagacggccuggccucuuguauccauauggagauugagggcgugcgcucccucaaauauagcuacuuugaaccucgguacauccugguugugcccaugaacaaggagaaauaugaaggguaccugagacgcaagggacuuuucucccgggccgagauugaauuugcugucucuagaguggaucucuauaucaagauuaaccagaauuuccccggcuacuuugacgagguuaucaacgccgacgaucuggacguggcguaucagaaacugagccaacucauucgcgaguaccuggggcuuaccgaagaaccugcuaagucccuggccaccacagccgaugucaaaacgucucaccucaagccggaagcucaucccaccaaauauaucagcuccaauaugggagacuuccugcacagcacagaucggaacuaccugaucaaguuuugggccaaacuuucugcuaagaagaccccugccgagagagacuccauucaccgccagcaugaagcggcccggcaggcucucaugggcagaauccggcccgaucacacacugcuguuccagcgcgggccugugcccgccccgcucaccagcggccugcauuacuauacgacacuugaggagcuguggaaaucuuuugaccucugcgaagauuacuucaagccucccuuuggaccuuaucccgagaaauccggcaaggacagccuggucucuaugaagugcagccuguucagauucuguccuugguccaaagaacuucccuuucaaccgccugaggggagcauuucuucccaccugggaagcggcgcuuccgauucugagaccgaagagacccggaaggcccuccccauccagagcuucucccacgaaaaagagucucaucagcacagacagcauagcgugcccguuauuucccgcccugggucuaaugugaagccgacacugcccccuaucccccaaggacggagauga

SEQ ID NO: 71606 - RNA, 2229 nt, Artificial Sequence
  derived and/or modified sequence opt5 from LRIF1__Homo_sapiens__XP_011540070
auguaccaggugguccaaaccaucggcagcgacgggaagaaccugcuccagcugcuucccauuccuaaauccucuggaaaucugaucccgcucguucagagcuccgugaugucugaugcccugaagggcaacacagggaaacccgugcaggucacguuccaaacccagauuagcuccucuagcacauccgcuagcgugcagcuuccuaucuuucagcccgccucuuccagcaauuauuuccugaccagaacaguugacaccucugagaagggacgggugacauccgucggcaccgggaacuuuucuagcuccgugagcaaaguucaaucccacggagugaagauugauggccucacgaugcagaccuucgcggucccucccucuacacagaaggacagcuccuuuaucguggugaauacccagagccugccugucacaguuaaaucuccggugcugcccuccggccaucaccuccaaaucccugcucaugccgaagucaagagcgugcccgccucuagccugccucccuccgugcagcagaaaauucuugcuaccgccacgacaucuaccagcgggaugguugaggcuucccaaaugccgacagugaucuacgucagcccugugaacaccguuaagaauguggucaccaaaaacuuccagaauauuuaucccaagccugugacagaaaucgccaagcccgucauucugaacacgacccagauccccaaaaauguggcgacagagacccagcucaagggaggccaacacucucaggccgcuccuguuaaauggauuuuucaggauaaccugcagccguucacacccucccuugugccugucaagagcucuaauaacguggccuccaaaauccugaagaccuuuguugaccgcaaaaaucucggggauaacacgaucaacaugcccccucugagcacaauugaccccuccggaaccagaucuaagaauaugccgaucaaggauaacgcucuggugauguucaauggcaaagucuaccuccuggccaagaaagggaccgacgugcuuccuagccaaauugaucagcagaacuccgugucucccgacacaccuguucggaaggauacccugcagacagucagcuccagccccgugacggaaaucucucgcgagguggucaauauugugcucgcgaaauccaagagcucucaaauggagaccaagucccugagcaacacacagcuugccucuauggcuaaucugagagccgagaaaaacaagguugaaaaaccuagccccuccaccacaaauccgcauaugaaccagagcucuaauuaucucaagcaguccaaaacccuguuuacgaacccuaucuuccccgugggauuuagcaccggccacaaugcuccccggaaggucacagccgugaucuacgcccgcaagggcuccguucugcaaucuauugagaaaaucagcuccucuguggacgcuaccacagucaccagccagcagugcguguucagagaccaagaaccuaagauucacaacgagauggcguccacgucugauaaaggggcccagggacggaaugacaagaaagauagccagggccgcuccaacaaggcucuccaucuuaagagcgacgccgaguucaaaaagaucuuugggcugacaaaagaucugagaguuugucucacccggauuccggaccaccugacaucuggagaaggcuucgauuccuuuagcucucuugugaaguccgggaccuauaaagaaaccgaguucauggucaaggaaggagagcgcaaacagcaaaacuuugacaagaagagaaaagccaagacaaauaaaaagauggaucauaucaaaaagcggaagacggagaacgcuuacaaugccaucauuaacggcgaagcgaaugugaccggcagccagcugcucucuuccauccugcccacaagcgacgugucccagcacaacauucugaccagccacucuaaaacacgccaggagaagagaaccgaaauggaguacuauacgcaugaaaaacaagagaaggggacacucaauagcaacgcugccuacgagcagucccacuucuuuaauaaaaacuauaccgaagauaucuucccugucacacccccugagcuggaagagaccauucgggacgaaaagaucagacgccuuaagcagguucugcgggagaaagaggccgcucucgaagagaugagaaagaaaaugcaucagaaguga

SEQ ID NO: 71607 - RNA, 3282 nt, Artificial Sequence
  derived and/or modified sequence opt5 from LRIG1__Homo_sapiens__NP_056356
auggccagacccgugcggggcgggcugggagcuccucgcagaagcccgugccuccugcuucuguggcuccugcuucugcggcucgagcccgucaccgccgcggcuggcccucgcgcccccugugccgcugccugcacaugugcuggggacucccuggauugcggaggcagagggcuggccgcgcucccuggagaccugcccucuuggacgcggagccuuaaccuguccuacaauaagcucucugaaaucgauccugccggcuucgaggaccugccgaaccuucaggaaguuuaucugaauaacaaugagcucaccgcugugcccagccugggcgccgcuuccucucacguggucagccuguuucuccaacauaacaaaauucgcuccguggaagggagccagcugaaggccuaccuuucucuggagguucucgaucugucccuuaauaacaucacagaggugagaaauaccuguuucccucacggacccccuauuaaagaacugaaccucgcgggcaaucggaucgggacacuggagcugggagccuuugacggccucagccgcucucugcuuacccugagacucuccaagaaccggauuacacagcugcccguccgcgcuuucaaacuuccgagacugacccagcucgaucugaaucggaaccgcaucagacugaucgaagggcucacguuucaaggacugaauagccuugaggugcugaagcuccagcggaacaacauuucuaagcugaccgacggcgccuucuggggccuguccaaaaugcauguucuucaccucgaguauaauagccugguggaagucaacuccgggucucuguacggacucacagcucugcaucagcuucaccugagcaauaacuccaucgcccgcauucacagaaagggcuggagcuuuugccagaaacuccaugagcuggugcugucuuucaauaaccuuacccggcucgaugaagagucccuggccgaacugagcucucucagcgugcugagacuuucccacaauucuaucagccauauugcugagggggcguuuaagggacugcgcucccuccggguccuggaccuggaucacaacgagaucagcggcacaauugaagacaccucuggggccuucuccggacuugauagccucucuaaacugacgcuguuuggcaauaagaucaaguccguugcuaaaagagccuucagcggccucgaggggcuggaacaccuuaaccugggaggcaaugccauccgcuccgugcaauuugacgcuuucgugaagaugaaaaaccucaaggagcugcauauuucuagcgacuccuuccugugugauugccagcuuaaauggcucccucccuggcugaucgggcggaugcugcaggccuuugucacagcgaccugugcucacccugaaucucucaagggacagagcauuuucuccgugccucccgagagcuuuguuugcgacgauuuccugaaaccccaaaucauuacacagccggagaccaccauggccauggugggcaaggacaucagauuuacauguucugccgcuuccucuagcuccagccccaugacguucgccuggaagaaagauaaugaaguccuuaccaacgcugacauggagaauuuugugcauguucacgcccaggauggggaagugauggaguauacaaccauccugcaucuccgccaagucacauucggccacgaaggacgguaccagugcgugauuaccaaccacuuuggcucuacguauagccauaaggcgagacugacagucaacgugcugccuuccuucaccaaaacaccccacgacaucaccauucgcaccacaacgauggcccggcuugagugcgcugccaccgggcauccuaauccccagaucgcuuggcagaaggauggaggcacagacuuuccggccgcgagagagcggcgcaugcacguuaugccugaugacgacguguucuuuauuaccgaugucaaaaucgacgaugccgggguguacagcuguacagcucaaaacucugccggauccaucagcgcuaaugccacccugacgguucucgaaacccccucccugguggucccucucgaggacagaguggugucuguuggcgaaacagucgcccugcagugcaaggcuaccgggaaucccccuccccggauuacaugguucaagggcgauagaccgcuuagccugaccgagcgccaccaucucacgccugacaaccagcugcugguggugcagaacgucguggcggaggaugccggacgguacacaugugaaauguccaauacccuuggcacagagagagcucacucucaacugagcguucuccccgccgccgggugccgcaaagacggaaccaccgugggcaucuucacaauugcugucguguccucuaucguucugacgagccucgugugggucuguauuaucuaucagaccagaaagaaauccgaagaguacagcgugacaaacaccgaugaaacaguugugcccccugacgucccgucuuaucuguccagccaggggacccuuucugaucggcaggagacgguggugcgcacagagggaggcccccaagccaaugggcauauugaauccaacggcgucugcccuagagacgcgagccacuuucccgagccugauacccauucuguugcuugucggcagcccaagcugugcgccggauccgccuaccacaaagaaccuuggaaggcuauggagaaggccgaaggcacccccgggccgcacaaaauggagcauggaggccgcgugguguguagcgacugcaauacagaggucgacuguuauuccagagggcaggcguuccacccucagcccgugagccgggauucugcucaaccuagcgcccccaacggaccggaaccuggcggguccgaccaggagcauucuccccaccaucagugcagccgcaccgccgcuggcuccugcccugaaugucaaggaucucucuaccccagcaaucacgauagaaugcugacagccguuaagaaaaagcccauggcuucccuggacggcaaaggggauucuagcuggacgcuugcccggcuguaucacccugacuccaccgagcuccagccggcgagcucucugacauccggaagccccgaacgcgccgaggcucaguaccuccuggugucuaacggccaucuuccuaaggccugcgaugcuucccccgagagcaccccucugacagggcagcugcccggaaagcaaagagucccucuccugcuugccccgaaauccuga

SEQ ID NO: 71608 - RNA, 3180 nt, Artificial Sequence
  derived and/or modified sequence opt5 from LRIG3__Homo_sapiens__NP_001129523
augguggacguccugcuccuguucagccuuugccugcucuuucacaucuccagacccgaucugucucauaaccggcuuagcuucauuaaggccuccucuaugagccaucugcagucccuccgcgagguuaaacugaauaacaaugaacuggagaccaucccuaaccucggcccggugucugcuaauauuacacugcuuagccuggccgggaacagaaucguggaaauucuccccgagcaccugaaggaauuucaaucccuugagacgcuggaccucagcucuaauaacaucuccgagcugcagaccgcguucccugcucugcagcucaaauaccuguaucuuaauagcaaccgggucacaucuauggaacccggauacuuugauaaucuggccaacacccuccuggugcuuaagcugaaucgcaacagaaucuccgccauuccucccaaaauguucaagcucccucagcugcaacaccuggagcucaaucggaacaagaucaaaaacguugacggccugacauuucaggggcuuggagcucugaaaagccucaaaaugcagcgcaauggcgugaccaagcugauggauggggccuucuggggacuuucuaacauggaaauucugcagcucgaccauaauaaccugacagagaucaccaaaggcuggcuguauggccuccugaugcuucaagagcugcaccucucccagaaugcuauuaacagaaucagcccggaugccugggaauuuugucagaagcuguccgagcuggaccuuacguucaaucaccucucucggcuggaugacagcuccuuucuggggcucagccugcuuaacacccugcauauuggaaauaaccgcgucucuuacaucgcggauugcgccuucagaggccucuccagccugaagacacuggaccuuaaaaauaacgaaaucucuuggaccauugaggauaugaauggggcuuuuagcggacucgacaagcugcggcgccugauccuccagggcaaccggauuagauccaucacaaagaaggccuucaccgggcuggacgcucuugaacaccuggaucucucugacaaugccauuaugagccugcaaggaaacgcguucucccagaugaaaaagcugcagcaacuucaucucaacacgagcucucugcugugugauugccagcucaaauggcugccccaguggguggccgagaauaacuuucaguccuucguuaaugcuagcugugcccacccucaacuucugaagggccgcucuaucuuugcugugucccccgacggcuucgucugcgaugacuuuccuaagccccagaucacagugcagccggagacccagagcgccauuaaaggguccaaccucucuuucaucuguagcgccgcuuccucuagcgauuccccuaugacauuugcguggaagaaagacaaugaacugcugcacgaugccgagauggaaaacuaugcucaucuuagagcccaaggaggcgaggugauggaauacaccaccauucuccggcugagagaggucgaguucgccagcgaagggaaguaucagugcguuaucucuaaucacuuuggauccagcuacucugugaaagcuaagcugacagugaacaugcuccccuccuucacgaagaccccuauggaccugacaauucgcgccggcgcgauggcucggcuugagugugccgccgucgggcaucccgcuccccagaucgccuggcagaaagauggaggcaccgacuuuccugcugccagagaacgccggaugcacgugaugccggaggacgauguuuucuuuaucguggacgucaagauugaagauaucggcguguacagcugcacagcgcaaaauucugccgggagcauuuccgcuaacgccacccugacgguucucgagacacccagcuuccugagaccucugcuugaccgcaccgugaccaaaggagagacagcuguccugcaguguaucgccggcgggucucccccucccaagcucaauuggaccaaagaugacuccccgcugguggucacagaacggcauuucuuugcggccggaaaccagcuccugauuaucguggauagcgacguuuccgaugcuggcaaguauacgugcgagaugucuaauacccuugggacagaaagaggcaacgugcgccugagcgucauuccuacccccacaugcgacuccccucagaugaccgcccccucucucgaugacgauggaugggcuacggugggcguugugaucaucgccgucguguguugcgugguugggaccagccuggucuggguggugauuaucuaccacacacggagacgcaaugaggacuguuccauuaccaacacagacgagaccaaccugccugccgauauccccucuuaucuuagcucccaaggaacgcuggcugaccggcaggauggcuacgucagcucugaauccgggagccaccaucaguucgugacaucuuccggagcgggcuuuuuccucccgcaacacgacagcucugggaccugccauauugauaauuccagcgaggccgacguugaagcugccacagaucuguuucucuguccuuuccugggcuccaccggacccauguaucuuaagggcaacguguacgggagcgaccccuuugagaccuaucacacaggaugcucuccugauccgagaacgguccugauggaccacuacgaacccagcuacaucaaaaagaaagaguguuauccuugcucccaucccucugaggaaagcugugagcgguccuucucuaauaucagcuggccuucccacgugcgcaagcuccugaacaccucuuacagccauaaugaaggccccgggaugaaaaaccugugccuuaauaaguccagccuggauuuuucugccaacccugagcccgcuuccguugccagcucuaauuccuucaugggaacauuuggcaaggcgcucagacggccgcaccuggacgcuuauagcuccuucgggcagccuucugauugucagcccagagccuuuuaccucaaagcccauagcuccccugaccuggacagcggcucugaagaggauggaaaggagcgcaccgacuuccaggaagagaaccacauuugcacauucaaacaaacccuugaaaauuaucggacgcccaacuuucaguccuacgaucuggacacauga

SEQ ID NO: 71609 - RNA, 1872 nt, Artificial Sequence
  derived and/or modified sequence opt5 from LRIT1__Homo_sapiens__NP_056428
augagaguggcccugggcaugcucuggcugcuugcucuggccuggcccccucaggcgcggggguucugcccgagccaauguuccugcucucuccacaucaugggagacggcagcaaggcucgcaccgucguuuguaacgaucccgacaugacacugccucccgccuccauuccucccgauacgucuagacuucggcuggagcgcaccgccaucagacgggugccuggggaagccuuucgcccgcucggaagacuggagcagcuguggcuccccuacaaugcccugagcgaacuuaacgcucugaugcuccggggccugcgcagacuucgggagcugcgccucccugggaauagacuggccgcguuccccugggccgcucugcgggacgccccuaaacuccgccugcuugaucugcaggcuaacagacucuccgccgugcccgcggaagccgcucgguuucuggagaaucuuacauuccuggaccucucuagcaaccagcugaugagacugccgcaagagcucauugucuccugggcccaucuggaaaccggaaucuuuccucccggccaccauccucgccgggugcuuggccugcaggauaaucccugggcuugcgacuguagacucuaugaucugguucaccuucuggacgggugggcccccaaccucgccuucauugagacagaacugcgcugcgcuagcccucggucucuggcgggaguggccuuuucccagcucgagcugagaaagugucagggcccggagcuucaucccggggucgcuagcauccgcucucugcucggaggcaccgcccugcugcggugcggggccacaggagugccuggccccgaaauguccuggagacgcgcuaauggccggccucuuaacgggaccguucaccaagaggugagcucugauggaacguccuggacccuccugggccugcccgccgucagccaccucgacuccggggauuacaucugucaggcgaaaaauuuccugggagcuucugaaacagugauuagccuuaucgugaccgagccgccuacauccaccgaacauagcggcucucccggggcccugugggccagaacgggaggcggcggggaggcugccgcuuauaacaauaagcucgucgcccgccacguuccucagauucccaaaccugcggugcuggccacaggacccuccgugccgagcaccaaggaggaacugacacuugagcauuuucagauggacgcucucggcgaacugucugacgggcgggccggaccuagcgaggcuagaaugguccgguccgugaagguugugggcgauaccuaccacucugucagccugguguggaaagcuccccaagcgaagaacaccacagccuucuccguucucuaugcuguguuugggcagcacagcaugcgcagagucaucgugcagcccggcaaaacgcgggucaccauuacaggacugcuuccuaagaccaaauacguggccugcguuugugugcaaggccuggucccgagaaaggaacagugcgugaucuucucuacaaaugagguuguggacgcugagaacacccagcagcucauuaacgucguggugaucuccguugccaucgucauugcccugccccugacgcuucucgugugcuguagcgcucugcaaaagcgcugccggaaauguuuuaauaaggauucuacagaagcgaccgugaccuaugucaaccuggagagacucggguacuccgaagacggacuggaggaacuuagccgccauuccgugucugaggccgauagacugcucagcgcucgguccucuguugacuuccaggccuucggcgugaaagggggacgcagaaucaaugaguacuuuugcuga

SEQ ID NO: 71610 - RNA, 2040 nt, Artificial Sequence
  derived and/or modified sequence opt5 from LRIT3__Homo_sapiens__NP_940908
augcaccuguucgccugccucuguaucgugcugagcuuucuugagggcgucgggugccugugucccucccagugcaccugugacuaccauggaagaaacgauggcucugggagccggcucguucugugcaaugacauggauaugaacgaacuuccuacaaaucugccgguggacacggugaagcuccgcauugagaaaaccgucaucagacggauuuccgcugaagccuucuauuaccugguggagcugcaauaucucuggguuacauacaacucuguggcgagcaucgaucccuccucuuuuuauaaucugaagcagcuucacgaacugcgccucgacggaaacagccuggcugccuucccuugggccucccuucuggauaugccccuccugagaacccuggaccuccauaauaacaaaauuacaagcgucccuaaugaggcucugcgguaccuuaagaaccuggccuaucucgaucugucuuccaaucgccuuaccacacugcccccugacuuucucgagagcuggacccaccuggugucuacgccguccggcguucuggaucucagccccucuagaaucauccuggggcuucaggacaacccuugguucugugauugccauauuuccaaaaugaucgaacugagcaagguggucgaccccgcuauugugcuccuggacccucuuaugaccuguuccgagcccgaacggcugacaggaauccucuuucagcgcgccgagcuggagcacugccugaagccgucugugaugaccagcgcgacaaaaauuauguccgcccucggcagcaauguccugcuuagaugugaugcuaccggcuucccuacgccccaaaucacauggacccggucugacuccagcccuguuaacuacacagugauucaggaaucucccgaggaaggggugcgcuggagcaucaugucccugaccggaaucucuagcaaggaugccggcgacuacaaaugcaaggcuaaaaaucucgccgggauguccgaggcggucgugaccguuacagugcugggaauuacgaccacacccaucccuccggauaccagcgaaagaacaggcgaccaccccgagugggauguccagccugggucuggacgguccaccagcgugucuuccgccagcuccuaucuguggucuagcuccuuuucucccacgagcuccuucagcgcuucuacacuuuccccucccagcaccgccucuuuuucccucagcccguucucuagcuccaccguuagcucuacaaccacacuguccacgagcauuuccgcuucuaccacaauggccaacaagcgcagcuuucagcugcaucaaggcggcaagagaaaccucaaaguggccaagaauggguccaaacugccucccgcuucuaccagcaagaaagaggaacuugcgcugcucgaccagacaaugcugaccgagacgaacgccgcuaucgaaaaucugcgggucguguccgagaccaaggaaucugucacacuuaccuggaacaugauuaauacaacccacaacagcgccgugacgguucucuacuccaaauauggaggcaaggaucugcugcuccugaaugccgacagcucuaagaaccaggugacaaucgaugggcuugagccuggaggccaguacauggcuugcgucugucccaaaggggugccuccccaaaaggaccagugcaucaccuucuccacagagagaguugaaggagacgauagccaguggucucugcuccugguggucaccuccaccgccuguguggugauucugccgcuuaucugcuuccuccuguauaaaguuuguaagcugcaaugcaaaagcgagccuuuuugggaagacgaucucgcgaaggagacauacauucaguucgaaacgcuguuuccccgcucucaguccgucggcgagcuuuggacccggagccauagagacgauuccgagaagcugcuccuguguagccgcucuagcguggaaucccaggugacauucaaaucugagggcagccggcccgaauauuacugcuga

SEQ ID NO: 71611 - RNA, 1500 nt, Artificial Sequence
  derived and/or modified sequence opt5 from LRMP__Homo_sapiens__NP_006143
augaacgacgaucccagcauggaggaaaauggcguggagagagucugcccugaaucccugcuccagucucgggaguacagcucccugccgcuuccccgccacaccucuagcacagacgggacgaucaccuccucugauccuggacuggaaauucucaacauggccagcugugaccuggauagaaauucccuuugcaagaaagaggaggacacacggagcgcuucucccaccaucgaagcccaaggcacauccccugcgcaugauaacauugcuuuccaggacagcaccucuaaggauaaaacaauccugaaucucgaggccaaggaagaacccgagaccauugaggagcacaaaaaggaacaugccuccggggacagcguugugucuccucugccggugacgaccgucaaguccgugaaccugcgccagagcgagaauacauccgcuaacgaaaaagagguugaggccgaauuucucagacugucucuuggauucaagugugauugguuuacccuggagaaacgggugaagcucgaggaacgcagcagagaccuggcugaagagaaucuuaaaaaggagaucacaaacugccugaagcuccuggaaucccugacgccccucugugaggaugacaaucaggcccaagaaaucauuaaaaagcuggagaaaagcaucaaguuccuuucucagugcgcggcccgggucgcuucccgcgccgaaaugcugggcgcuauuaaccaggagagcagagugucuaaagccguugaggugaugauccagcacgucgaaaaucucaagcggauguaugcgaaagagcaugccgaacuggaggagcuuaagcaagugcugcuccagaacgaacgcagcuuuaauccucuggaggacgaugacgauugucagauuaagaaaagauccgcuucucugaacagcaagcccuccagccuccggcgcgugaccaucgccucucugccuagaaacauugggaaugcuggaauggucgccggcauggaaaacaaugaccgguucuccagacgcucuagcuccuggcggauccuuggcagcaaacaguccgagcacagacccucucugccgcgcuuuaucagcacauacuccugggccgaugcugaagaggagaagugcgaacucaaaaccaaggacgauucugagccuagcggggaagagacaguugaacggaccagaaagcccucccugagcgagaaaaagaacaauccuucuaaaugggacguguccagcguguaugauaccauugcgucuugggccacaaaccuuaaguccagcauccgcaaagcuaauaaggcccuguggcucucuauugccuucaucguccuguuugcugcccugaugagcuuccucacgggacaacuguuucagaaguccguggacgcggcucccacccagcaagaggauagcuggacaucucuugaacacauucuguggcccuucacccggcucagacauaacggcccuccgcccguuuga

SEQ ID NO: 71612 - RNA, 2142 nt, Artificial Sequence
  derived and/or modified sequence opt5 from LRP10__Homo_sapiens__NP_054764
augcugcucgccacccugcuucugcuccugcuuggcggggcucuggcccaccccgacagaaucauuuucccuaaccaugcgugcgaggauccgcccgcugugcuccuggaaguccagggaacacugcaacggccucucguucgcgacagcagaacgucccccgccaauuguaccuggcugauccuuggcucuaaggagcagacagugaccauucgguuucagaaacugcaccucgccugcgggagcgaacgccugacacuuagauccccucugcagccccucaucucucugugugaggcuccuccgagcccccugcaacucccuggaggcaacgugaccauuacauacuccuaugccggggcucgggcccccaugggacagggcuuccugcuuucuuacagccaggauuggcugaugugccuccaggaagaguuucaaugucugaaucaucgcugcgucuccgcggugcagagaugugacggcguugaugccugcggggacggaagcgaugaggcuggcuguucuuccgacccuuuccccgggcuuaccccgcggccugugcccagccugccuugcaacgucacgcucgaagauuuuuauggaguguucucuucccccggcuacacccaccuggccagcguuucucauccccaguccugucacuggcugcucgacccucacgaugggcgcagacuggcugugcgguuuacagcccuugaccugggauucggcgaugcgguccauguguaugacggcccggggcccccugagagcucccgccuccugagaucucuuacccacuuuagcaauggaaaggccgugacagucgaaacccuguccggccaggcuguugugagcuaccauacgguggccuggucuaacgggcggggauucaaugcuacauaucacguccgcggcuacugccuccccugggacagaccuugcgggcugggauccggccugggcgccggggagggacucggcgagcgguguuacagcgaagcccaaagaugcgaugggucuugggacugugcugauggaaccgacgaggaagauugccccggcuguccgccugggcacuuucccugcggcgcggccggaacaagcggcgcuaccgccuguuaucugccugccgaccgcugcaacuaccagaccuucugugcugauggggccgacgagcggagaugccgccauugucagcccggaaauuuucggugcagagaugaaaaaugcguguaugagacauggguuugugacggccaaccugauugcgcggacggguccgacgagugggauuguucuuacgugcuuccccgcaaggucaucacggcugccgugaucggaagccugguuugcggccuccugcuggugauugcccuuggguguaccugcaaacucuaugcuauccggacacaggaauacuccauuuucgccccgcugagcagaauggaggcugaaaucguccagcagcaagccccucccucuuauggccagcugauugcgcagggagccauucccccuguggaggacuucccgaccgaaaaccccaaugauaacuccguccucggcaaucugcgcagccuucugcagauccuccggcaagacaugacaccugggggaggccccggggcuagacgccggcagagaggacggcugaugcgcagacuggugcggagacuucgccgguggggccuccugccuagaaccaacacgcccgcccgcgcuucugaggccagaucccagguuacaccuagcgcggcuccccuggaggcccucgaugggggcaccggaccggcccgggaaggcggggcugugggaggccaggacggggagcaagccccuccccugccuaucaaggcuccccuuccguccgccucuaccagcccugcgcccacaaccgucccugaagcccccggaccccugccuucccucccgcuggagcccucucugcuuagcggcgugguucaggcucuccgcgggagacugcugccuucccucggacccccuggccccacacggagcccuccgggcccccacacggccgugcuggcccuugaagaugaggacgauguccugcucgugccucuggcugagcccgggguguggguugccgaagcggaggacgaaccucugcuuaccuga

SEQ ID NO: 71613 - RNA, 2523 nt, Artificial Sequence
  derived and/or modified sequence opt5 from LRP12__Homo_sapiens__NP_001129175
auggccugcagauggagcaccaaggagucuccccgguggcgcuccgcucugcuccugcuuuuccuggccggcguguacgcguguggggaaacaccugagcagaucagagcuccgagcggaauuaucacgucccccggcuggccuucugaauaucccgccaaaauuaacugcagcugguuuauccgggccaauccuggggagauuaucaccaucuccuuccaagacuuugauauucagggaucucgcagauguaaccucgacuggcugacaaucgaaaccuacaagaauauugagagcuaucgggcuugcggcuccacaauucccccuccguacaucagcucucaggaucacaucuggauucgcuuccauuccgacgauaacaucagcagaaaaggguuucggcuugccuauuucucuggaaaguccgaggaacccaauugugcuugcgaccaguuucgcuguggcaacggcaaaugcaucccugaggccuggaaguguaauaacauggaugaaugcggggacagcucugaugaggagauuugugcgaaggaagccaaucccccuaccgcugccgcuuuccaacccugcgccuacaaccaguuucagugccuguccagauucacaaaagucuauaccugucucccggagagccugaagugcgacggaaauaucgauugucuggaccucggcgaugaaauugacugcgacguuccuacgugugggcaguggcugaaauacuuuuacggaaccuucaacucccccaauuauccugauuuuuacccucccggcucuaacugcacauggcuuaucgacaccggggaucaccggaaggugauucugcgcuucacagacuucaaacucgauggaaccggcuauggcgacuacgugaagaucuaugaugggcuggaggaaaauccccauaaacuucugagaguccucacggcguuugacagccacgccccgcugacagugguuuccagcucuggacaaauccgggugcauuucugugcugauaaggucaacgccgcucgcggcuuuaacgccaccuaccagguggacggguucugccugcccugggagauuccuuguggaggcaauugggggugcuauacagagcagcagagaugugauggauacuggcacugccccaacggccgggacgaaaccaauugcaccaugugucaaaaggaggaauuuccuugcuccagaaacggcguuuguuacccccgcagcgaccggugcaauuaucagaaccacuguccgaaugggucugaugagaaaaacugcuucuuuugucagccuggaaauuuccauugcaagaacaauagauguguguuugaaagcugggucugcgacucccaagaugacuguggcgaugggucugacgaggagaacugccccgugaucgugccuacacgcgucauuacggccgcuguuaucggaagccucauuugcggccugcuucuggugaucgcgcucggguguaccugcaaacuguacucccuucggauguucgaaagacgcagcuuugagacacagcugucucggguggaagccgagcuccugagacgcgaagcucccccuuccuauggccagcugaucgcccagggacucauucccccggucgaggauuucccuguguguagccccaaucaagccucuguucuggagaaccuucggcuggcugugagaucccagcucggcuuuaccagcguccgccugcccauggccgggcgguccucuaauaucuggaacagaauuuucaacuucgcgcggagccgccacuccggaucucuugcucuggugagcgccgacggcgaugaaguugugccuucccagagcacaucuagagagccggaacggaaucauacccacagaucccucuuuagcgucgagucugacgauacggacacagagaacgaacgccgggauauggccggggcuuccggaggcguggccgcuccccugccucagaaggugcccccuaccaccgccgucgaggcgacaguuggggccugcgcuagcucuagcacccaauccacaagaggcggacacgccgacaauggccgcgacgugacgagcgucgaacccccuucugugucccccgcuagacaucagcugaccagcgcccucucccggaugacacaggggcugcgcuggguuagauucacccuuggacggucuagcucccugucucagaaccaaagcccgcuccgccagcuggauaauggcguguccgggagagaggacgaugacgaugucgaaaugcugaucccuauuucugacggaagcuccgauuuugacgugaacgauuguagccggccccuucucgaccuggcgucugaucagggccaggggcugcgccaaccuuacaaugccacaaaccccggcgugagaccguccaaucgggacggaccuugcgagcgcuguggcaucguucacaccgcucagauucccgauacgugccucgaggucacccugaaaaacgaaacaagcgacgacgaggcccuucugcucuguuga

SEQ ID NO: 71614 - RNA, 13800 nt, Artificial Sequence
  derived and/or modified sequence opt5 from LRP1B__Homo_sapiens__NP_061027
augagcgaguuccugcuggcccugcuuacccuguccggacuccugcccauugcucgggugcuuaccgucggggccgaccgggaucagcaacugugcgacccuggagaauuucucugucacgaucauguuacgugcgugucucagagcuggcugugugacggcgauccggacugccccgaugacuccgaugaaucucuggacaccuguccugaagaaguggaaauuaagugcccccucaaccacauugccugucuggggacaaauaagugcguccaucuuagccagcuguguaacggagugcucgauugcccugacggcuacgaugaagggguucacugucaggagcugcuuuccaauugccaacagcugaacugccaguacaaguguaccauggugcgcaauucuacaagaugcuacugugaagacggauucgagauuaccgaagacggccggagcugcaaggaucaggacgagugugcugucuacggcacaugcucccaaaccugucgcaacacgcaugggagcuauaccugcucuuguguggagggauaucucaugcagcccgauaauagauccugcaaggccaaaaucgaaccuacagaccggccgcccauucugcugaucgccaacuuugagaccaucgaaguuuucuaccucaauggcagcaagauggcuacacugucuuccgugaacgggaaugagauucacacccuugauuuuaucuauaacgaagacaugauuuguuggaucgagagccgcgagucuuccaaucagcugaagugcauucagaucacgaaagccggaggccucacagaugaauggaccauuaacauccugcaauccuuccacaauguccagcagauggcuaucgacuggcuuacaagaaaccuguacuuuguggaucaugugggggaccggauuuucgucugcaacuccaauggaucuguuugugugacccucaucgaucuggagcugcacaacccuaaggccauugcgguggaccccaucgccggcaaacucuuuuucaccgacuacggcaaugucgcuaagguggaacgcugcgauauggacgggaugaacagaacacggauuaucgauagcaaaacggagcaaccugccgcucuggcccuugaccugguuaauaagcucguguauugggucgaucuguaccuugacuaugugggaguuguggauuaccagggcaagaaccgccauaccgucauccaggggagacaggugcggcaccuguauggaauuacagucuuugaagacuaccucuaugcgaccaauuccgauaacuacaauaucgugcgcauuaacagauucaauggcacagacauccacagccugauuaaaaucgagaacgccugggggauccggauuuaccaaaagagaacccagcccacgguucgcucucaugcuugugagguggauccguauggaaugccuggcggcugcucccacaucugucugcucagcucuagcuacaaaacacggaccugcagaugucgcaccggguuuaaucugggauccgacggccggucuugcaagagacccaaaaacgaacuuuuccuguucuaugggaagggacgcccuggcauuguccgggggauggaucucaauacaaaaaucgccgacgaguacaugauucccaucgaaaaccuggugaaccccagagcucuggacuuucaugccgagaccaauuauauuuacuucgccgauacaacgagcuuucuuaucggccgccagaagaucgacggaaccgaacgggagacaauucucaaggaugaccuggauaacguugagggcaucgcuguggacuggauugggaauaaccuguauuggaccaaugauggacacagaaaaacaaucaacgucgcgcgccucgaaaaggccucccagagccggaaaacccugcuugagggcgaaaugucucauccuagagggauugugguggacccgguuaauggauggauguacuggacggauugggaggaggacgaaaucgaugacuccgucggccggaucgagaaggcuuggauggauggguucaaccgccaaauuuuugugaccagcaaaaugcuguggcccaauggccucacacuggacuuccacaccaacacacuguacuggugugacgccuauuacgaucacaucgaaaagguguuucuuaauggaacccauagaaagauugucuauucuggccgggagcucaaccacccuuucgggcugucccaucacggaaauuacguguuuuggacggacuauaugaacggcagcaucuuccagcuggaucucauuacauccgaaguuacccugcuuagacacgagagacccccucuguuugggcuccagaucuacgacccccggaaacagcaaggagauaauaugugcagagugaacaacggcggguguucuacacugugccuggccaucccgggcggacgcgucugcgcuugugccgacaaucagcuucucgaugagaacggcacaaccugcacauucaauccuggggaagcgcugccccauauuuguaaggcuggagaguuuagaugcaaaaaccggcacuguauccaggcccgcuggaagugcgacggcgaugacgauugucuggacgggagcgacgaagauuccgugaauugcuucaaccauucuuguccugacgaucaguucaaaugccaaaauaacagauguauucccaagcgguggcucugcgacggagccaaugauugcggcagcaacgaggacgaauccaaucagacguguaccgcucgcacaugccagguugaucaauuuagcugugggaacggcagaugcaucccucgggccuggcugugugaccgcgaggaugacugcggagaucagaccgacgagauggcuucuugugaguuccccacaugcgagccgcuuacccaguuuguguguaaguccggcagaugcauuagcucuaaauggcacugugauuccgacgacgauugcggggacggaagcgaugaagucggcugcgugcauucuuguuucgacaaucaguuucggugcagcuccgggcgcuguaucccuggacacugggccugcgauggcgacaacgauuguggcgacuucagcgaugaggcgcaaaucaauugcacgaaggaagagauucacucucccgccggguguaacggaaacgaguuucagugccaucccgacggcaauuguguuccugaucuguggagaugcgacggggaaaaagauugugaggacggauccgacgaaaagggcugcaacgggacaauccggcucugcgaucacaaaaccaaguucagcuguugguccaccggaagaugcauuaauaaggcuugggugugugacggcgauaucgacugcgaggaucagucugacgaggaugacugugauagcuuucugugcggcccgcccaaacauccuugugccaacgacacauccgucugccugcagcccgaaaaacuuuguaaugggaaaaaggauugcccugacggaucugacgagggcuaucucugugaugaaugcagccugaacaaugggggauguuccaaccacugcucuguggugcccggccgcgggauugucugcagcuguccugagggacugcaacucaauaaagacaacaagaccugcgaaaucguugauuacuguuccaaucaucugaaaugcagccaggugugugagcagcacaagcacacagugaagugcucuuguuacgagggcuggaaacuugacgucgauggcgaauccugcacgagcguggaccccuucgaggcuuuuauuaucuucucuauccggcaugaaauuagacgcaucgaucugcacaagcgggacuauucccuccugguuccggggcugagaaacaccauugcccuugauuuucauuucaaucagagccugcucuacuggacagacguggucgaggaucgcaucuaucggggaaaacugucugaauccggcggggugagcgcgauugagguuguggucgagcacggacucgccaccccugaaggccugacaguggacuggaucgcugggaacaucuacuggauugauuccaaucuugaccaaaucgagguugccaagcuggacggaagccucagaaccacgcugauugcuggcgccauggaacacccccgcgccaucgcucuggauccucgguauggcauucuuuucuggaccgacugggaugcgaacuuucccagaaucgagucugccagcauguccggggcuggacggaaaacaaucuacaaggacaugaagaccggcgccuggccgaaugggcugacaguggaucauuucgaaaaacgcauugucuggaccgacgccagaucugaugcuaucuauagcgcccucuacgacggaacaaacaugauugagaucauucggggccacgaguaccugucccauccuuuugcggugucucucuaugggagcgaaguguacuggaccgauuggcgcacgaacacacuguccaaggcuaauaaauggaccggacagaacgucucuguuauccagaagaccagcgcccaacccuucgaccuucagauuuaucacccuuccagacagccccaggcccccaauccuugugcugccaacgauggcaaaggcccgugcagccauaugugucugaucaaucacaaccggucugcggcuugcgccugcccccaccucaugaagcuguccagcgacaagaaaacauguuacgagaugaagaaauuucugcuuuaugccagacgcucugaaaucagagggguggacauugauaauccuuacuucaacuuuaucaccgcuuucacggugcccgacauugaugacgucacagugaucgauuuugacgccuccgaggagagacuguauuggaccgauauuaagacacaaaccaucaaacgcgcuuucaucaauggaacaggccucgaaaccguuauuagccgggacauccaguccauuagagggcuggccguggauugggucucucgcaaccucuacuggaucagcuccgaguuugacgaaacgcagauuaauguggcgcggcuggauggaagccuuaagaccucuaucauccauggcauugacaagccucagugccuggccgcucaccccguuagagggaaacuguacuggacagauggaaacaccaucaauauggccaacauggacggcuccaauagcaagauucucuuccaaaaccagaaagagccugugggccugucuaucgacuaugucgaaaacaaacuuuacuggauuagcuccgggaauggaacaaucaaccgcuguaaucuggauggcgggaaccucgaggugauugagucuaugaaagaagaacugaccaaggcuacggcccucacaaucauggacaaaaagcuguggugggccgaucagaaucuugcucagcugggaaccugcagcaagagagacggccggaacccgacaauccugcgcaauaaaaccuccggggucgugcauaugaagguuuaugauaaagaagcgcaacagggaucuaacagcugucagcucaauaacggcggcugcucccagcugugucuucccaccagcgagacaacgagaaccugcauguguacagugggguacuaucugcaaaagaaucggaugucuugccagggaauugaauccuuccucauguacagcguccacgagggcauccgcgggauuccucuggagcccuccgacaaaauggaugcccucaugccuaucucuggaaccagcuuugcugugggcauugacuuccacgccgaaaacgauacaaucuauuggaccgacaugggguuuaauaagaucuccagagccaagcgggaucagacguggaaagaggacauuaucacaaacggccugggaagaguugaaggcauugcuguggauuggaucgccgggaauauuuacuggaccgaccauggauucaaccuuaucgaggucgcgcgccugaacggcucuuuucgguacgugaucauuagccaagggcuggaccagcccagauccaucgcugugcacccggaaaagggacuccuguucuggaccgaguggggccagaugccuuguauugggaaagcccgccuugauggcagcgagaagguuguccuggugucuaugggaaucgccuggcccaauggcauuuccaucgacuaugaagagaacaaacucuacuggugcgaugcucggacagacaagauugaaagaaucgaucuggagaccgggggaaaucgggagauggugcucagcggcucuaacgucgacauguuuuccguggccguuuucggggcguauaucuacuggagcgaucgcgcucaugccaauggaucugugagacggggccacaagaacgacgccacagaaacgauuaccaugcgcacagggcugggcgucaaucuuaaagaggugaagaucuuuaacagaguucgggaaaaaggaaccaaugugugcgcucgcgauaacggcggguguaagcagcugugccuguauagaggaaauagccggcgcacaugugccugcgcucauggcuaccucgccgaggacggggucaccugucugagacacgaaggauaucuucuguacuccggccggacgauucucaaaucuauccaccugagcgaugagaccaaccucaauucccccauuagaccuuacgagaacccccgcuauuucaagaaugugaucgcgcucgccuuugacuacaaccaacggagaaagggcacaaaccgcaucuucuauagcgacgcucauuuugggaauauucagcuuaucaaagauaacugggaagaccggcagguuauuguggagaaugucggauccguggaaggccuggccuaccacagagcuugggauacccuguauuggacaucuagcaccacauccucuaucacgcgccauaccguggaccagacacggccuggggccuucgauagagaggccgucauuaccaugagcgaagacgaucacccgcacguucucgcucuggacgagugccaaaaccuuauguucuggaccaauuggaacgagcagcaucccuccaucaugcgcucuacacugacgggaaagaaugcccaggugguggucagcaccgauauccucacaccuaacggccugaccauugacuaccgggcggaaaaacuguauuuuuccgaugggagccucggaaagaucgagagaugugaauacgacggcucucagcgccacgugauuguuaaauccggccccgggacauuccuuagccuggcuguguacgauaauuauaucuuuuggucugacuggggacggagagccauucugcgcuccaacaaguacaccggcggggacacgaagauccucagaagcgauauuccucaucaacccaugggaaucaucgccgucgcuaaugacacaaacucuugcgagcuguccccgugugcccuucugaauggcgggugccacgaucucugucugcugaccccuaacggacgggugaauugcagcugccgcggcgaccggauucuccuugaagauaacagauguguuaccaaaaacuccagcugcaaugcguauucugaguucgaguguggcaacggggaaugcaucgacuaccagcugacaugugauggcauuccccauugcaaggacaaaagcgaugagaagcugcucuauugugaaaauagauccugccggcgcggcuuuaaaccuuguuacaacagacggugcaucccccacgggaagcugugugacggagagaaugauugcggcgacaacucugaugagcuugacugcaaagugagcaccugugcuacagucgaguuccgcugcgccgacgggaccuguauuccuagauccgcccggugcaaucagaacaucgauugugcugacgccucugaugagaagaauugcaacaauacggacuguacacacuuuuauaagcugggagugaaaaccacaggcuucauccgcugcaacagcaccucccucuguguccugcccacguggauuugcgauggcucuaaugacuguggggauuacagcgacgaacugaagugcccggugcaaaacaaacauaagugcgaggaaaauuacuuuuccuguccuagcggaagaugcauccucaacaccuggauuugugauggccagaaagacugcgaggaugggcgggacgaguuccacugugacucuuccugcagcuggaaccaguuugcguguucugcccagaagugcaucuccaagcauuggauuugugauggagaagacgauugcggcgacgggcuugaugagagcgacuccaucuguggagcuaucacaugcgccgcugauauguucucuugccaaggcagccgcgccuguguucccagacacuggcugugcgacggcgaacgggauugucccgacggguccgaugagcugagcaccgcuggaugcgccccuaauaacacaugugacgaaaaugcguuuaugugccauaacaaaguguguauuccgaagcaguucgugugcgaucacgacgacgauuguggcgacgggucugaugagagcccccagugcggauaucgccaguguggcaccgaggaguucagcugcgccgacgggagaugccuccugaauacacaauggcagugugauggagacuuugauugcccugaccacucugaugaggcuccccuuaacccuaaauguaagagcgccgaacaguccugcaauucuagcuucuuuauguguaaaaacggccggugcauccccuccggcgggcugugugacaauaaggaugacugcggagauggcucugacgagcgcaacugucauauuaaugaaugccucagcaagaaagucuccggguguagccaggacugccaagaucugccuguuucuuacaagugcaaauguuggccgggauuccagcugaaggacgauggcaaaaccugcguggacaucgaugaguguuccagcggguuucccugcucccagcaguguauuaacacguauggaacauacaagugccucuguaccgacggcuaugagauccaaccugauaaucccaacggcugcaagucucuuagcgacgaagaaccuuuccugauccuggcugaucaccaugaaauuagaaaaaucuccaccgacgggucuaauuacacacuccugaagcagggacuuaacaacgugauugccaucgauuuugacuaucgggaggaguucauuuacuggaucgacagcuccagacccaauggcagccgcauuaaccggaugugucugaaugggucugauaucaaagucgugcacaacaccgccguuccgaaugcucucgcgguggacuggaucggaaagaaccuguacugguccgauacagagaagcgcauuaucgaggucagcaagcugaauggccucuauccuacgauucuugugucuaaacgccugaaguuuccccgggaccugucccucgauccccaggccggguaccuguauuggaucgacugcugugaauacccucacauuggcagagucggaauggauggcaccaaccaaagcgugguuaucgagacaaagaucucucgccccauggcucuuaccauugacuaugugaaucggagacuguacugggccgaugaaaaccauaucgaguucuccaauauggacgggagccaccgccauaaagucccuaaccaggauauuccgggagugaucgcccucacacuguuugaggacuauauuuacuggaccgauggcaagacgaaaucucugagccgggcucacaagaccuccggggccgacagacucagccuuaucuacuccuggcaugcgaucacagacauucagguuuaucacucuuaccgccagcccgaugugagcaaacaccugugcaugaucaauaacggaggcugcucccaucugugucuccuggccccugggaagacccacacaugcgcuugucccaccaauuucuaucuugccgcugacaaccggacgugccugucuaacuguacagccagccaauuuagaugcaagaccgauaaauguauuccuuucugguggaagugcgacacagucgaugacuguggcgauggauccgacgaacccgaugacugcccggaguuccggugucagccuggcagauuucagugcgggaccggacucugcgcgcugcccgccuucaucugugauggcgaaaaugacugcggggauaacucugacgagcugaauugugacacccaugugugccucagcggacaguuuaaauguacaaagaaccaaaaaugcauuccugugaaucuucgcuguaacggccaggaugacugcggggaugaagaggacgagcgggauugucccgaaaauuccugcagcccugacuacuuccaguguaagacgaccaagcacugcaucucuaaacuguggguuugcgaugaggaccccgauugugcugacgccuccgaugaagcuaacugcgacaagaaaacauguggcccgcacgaguuucagugcaagaauaacaauuguauuccugaccauuggagaugcgauagccaaaacgacuguucugauaauuccgacgaagagaacugcaaaccccagaccuguacacugaaggauuuccucugcgccaauggagacugugucagcucucgcuuuuggugcgauggcgacuucgauugugcugacggguccgaugagagaaacugcgaaaccagcugcucuaaggaccaguuucgguguuccaauggacaaugcauccccgccaaauggaagugugauggccacgaggacugcaaauauggggaagacgaaaagagcugugagccugcgagcccgacgugcuccucucgcgaauacaucugugccagcgauggaugcauuuccgcuucucugaaauguaacggcgaguaugacugcgccgaugggagcgacgaaauggauugugugacagagugcaaggaagaccaguucagaugcaaaaacaaggcucauuguauccccauucgguggcuuugcgauggcauccacgacuguguggauggauccgacgaggagaauugcgaacgcggcgggaacauuuguagagccgaugaguuucugugcaauaacucucucuguaagcugcauuucugggucugcgacggagaagacgauuguggcgacaauagcgaugaggccccugacaugugcguuaaauuucugugucccuccacccggccucaccgcugcagaaacaaucggaucugccuccagagcgaacagauguguaacgggaucgaugagugcggagacaauucugaugaggaccacuguggcggcaaacuuaccuacaaagcgcgccccugcaagaaagaugaguucgcuuguuccaacaagaagugcauuccuauggaccugcaaugugauagacuggacgauugcggggacggaagcgacgagcagggcugucggaucgcccccacagaauauaccugcgaggauaaugugaacccguguggggacgaugcuuauugcaaucagauuaaaacaucuguguucugccgcuguaagccuggauuucagagaaacaugaaaaaucggcaaugcgaagaccucaacgagugucuggucuucggcacgugcucccaucaguguaucaacguggaggggagcuacaagugcguuugugaucagaauuuucaggaaagaaacaauaccugcauugccgagggauccgaagaccaagugcuuuauaucgccaacgauacagacauccugggcuucauuuaccccuuuaauuauucuggcgaucaccagcagaucagccauauugagcacaacucccgcaucaccgggauggacgucuacuaucaacgggauaugauuaucuggucuacacaguucaauccuggaggcaucuuuuacaaaagaauccaugggcgcgagaagcggcaggcuaacagcggacucaucugucccgaguucaagagaccgcgcgacauugccguggauuggguugcgggcaauaucuacuggaccgaccacucccggaugcacugguuuagcuauuacacgacccauuggacaucucugagauauuccauuaacguggggcagcugaauggaccuaacugcacccgccuccugacaaauauggccggcgagcccuacgcuaucgccgucaaccccaaacggggcaugauguauuggaccguggugggggaccacagccauauugaagaggcugccauggauggaacacuuagacggauccugguccaaaagaaucuccagcgcccuaccggccuggcgguugacuacuucucugaaagaaucuacugggccgauuuugagcuuagcauuaucggguccgugcuguaugacggaucuaacagcguggucuccgugagcucuaaacagggccuccugcacccccaccggauugauaucuucgaggacuacauuuauggggcuggaccuaagaacggcguuuuucgcgugcagaaauucggccauggguccgucgaauaccuggcccucaauaucgauaagacgaagggagugcugaucagccacagauauaaacaacuugaccugccgaaccccugucucgaucuggcuugcgaguuccuuugccugcucaauccuuccggcgccacauguguuugccccgaagggaaguaccugauuaacggaaccuguaaugacgauucucugcucgacgacagcugcaaacugaccugugagaacggcgggcggugcauccuuaaugaaaagggagaucugagaugucauugcuggccuuccuauucuggcgagcgcugugaggugaaccacugcagcaauuacugucagaacggcgggacaugcguccccuccgugcucggacggccuacgugcucuugugcucugggcuuuaccgggccgaauugcggaaaaacaguuugugaagacuucugccagaacggcgggaccuguauugugacagccggaaaucagcccuacugccauugucaaccugaguauaccggcgauagaugccaguacuaugucugucaccacuacugcgugaacagcgaauccuguacaaucggcgacgaugggagcgucgagugcgugugccccacccgcuaugaaggaccuaagugugagguugacaagugcgugcggugucauggcgggcacugcauuaucaauaaagauucugaggacaucuuuuguaacugcacgaacggaaagaucgcguccagcugucagcuuugcgauggcuacuguuauaaugggggaaccugccagcuggaccccgaaacaaacgucccggugugucucugcucuaccaauugguccggcacacaaugcgagagaccugcccccaaaagcucuaagagcgaucauaucuccacccgcagcauugcuaucauugugccccugguucugcucgugacgcugaucacaacccuugucauuggccuggugcucuguaaaagaaagcggcgcacaaaaaccaucagacggcagccuaucauuaacgggggaaucaauguugaaauuggcaaccccuccuacaauauguacgagguggaccacgaucacaacgacgggggacugcuugacccuggcuucaugaucgauccgacgaaggcccgcuauauugggggcggacccucugcuuuuaagcugccucauaccgcgcccccuaucuaccucaauagcgaccugaaaggcccccugacagccgggccgaccaacuauuccaauccugucuacgcgaagcucuauauggauggacagaacugcagaaauucucugggcagcguggacgagcggaaagaacuucugcccaagaaaaucgagauugggauccgcgaaacagucgcuuga

SEQ ID NO: 71615 - RNA, 13635 nt, Artificial Sequence
  derived and/or modified sequence opt5 from LRP1__Homo_sapiens__NP_002323
augcugacacccccucuccugcuucugcucccgcugcuuagcgcccugguggcugccgcgauugacgcucccaagaccugcuccccuaaacaguucgccugccgggaucaaauuacgugcauuucuaagggcuggcggugugacggggaacgcgauugccccgacggaagcgaugaagccccugaaauuuguccccaguccaaagcucagcgcugccagccuaaugaacacaauugucuuggcaccgagcugugcgugcccaugucucggcuguguaacgggguucaagacugcauggauggaagcgacgaaggcccccauugucgcgagcugcaggggaauugcucccgccugggaugccagcaccauugugugccuacacuugauggcccgaccugcuacuguaacucuagcuuucagcugcaagccgacggcaagacaugcaaagauuucgacgaguguuccguguaugggaccugcagccagcucuguacaaauaccgauggaucuuuuauuugcggcuguguggaaggguaccugcuucagccugacaaccgguccugcaaggcuaagaaugagcccguggacagacccccuguucugcucauugccaacagccagaauauccuggccacguaucugucuggagcccaaguguccaccaucacacccaccagcacacgccagaccacggcuauggauuucucuuacgccaacgaaacaguuuguugggugcacguuggcgacuccgcugcccagacccaacucaaaugcgcgcggaugccugggcugaagggauuuguggaugagcauacaauuaauaucagccuuucccugcaccacguugagcagauggccauugacuggcucaccggcaacuucuauuuuguggaugacaucgaugaccgcauuuucgugugcaauagaaacggcgauaccugugugacacugcuugaccuggaacucuacaaucccaaagggaucgcucuggaucccgccaugggaaaggucuuuuucacggacuauggccagauuccuaaaguggagcggugcgacauggaugggcagaaccgcaccaagcugguggacucuaagaucgucuuuccccauggaaucacacucgaucuggugagcagacuuguuuacugggcugacgccuaccuggauuauauugaaguggucgacuacgagggcaaagggcggcaaaccaucauucagggaauccucauugaacaccuguauggccuuacaguguucgagaacuaccuguaugccaccaauuccgauaacgcuaaugcgcagcagaagacgagcguuauccgcgugaacagauuuaauucuacagaguaccaagucgugacccgggucgacaaaggcggggcccuccauaucuaucaccagagacgccagccccgggugagaucccacgcuugugaaaacgaucaguacggaaagccuggcgggugcagcgacauuugucugcuggccaauucucauaaagccagaaccugccgguguagaagcggauucucccucggcucugauggaaagagcugcaaaaagcccgagcacgaacuguuccuuguuuacggcaagggacgcccuggcaucauucgggggauggacaugggagcuaaagugcccgaugagcauaugaucccgauugaaaaccugaugaauccuagagcccucgacuuucacgcggagacaggcuucaucuauuuugcugacaccacauccuaccugaucgggcgccaaaagauugauggaacggagcgggaaaccauccugaaagacggcauucauaacgucgaggggguggccguugauuggaugggcgacaaucuuuauuggacagaugacggacccaagaaaaccaucagcguggccagacucgaaaaggcugcccagacacgcaagacccugauugagggcaaaaugacgcacccucgggcuaucgucguggauccccugaacggguggauguacuggaccgacugggaagaggauccuaaggacucuagacggggacgccucgagagagccuggauggauggcucccaccgggacauuuucgugacaagcaaaaccguucuguggcccaaugggcuuucucuggauaucccggcgggaagacucuauugggucgacgccuuuuacgaccgcaucgaaacaauucugcugaacggcaccgaucggaagaucguguaugaggggccugaacuuaaucaugcuuucggccucugucaccauggaaacuaccuguuuuggacggaguacagauccggcagcguguaucgccuggagagaggggucggaggcgcgccgcccacagugacccuccugcgguccgaacgcccuccgauuuucgagaucagaauguacgacgcucagcagcaacagguugggacaaacaaaugccgggugaauaacggaggcuguucuagccuuugccuggccacccccgggucccgccagugcgcgugugccgaagaucaaguccucgacgcugauggcgugaccugccuggccaauccuucuuauguucccccuccccagugucagccuggagaguuugcuugcgccaacagcagauguauucaggaacgguggaagugcgacggcgauaaugacugucuggauaacuccgacgaggcccccgcucuuugccaccaacacacauguccgagcgaucgcuucaagugcgagaauaacagauguaucccuaaucgguggcucugcgacggggacaacgauugcggaaauucugaagacgaguccaacgcgacguguagcgccagaaccugucccccuaaucaguuuucuugugcuuccggcagaugcauccccauuagcuggacaugugaucuggacgaugacugcggggaucggucugacgaaagcgccuccugugccuacccgaccugcuucccucugacacaguuuaccuguaacaauggaagaugcaucaacauuaacuggcgcugugauaaugacaacgauugcggcgacaauagcgaugaggcuggcugcucucauuccuguagcuccacgcaguucaaaugcaacucugggcgguguauccccgaacacuggacaugcgacggagacaaugauuguggcgacuauagcgaugagacccaugccaacugcaccaaucaagcgacaagaccucccgggggaugucacaccgacgaguuccagugccgccucgauggccuguguauuccccuucgguggagaugcgacggggauacagacuguauggauuccucugacgaaaagagcugcgagggagugacgcaugucugcgauccuuccgugaaauuuggcuguaaggacucugcucgcugcaucagcaaagccuggguuugugauggcgacaacgacugcgaagauaauuccgacgaggaaaacugugagagccuggccugccggccgcccucucacccuugugcuaauaacaccuccgugugccugcccccugauaagcugugugacgggaaugaugacugcggagauggcagcgacgagggggaacugugugaucagugcucucuuaacaauggaggcuguucccacaacugcagcgucgcccccggggagggaaucgugugcucuuguccucucggcauggaacugggcccggacaaccauacaugccagauucaauccuacugugcgaagcaccugaaaugcagccagaagugugaucagaauaaauucuccgugaagugcagcuguuaugagggguggguccucgagcccgacggagaaucuugcagaagccuggacccuuuuaaacccuucaucaucuuuagcaaccgccaugagauccggagaauugaucuucacaagggcgacuacucuguucuggugccugggcuccggaauaccaucgcucuggauuuccaucugagccaauccgcccuuuacuggacagacguggucgaagauaaaaucuaucgcggaaagcugcucgacaacggcgcccugaccucuuuugaggugguuauucaguacgggcucgcuacgcccgaaggacuggccguggauuggaucgcuggcaauauuuauugggucgagagcaaccuugaccagaucgagguggccaagcuggauggcacccucagaacaacccugcuggcgggggacauugaacacccgcgggccaucgcucuugauccucgcgacgggauucucuucuggacagauugggacgccucccuccccagaaucgaggcugccucuaugagcggcgccgggcggagaaccguucaccgcgaaacaggauccggcggguggcccaauggacugaccguggacuaccucgagaaacggauccuguggauugaugcuagaagcgacgcgaucuauucugcccgcuacgauggcuccggccauauggaaguccuucgggggcacgaguuucugagccauccuuucgcugugacgcucuauggaggcgagguuuacuggacagacuggagaaccaacacccuggccaaggccaauaaauggacagggcacaacgugaccgucgugcagcgcacgaauacacaacccuuugaucuccagguguaccacccuucucggcagccgauggcucccaacccuugugaagccaauggaggccaggggcccugcucccaucuuugucugauuaacuauaauagaaccgucagcugcgcgugcccucaccucaugaagcugcauaaagacaacacaaccuguuacgaguucaagaaguuucuccuguaugcucgccaaauggaaaucagaggaguugaucuugacgcccccuacuauaauuacauuaucuccuucacagugccggauaucgacaacgugaccguccuggauuaugacgcccgggagcagcgcguguacuggucugacguuagaacgcaggcuauuaaacgggccuucaucaacggcaccggcguggaaacagucgugagcgcggaucugccuaaugcucacgggcucgccguugacugggugucccgcaaccuguuuuggaccagcuacgauacaaauaagaaacagauuaacgucgccagacuugacggaucuuucaagaaugcugugguccaaggccuggagcagccccaugggcucgugguucacccucugcggggaaaacucuauuggaccgauggcgacaacaucuccauggccaauauggaugggagcaacagaacgcugcucuuuucuggacagaagggccccgugggccuggcuauugacuucccugagagcaagcuguacuggaucuccucugggaaucacacaaucaaccgcugcaaucucgauggaagcggccuggaagucauugacgccaugcggucccagcuugggaaagcgaccgcccuggcuaucaugggagauaagcucuggugggccgaccaagugucugagaaaaugggcacauguagcaaggcugauggguccggcagcguugugcugagaaacucuaccacccucgucaugcauaugaaaguguaugacgaauccauucagcuggaccacaagggaacaaaucccugcagcgugaacaauggcgauuguucccagcuuugccugccgacgucugagaccacacgcagcuguaugugcaccgccggguacucccugcggucuggacaacaggccugugagggcguugggagcuuucuccuguauuccguccaugaaggaaucagaggcauuccucuugaccccaacgauaagagcgacgcucuggugcccgugucugggacaucccucgcggucggcaucgauuuccacgccgagaacgacaccauuuacuggguggauaugggacugagcacgaucucucgggcuaaacgcgaccagacauggagagaagauguugugaccaauggcaucgggcgggucgagggaauugccguggacuggaucgccggcaacauuuauuggaccgaucagggguuugacguuaucgaaguggcucgccucaauggauccuucagauacgucgugauuagccaaggccuggauaagccucgggccaucacaguucacccggagaaaggguaccucuuuuggaccgaguggggccaguauccccgcaucgaaagaucucggcuggacggaacagagcgcgugguccuggugaacgugagcauuuccuggccuaauggcaucucugucgacuaccaggaugggaagcucuauuggugcgacgcgagaacggauaaaauugaacggaucgaccuggagaccggagaaaacagagagguugugcuuagcuccaauaacauggauauguucagcguguccgucuuugaggacuucauuuacuggucugaucgcacacaugcuaauggcagcaucaagcggggguccaaagacaacgccaccgauucugugccccugagaacaggaaucggcguucagcucaaggacauuaagguguucaaucgcgaucggcaaaaaggcaccaacgucugugccguggcuaaugggggaugccagcagcugugccuguauagaggccgcgggcagcgggccugugcgugcgcccacggaaugcucgcugaagacggcgccagcuguagagaguacgcuggguaucuucuguacuccgaacgcacgauccugaagucuauucaucucagcgacgagcggaaccugaaugccccuguucaacccuuugaagauccugagcacaugaaaaacgugaucgcucuugccuucgacuacagagcgggaaccuccccgggcacacccaaccgcaucuuuuucagcgauauccauuuuggcaauauucagcagaucaacgacgaugggucucggagaaucaccauugucgagaaugugggauccgucgaaggccuggccuaucaccgcgggugggacacacucuacuggaccagcuauacaacgucuaccaucacaagacacaccguggaucaaacccggccuggagcuuucgagcgcgaaacaguuauuacgauguccggcgacgaucaucccagagccuuugugcuggacgagugccagaaccugauguucuggaccaauuggaacgagcagcacccuagcaucaugcgggcugcccucucuggggccaaugugcuuacacugauugaaaaggauaucagaacccccaacggacuggcuaucgaccaucgggcggagaaacucuacuuuuccgaugccacacuggacaagauugaacgcugugaguaugacggcagccacagauacgucauccuuaaguccgaaccgguucacccuuucggccuggcuguguauggggagcauaucuuuuggaccgauugggugcggcgcgccguccagagagccaauaaacacgugggaagcaacaugaagcuccugcggguugacaucccccaacagcccaugggcauuaucgcuguggccaaugauacgaacucuugcgagcugagcccuugucgcaucaauaacgggggaugccaggaccucugucuucugacacaucagggccacgucaauugcuccuguagagggggacggauucugcaagaugaccuuaccugccgcgcggugaacucuagcugcagagcccaggaugaguucgagugugcuaacggcgaaugcaucaauuuuucccugaccugugacggcgucccccauugcaaagauaagucugacgagaaaccuagcuacuguaacucccggcgcugcaagaagacauucagacaguguucuaaugggcggugcgugagcaacaugcuuugguguaauggagccgaugacugcggcgauggguccgacgaaauuccguguaacaaaaccgcuugcggaguuggcgaguuccgcugcagagacgggacauguaucggaaauagcucucggugcaaccaguuuguggauugugaggacgccuccgaugaaaugaauugcagcgcgaccgacuguucuuccuacuucagacugggcgucaagggcgugcucuuucaacccugcgagcgcacgagccuguguuaugccccuuccuggguuugcgauggggcuaacgacuguggagauuacucugacgaacgggauugccccggcgugaaaagaccucgcuguccccugaauuauuucgccugcccgagcgggcggugcauuccuauguccuggacaugugacaaggaggaugacugcgaacacggagaggacgagacccacuguaacaaauuuugcagcgaagcucaguucgagugucagaaucauagaugcaucucuaagcaguggcucugugauggcuccgacgauugcggggacggaagcgaugaagccgcucacugugagggcaagacaugcggccccucuagcuuuuccuguccugggacccaugucugcgugcccgagcgcuggcuuugcgacggagauaaagacugugccgauggcgcggacgaaucuauugccgcugggugccuguacaacagcacgugugaugaccgggaguucaugugccaaaauagacaguguaucccuaagcacuuugugugcgaucaugaccgcgacugugccgauggauccgacgaaucucccgagugcgaauauccgaccuguggcccuagcgaguuccggugcgcuaacgggagaugucuguccagccgccagugggagugcgauggagaaaacgacugccacgaucaaucugacgaggcccccaaaaauccccacuguacaucccaggaacauaagugcaacgccagcucccaguuucucuguucuagcggccggugcguugcggaggcucugcuuuguaauggccaggaugacugcggggauuccucugacgaaagaggaugucacaucaacgagugccugagccggaaacucuccggcuguagccaagauugcgaggaccugaagauuggguucaaguguagaugccgcccuggauuucggcugaaagaugacggcagaaccugcgccgacgucgaugaauguucuacaaccuucccgugcucccagcgcuguaucaauacacaugggagcuacaagugccucuguguggagggcuaugcucccagaggaggcgacccucacucuugcaaagccgugaccgaugaagaacccuuccuuauuuuugccaaccgguacuaccugcgcaagcugaaucucgacggguccaacuauacgcugcuuaaacagggacugaauaacgcugucgcccucgauuucgacuacagagaacagaugaucuauuggacagauguuaccacccaaggcagcaugauucggcgcaugcaccugaaugggucuaacguccaggugcugcauagaacaggacucuccaauccugacggccuugcggucgauugggucgggggcaaccuguacuggugugacaagggacgggauaccaucgagguuagcaaacugaauggcgccuaucgcacagugcucgucucuagcgggcugagagagccccgggcucuugugguugacgugcagaacggauaccuguauuggacggacuggggcgaucacucccucaucgggcgcauuggaauggacggcagcuccagaucugucaucguggauaccaagauuacauggccuaacgggcugacccuggacuacgugacagaacggaucuacugggccgaugcucgcgaggacuauauugaauuugccagccucgauggcuccaauagacaugucguucuuucucaggacaucccccacaucuucgcgcugacccuguuugaggauuacguguauuggacggacugggagaccaagagcauuaaccgggcccauaaaacaaccggaacaaauaagacccuccugaucuccacgcuucacagaccgauggaucugcacguguuccaugcucuccgccaaccugacguccccaaccacccuugcaaagugaauaacggcggguguucuaaucugugccugcucagccccggaggcgggcauaagugugccugcccgacaaacuuuuaccuuggauccgauggccggaccugcguuagcaauuguacagcuucucaguucgugugcaaaaacgacaaguguauuccuuuuugguggaagugcgacaccgaagaugacuguggggaucacuccgacgagccgcccgauugcccugaguucaaauguagacccggccaguuucaaugcagcaccggaaucuguacaaauccugccuucauuugcgacggcgauaacgacugucaggauaauucugacgaggcuaacugcgauauccacgucugccugccgucccaguuuaaguguacgaauaccaaccgcugcauucccgggaucuuccgguguaacggacaggacaauugcggcgauggggaagacgagagagacuguccugaggugacaugcgcccccaaccaauuccaguguagcaucaccaaacgcugcauuccucggguuugggugugugauagagacaaugauugcgucgacggaucugaugaacccgcgaacuguacacagaugaccugcggcguggacgaguuucgcugcaaggauuccggccgguguaucccugccagauggaaaugcgacggggaagaugacuguggagauggcagcgacgagccgaaggaagagugcgacgagcggacgugugaacccuaucaguuccgcugcaagaauaacagauguguuccugggcgguggcaaugcgauuacgacaaugauuguggagacaacucugaugaggaauccugcacaccccgcccuuguagcgagagcgaauuuuccugcgcuaauggcagauguauugccgggcgguggaaaugcgacggagaucaugacugcgcugauggcucugacgagaaggauuguacccccagaugcgacauggaucaguuccaguguaaaagcggccacugcaucccgcugcgcuggcggugugacgccgacgccgauugcauggacggguccgaugaggaagcguguggaaccggcgugagaacaugcccucucgacgaguuucaguguaacaauacccugugcaagccccuugcuuggaaaugugauggggaagacgauugcggagacaacucugaugagaaucccgaggaaugcgcccgcuucgucuguccucccaaccggccuuuuagaugcaagaaugaccgcgugugucuguggauuggcagacaaugcgaugggacagacaacuguggagacggcacggaugaggaagacugcgagccgcccaccgcccauacaacccacuguaaggauaaaaaggaguuccucugccggaaccagcgcugucugagcuccucucugagaugcaauauguuugacgauuguggcgacgggagcgaugaggaggacugcuccaucgauccuaaacucacaagcugcgcuaccaacgccucuaucuguggagacgaagcucggugcguccgcacggagaaggccgcguauugugccugcagauccggcuuccauaccgugcccgggcagccuggaugucaagauauuaaugaaugccuucgguuuggcacauguagccagcugugcaacaauaccaaagggggacaccuguguucuugcgcucgcaacuucaugaagacacacaauaccuguaaagccgagggcuccgaauaccagguucucuacaucgcugacgauaacgagauuagaagccuguuucccggccauccgcacuccgccuaugagcaggcguuccaaggggacgaaucugugcggaucgacgccauggauguccaugugaaggcuggaagaguguacuggacaaauuggcacaccggcacgauuagcuaucgcucccuuccucccgccgcuccucccacaaccucuaaccggcauagacgccagaucgacagagggguuacccaccugaauaucagcggacucaagaugccgagaggcauugccaucgauuggguggcugggaacgucuacuggacagacuccggacgcgaugugauugagguugcccagaugaaaggcgaaaaucggaagacgcugaucagcggcaugauugacgagccucacgcgaucguggucgauccccugagagggaccauguauuggucugacuggggaaaccaucccaaaaucgaaacagccgcuauggauggcacccuccgggagacacuggugcaggacaauauucaauggccuaccgggcuugccgucgauuaccacaacgagcgccuguauugggccgacgcuaagcucuccgugaucggaagcauuagacugaauggcacagaucccaucguugccgcggacucuaaacgggggcuuagccauccuuucuccauugacguguuugaagauuacaucuacggagucaccuauauuaacaaccgcguguucaagauccacaaguuuggccacucuccgcugguuaaucucacgggcgggcugagccaugcuuccgacgugguccuguaccaccagcauaaacagcccgaggugaccaacccuugcgauagaaagaaaugcgaauggcucugucugcuuagccccucuggaccugugugcacaugucccaauggcaagcggcuggacaacgggaccugcguuccugucccgucccccacaccucccccugaugcuccccgcccgggaaccuguaaucuccagugcuucaacggcgggagcuguuuucugaaugccagacggcaaccuaaaugcagaugucagccccgcuauacgggagacaagugcgagcuugaucaguguugggagcacugccggaacggcggcacaugcgccgccucccccucugggaugccuaccuguagaugccccacaggauucaccggcccuaaguguacgcagcaagugugcgcuggguacugugccaauaacucuaccugcacagugaaucagggaaaccagccgcaaugucgcugccugcccggcuuucucggggaccggugucaguauagacagugcuccggcuacugugaaaauuucggaaccugccagauggcggccgauggcucccgccaaugccgguguacagcuuauuuugaggggagcagaugcgaagucaacaaauguucccgcugccuggagggagccugugugguuaauaagcagucuggcgacgugaccugcaacuguacagaugggcgggucgcuccuagcugccugaccugugugggacauugcuccaacggcgggagcuguacgaugaacucuaaaaugaugcccgaaugccagugcccuccccacaugacaggcccgagaugugaggagcacguuuucucccagcaacagccuggacauaucgccagcauucucaucccccugcuucugcuccugcuucuggugcucgucgcgggcguggucuuuugguacaagcgcagagugcagggggccaaaggauuccagcaccaacggaugaccaacggcgcuaugaaugucgaaauugggaacccuaccuacaagauguaugagggaggcgaacccgacgacgucgggggccugcuggaugccgacuuugcucucgauccugacaagcccacaaauuucaccaacccgguguacgccacacuguauaugggaggccaugggucucgccacucccuugccagcacggaugagaaaagagaacugcucggacggggccccgaggacgagaucggggauccucuggcuuga

SEQ ID NO: 71616 - RNA, 1044 nt, Artificial Sequence
  derived and/or modified sequence opt5 from LRP2BP__Homo_sapiens__NP_060879
augaagcugaccagcgagaaacuccccaagaacccuuucuacgccuccgugucucaguaugcugccaaaaaucaaaaguuuuuccaguggaaaaaggaaaagacagacuacacgcacgcgaaccuggucgauaaagcccuucagcugcucaaggagagaauccugaaaggcgacacccuugcuuauuuucugcgggggcagcucuacuucgaagagggaugguaugaagaggcccuggagcaauuugaagagauuaaggaaaaagaucaucaggcuacauaccagcugggcguuauguauuacgacgggcucggaaccacacuggaugccgagaagggcguggacuacaugaagaaaauccuugauagcccgugccccaaggcucgccaccugaaauucgccgcggccuauaaucucgggagagcuuacuaugagggaaagggcgugaaacgguccaacgaagaggccgaacgccuguggcuuauugcugccgacaauggcaacccuaaggcgucugucaaagcccagagcaugcuggggcucuacuauuccaccaaggagcccaaggaacuggagaaggcuuuuuacuggcauucugaggccuguggaaauggcaaccuggaaagccaaggggcucucggacugauguaucuuuacggccaggggaucagacaggauacagaggccgcccugcagugccuccgggaagcugcggagcgcggaaauguguacgcccaaggcaaccugguugaauauuacuauaaaaugaaauucuuuaccaaguguguggcuuucuccaaaagaauugccgacuacgaugagguccacgacaucccuaugaucgcccaggugacggauugccuucccgaguuuauuggccgggggauggcuauggccagcuucuaucaugcgcgcugucugcagcucggacugggcaucaccagagacgaaacaaccgcuaagcacuacuauucuaaggccugccggcugaauccugcccucgcugacgagcugcacucccuucugauucgccaaagaaucuga

SEQ ID NO: 71617 - RNA, 13968 nt, Artificial Sequence
  derived and/or modified sequence opt5 from LRP2__Homo_sapiens__NP_004516
auggacagaggccccgccgcuguggccugcacccugcuccuggcgcuugucgcuugucuggccccugccagcgggcaggagugcgauuccgcucacuuccgguguggaucuggccauugcaucccggccgacuggcgcugugaugggacaaaggacugcagcgaugacgcugaugaaauuggaugugccguugugacgugccaacagggcuacuuuaaaugucaguccgaggggcagugcauccccaacucuugggugugugaccaagaucaggacugcgaugacggaagcgaugaaagacaggacugcucccagucuaccuguagcucccaccaaauuacaugcagcaauggccaguguaucccuucugaguaucggugcgaccauguccgcgauugucccgacggcgcggaugaaaacgacugccaguacccuaccugugagcagcucacaugcgauaauggggccuguuauaacaccucccaaaagugcgacuggaaaguggauuguagagacagcucugaugagauuaauugcacagaaaucugccugcacaacgaguucuccuguggaaauggcgaaugcaucccccgggcuuacguuugugaccaugauaacgacugccaggacgggagcgaugagcacgccuguaauuauccuaccugcggaggcuaccaguuuacguguccgucugggcgcugcauuuaucaaaacugggugugugacggagaggaugacugcaaggauaauggcgacgaagauggcugugaguccgggccccacgacguccauaaaugcagcccuagagaaugguccugccccgagucuggacgguguaucagcauuuacaaggugugcgauggcauccuugacuguccugggcgcgaagaugagaacaauaccuccacaggaaaguacugcagcaugacccuguguucugcucucaacugccaguaucagugucacgagacacccuacggcggggccugcuucuguccgccuggauauauuaucaaucauaacgacuccagaaccugcguugaauuugaugacugucagauuuggggcaucugcgaccaaaaaugcgagagccggcccggccgccaccugugucacugcgaagagggguacauccuggaaagaggacaguauuguaaggcgaacgauucuuucggcgaggccagcauuaucuuuuccaaugggcgggaccuccugauuggagauauccauggccgcucuuucagaauucuuguggagagccagaaccggggggucgcugugggcguggccuuucacuaccaucugcagagagucuucuggacggacacaguucaaaauaaaguguuuuccguggauaucaacggacucaauauccaggaaguccugaacgugagcguugagaccccugaaaaucuugcuguggacugggucaacaauaagauuuaucugguggagacaaaaguuaaccgcaucgauauggugaaucucgacggcucuuaccgggucacccugauuaccgaaaaccuggggcaccccagaggaaucgccguggaucccacagucggcuaccucuucuuuuccgacugggagagccugucuggggagccuaagcuugaacgcgccuucauggauggauccaaucggaaggaccuggugaaaacgaagcucggcuggccggcugggguuacccuggauaugauuagcaaaagaguguauugggucgacucccgcuucgacuacaucgagacagugaccuaugauggcauccagcggaagacaguugugcauggaggcucucuuauuccccacccuuuuggggucagccuguucgaaggacagguguuuuucaccgacuggacgaaaauggcggugcucaaggccaacaaauuuacagagaccaauccccaaguuuacuaucaggcuucccugagaccuuacggcgucaccguguaucacucucugcgccagcccuacgccacaaacccgugcaaggauaacaaugggggaugugagcaggugugcguccucagccaucggaccgacaacgauggccugggguucagauguaagugcacauuuggcuuccaacuugacacggaugaacgccacuguaucgccgugcagaauuuucugauuuucuccagccagguugcuauccggggaauuccuuuuacccucucuacacaagaggacgugaugguccccguguccggcaacccuagcuucuuuguugggaucgauuucgacgcccaggauucuaccauuuucuuuuccgacaugagcaaacauaugaucuucaagcagaaaaucgacggaacaggcagagaaauucuggcggcuaaucggguggagaacgucgaaucucuugccuuugauuggaucagcaagaaucuguacuggaccgacucccacuauaaaagcauuucugugaugcgccucgccgauaagacgagacggaccguugugcaguaccugaacaaucccagauccgucguggugcacccuuucgcuggguaucuguuuuucacagacugguuucgccccgccaagaucaugcgggcuuggagcgauggaucccaucuccugccggucauuaacaccacacuuggcuggccuaaugggcuggccaucgacugggcggccucuagacucuacuggguugaugcuuauuucgacaaaaucgagcacagcaccuuugauggccuggaccgcagacggcugggacauauugagcaaaugacgcaccccuucggccuugccaucuuuggggaacaucucuucuuuacagauuggcgccugggagcuauuaucagagugcggaaggccgacggcggggagaugaccgugauucgcuccggaaucgcguacauccugcaccucaaaucuuaugaugucaacauucagacaggcagcaaugccugcaaccagcccacccacccuaauggcgacuguucccauuucugcuucccggugcccaacuuucagagaguuugcggguguccuuacggaaugcggcuggcuucuaaccaccuuaccugcgaaggcgaccccacaaaugagccucccacggaacaaugugggcuguucagcuuuccuugcaagaacggacgcugugugcccaauuacuaucucugcgauggcgucgacgauugucaugacaacuccgaugagcagcugugcgggacccugaauaacacauguagcucuuccgccuucaccugcggacacggcgaguguaucccggcucauuggagaugcgacaaacggaaugauugcguggacggcagcgaugaacacaacuguccuacacacgcccccgccucuugccuugacacccaguacacgugugauaaucaucagugcauuuccaagaacuggguuugugacacagauaaugacugcggggacggaagcgaugagaagaacuguaauucuaccgaaaccugccaaccuucccaguuuaacugucccaaucaccgcugcaucgaccucagcuucgugugugauggcgacaaagauugcgucgacggguccgaugaggugggauguguucugaacugcacagcuagccaguuuaagugcgcgucuggcgacaaauguauuggggugaccaacagaugcgauggagucuucgacuguagcgauaauuccgacgaagccggcugcccgacacggccucccggcaugugucauucugacgaguuucaaugccaggaggaugggaucuguaucccuaacuucugggaaugcgacggacaccccgauugucuguauggcagcgacgagcacaaugcuugcgugcccaagacguguccuuccucuuacuuucauugcgauaacgggaauugcauucacagagccuggcucugugaccgcgauaacgacugcggagauaugagcgacgaaaaagauuguccgacccagcccuuccggugcccuuccuggcaguggcaaugucugggccauaauaucugcgugaaccuuucugucguuugugacgggauuuucgauugccccaauggaacagacgagagcccucuguguaacggcaauuccugcagcgacuuuaacggcggguguacccacgagugcgugcaggaacccuucggagccaagugccucuguccucugggcuuucugcuugcuaaugauucuaagacaugcgaggacaucgaugaaugugacauucucggguccugcagccagcauuguuauaacaugagaggaucuuuccgcugcuccugugauaccggcuacaugcuggagagcgacgggcggacgugcaaagugaccgccuccgaaucucugcuccugcuugucgcgagccagaauaagaucauugcugauuccgugacaagccaaguucacaacaucuauucucugguggagaauggauccuacaucgucgccguggacuuugauagcauuucuggcagaaucuucuggagcgacgccacccagggcaaaacaugguccgcuuuucagaacgggaccgaucgccggguuguguucgacucuagcauuauccucacagagaccauugccaucgacugggucggaagaaaccuguacuggacggauuaugcgcuggaaacaaucgagguguccaagauugacggcucucaccgcaccguccuuaucagcaaaaaucucaccaacccgcgggggcuggcucuggaucccagaaugaaugaacaucuccuguuuugguccgacuggggacaccauccucggauugagcgcgccagcauggauggcucuaugagaacagugaucguucaggacaagauuuucuggcccugugggcuuaccaucgauuacccuaaccggcugcucuauuuuauggacuccuaccuggauuauauggacuucugcgauuacaauggacaccaccgcagacaagugaucgccagcgaccugauuauccggcaucccuaugcucuuacgcuguuugaagauuccgucuacuggacagacagagccacccgccgggugaugagagcuaacaaauggcacggcggcaaucagucuguugugauguacaacauucaguggccgcucgggaucgucgccgugcauccuagcaagcagcccaauuccgugaaccccugugcguucucucgcugcagccaccugugccuccuguccagccaaggaccucauuucuauucuuguguuugccccuccggcuggagccuuucuccugaccugcucaauugucugcgggaugaccagccguuucugauuacagucagacagcacaucauuuucgggaucucccuuaaccccgaggugaagagcaaugaugccauggugccuaucgcuggaauucaaaacggccuggacgucgaguuugaugacgccgaacaguacaucuauuggguggagaaucccggggaaauucaccgcguuaaaaccgauggaacaaaccggaccguguucgcuucuaucagcauggucggcccuuccaugaaccucgcccuggacuggauuucuagaaaucucuacagcacgaacccccgcacccaguccaucgaggugcugacacuucauggcgauaucagauaucggaagacccugauugccaaugacgggacagcucucggaguuggcuuuccgaucgggauuaccguggauccugcgcgcggaaaacuguacuggagcgaccagggcacggauuccgggguccccgccaagaucgcuucugccaacauggacggcacaagcgugaaaacccuguucacaggaaaucuugaacaccuggagugcguuacccucgacauugaggaacaaaagcuguauugggccgugaccggcagaggggucaucgagcggggaaacguggauggcacagaccgcaugauccucgugcaucagcugucccacccuugggggauugcuguccacgauucuuuucuuuacuacacggacgaacaguaugagguuaucgagagaguggauaaggccaccggagcgaauaaaauugugcugcgggacaacguccccaaucugagaggccuccagguguaccaucgccggaacgcugccgaaagcuccaauggguguucuaacaauaugaacgccugccaacagaucugucugccuguucccggcggacuuuucagcugcgcuugugccacaggcuuuaagcugaauccggauaacagauccugcagcccuuauaacucuuucauuguggucuccaugcucagcgcgauccgcggguuuucucuggagcucuccgaccacagcgaaaccauggugcccguugcuggacagggccggaaugcccugcauguggaugucgacgugucuuccggguucauuuacuggugugauuuuagcuccagcgucgccucugacaacgcuaucagacggaucaaacccgacggaagcucccuuaugaauauugugacacacggcaucggggagaacggcguucgcggaauugccguggauuggguggcuggcaaucuguauuucaccaacgccuucgucucugaaacgcugaucgagguucucagaauuaauacaaccuaccggcgcgugcugcuuaaggugaccgucgacaugccuagacauaucgugguugauccgaaaaaccgguaucuguuuugggcggacuacgggcagcgccccaagaucgagagaagcuuccucgauugcacaaaucggaccgugcuggucuccgaaggaauugugacaccucgcggccucgccgucgacagaucugauggguacguguauuggguugacgauagccuggacaucauugcucggaucagaauuaacggagagaauuccgaagugauccgcuacggcucucgguaucccacgccuuacggcaucaccgucuuugagaacagcauuaucuggguggauagaaaucuuaagaaaauuuuccaagccuccaaggaacccgagaacacagagccuccgaccguuauccgcgacaauauuaacuggcugcgggaugugacaaucuuugacaaacagguccagcccagaagcccugcugaagugaacaauaaccccugccuggagaauaacgggggauguucucaccucugcuucgcccugccuggccuucacacccccaagugugacugcgccuuugggacgcugcaauccgauggaaaaaauugugcuauuagcaccgaaaacuuccucaucuuugcgcugucuaauucccuccgcagccugcaucuugacccggagaaccacuccccucccuuccagacaaucaauguggaacggaccguuaugucucuggauuaugacagcgucuccgauagaauuuacuuuacacagaaccuggccagcggcguggggcagaucucuuaugcuacccucuccagcggaauucauacacccacggugaucgccucuggcauuggcaccgccgacgggaucgcuuucgauuggaucacacgccggauuuacuacagcgacuaucugaaucaaaugaucaacuccauggccgaggauggaucuaauagaaccgucauugcgcgcguuccuaagccccgggcuaucgugcuugacccuugccagggcuaccuguauugggccgauugggacacccacgccaagauugagagagcuacacucgggggaaacuuucgcgugccgaucgucaauagcucccuggugaugcccucuggccugacgcucgauuacgaagaggaccuucuguauuggguugacgccagccugcagagaaucgaacgguccacccucacagggguggaucgcgaggucauugugaacgcggccguucaugcuuucggacugacccuuuacggccaguauaucuacuggacagaccuguacacccaaagaauuuaucgggccaacaaauacgauggcagcgggcagaucgcuaugacgacaaaucuccugucucagccuagaggaauuaacaccguggucaagaaucagaaacaacaguguaacaaucccugcgagcaguucaacggcggguguucccacaucugcgccccuggacccaauggcgcugaaugucagugcccgcacgaggggaacugguaucuggccaauaaccggaagcauugcauuguggacaauggagaacgcuguggcgcgagcuccuuuaccugcucuaacggcagauguaucagcgaggaauggaaaugcgauaaugacaacgauuguggggacggauccgaugagauggagucugugugcgcccuccacacauguagcccuaccgcuuucacaugcgccaauggccgguguguccaauacuccuaucgcugcgacuacuauaacgauuguggggacggaagcgacgaagcuggcugccuuuuuagagauugcaacgccaccacggaguucauguguaauaaccggcgcugcauccccagagaauuuauuuguaaugggguugacaacugccaugauaauaacacaucugacgagaagaauuguccugaucggaccugccaguccggauacacaaaaugucacaacagcaauaucugcauuccccgcguguaccugugugacggcgauaacgacugcggcgauaauucugacgaaaacccuaccuauuguacgacccacacaugcuccagcucugaguuccagugcgccuccgggagauguaucccccaacauugguacugcgaucaggagaccgacuguuuugaugcuagcgacgaaccggcgucuugcggacacagcgagcggacaugucuggccgacgaauucaagugcgauggcgggcgcuguauuccuuccgaguggaucugcgacggagauaaugacuguggcgauaugagcgacgaagauaagagacaucagugccagaaccaaaauuguuccgacucugaguuucucugcgugaacgaucggccccccgaccgcagaugcaucccucagagcugggucugugauggggacguggauugcaccgacggauaugacgagaaccagaauuguacacggagaaccugcuccgaaaacgaguucacguguggcuacggccugugcauuccgaaaaucuuucgcugugaucggcacaaugacugcggggauuauucugacgaaagaggaugucuuuaccagacaugccaacagaaccaguucaccugucagaauggccgcugcauuagcaagaccuuuguuugcgaugaggacaacgauuguggggacggauccgaugagcugaugcaucucugccacacacccgaaccuaccugucccccucacgaguucaaaugcgacaauggccgguguaucgaaaugaugaagcugugcaaccaucuggaugacugucucgacaauucugaugagaaagggugcggaauuaacgaaugucacgaccccagcaucuccggcugcgaucauaauuguacagacacgcuuaccagcuucuauugcucuugcagaccuggcuacaagcugauguccgauaagcgcacauguguggacaucgaugagugcaccgagaugcccuuugucuguagccaaaaaugcgaaaacgugauugggucuuacaucuguaagugcgcuccgggauaucugcgggagccugacggcaaaacauguagacagaauuccaacauugaacccuaccucaucuucagcaaucgcuauuaccugcggaaccuuaccauugauggguauuuuuacucucugauccucgagggacuggacaacguuguggcccuggauuucgacagagucgaaaagcgccucuauuggaucgauacgcagcggcaagugauugagagaauguuucuuaauaaaaccaacaaggagacaaucauuaaucaccggcugccugccgcugaaucccuggccguugacugggugagcagaaagcucuacuggcuggacgcgcgccuugauggccuguucgucucugaccucaacgggggccaccggagaaugcuggcccagcauugcguggaugcuaauaacaccuuuuguuucgacaauccccgcggacuggcccuccacccgcaguacggcuaucuuuacugggcugauugggggcauagagccuauaucggacgggucggcauggacgggacaaacaaauccgugauuaucagcaccaagcuggaguggccuaauggaauuacgaucgauuacacaaacgaccugcucuauugggcggaugcccaccugggcuacaucgaauauagcgaccuugaggggcaucaccgccacaccguuuacgauggcgcucugccccaucccuuugccauuacaaucuucgaagacaccauuuacuggaccgauuggaauacaagaacgguggagaaaggaaacaaguaugacggcuccaaucggcagacccucgucaacacaacccaccgcccuuuugacauccauguguaccaccccuauagacaaccuauugugucuaauccgugcgggacaaacaauggaggcuguagccaucugugccugaucaaacccgggggaaagggcuucaccugcgaguguccugaugacuuucggacgcuccagcuuuccgggucuacauacugcaugcccauguguagcuccacccaguuccugugcgcuaacaacgaaaaguguaucccuauuugguggaaaugcgauggccagaaggacuguucugauggaagcgacgagcuggcccucugcccccaacgcuucuguagacugggccaguuucagugcuccgaugggaauuguaccagcccucagacacuuugcaacgcucaccaaaauuguccggacggaucugaugaagaccggcugcucugcgagaaccaccauugcgauuccaaugaguggcagugugccaacaaacgcugcauccccgaaagcuggcagugugacaccuucaaugacugcgaggauaacucugacgaagauuccagccacugugcguccagaacaugccggccuggccaauuucgcugugccaaugggagaugcauuccccaggcuuggaagugugacguugauaacgacugcggagaucauucugacgagccuaucgaagaguguaugagcuccgcccaccugugcgauaauuucacggaguuuucuugcaaaaccaacuaucgguguauucccaagugggcugugugcaauggcgucgacgauuguagagacaacagcgaugaacaggggugcgaggaacgcacaugucacccggugggcgacuuccggugcaagaaucaucacuguaucccucugagauggcagugcgacggacaaaacgauuguggcgacaacuccgaugaggaaaauugcgccccccgcgaguguaccgagagcgaauuucggugcguuaaccagcagugcauccccucuagauggauuugugaccauuacaaugauugcggggacaacuccgaugagcgcgacugugaaaugcggacaugccacccugaguacuuccaguguaccagcggacauugcgugcacucugaacucaaaugugauggcagcgccgacugccuugaugcguccgacgaggcugacugucccacgagauuuccugauggggccuauugccaagcuaccauguucgaguguaagaaucacgucugcaucccgcccuacuggaaaugcgacggagaugacgauuguggcgacggcucugaugaagagcugcaucugugccucgacgugccuuguaacagccccaaucgcuuucggugcgauaacaauagauguauuuauucccacgaagucugcaacgggguggacgauuguggagacggcacagaugagaccgaggaacauugccggaagccuacacccaaaccguguaccgaguacgaauauaagugcgggaauggacacuguaucccucacgacaacguuugcgacgaugccgacgauugcggcgacuggagcgaugagcugggguguaauaaaggaaaggaacgcacaugcgccgagaacauuugugagcagaauugcacccagcuuaacgaaggcggcuucaucuguucuugcacggcuggguuugagacaaacguguucgacagaaccuccugucuggauauuaaugaaugcgagcaguucggaaccuguccccaacauugccggaacacaaagggcagcuacgaaugugucugcgccgacggguuuacguccaugucugaucgcccuggaaaaagaugcgcggccgagggcagcuccccccuccugcugcucccggacaaugugcggaucagaaaguauaaccuuucuagcgagcgcuucuccgaauaccugcaggaugaggaauacauccaggcuguugacuaugauugggacccuaaagacauugggcugucuguggucuacuauaccgugcggggagagggcagcagauuuggcgccaucaagcgcgcuuacauucccaauuucgaauccgggcggaacaaucucgugcaggagguugaucugaaacuuaaguaugucaugcaacccgacggaaucgccguggauugggugggcagacacauuuacuggagcgacgucaagaacaaacgcaucgagguggcgaagcuggaugggagauaucggaaauggcucaucucuacagaccuggaucagccugccgcuauugccguuaaucccaagcugggacucauguuuuggaccgacuggggcaaagaaccuaagaucgaguccgcuuggaugaacggggaagaucgcaauauucuuguguucgaggaccugggauggccgacaggccugagcaucgauuaccucaacaaugacagaauuuacuggucugacuuuaaggaggaugucaucgaaaccaucaaauaugacggcacagaucggcgcgugauugccaaggaggcuaugaaccccuacucccuggacaucuucgaagaucagcuuuauuggauuagcaaagagaagggggaaguuuggaaacaaaauaaguuuggacagggcaagaaagagaagacccugguggucaacccuuggcucacgcaggugagaaucuuccaucagcugcgguacaacaaaucuguucccaaucuguguaagcaaauuugcagccaccucugucugcuucgcccugggggauauuccugcgccuguccccagggcagcuccuuuaucgaggggucuaccacagaaugcgacgcggccauugagcugccuaucaaccucccgcccccuuguagaugcaugcauggaggcaauuguuacuucgaugaaaccgaccugcccaaaugcaaguguccuagcggcuauacagggaaauacugcgagauggcuuucuccaagggaaucucucccggcaccacggccguggcuguccuucugacaauucuccugaucguggugauuggggcccuggccaucgcgggauuuuuccacuaccggagaaccggcagccuccugccggcucuuccuaagcugcccucccucucuagccuggucaaacccuccgaaaacgggaauggaguuacauuucgcagcggcgccgaucuuaacauggacauuggcgugucuggguucggaccugagaccgccaucgaucgguccauggcuaugagcgaggacuuugugauggaaaugggcaagcagcccaucauuuucgagaauccuauguauucugccagagauuccgcugucaaagugguucagccgauccaagugacggucagcgaaaacguggacaauaagaacuacgggucucccauuaauccuuccgagaucguucccgaaaccaacccuacaagccccgccgcggacggaacccaggugacaaaauggaaucuguuuaagcgcaagucuaaacagaccacaaacuucgagaauccgauuuaugcccagauggagaacgaacaaaaggaguccgucgcugccaccccucccccuagccccucccucccugcuaaacccaagccgcccagccggagagauccuacgcccacauacucugccaccgaagacaccuuuaaagauacagcgaaccuggugaaggaggacagcgaggucuga

SEQ ID NO: 71618 - RNA, 5718 nt, Artificial Sequence
  derived and/or modified sequence opt5 from LRP4__Homo_sapiens__NP_002325
augagacggcaguggggcgcccugcuccugggggcucuucugugcgcccacggacucgcgagcucccccgagugugcuugcggccgcucucauuucaccugugccgugagcgcccugggggaaugcacauguaucccugcucaauggcagugcgacggagauaacgacuguggcgaucacuccgacgaggaugggugcauucuuccgacguguucuccccuggacuuucauugcgauaauggaaaguguaucagacggagcugggucugcgacggcgauaacgacugcgaagaugacuccgaugagcaggacuguccuccccgcgaaugcgaggaggacgaauucccuugucagaauggcuacugcauuagaucucucuggcacugugauggggacaacgauugcggagacaauagcgaugagcaaugugacaugcggaaaugcuccgauaaggaauuucgcuguagcgacggcucuugcaucgccgagcauugguauugugauggggacaccgauugcaaagacggauccgacgaggaaaacugccccagcgcuguuccugccccgcccuguaaucuggaggaauuccagugcgcguacggcagauguauucuggauaucuaucacugcgacggggaugacgauuguggagacuggucugaugaguccgacugcagcucucaccagccuugucgguccggcgaauuuaugugcgauagcggccucuguaucaacgccggguggcgcugcgacggagaugcugacugugaugaccaguccgacgagagaaauugcacaaccucuaugugcacagccgagcaauuccggugucauagcggccgcugcgugagacuguccuggcggugugauggggaagacgauugcgcugacaacagcgaugaggaaaauugugagaacaccggaucuccccagugcgcccuugaccaguuucuguguuggaauggccgcugcauugggcagagaaagcucuguaacggagugaaugauugcggcgacaacuccgaugaaagcccucaacagaacugucggcccagaacaggcgaggagaauugcaacgucaauaacgggggaugcgcgcagaaaugucaaauggugcgcggcgccguucagugcaccugucacacgggguaccggcugaccgaagacggacauacaugccaggaugugaaugagugugcugaagagggcuauugcucucagggguguaccaacagcgaaggcgccuuccaaugcuggugugagacaggauacgagcuuagaccggaccgccgguccugcaaggcucugggcccugaacccguccuccuguuugccaauagaaucgauauucgccaggugcugccucaccggucugaguauacccuccugcuuaacaaucuggaaaacgccaucgcucucgacuuccaccauagacgcgagcugguuuuuuggagcgacgugacgcuugaucggauucugagagcgaaucucaacggguccaaugucgaggaaguggugagcacaggacuggagucucccggcgggcuggccgucgacuggguucacgauaagcucuacuggaccgacuccggaacaagccgcaucgaaguggcuaaccuggauggcgcccaucggaaagugcuucuguggcagaaucucgagaagcccagagccauugcucugcacccuauggaagggaccaucuacuggaccgacuggggcaacacaccgcggaucgaggccucuuccauggauggaagcggccgcagaauuaucgcggacacgcaucuuuucuggcccaacgggcugaccauugauuaugcuggacggagaauguacugggucgacgccaaacaccacgugaucgagcgcgccaaucucgauggcucccaucggaaggcuguuauuucucaggggcugccucaccccuuugccaucacaguguucgaagacagccuguauuggaccgacuggcauacaaaauccaucaacucugcuaauaaguucaccggaaagaaccaagagauuaucagaaauaaacuccacuuuccuauggauauucacacgcugcauccccagcgccagccggccggcaagaacagauguggggacaauaacggcggaugcacacaccuuugccugccuagcggccagaauuacaccugugcgugccccaccggguuccggaaaaucuccagccaugccugugcucaaucucucgauaaguuucugcuguucgcccgcagaauggacauucggcgcaucuccuuugauacagaagaccuuagcgaugacgucaucccucucgcugaugugagaucugccguugcgcuggacugggauucccgggacgaucacguguauuggaccgacgucagcacagacacgauuucucgcgccaaaugggauggaaccggccaggagguggucguggacacaagccuggaaucccccgcugggcucgccaucgauuggguuaccaacaagcuguacuggacagacgcuggaaccgauagaauugagguggccaauacggacggcagcaugcggaccguccuuaucugggagaaccuggaucgcccuagagacauugugguugaacccauggggggcuauauguacuggacagauuggggagccucuccgaaaaucgagcgggcuggcauggacgcguccgggagacaggugauuaucagcuccaaucucaccuggccuaacggacuggccaucgauuacggcucucagcgccuguauugggcugacgccgggaugaagacaauugaauucgccggacuugauggcagcaagcggaaaguccucaucggcucccaacugccccaucccuuugggcugacccucuacggagagagaauuuauuggacggacuggcagacaaagucuauccagagcgcugaccgccugaccggccuugaucgggaaacacugcaagagaaucucgagaaccugauggacauucacguguuccacagacgccggccuccgguguccacccccugcgccauggaaaacgggggauguucucaucugugccuuagaagcccuaaucccuccggcuuuagcuguaccugcccuacagggaucaaccuccugucugauggaaaaacguguucccccggcaugaauagcuuccugaucuuugcgcgccggauugacaucagaaugguuucucucgauauuccuuacuucgcugacgucguggugcccaucaacauuaccaugaagaauacaaucgccaucggcgucgauccgcaggaggggaaaguguauugguccgacagcacccugcaccggauuucucgcgccaaccuugauggaucccagcaugaagacaucauuacaaccggccugcagacgacagaugggcucgcuguugacgccaucggaagaaagguguacuggaccgacaccggcacaaaucggauugaggucgggaaccuggauggaagcaugcgcaaggugcugguuuggcaaaaucuugacuccccuagagcgaucgugcucuaucacgagaugggcuuuauguacuggaccgauuggggcgaaaacgcuaaacuggagcggagcgggauggacggaucugauagagccguccugaucaauaacaaucucggcuggcccaacgggcugacaguggacaaggccagcucccagcuucugugggcugaugcccauacggaacgcauugaggcugccgaccucaauggagcgaaccggcacacccugguuucuccugugcagcaccccuacggccugacacuucuggauagcuauaucuacuggaccgacuggcagacaagauccauucaucgcgccgauaaagggaccggaucuaacgucauccucgugcggagcaaucugccgggccucauggacaugcaagcuguggauagagcccagccucugggcuucaacaagugcgggucccgcaauggaggcuguucucaccuuugccugccccggccuagcggguucuccugcgcuugucccacgggaauucagcucaaaggcgacgggaagaccugcgaccccagcccugaaacauaucugcuguuuucuuccagaggaagcauccgcagaauuucucuugauaccuccgaccauacagauguccacguuccggugcccgagcugaacaaugugaucagccucgacuacgauuccgucgacggcaagguguauuacaccgauguuuuccuggacgugauccggcgcgccgaucucaacggcucuaauauggagacagucauugggagaggacugaaaaccacggacggccuugccguggauuggguugcucggaaccuguauuggacagacaccgggcgcaauaccaucgaagcgagcagacucgacggauccugucggaaggugcugauuaacaauagccuggaugagccuagagccaucgcugucuuuccccgcaaaggcuaccuuuucuggacagacugggggcacauugccaagaucgaacgggccaaccuggauggaucugagagaaaagugcucaucaauaccgaccugggcuggccuaacggccucacgcuggauuacgacacacgccggauuuauuggguugaugcucaucuugacagaaucgaauccgccgaucugaaugggaagcugcggcaggugcucgucagccacgugucucaucccuuugcgcugacccaacaggaccgcuggauuuacuggacagauuggcagaccaagagcauccaaagaguggacaaauauuccggacggaacaaggagacaguccuugcuaauguugagggccugauggauauuaucguggugucuccucagcgccagaccgggacgaacgccugcggagucaacaauggcggguguacccaccucugcuucgccagagcuagcgacuuugugugugccugcccggacgaacccgauucccggccuuguucucugguucccggacucgugccucccgcgccgcgcgcuacaggcaugagcgagaaauccccuguccugcccaacacccccccuacaacccuuuacagcucuacgacaagaacccggacaucccuggaagagguggaaggccgcugcagcgagagagacgcccggcuggggcucugugccagauccaaugaugcuguucccgccgcuccuggagagggccugcauaucucuuaugccauugggggacuucugagcauccuccugauucucguggucaucgcggcccugaugcuuuaccgccacaagaaauccaaguucaccgacccgggcauggggaaccugaccuauucuaaucccagcuaccggacauccacgcaggaagugaaaauugaggcuaucccuaagcccgccauguacaaccaacugugcuauaagaaagaaggcggaccugaucacaauuacaccaaggagaaaauuaagaucgucgagggcaucugucuccugagcggggacgaugcugaaugggacgaucuuaaacagcugagaucuucccgcggaggccuccugcgggaccaugugugcaugaagacagauaccguuagcauucaggccucuuccgggagccucgacgauacagagaccgaacagcugcuucaagaggaacagucugagugcagcuccgugcacacggccgcuacacccgagagacgcggaucucugccggacaccggcuggaagcaugaacggaaacugagcuccgagagccaggucuga

SEQ ID NO: 71619 - RNA, 4848 nt, Artificial Sequence
  derived and/or modified sequence opt5 from LRP5__Homo_sapiens__NP_002326
auggaggccgcucccccuggcccgcccuggccucugcuccugcuucugcuccugcuucuggcccucugcgggugucccgcgccugcugccgccagcccccugcuucucuucgcuaacagacgggacgugcgccuggucgaugccggaggcguuaagcuggaauccaccaucguggugucugggcuggaggacgcugccgcggucgauuuucaguucagcaaaggagccguguacuggacagacguuuccgaagaggcuauuaagcaaacguaucucaaucagaccggcgccgcugugcagaacgucgugaucucugggcugguuagcccugauggacuugccugcgacugggugggcaaaaagcuguacuggacagauuccgaaaccaauagaauugaggucgcgaaccucaauggcacaucucggaaagugcuguuuuggcaggaccuggaucaaccgcgcgccaucgcucucgaccccgcccacggguauauguacuggaccgauuggggagagacaccuagaauugaacgggcuggcauggacgggagcacccgcaagaucaucguggauuccgacauuuauuggcccaacggacugacgaucgaccuugaggaacagaagcuguacugggccgaugccaaacucagcuucauucauagagcuaaucuggacggcucuuuucggcagaaggucguugaggggucccuuacccacccuuucgcgcugacacucagcggagauacccuguauuggacagacuggcagacccgcucuauccaugccuguaacaaaagaacgggcggcaagcggaaagagauucuguccgcucucuacagccccauggauauccaagugcugucucaggaacgccagccguuuuuccacacaagaugcgaggaagacaaugggggauguucccaucuuugccugcucagcccuuccgagcccuuuuacaccugugccugcccuacaggcgugcagcugcaagauaacgggcggaccuguaaggccggagcugaagagguccuucugcucgcccgcagaaccgaccugcggagaauuucucuggauacacccgacuucacggauaucgugcuccagguugacgacauccgccacgcgauugcuaucgauuaugacccccuggagggcuacguguauuggaccgaugacgaaguccgggccauuagacgcgccuaccuugaugggagcggagcucagacacuggugaauaccgagaucaacgacccugauggcauugccguugacuggguggcucggaaucucuauuggacagauaccggcacggacagaaucgaagucacacgccugaacgggaccucccggaagauccuggugagcgaggaucuugacgaaccgagagccauugcgcuccaccccgucaugggacugauguacuggaccgauuggggcgagaauccuaaaaucgagugcgccaaccuggacgggcaagaacgccgggugcucguuaacgcuucucugggauggcccaauggccuugcccuggaccuccaggaggggaagcuguauuggggcgaugcuaaaacagacaagauugaagugaucaacgucgauggaaccaaaagacgcacacugcuugaggacaagcucccucauauuuuuggcuucacgcugcugggggauuuuaucuacuggaccgacuggcagcggagauccaucgaacgggugcacaaaguuaaggccagccgcgaugugauuaucgaccagcuccccgaucugaugggacuuaaggcggucaauguggccaaagugguuggcacaaacccgugugcugacagaaaugggggaugcucucaucugugcuucuucaccccucacgccacacgguguggcugccccauugggcucgagcugcugagcgauaugaagaccuguaucgucccugaggcuuuucuuguguucacguccagagccgccauucaccgcaucucucucgaaaccaacaauaacgacguggcuauuccccugacaggcgucaaagaggcgagcgcccuggauuuugacguguccaauaaccauaucuacuggaccgacguuagccucaagacaaucucucgggcuuucaugaauggauccagcguggaacacgucguggaguuuggccuggauuauccugaggggauggccguugacuggauggggaaaaaccuuuacugggccgauaccggcacgaauagaauugaaguggcucgccuggacgggcaauucagacagguccucguguggcgggaucuggacaacccccgcucucuggcccuugauccgacaaagggauauaucuacuggaccgaguggggcgggaagccuagaauuguucgggcguuuauggacggcacaaauugcaugacccucguggauaaagucggacgcgcuaacgaccugaccaucgauuaugccgaccagagacuguacuggacagaccucgauacgaacaugauugaauccagcaauaugcugggccaggagcggguggugaucgccgacgaucuuccccaucccuucgggcugacccaauauuccgacuacaucuacuggacagauuggaaccuccacucuauugaacgcgcugacaagaccagcggaagaaaucggacacugauccagggccaucuggauuuugucauggacauucuuguuuuccacuccucucgccaggaugggcugaacgacuguaugcacaauaacggacagugcggccaacucugucuggccaucccugggggccauagaugcggaugugcgagccacuauacccucgauccguccagccggaauugcucucccccuacgacauuucugcuuuucucccagaaaagcgcuauuucuagaaugauccccgacgaucagcauuccccugaccugauccucccccugcacggccugcgcaacgugaaggccauugacuacgauccucuugacaaauuuaucuauuggguggaugggcggcagaauauuaagagagccaaggacgauggaacccaacccuucguccugaccagccucucucagggccagaacccggaccgccaaccucacgaucugagcaucgacauuuacucccggacacucuucuggaccugugaggcuacaaauacgaucaacgugcauagacugagcggggaggccaugggaguugugcuucgcggcgaucgggacaaacccagagcuaucgucgugaaugccgaacgcggcuaucuguacuuuaccaacaugcaggaucgggcggccaagauugagagagcugcccucgacgggacagaacgggagguucuguucaccacaggacugauccgcccuguggcucuugucguggauaauacccugggcaaacucuuuuggguugacgccgaccugaagagaauugaaucuugcgaucucuccggggccaaccggcugacgcuugaggacgcuaacaucgugcagccccugggacugaccauucucggcaaacaccuguauuggaucgaucgccagcaacagaugauugagagagucgaaaagacaaccggggacaagcggacaagaauccagggacgcguggcgcaucuuaccggcauccacgccguggaggaagucagccuggaggaguucuccgcucauccgugcgcccgggauaauggcggguguucucacauuugcaucgccaaaggagacggcacaccuagauguagcugccccguucaccucgugcugcuccagaaccugcuuaccuguggggaaccucccacgugcucccccgaucaauuugcuugugccacaggagagauugacugcaucccuggcgcguggcgcugugauggguucccggaaugcgacgaucagucugacgaggaaggaugucccgugugcagcgcugcccaguuuccuugcgcccggggccagugugucgaccugagacugcgcugcgauggcgaggcugacugucaagaucgguccgacgaggccgauugcgacgcgauuugucuccccaaucaguucagaugcgcuucugggcagugugugcugaucaagcaacagugcgauagcuuuccugacuguaucgauggauccgacgaacuuaugugcgagauuaccaaacccccuagcgaugacucuccggcccauuccagcgccaucggccccguuauugggaucauucugucucucuucgugaugggaggcgucuacuuugugugucagcgcguugugugccagagauacgcuggggccaacggaccuuucccccacgaauaugucuccggcaccccucaugugccccugaauuuuaucgcuccgggcgggagccaacacggaccuuucacaggcaucgccugcgggaagucuaugauguccagcgucucccucaugggaggccggggaggagugccccuguacgaucgcaaccauguuaccggcgcgagcucuagcuccucuagcuccacgaaagccacacuuuaucccccuauucugaaucccccuccgucucccgcuaccgacccuagccuguacaacauggacauguucuauuccucuaauauccccgccacagcuagaccuuaccggcccuauauuauccgcggcauggccccgccuaccacacccuguagcaccgaugugugcgacuccgauuacagcgccucuagauggaaggcuuccaaauacuaucucgaccugaacagcgauucugacccuuaucccccucccccgacgccucacucccaguaccuuagcgcggaggauuccuguccucccucucccgccaccgaacggagcuacuuucaccuguucccgcccccucccuccccuugcacagacagcucuuga

SEQ ID NO: 71620 - RNA, 4842 nt, Artificial Sequence
  derived and/or modified sequence opt5 from LRP6__Homo_sapiens__NP_002327
augggcgccguccugagaagccuccuggcuugcuccuucugcguccuucugcgggccgcgccccuccugcuuuacgcuaaccgcagagaccugcggcucguugaugccaccaaugggaaggagaacgccacaaucguggugggaggccuggaagacgcugccgcugucgauuuuguguucucucacgggcugauuuauuggagcgacguuuccgaggaagccaucaaacgcacggaguuuaauaagaccgaaucugugcagaacgucgugguuagcggacuccuguccccugauggccuugcgugcgacuggcugggggagaaacucuacuggacagauucugagaccaauagaauugaagugagcaaccuggacggaucccuucggaagguccuguucuggcaagagcucgaucagccgcgcgccaucgcucuggaccccagcucuggcuuuauguauuggacagauuggggcgaagugccuaaaauugagagagccgggauggacggauccagccgguucaucaucauuaauucugagaucuacuggcccaacggccugacccucgauuaugaggaacagaagcuguacugggcugacgccaaacuuaauuuuauucauaaauccaaccuggacgggacaaaucgccaggcgguggucaagggaagccucccucaccccuucgcccugacccuuuuugaagauauccuguauuggacggacuggucuacccauuccauucucgcuuguaacaaauacacaggcgaggggcugagagaaauccacagcgauauuuucuccccuauggacauccaugccuuuucucaacagcggcagccgaaugcuaccaaccccugcggaaucgauaauggcggcuguagccaccugugccucauguccccuguuaagcccuucuaccagugugccugcccuacaggggugaaacugcuugagaacggaaagaccuguaaggacggcgccacggagcugcuccugcuugcucgcagaacagaucugcggcgcauuagccucgacacccccgauuuuacagacaucgugcugcaacuggaagauauuagacacgcgaucgccauugacuaugacccggucgagggguacaucuauuggaccgaugacgaagugcgggcuaucagacgcucuuucauugauggauccggcagccaguucguugugaccgcccagaucgcccauccugacgggauugcugucgauuggguggcccggaaccucuacuggacagacacgggaaccgauagaaucgagguuacacgccugaauggcaccaugcggaaaauucuuaucucugaagaccuggaggagcccagagcgaucgugcucgauccuauggucggcuauauguacuggacagacuggggagaaauucccaagaucgagcgcgcugcccuggaugggagcgaccgggugguccuggugaacaccucccuuggcuggcccaaugggcucgcccuggauuaugacgaaggaaaaauuuacuggggcgacgcuaagacggauaaaaucgagguuaugaacacagacgggaccggcagacgcgugcuggucgaagauaagauuccucacaucuuuggauucacccuccugggcgacuacguguauuggacagauuggcagcggagaucuauugagcgcguucauaaacggagcgccgagagagaagugaucaucgaccaacuuccggaucugauggggcucaaggcuaccaauguccaccgggugauuggauccaaccccugcgccgaggaaaauggcggguguagccaccugugccuguaccgcccucagggacuuagaugcgcgugucccaucggcuuugagcucauuucugacaugaagacaugcaucgugccugaggccuuccugcuguuuucccggagagcugauauucgccggaucagccucgaaacgaacaauaacaauguugccaucccccugaccggggucaaagaggcuucugcccuugacuucgaugugacagacaacagaauuuauuggaccgauaucucccugaagacaauuagccgcgcguuuaugaauggcuccgcccucgaacauguggucgaguucggacuggacuacccggaaggcauggcuguggacuggcuggggaaaaaccuuuauugggccgauaccggaacgaauagaaucgagguuucuaagcucgacggccagcaccggcaagugcuggucuggaaagaucuggacagcccucgcgcucucgcccuggaucccgccgagggguuuauguacuggaccgaauggggaggcaagccuaagauugacagagcugcgauggauggguccgagcggacaacccuugugcccaacguuggccgcgccaacggacugacaaucgacuaugcuaaaagacggcucuacuggaccgaucuggacacgaaucugaucgaaucuagcaacaugcuuggccucaaucgcgaggugauugccgaugaccugccucaucccuucgggcugacacaguaccaggacuauaucuacuggaccgauugguccagacggagcauugaacgcgccaacaagacaucuggacagaauagaaccaucauucaaggccaccucgacuaugucauggauauccugguguuucauuccagccggcagucuggguggaacgagugugcuuccagcaauggacacugcucucaccuuugucuggccguuccggugggcggguucgucugcggcuguccugcgcauuacagccucaacgcugacaauagaaccugcuccgcccccacaacguuucugcuguucagccagaaaucugccaucaaccgcauggugauugaugagcagcaaucccccgacaucauucuuccuauccacagccugcggaaugugagagcuauugauuaugacccgcucgauaagcagcuguacuggaucgacucccgccagaacaugauucggaaagcccaggaagauggaucucaaggcuucaccgucguugugagcuccgugcccucucagaaucucgagauccagccuuaugaccugagcaucgauauuuacuccagauacaucuauuggacaugugaagcgaccaacgucauuaaugugacacgccuugacgggcggucuguuggagugguccugaagggcgagcaggacagaccccgcgcugugguugugaacccugaaaagggguacauguauuuuaccaaccuccaagagcggagccccaaaaucgagagagccgcccuggauggaacggaacgggagguccuguucuuuuccggccuuagcaagccuauugcucuggcccucgacucucgccugggcaaacucuucugggcugauuccgaccugagacggaucgaaagcucugaucuuuccggggccaaucgcaucgugcuggaggacagcaacauucuccagcccguuggacugacaguguuugagaauuggcuguacuggaucgauaagcagcaacagaugauugaaaagaucgacaugaccggcagagaggggcggaccaagguccaggcgagaauugcccagcuuucugauauccaugcugugaaggaacugaaccuccaagaguaucgccagcacccgugcgcccaggacaauggaggcuguucccacaucugccuggugaaaggggauggaacaacccggugcagcuguccuaugcaucucguccugcuucaggacgaacuguccugcggcgagcccccuacauguagcccccaacaguucacgugcuuuaccggcgagauugauuguaucccgguugcuuggagaugcgacggguucacagaaugugaggaccacucugaugaacugaacugcccuguguguagcgagucccaguuucagugcgccucuggacaauguauugacggcgcccuccgcugcaauggggaugcuaacugccaggacaagagcgaugagaaaaauugugaagugcugugccuuaucgaccaguuccggugugcgaacggacaaugcauuggcaagcauaaaaagugugaucacaaugucgacugcuccgauaaaucugacgagcuggauuguuaccccaccgaggaaccugcuccccaggccacaaacaccguggggagcguuaucggagugauugucacgaucuuuguguccggcaccguuuauuucaucugccagagaaugcucuguccccgcaugaagggcgacggggaaacaaugaccaaugacuacgugguccauggaccugccucugugccgcugggcuacgucccccacccuagcucccucagcgggucucugcccggaaugucccggggcaagagcaugauuucuucccuuagcaucaugggaggguccucuggcccucccuaugauagagcccacgugacaggcgcuagcuccucuagcuccagcucuaccaaagggacauacuuuccugccauucugaacccgcccccuagccccgcgaccgagcgcucccauuauacgauggaguucggauacucuagcaauuccccuucuacacacagaagcuauuccuaccggcccuauagcuaccgccauuucgcuccgccuaccacccccugcucuacagacguuugugauuccgacuacgcccccagcagacggaugaccuccguggccacggcuaagggcuauacaucugaucugaacuacgacagcgaaccugugcccccuccgcccaccccucgcucccaguaucucucugccgaggaaaacuacgagagcugucccccuucccccuauacagaaagaagcuacucucaccaucuguauccgccucccccuucccccugcaccgauagcucuuga

SEQ ID NO: 71621 - RNA, 1074 nt, Artificial Sequence
  derived and/or modified sequence opt5 from LRPAP1__Homo_sapiens__NP_002328
auggcccccagacgggugcgcagcuuccugagaggccucccugcucugcuucugcuccugcuuuuucuggggccguggcccgccgcgucccacggaggcaaguacucucgggagaaaaaccagccuaagcccagcccuaaacgcgaauccggggaggaguucagaauggagaagcucaaucaacugugggaaaaagcucagcggcugcaucuucccccuguccgccuggccgagcuucacgccgaccugaagauccaggagagagaugaacucgcuuggaagaaacugaagcucgacggacuggaugaggacggcgaaaaagaggcccggcucauucgcaaccugaauguuauccuggcuaaguaugggcucgauggaaagaaggacgccagacaggugaccucuaacagccuguccggcacacaagaggauggccuugacgauccgcggcuggaaaagcucuggcauaaagcgaagacgucugggaaauuuagcggagaggaacuggacaaacuuuggcgcgaguuccugcaccauaaagaaaaggugcacgaguacaauguccuccuggagacccuguccagaacagaagagauucacgaaaacgugaucagccccucugaucucuccgacauuaaaggcagcguucugcauucucggcacaccgagcuuaaggaaaagcugcgcuccaucaaucaggggcucgauagacugcggagagugagccaucagggauauucuacagaggccgaguuugaagaaccucgcgucaucgaccuuugggaccuggcucaguccgccaaccucaccgauaaagaacuggaggcuuuccgggaggaacugaagcacuuugaggccaaaauugaaaagcacaaucauuaccaaaaacagcucgagaucgcgcacgaaaagcugagacaugccgagagcgugggcgacggggagcgcguuucccggucuagagaaaagcacgcccuucuggagggacgcacaaaagaacucggcuauaccgugaagaaacaucugcaggaucugagcggccggauuuccagagcucgccacaacgagcuuuga

SEQ ID NO: 71622 - RNA, 4185 nt, Artificial Sequence
  derived and/or modified sequence opt5 from LRPPRC__Homo_sapiens__NP_573566
auggccgcucugcucagaagcgcccgguggcugcuucgcgcgggcgcugcccccagacugccucucucccugcggcuucugcccgggggaccgggccgccuccacgccgcuucuuaccugccugccgcuagagccgggcccguggcgggaggccugcucagcccugcccggcuguaugcuaucgccgcuaaggagaaagacauucaggaagaguccaccuucucuagccgcaagaucuccaaccaauuugauugggcccuuaugagacuggaccucucuguccggcgcacagggcggauucccaaaaagcugcuucagaaaguuuucaaugauacgugcagaagcggaggccugggcgggucccaugcgcuccugcugcuccgcagcuguggaucucugcuuccugaacugaagcucgaggaaagaaccgaguuugcccaccggaucugggacacacugcagaaacuuggcgcuguguacgaugugucccauuauaacgcccugcucaaagucuaccugcagaaugaguauaaguucagcccgaccgacuuucuggcuaaaauggaagaggccaacauucaacccaaucgcgugacauaccagagacucaucgccucuuauugcaacguuggggauaucgaaggagcuuccaagauucugggcuucaugaaaaccaaggaccuuccugugacagaggcggucuuuagcgcccuggugaccgggcacgcucgggccggagauauggagaaugccgaaaacauccucacgguuaugagagacgcuggcauugagcccggcccugauaccuaccuggcccuucugaaugcguacgcugaaaagggggacaucgaucaugugaaacagacacucgagaaggucgaaaaaucugagcugcaccugauggaccgcgaccuccugcagauuaucuucuccuuuagcaaggccggauauccccaauacguguccgagauucuugaaaaagugaccugugagcggagauauaucccggaugccaugaaccugauccuccugcuggucacagaaaaacuugaggacguugcucuccagauucugcuggccugcccugugucuaaagaagauggccccagcguguucggguccuuuuuccuccagcacugugucaccaugaauacgccuguggagaagcugacagacuacugcaagaaacuuaaggagguucagaugcauagcuuuccccugcaauucacccuccacugugcucugcuggccaacaaaacagaucuugcgaaggcccucaugaaagcugugaaggaagagggauuccccauccgcccucauuauuuuuggccgcugcuggucggccggagaaaggaaaagaaugugcaggggauuaucgagauucucaagggaaugcaggaacugggcguucaccccgaccaagagaccuacaccgauuaugugaucccuugcuucgacucugucaacuccgcccgcgcuauccuucaggagaauggcugucugagcgauucugacauguuuagccaggccgggcuccgguccgaagcggccaacggaaaccuggauuucgugcugucuuuucuuaaaagcaauacacuccccauuucccugcagagcaucagaucuucccugcuccugggcuuccgccggagcaugaacauuaaucuuuggucugagaucacggaacugcucuacaaggacgggagauacugccaagagccucgcggacccaccgaggcugucggcuauuuucuguacaaccugauugacuccaugagcgauuccgaagugcaggccaaagaggaacaccuucggcaguauuuccaucagcucgagaagaugaauguuaagaucccggaaaacaucuacagagggauucggaaucugcuggagucuuaucacgugccugagcucaucaaagacgcucaucugcuugucgaaagcaagaaccuggauuuucaaaagacagugcagcucaccuccucugagcuggaaagcacacuggagacccuuaaggccgaaaaucagcccauucgcgacguucugaaacagcucauccuggugcucuguuccgaggagaacaugcaaaaggcccuggaacuuaaggcuaaauacgagagcgauauggucacgggcggauaugcggcccugauuaaucucugcugcagacacgacaagguggaagaugcucugaaccugaaagaggaguucgaccggcuugauucuuccgccgugcuggacacaggcaaguacguugggcucgucagagugcuggccaaacauggaaagcuccaggaugcuaucaauauucugaaagaaaugaaggagaaggacgugcuuaucaaagauaccaccgcccugagcuuuuuccacaugcucaacggcgcggcucugcgcggggaaaucgagacagucaagcagcugcacgaagccauugugacccuuggacuggccgagccuucuacaaauaucuccuuuccccucguuacggugcaucuggagaaaggcgaccucagcaccgcucuggaagucgccauugacuguuacgagaaguauaaagugcuuccucggauccacgauguucugugcaagcugguggaaaagggggagacagaccucauucagaaagcgauggauuucgucucucaagaacagggcgagauggugaugcuguacgaccuuuucuuugcuuuccugcagaccggaaacuauaaggaggccaaaaagaucaucgaaacacccggcauuagagcccgcagcgcuagacuccaaugguuuugugaucggugcguugccaacaaucagguggagacccuggaaaaacucgucgagcugacgcagaaacuuuucgaaugugaccgcgaucagauguacuauaaccugcugaagcucuacaaaaucaauggggacuggcaaagagcugaugccguguggaacaagauucaggaggagaaugugaucccgcgggagaaaacccugcgccuucuggcggaaauucucagagaaggaaaccaggaggucccuuuugacguucccgaacugugguaugaggaugagaagcauucccucaauucuagcuccgccagcacaaccgaacccgacuuccagaaagauauccugaucgcuugccggcuuaaccaaaagaagggcgccuacgacauuuuucugaaugcuaaagagcagaacaucguguucaaugccgaaacauacuccaaccugauuaagcuccugaugucugaggacuauuuuacccaggccauggaggugaaggcuuucgcggaaacgcacaucaagggguuuacacuuaaugaugccgcuaacagccgccugauuaucacccaggucagacgggacuaccucaaagaggccgugacaacccugaagaccguucucgaucaacagcagacaccuucccgccuggccgugacgagagucauccaagcucuugccaugaaaggagacguggaaaauauugagguugugcagaagaugcugaacggccuggaagauucuaucgggcucagcaagauggucuucauuaacaauaucgcgcuggcucagauuaaaaacaauaacaucgacgccgccauugagaauaucgagaacaugcuuaccuccgaaaauaaggugaucgagccgcaguauuuuggccuggcuuaccucuuccggaaaguuauugaggaacaacuggaacccgccguggagaagaucucuauuauggcggagagacuggcuaaccaguucgccaucuauaaaccugucacagacuuuuuccuccagcuuguggaugccggaaagguggaugacgcucgcgcccugcugcagcgguguggcgcuauugccgaacaaacccccauccuccugcuuuuucugcucagaaauagccgcaagcaggggaaagcguccacagucaagagcguucuggagcugaucccugaacucaacgagaaagaagaggccuacaauucucuuaugaaguccuaugugagcgagaaagaugugaccucugcuaaggcccuguacgaacaccugacggcuaagaacacaaaacucgacgaccuguuccuuaagcgguacgccucccugcucaaauaugccggagagcccgucccuuuuauugaacccccggagagcuucgaguuuuacgcucagcagcugagaaagcugcgcgaaaauucuuccuga

SEQ ID NO: 71623 - RNA, 1245 nt, Artificial Sequence
  derived and/or modified sequence opt5 from LRR1__Homo_sapiens__NP_689542
augaagcugcacugcgagguggaagugaucagcagacaucuccccgcccugggccuucggaaccgcgggaaaggaguuagagcugugcugucccucugucagcaaaccucucggagccagccuccggugcgcgccuuccugcuuauuuccacacugaaggacaaaagaggcacgcgguacgagcuccgcgaaaauaucgagcaguuuuucaccaaguuugucgaugaagggaaagcgacagugagacugaaggagcccccuguugacauuugccugucuaaggcuaucagcuccucucucaaaggauuccugagcgccaugcggcuugcccaccgcggcuguaacguggauacccccgucuccacacugaccccugugaagacaagcgaguuugaaaauuucaaaaccaagaugguuauuacgucuaaaaaggacuauccccucuccaagaacuuuccuuacagccuggagcaucuucagaccucuuauugcgggcuggugagagucgauaugcggaugcucugucugaaaucccugcgcaagcucgaccugagccacaaucauaucaaaaagcugccggcuacaaucggagaucugauucaccuccaagaacugaaccuuaaugacaaccaccuggagucuuucuccguggcccucugccauagcacccugcagaaaucccugagaucucucgaucugagcaagaauaaaaucaaggcccuucccgugcaguuuugucagcugcaagagcucaagaaccugaaacuugacgauaaugaacugauucaguucccuugcaagaucggccagcucauuaaccugcgguuucuguccgcugcgcgcaauaaacuccccuuccugccuagcgaguuuagaaaccuuucucuggaauaccucgaccuguucggcaauacauucgagcagcccaagguccugccgguuaucaaacuucaagccccucucacccugcuggaauccagcgcucggacgauucuccacaacagaauccccuaugggucucauaucauuccuuuucaccugugucaggaucuugacacagccaagaucugcguguguggacgcuucugccugaacagcuuuauucagggcaccacaaccaugaaucuccacuccguggcucauaccgucgugcugguugacaaccuugggggaacagaggcccccaucauuucuuacuucugcagccuuggcuguuaugucaauuccagcgauaugcucaaguga

SEQ ID NO: 71624 - RNA, 1764 nt, Artificial Sequence
  derived and/or modified sequence opt5 from LRRC15__Homo_sapiens__NP_001128529
augccccuggacaaggccaugccucucaaacacuaccugcuucugcucgugggcugccaggcuuggggagccgggcuggcguaucauggcuguccgagcgagugcaccuguuccagagcuucucaagucgaaugcacaggggcccggaucguugccgugcccacgccucuucccuggaacgcuaugagccugcagauucucaauacccacaucacagagcugaacgaauccccuuuccugaauauuucugcccucaucgcucugcgcauugagaagaacgaacuuagcagaaucacccccggagccuuucggaaucugggcucccuccgcuaccugucucuugcgaacaauaaacuccaggugcucccuaucgggcuguuccagggacuggauagccucgagucccugcuucugagcucuaaccaacuccugcagauucagccggcccauuuuucccaguguagcaaucuuaaggagcugcaacuccacggcaaccaucuggaauauauccccgacggcgcuuucgaucaccuggucgggcucacaaaacugaaucuuggaaagaacucucugacccacauuuccccuagaguguuucagcaucucggcaaucugcagguucuucggcuguacgagaaccgccucacagacauccccauggggaccuucgauggacuggugaaucugcaggaacucgcccugcaacagaaccagauuggccuucugagcccugggcucuuucacaacaaucauaaccugcaaagacuguaucuuucuaauaaccacaucucccagcugcccccgagcgucuucaugcagcugccucagcugaaucggcucacgcuguuuggaaacucccuuaaggagcugucucccggcauuuucggcccuaugcccaaucuccgcgagcuguggcuguacgacaaccacaucagcucccuucccgauaauguguuuagcaaccucagacaacugcagguucugauccucucucggaaucagauuuccuucaucagcccuggggcuuuuaacggacugaccgaacuucgcgagcugucucuccauacaaaugcccugcaggaccuggauggcaacguguucagaaugcuugcgaaucuccaaaacauuagccugcagaacaaucggcugcgccagcucccggggaacaucuucgccaaugucaacggacugauggcuauucagcuucaaaauaaccagcuggaaaaucucccccugggcaucuuugaccaccuggggaaacuuugcgagcucagacuguaugauaacccuuggcggugugacuccgauauccugccccucagaaauuggcugcuucugaaccagccucgccucggaaccgacacagugcccgugugcuucucuccggccaauguccggggccagagccugauuaucauuaacguuaauguggcugugccuuccguccaugugcccgaaguuccuagcuaccccgagaccccuugguaccccgacacgccgucuuauccugauacaaccuccgugagcucuacaaccgagcugaccucccccgucgaagacuacacagaucuuacgaccauccaagugacagacgauagaagcguuuggggcaugacccaggcccaguccgggcuggccauugcugcgaucgugaucggaauugucgcccucgcuuguucucuggccgccugcgugggcuguugcugcuguaagaaacgcagccaagcuguccucaugcagaugaaggcccccaacgagugcuga

SEQ ID NO: 71625 - RNA, 4098 nt, Artificial Sequence
  derived and/or modified sequence opt5 from LRRC16A__Homo_sapiens__NP_001167448
augaccgaggaaagcuccgacgugcccagagagcugaucgaaucuauuaaggaugucaucggccggaaaauuaagaucagcguuaaaaagaaagugaagcucgaggugaagggggacaaagucgaaaacaaggugcugguucuuacauccugccgcgccuuccuggugacggcucggauuccuaccaaacucgagcugacauuuucuuaccuugagauccacggagucguguguagcaaguccgcccagaugaucguugaaaccgagaaaugcucuauuagcaugaagauggcguccccggaagaugugagcgagguccuggcucauaucggcacaugucuccggaagauuuuccccgggcugucuccugugcgcaucaugaaaaagguguccauggagcccagcgaaagacuggccucucuccaagcccugugggacucccagaccgucgcugagcagggaccuugcggcggguuuagccagauguaugccuguguuugcgauuggcuuggauucucuuaccgggaagaggugcaaugggacguggauacaauuuaucugacccaggacacgcgcgaacucaaucugcaggauuuuucccaccuugaccauagagaucugauccccauuaucgcugcccucgaguacaaccagugguucaccaaacugagcuccaaggaccugaaacucucuacagaugucugugagcaaauccugcgggugguuagccgcuccaauagacuugaggagcuggugcucgaaaacgcgggccugcggaccgacuuugcccagaagcucgcuagcgcccuggcucacaauccuaacucuggccuccauacaauuaaucuggccgggaacccgcuggaggaccgcggagucuccagccucucuauccaguucgcgaaacugcccaagggccuuaagcaccugaaucucagcaaaaccucccugucuccuaagggggugaacagccuuucccagagccugucugccaauccccucacggcuuccacacugguucaccuggaucucagcggaaacgugcugagaggcgacgaucuuucucauauguauaauuuucuggcccaaccuaacgcuauuguccaccucgaccuguccaauaccgaaugcagccuggauaugguguguggggcccuucuccggggaugccugcaguaccuggccguccucaaccugucccgcacaguguucucucauagaaaaggcaaggagguucccccgagcuuuaaacaguucuuuuccucuagccuugcucugaugcacaucaaccucuccggcaccaagcugagcccugagccccugaaggcgcuucuccuggggcuggccuguaaucacaaccucaaaggagugucucuggaccuuuccaauugcgaacugcggagcggcggggcucaaguccucgagggaugcauugccgaaauccauaacaucaccucucuggauauuuccgacaauggccuggagagcgaucuuucuacacucaucguguggcugagcaagaacagauccauucagcaccuggcccucgggaaaaauuucaacaauaugaaaagcaaaaaccugacgccuguucuugacaaucuggugcagaugauccaggaugaagagucuccccuccaaucccugagccuggcugacuccaaacuuaagaccgaggucacaauuaucaucaacgcccucggaucuaauaccagccugacaaagguggacauuuccggcaacggcaugggggauaugggagcgaagaugcuggcuaaagcccuccagaucaauaccaagcugcgcacggugauuugggacaaaaacaacaucacagcccagggcuuccaggauauugcuguugccauggaaaagaauuauacccuucgguuuaugcccaucccuauguacgacgcuucucaagcccugaagaccaacccggagaaaacagaagaugcgcuccagaagauugagaauuaccugcugagaaaccaugagacccgcaaauaucuucaggaacaggccuaccggcugcaacaggggaucgucacaagcacgacccagcagaugaucgacagaauuugugugaaggugcaagaucaccucaauucccugcgcaacugcggaggcgacgcuauccaggaggaucucaaaucugccgaacggcugaugagagacgcuaagaauagcaaaacacuucugcccaaccucuaucaugucgggggcgccuccugggcgggagccagcggccugcugucuuccccuauucaggagacccuugaaagcauggcuggggaggugacacgcguuguggaugagcaacugaaggcccuccuggaaucuauggucgacgcugccgagaaucucugucccaacgugaugaagaaagcccacauccggcaggaucugauucacgcuuccaccgaaaagaucagcaucccuagaacguucguuaaaaaugugcuucuggagcagucuggaauugacauccucaacaagauuuccgaagucaaacugaccguggcgagcuuucuguccgaccgcaucguugaugagauucuugacgcccugagccauugccaccauaagcucgcugaucacuucucucggagaggcaagacacugccccagcaagagagccucgaaaucgagcuggccgaagagaaaccggugaagcgguccaucauuaccgucgaggaacuuacagagaucgaacgccuggaggaccuggauaccuguaugaugacgccuaaaucuaagagaaaaagcauucacucccggaugcucagacccgugucucgcgccuuugaaauggaguucgaccuggauaaggcucuugaggaagugccuauccauauugaggaucccccuuuucccagccugcggcaggaaaagagauccucuggguucaucagcgagcucccguccgaagagggaaagaagcuggagcacuuuacaaaacuccgcccuaagagaaauaaaaagcagcagcccacccaagccgcggucugcgcugccaacaucguuagccaggacggcgaacagaaugggcugaugggccggguggacgagggaguggaugaguucuuuacaaagaaagucaccaagauggacucuaaaaagugguccacccgcggcagcgaaucucaugaacuuaacgaagggggagaugagaaaaagaaaagagacuccagaaagagcuccggcuuccugaaccugauuaagucucgcagcaaauccgaaagacccccuacaauccucaugacggaggaaccgagcucucccaagggggccgugcgguccccucccguugacuguccucgcaaagauaccaaggcugccgagcacaauggaaacagcgaaagaauugaggagaucaaaacacccgacucuuuugaagagagccagggcgaagagauugggaagguggagcgguccgauucuaagagcuccccucaagcgggccgcagauacggaguccaggugaugggcucugggcugcuugcugaaaugaaagccaagcaggagaaacgggccgcuugcgcccaaaagaaacugggaaaugacgcuguuagccaggauuccagcucucccgcccucuccggcguggaaagaagcgacgggggaggcgcggggcugccggagaaccgcuucggccucggaaccccugaaaagaauacaaaggccgagcccaaagcugaggccggcucccggucuagaagcuccucuagcaccccuacgucccccaagccgcugcuucagagcccuaaacccucucuggcugcccgcccugucaucccccagaagccccggacagccuccagaccugaugacauuccggauagccccucuuccccuaaaguggcucugcuucccccuguucugaagaaggugcccagcgacaaagaacgcgaugggcaaucuagcccucagccgucuccccggaccuucucccaggaggucagcagacgcuccuggggacagcaagcgcaggaauaucaggagcagaagcaacggagcuccucuaaagacggccaucaggggagcaaguccaacgacucuggagaagaggccgagaaagaauuuaucuucguguga

SEQ ID NO: 71626 - RNA, 4119 nt, Artificial Sequence
  derived and/or modified sequence opt5 from LRRC16B__Homo_sapiens__NP_612369
auggccaagcccagcguggagcugaccagagaacuccaggacuccauccggcgcugccugucucaaggcgcuguccuucagcagcaccauguuaaacuggagacaaagccuaaaaaguucgaagauagagugcucgcccugacgagcuggcggcuucaccuguuucuccugaaagugccggcgaaggucgaguccucuuucaacgugcuggaaauucgcgcuuuuaauacccucagccagaaccaaauccugguugagacagagagagggaugguguccaugcggcuucccucugccgaaagcgucgaccaggugacccgccauguuuccagcgcccugucuaagguguguccuggacccggcugccucauuagacgggggaaugcugauacaccugagggaccccgcgacaccuccccuaacagcgaaacaucuaccuccacgacccacagcgucuguggcggguucucugagacauacgccgcucugugcgauuauaauggacuucauuguagagaggaagugcagugggacguggauaccaucuaccacgccgaggacaaccgggaauuuaaucugcucgauuucucccaccuggagagccgcgaccuggcgcucauggucgccgcucuggccuauaaccagugguuuacaaaacuuuacugcaaggaucugagacucggcuccgaaguucuggagcaagugcuucauacccugucuaaaagcggcucccucgaggaacuggugcuggacaaugcugggcucaagacggauuucguccagaaacuggccggaguguuuggcgagaacgggagcuguguucuucacgcgcugacacucucucauaauccgauugaagacaagggauuccugucccuuagccagcagcugcucugcuuucccucuggccugaccaagcugugucucgccaaaacagcuaucagcccucgggggcugcaagcccuuggacagaccuucggcgcuaaccccgccuuugccuccucucugcgcuaucucgaccugagcaagaauccuggccugcuugcuaccgaugaggcgaacgcccucuacuccuuccuggcucagcccaaugcccuggugcaccucgaccugagcgggacagauugcgucaucgaccuucugcucggagcccugcugcacggcuguugcucucaucuuacguaucucaaccuggcuagaaacuccugcagccaccggaaagggagagaagccccgccugcguucaagcaauuuuucucuuccgcuuacacccugagccaugugaaucucuccgccacaaaacugccccuugaggcccugcgcgcucuccugcagggacugucucuuaacagccaccucuccgaucugcaucuggaccucucuagcugugagcugcgguccgccggcgcucaggcccuucaggaacaacugggggcgguuaccugcgugggaagccucgaucugucugacaauggcuuugauuccgaccugcuuacacucgucccugcccugggcaagaacaaaagccugaagcaccucuuccuggggaagaauuuuaacgugaaagcuaagacccuugaggaaauucugcacaaacucguccagcugauccaggaggaagauuguucucugcagucccuuagcguggccgacucuagacugaagcuccgcacgagcauucugaucaaugcucucggauccaacacaugccuggccaaaguugaccuuagcggcaaugggauggaggauauuggagcgaagaugcugucuaaggcccuccaaaucaacuccagccugcggaccauucugugggacagaaauaacaccuccgcucuuggcuuccuggauaucgcccgcgcucucgagucuaaucauacacugcgguuuaugagcuuccccguguccgacaucucucaggccuacagaagcgcccccgaacgcaccgaggaugucuggcagaaaauucaguggugucucgugcggaacaaucacucccaaacaugcccucaggaacaggcuuuuagacugcagcaagggcuuguuacgucuagcgcggagcagaugcugcagcgccucuguggccgggugcaagaggaagucagagcccugcggcugugcccgcuugagcccgugcaggacgaacugcucuaugcucgcgaucugaucaaggacgccaaaaacuccagagcccucuucccuagccuguacgagcuuggacaugugcuggcuaacgauggccccguucggcagagacuggaaucugucgccuccgaggugagcaaggcgguggacaaagagcuccaggucauucuggaaucuauggugucccuuacccaagagcuguguccuguugcuaugcgcguggccgaagggcacaauaagaugcucagcaacgucgccgagcgggugacaguucccagaaauuuuauccgcggagcucugcucgaacaggccggccaggauauucagaacaagcuggacgaggugaaacuuucugucgugaccuaucugacauccagcaucguugaugagauccugcaagaacucuaccacucccauaagagccuggcgagacaccuuacccagcugcggacgcucucugacccgccugggugccccggacagggccaggaccugagcucccgcgggagaggccggaaucaugaucacgaggaaaccacagacgaugagcucggaaccaacauugacacaauggcuaucaaaaagcaaaaacgcuguagaaagauucggccugugucugccuucaucagcggcucuccccaggauauggaaucccagcuggggaaucuuggcauuccucccggaugguuuagcgggcugggaggcucccaaccgaccgccucugggagcugggagggccuguccgagcucccuacgcauggauauaagcugcgccaccagacacagggcagaccccggcccccucgcaccacaccgcccgggccuggaagacccagcaugccugcucccggcacccggcaggaaaacgggauggccaccagacuugacgagggacuggaagauuucuucucucgccggguccucgaggaguccagcucuuacccuagaacacugcgcacggugcggcccggccucuccgaagcuccgcugccuccccuucagaaaaagagacgccgggggcuguuucacuucagacgcccucggagcuuuaaaggcgacagaggacccggcuccccgaccacagggcugcuccugccucccccucccccucccccgcccacccaagagucuccucccagcccugaucccccuucccuuggaaauaacagcucuccgugcuggucccccgaagaggaaagcucucugcucccuggcuucgggggaggccggggccccagcuuucgcagaaagauggggacagagggauccgagccuggcgaagggggacccgccccgggcaccgcgcagcagccucgggugcauggggucgcccugcccggacuggagcgcgcuaaaggcuggucuuucgacggcaagagagaagggcccggaccugaucaagagggcagcacgcaggccuggcagaaacggagauccucugacgaugcugggcccggaagcuggaagccuccgcccccuccccaguccacaaagccuagcuuuucugccaugcgccgggccgaagcuaccuggcacaucgcggaggaguccgcccccaaucauagcugccaauccccgucuccugcuagccaggacggcgaagaggaaaaagaggggacccucuuccccgaaagaacacuuccugcccgcaacgccaagcugcaggaccccgcucuggccccuuggcccccgaaaccuguugcggugccccggggaagacagcccccucaagagccgggcgugcgcgaggaagcugaggccggcgaugccgcucccggggucaauaagccucggcucagacuguccucucagcaggaccaagaggaacccgaggugcagggaccucccgauccuggccgcagaaccgccccgcuuaaacccaagcggacacgcagagcgcagagcugugacaagcuggaaccugaucggcgcagacccccugaccccacggggaccuccgagccgggaacagauuga

SEQ ID NO: 71627 - RNA, 942 nt, Artificial Sequence
  derived and/or modified sequence opt5 from LRRC17__Homo_sapiens__NP_005815
augagaguggucaccaucguuauucugcucugcuucuguaaggccgcugagcugcggaaagccagccccggcuccgugcgcucuagagugaaccacgggcgggcgggaggcgggcgcagaggaagcaauccugucaagcgguacgcuccgggccuucccugcgacguguauacauaccugcaugaaaaauaucucgauugucaggagcgcaagcugguuuacgugcuuccuggguggccccaagaccugcuccacaugcugcuggccagaaacaaaauccggacgcucaagaauaacauguuuuccaaguucaaaaagcugaaaucucuugaucugcagcagaaugaaauuagcaagaucgaguccgaagccuuuuucggacucaacaaacugaccacacuucugcuccagcauaaucaaauuaagguccugaccgaggagguguuuaucuauacaccucugcucucuuaccugcgccuuuaugacaaccccuggcacugcaccugugaaaucgagacacugauuagcaugcuccagaucccuagaaaucggaaccugggcaauuacgcuaagugcgaauccccgcaggagcagaaaaacaagaaacuucgccaaauuaagagcgagcagcuguguaaugaagaggaaaaagagcagcucgaucccaagccucagguuucuggcagacccccugugaucaaacccgaagucgacuccaccuucugccauaacuacguguuuccgauucaaacgcuggauuguaagcggaaggagcugaaaaaggugccuaauaacauucccccugacaucgucaaacucgaucugagcuauaacaagaucaaucagcuucgccccaaagaguucgaagacguucacgagcugaagaagcucaaccugucuuccaaugggaucgaauuuauugaucccggaagccuuagauga

SEQ ID NO: 71628 - RNA, 786 nt, Artificial Sequence
  derived and/or modified sequence opt5 from LRRC18__Homo_sapiens__XP_011538131
auggugaagggcgagaaagggcccaagggaaagaagaucacccugaaagucgccagaaacugcauuaagaucacauucgacggcaagaaacggcucgaucugagcaagauggggauuacgaccuuuccuaaauguauccuucgccuguccgacauggaugaacucgaccugucuagaaaucuuauucggaagaucccggauagcaucuccaaauuccagaaccugcgcuggcucgaccugcacucuaauuacauugauaagcugcccgagagcaucggacaaaugacaucccuccuguaucuuaacguuucuaauaacagacugaccagcaauggccucccuguggaacugaagcagcuuaaaaacauucgggcugugaaucuggggcucaaccaucuggacuccguccccacaacccugggagcccucaaggagcugcacgaagugggccuucaugauaaucugcucaacaauaucccuguuagcauuucuaaacugcccaaacuuaaaaagcugaacaucaaacgcaauccuuuuccgaagcccggcgaguccgagauuuucaucgacagcaucagacggcucgaaaaccuguacguggucgaggaaaaggaucugugcgcggcuugucuccgcaaaugccagaacgccagagacaaucugaaccggauuaagaauauggccacaaccacgccucgcaaaaccaucuuucccaaccuuauuucuccuaauuccauggcuaaggauagcugggaggacuggagaauccggcugacaucuuccuga

SEQ ID NO: 71629 - RNA, 1575 nt, Artificial Sequence
  derived and/or modified sequence opt5 from LRRC1__Homo_sapiens__NP_060684
auguuccacugcaucccccuguggagauguaaccggcauguggagagcauugacaagcgccacugcucccucgucuacguuccugaagagaucuauagauacgcccggucucuggaagaacuucugcucgaugcuaaucagcugcgcgaacuuccggagcaauuuuuccagcuggugaaacucagaaagcugggccugagcgacaacgagauucagcggcuucccccugaaaucgccaauuuuaugcagcugguggagcuugaugucucccgcaacgaaauucccgagaucccugagucuaucagcuucuguaaagcgcugcaaguggcugacuuuuccgggaauccccucaccagacugccugaaucuuucccggagcuucagaaccugacaugccucagcguuaaugauauuucccugcagagccugcccgaaaacaucggaaaucucuauaaccuggccucucuugagcugcgggaaaaucuccugacguaccuuccugacucccugacccagcuccgcagacuggaggagcuggaucucggcaacaaugaaauuuauaaccugcccgagagcaucggggcccuucugcaucucaaggaccuguggcuugauggaaaucaacugucugaacucccucaggagauuggcaaccugaaaaaccugcucugucuggacguguccgaaaaucggcuugagcgccugcccgaggaaaucagcgggcucacaucucugaccgaucuggucauuucccagaaccuucucgagacaaucccggacggaaucggcaagcugaagaaacugagcauucucaagguggaucagaauagacugacccaacuuccugaagcuguuggcgagugcgaaucccugacagagcucgugcugaccgagaaccagcugcuuacgcuccccaaaucuaucgggaagcugaaaaagcugagcaaucucaacgccgaccggaauaagcuggucucccuuccuaaagaaauuggaggcuguugcagccugaccguguuuugugugcgcgacaacagacucacacggauccccgcugaggucucucaggccaccgaacugcacguucuggauguggcggggaauagacuucuccaucugccccugucccucacagcccugaagcucaaagcucuguggcucagcgacaaccaaucucagccucugcugaccuuccagacggauacagacuacaccacaggagagaagauucuuaccugcgugcuccugccgcagcugcccagcgagccuaccugucaagaaaaucucccccgcugcggcgcccuggagaaccuugucaaugauguguccgacgaggcuuggaacgagcgggccguuaauagagugucugcgauccgcuuugucgaagaugagaaagacgaggaagauaacgagacacggacgcugcucagacgcgccaccccucaccccggggaacugaagcacaugaaaaagacaguggagaaccugcggaaugacaugaacgcugccaagggacuugauagcaauaaaaacgaaguuaaucaugcuaucgacagagugaccacauccgucuga

SEQ ID NO: 71630 - RNA, 555 nt, Artificial Sequence
  derived and/or modified sequence opt5 from LRRC20__Homo_sapiens__NP_001265141
augcugaagaaaaugggcgaggccguggcuagagucgcccggaagguuaacgaaaccguggagagcggguccgacacacucgaucuggcggaaugcaaacuugugucuuuccccaucggaauuuacaagguccugcgcaaugugagcggccagauccaccucauuacgcuggcuaacaaugagcuuaaaucccugaccucuaaguuuaugacaaccuucagccaacucagagaacugcaucuggaggggaacuuucuccaccggcugccuuccgagguuucugcccuucagcaucugaaggccaucgaccucagccgcaaucaguuccaggauuuuccggaacaacugacagcccuucccgcucuggagaccauuaaccucgaagagaaugagaucguggacgucccuguggaaaaacuggcugccaugcccgcgcugagauccaucaaccuccgguucaauccucugaacgccgagguucgcgugauugcucccccucuuaucaaguuugauaugcugaugagcccggaaggagccagagcuccccucccuuga

SEQ ID NO: 71631 - RNA, 1005 nt, Artificial Sequence
  derived and/or modified sequence opt5 from LRRC26__Homo_sapiens__NP_001013675
augagaggccccagcuggucccggccucgcccgcugcuccugcuucugcuccugcuuucucccuggccugugugggcccaggucagcgcuaccgccucccccucugggagccugggagcgccugacugccccgagguuuguacaugcgugccuggcgggcucgcuuccuguucugcccugagccugccggccgugcccccuggacucucccugagacuucgggcucugcuccuggaucacaaccgcgucagagcccuucccccuggcgcuuucgccggggcgggagcccugcaacggcucgaccugcgcgaaaauggccugcauagcgugcacguuagagcuuuuuggggccucggggcccugcagcuucuggaucucucugcuaaccagcuggaggcccuugcgcccggaacguucgccccgcugcgggcucuccgcaaucugucccuggccggcaacagacucgcucggcuggaaccugccgcccuuggggcucugccccuccugcgcagccuuucucugcaggacaaugagcucgcggcccuggcuccuggacugcucggcagacugcccgcccuugaugcccugcaucuccgggggaaccccuggggaugcggcugugcucugcgcccucugugcgccuggcuuagacggcacccgcuccccgcguccgaagcugagaccgugcugugugucuggccuggcagacugacacucagcccccugaccgccuuuucugacgccgcuuucucccauugcgcccaaccucuugcucugcgcgaucucgccgugguuuacacacuggggcccgcgagcuuucuggugucccuugccucuugucucgcucugggaagcggccugaccgccugccgggcuagacgccggagacuccgcacagccgcgcugcggccgccuagacccccugaccccaauccugaucccgacccgcacgggugugccuccccugcugaucccggaagccccgccgcugccgcccaggcuuga

SEQ ID NO: 71632 - RNA, 906 nt, Artificial Sequence
  derived and/or modified sequence opt5 from LRRC30__Homo_sapiens__NP_001099051
augggcgccagacagagccgggcuuccucuaaggacaaagggcccaagcgcaugcuguucaccggaagacggcaaaaauuuagcccuugggaugacgcccuccuguccggccgcgauccgagaucucuucugaagcgggggaugcaccaugugagcuucucccucgucacacgcggaaugacggacauccccgauuuucuguggggccuuucugagguucagaaacugaaccucagccacaaucagcugagagugcugccucccgaaguggggaagcucacccggauugucgugcugaaccuuugcggaaaucgccugaagucccucccuagagagguuagccugcuucagugucugaaaguccucuucgugaacaugaauugccugacagaagugcccgcggagcugucucucugucggaagcuggaaguucuuucccugagccauaacugccucucucaacugccugcuuguuuugccgaccuuucccgccugagaaaacucaaucugagcaacaauuucuuugcccacaucccgaugugcguguucucucugaaggagcucauuuuucugcaugucggcuccaaccggcuugagaauaucgcugaaagcauucagcaccuggccucccuccagaucuucaucgcugagggcaacaauauucacucuuuuccccgcagccugugucuugugaccucccuggaacuccugaaccugaauaacaacgauauccagacacucccuagcgagcugcaucuucugugcagacucgugcggauugccuggaaucccauggacaaagggcugcacaucucucauaacccucuguccaagccccuuccggagcucgucgaaggaggccuggagaugcuguucggguaccucaaggauaaaaagcacaccuga

SEQ ID NO: 71633 - RNA, 1989 nt, Artificial Sequence
  derived and/or modified sequence opt5 from LRRC32__Homo_sapiens__XP_005273959
augagaccccagauccugcuccugcuugcccugcucacccugggccuugcugcccaacaccaggacaaggugccuugcaaaauggucgauaagaaaguuagcugucaggugcuggggcuccuccaggugccguccguccugcccccugacacagagacgcucgaucugucuggaaaccaacuucggagcauucuggcgucuccccucggcuucuacaccgcucugcgccaucuugaccuguccacaaaugaaaucagcuuucuccagccuggggccuuccaggcccugacccaccuggagcaucucucccuggcucacaacagacuugccauggcuacagcccugucugcgggaggccucgggccccugccucgggugaccagccuugaucuguccggaaauagccucuauucuggccugcuggaacgccuccugggcgaggccccgucccuucauacacugagccucgcugaaaacucucugaccagacuuacgcggcacaccuuucgcgacaugcccgcccuggagcagcucgaucugcacuccaauguucugauggacauugaggauggggcuuucgaaggacucccuagacugacacaucuuaaccugagccgcaauucucugaccugcaucuccgacuuuagccugcaacagcugcgggugcuugaucucuccuguaacucuauugaggccuuccagacagcgagccagccccaagccgaauuucagcugaccuggcuggaccucagagagaauaagcugcuucacuucccugaucuggcugcccucccccggcugaucuaccugaaccuuuccaauaaccucauccgccugccgacgggcccuccccaggacagcaaagggauucaugcuccuucugagggaugguccgcccugccccucagcgcccccucuggcaaugcuagcgggagaccucugucccaacuucugaaccucgaccugucuuauaaugaaaucgagcugauuccggauagcuuucuugaacaccucacaucccugugcuuccugaaccucagccggaacugucugcgcaccuuugaggcgagacggcuuggaucucugcccugccucaugcugcuggaccuuucccacaaugcccucgaaacacuggagcugggcgcuagagcccucggcagccugcgcacccuucugcuccaggggaacgcccugcgggaucugccucccuacaccuucgcuaaucuugccucucugcagagacucaaccugcagggaaaucgcgucuccccuuguggcgggcccgacgagccgggaccuagcggcugcguggcguuuuccgggaucacaucucuccggagccugucccuuguugauaacgaaauugagcugcucagagcuggagccuuccugcauacgccccugaccgaacuugaccugucuagcaauccuggccucgagguggccacaggcgcucucgggggacuggaagccucccuggagguccuugcucugcaaggcaacgggcucauggugcuucagguggaucugcccuguuucaucugccugaagcgccugaaucucgccgagaaccggcugagccaccucccugcguggacccaggccgucucucuggaaguucuugaccugagaaauaacuccuuuagccugcuccccggaucugcuaugggcgggcuggagacaucccuucgccggcuguaucuccagggcaauccgcugagcuguugcggaaacggcuggcucgccgcucaacugcaucaggggagaguggauguggacgccacccaggaucuuauuugccgcuucucuagccaggaagaggucucccugagccacgugcggccugaagacugugagaagggaggccugaaaaauaucaaccucaucauuauccugacguuuauucuuguuucugcgauccugcucacaacccuggccgcuugcuguugcgugagacggcaaaaguucaaccagcaguacaaagccuga

SEQ ID NO: 71634 - RNA, 5103 nt, Artificial Sequence
  derived and/or modified sequence opt5 from LRRC37A__Homo_sapiens__NP_055649
augagcuccgcccagugccccgcucuggugugugucaugucuagacuccgguucuggggcccuuggccgcugcuuauguggcaacugcucuggcugcuuguuaaggaggcccagccccuggaaugggugaaagacccucuccagcugaccagcaacccccuggggccucccgaguccuggucuagccacuccucucauuuuccucgcgaaagcccgcacgcgcccacacucccugcugaucccugggacuucgaucaucugggaccuuccgccagcucugagaugcccgccccgccucaggaauccacggagaaucuugugcccuuucuggacaccugggauagcgcuggcgagcaaccucucgaacccgagcaguuccuggccucucagcaggaccuuaaggauaaacuguccccccaagaaagacucccugucagcccgaagaaacugaagaaggaccccgcucagcgguggucucuggccgagaucauugggaucacacgccagcucuccaccccucagagccaaaaacagacacugcagaacgaguacuccucuaccgauacacccuauccuggaagccuucccccggaacugagagugaaguccgacgagccucccggcccuagcgaacaaguugggcccucucaguuucaccucgagccugaaacccagaaucccgagacgcuggaggauauucaguccagcucucuucaacaggaagcgccggcccagcugccucagcuccuggaggaagagcccagcuccaugcaacaggaagcucccgcccugccuccggagucuagcauggagucccucacccugcccaaccaugaagugagcguccagccucccggagaggaccaggcuuacuaucaccuuccuaauaucacagugaaacccgccgauguugaagugaccauuacaucugagccuaccaacgaaacggaguccagccaagcgcagcaggagacacccauccaguucccggaagaggucgaaccuucugccacccaacaggaggcucccaucgagccucccgugccgccuauggaacacgagcuguccauuagcgaacagcaacagcccgugcagccuuccgagucuccccgggaagucgagagcucccccacacagcaagagaccccuggccagccgcccgaacaucacgagguuaccgugucuccucccggccaucaccagacacaccaucucgccagcccuuccgugagcgucaagcccccugacgugcagcugacgaucgcugccgaaccgucugccgagguugggaccucccuugugcaccaagaagcuacaacccgccugagcggaucuggcaaugacgucgagcccccugcgauucagcaugggggacccccucuccugcccgaguccagcgaagaggccggcccgcuggcugugcagcaggaaacaucuuuucaaagcccugagcccaucaacaaugaaaaccccuccccuacccagcaggaggccgccgcugagcacccccaaacggccgaagagggggaaagcucucucacacaucaggaggcgccugcucagaccccggaguuccccaauguuguggucgcccagccucccgaacacucccaccugacccaagccacagugcagccucuugaucugggauuuaccauuacacccgagagcaaaacggaagucgagcucuccccgaccaugaaggaaacaccuacccagcccccuaagaaagugguuccccagcugagaguguaccaaggcgucacaaacccuacccccggccaggaccaggcucagcauccggugucuccuagcguuacggugcaacugcuugaucucgggcugaccaucacacccgagcccaccacagaggucggacacuccaccccuccgaagcggacgauugugucucccaaacauccugaagugacacugccccacccugaccagguucagacccagcacagccaucucacacgcgccaccguccaaccccuggaucuuggcuucaccaucacaccuaaguccaugacggagguggaaccgucuaccgcucugaugacaaccgcccccccucccgggcacccugaggugacacuccccccgagcgacaaaggacaggcgcagcauucccaccugacccaagccacgguccagccucuggaucuugaacucacaaucaccaccaagcccacaaccgaggugaaacccagcccuacaacggaggaaaccucuacacagcccccugaccugggccuggcuauuaucccggagcccaccacagaaaccgggcauuccacggcccucgagaagaccacagcuccuagacccgaucggguucagacccugcaccgcagccuuacagaagugaccggaccucccacagagcuggagccggcccaagacucucucguccaguccgaaagcuauacccagaauaaggcgcugacggccccugaggaacacaaagcuucuacauccaccaacauuugcgagcuguguaccugcggcgaugagaugcuuagcuguaucgaccucaaucccgaacagagacugcggcaagugccuguucccgagccuaacacacauaacggcaccuuuacgauucugaauuuccaggggaacuacaucuccuauaucgacggaaauguguggaaggccuacagcuggacagaaaaacucauucugcgcgagaacaaucuuaccgaacugcacaaggauucuuuugagggccuccugagccugcaguaccuugaccucuccugcaacaaaauccagucuauugagagacauacauucgaaccccugccguuccugaaguuuaucaaucucagcuguaacgucauuaccgagcuguccuucgggacauuucaagcuuggcacggaaugcaguuccuucauaagcugauccucaaucacaacccucugaccacgguggaagaucccuaucuguuuaaacuucccgcccugaaguaccucgacaugggcaccacacugguuccucucaccacacugaaaaauauccuuaugaugaccguggagcuggaaaagcucauucugccgucucacauggccugcugucugugccaguucaaaaacagcaucgaggcugucuguaagacggugaagcuucauugcaauuccgcgugccugacaaacaccacacacugucccgaggaagccucuguggggaauccugagggcgcuuuuaugaaaguccuccaagcccggaagaacuauaccagcaccgaacugauuguugagcccgaagagccuuccgauagcucuggaaucaaccucuccggcuucgggagcgagcagcuggacacaaaugaugaaucugacuuuauuuccacgcuuagcuacauccugcccuauuucuccgccgugaaccucgaugugaaaucucugcugcuuccuuuuauuaagcugcccaccacaggaaauagccucgcuaaaauccagaccgucggccagaacagacaacgcgugaagcggguucugauggggccgagauccauccagaagcgccauuucaaagaggugggacggcagagcauuagacgcgaacagggcgcccaagcgucugucgagaaugcugccgaggaaaagcggcucacauccccugcccccagagagguggaacagccucacacccagcaggggcccgagaaacuggcuggcaacgccguuuacacgaagccgagcuuuacacaagaacacaaagcggcugugucuguccuuaagccuuucagcaaaggaacccccuccaccucuagccccgccaaggcccugccucaggugcgcgaccgguccaaggaucugacacaugcuaucucuauucucgagagcgccaaagcuagaguuaccaauacaaagacguccaaacccaucgugcacgcccgcaagaaauaucgguuccauaagaccagaagccacgucacacaucggaccacaaaggugaaaaagucuccuaaagugcgcaagaaauccuaccugagcagacuuaugcuggcgaaccggcucccguuuuccgccgcuaagucucugauuaauagccccucccagggcgccuucucuagccucggggaccuguccccucaggagaaccccuuucuugaagucagcgcucugucugagcacuucaucgaaaagaauaacaccaaacacacgaccgccagaaaugccuuugaggaaaacgauuucauggagaauacaaacaugccugagggaaccaucuccgaaaacacaaauuacaaccaucccccugaggcugacagcgcgggcaccgccuuuaaucuggggccgacaguuaagcaaacggaaaccaaaugggaguauaacaaugugggaacagaccucucucccgaaccuaaguccuucaacuacccccugcuuagcucuccuggcgaucaguuugagauucagcugacccaacagcuccagagccugauccccaauaacaaugugcgccggcucauugcucacgucaucagaacccugaaaauggacugcuccggggcccaugugcagguuacaugugccaagcuuauuucucgcacgggccaccugaugaagcugcucagcggacaacaggaggugaaagcuuccaagaucgaaugggauaccgaccaguggaaaaucgagaacuauauuaaugaaagcacagaggcccaguccgagcaaaaggaaaaaucucuggagcuuaagaaagaagucccgggcuacggguauaccgauaagcugauccucgcgcugauugugacaggaauccucaccauucugaucauccuuuucugccugauuguuaucuguugccacagacggagccugcaggaggacgaagagggcuuuucccgcgggauuuucagauuucucccuuggcggggauguucuagccgcagagagucccaggauggccugucuagcuucgggcagccccuuugguucaaggaccuguacaaaccccucuccgcuacgcggaucaacaaucaugccuggaagcugcacaaaaagagcucuaacgaagauaaaauucugaaucgcgacccuggcgauuccgaggcccccacagaagaggaagagagcgaggcucucccuuga

SEQ ID NO: 71635 - RNA, 2844 nt, Artificial Sequence
  derived and/or modified sequence opt5 from LRRC37B__Homo_sapiens__NP_443120
augagcuggcugagauucuggggccccuggccucuccugaccuggcagcuucugucccuccuggugaaggaggcccaaccgcuugucuggguuaaagacccccugcagcucacaucuaacccucuggggcccccugaacccuggagcucccggucuagccaucugccuugggaguccccgcacgcucccgccccucccgcggcuccuggagauuuugacuaccucggccccucugccagcucccagaugagcgcccugccgcaggaaccuacggagaaucuugcucccuuccugaaggaacucgauucugccggggagcugccucuuggacccgagcccuuucuggcugcccaccaagaccucaacgauaaacgcaccccugaagagagacugccggaaguggugccccugcucaaucgggaccagaaccaggcgcugguccagcuuccucgccugaagugggugcaaacaaccgaucucgacagagccgcuggccaucaggccgaugagauccugguuccccuugacuccaaagugagccggccuacaaaguucgucgugucucccaagaaucugaaaaaggaucucgcugagcgcuggucccugccggaaauuguugggaucccucaccagcugagcaaaccccagagacaaaagcagacccucccugacgauuaucugucuauggacacacuuuaccccggaucccugccucccgagcuccgggugaacgccgacgaaccgccuggcccucccgagcaggucggccugagccaauuucaucuugaacccaaaucccagaauccggagacccuggaggauauucagucuagcucccuccaggaagaggcgcccgcccaacugcugcagcucccucaggaaguggagcccagcacgcagcaagaagcuccugcccugcccccugagucuuccauggagagccuugcucagacaccccugaaccacgaagugaccguccagccgccuggggaggaccaggcccacuauaaucuccccaaguucaccguuaagccugccgauguggaagugacaaugaccucugagcccaaaaacgaaacggagagcacacaagcucagcaggaggcgccgauccagccucccgaagaggccgaaccuuccucuaccgcucugcgcacaaccgacccuccgcccgagcaucccgaggucacccugcccccuagcgauaagggacaagcccagcacucccaucuuacagaagccacggugcagccccucgaccuggagcugagcauuaccacagaaccuaccacagagguuaaacccucuccuaccacggaagagacauccgcucaaccgcccgauccuggccucgccaucacccccgagccuaccacagaaaucgggcacagcaccgcgcuggagaagacaagagcuccccacccggaccaggugcagacgcuucaucggucucugaccgaagucacaggaccucccaccaaacucgaguccagccaggauucccuggugcaaucugaaacagcccccgaggagcagaaggccagcaccuccacgaauauuugcgaacuguguaccugcggcgacgagacacuuucuuguguugggcucagcccuaaacagcgccugagacaggugcccgucccugaaccggauaccuacaacggaaucuuuacaacccugaauuuccaaggcaacuauauuuccuaccucgacggcaauguguggaaggcuuauagcuggacggagaagcugauccuuucugaaaacuaccugacagagcuccccaaagacuccuuugaggggcugcuguaccuucaguaucucgaucugagcugcaacaagauucgguacaucgaacgccagaccuucgagucucugccuuuucuccaguauauuaaucugggauguaaccuuaucacaaaacugucccucggcaccuuccaagccuggcacgggaugcaguuucugcauaaucugauccuuaacagaaauccccucaccacagucgaagacccuuaccuguucgagcugcccgcucucaaguaucuggauaugggaacgacccacauuacacuuaccacacugaaaaacauccucaccaugacgguggagcuggaaaagcugauucuuccgagccauauggccugcugucugugccaguucaaaaauucuaucgaggcgguuuguaagacagugaagcuccacugcaacaccgccugucugaccaauagcauucacugcccugaagaggcuuccgucggcaaccccgaaggggccuuuaugaaaaugcuccaagcucggaagcagcauaugagcacacagcugaccaucgagucugaggccccuuccgacagcuccggaaucaaucuuucuggcuucggcggggaucagcuggaaauucaacucacagagcagcugagaagccugauccccaacgaagacgugcgcaaauuuaugucccacguuauucggacgcuuaagauggagugcucugaaacccaugugcagggaagcugugcgaagcugaugcucagaacaggccugcucaugaaacugcuuuccgagcagcaagaggccaaggcucugaaugucgaaugggauaccgaccagcagaaaacaaacuacaucaaugagaacauggaacagaacgagcaaaaggaacagaaaucuagcgagcucaugaaggaggugccuggggaugacuauaagaauaaacugauuuucgccaucuccgugaccguuauccugauuauccuuauuaucaucuuuugccugauugaagucaacagccacaagcgcgcuucugagaaauacaaggauaaucccuccauuagcggagccuga

SEQ ID NO: 71636 - RNA, 1008 nt, Artificial Sequence
  derived and/or modified sequence opt5 from LRRC39__Homo_sapiens__XP_011538980
augaccgagaacguggucugcacaggcgccguuaaugcugugaaggaagugugggagaaaagaaucaagaaacugaacgaagaccucaagcgggagaaagaguuccagcacaagcugguccgcauuugggaagagagagugagccuuacgaagcugcgggaaaaaguuacccgcgaggaugggagagugauccucaagauugaaaaagaggaguggaagacacugcccuccucucuucugaaacucaaucaacugcaggaauggcagcugcaucggaccggacuccugaagaucccugaguuuauuggccgcuuccagaaccuuaucguccuggaccucagcagaaauacaaucuccgaaauuccgcccgggaucggacugcuuacccggcugcaagagcucauucugucuuacaacaagaucaaaacagugccuaaggaacugagcaauugugccucccucgagaaacuggagcuugcgguuaaccgcgauauuugcgaccugccccaggaacucucuaaucugcuuaagcugacccaccucgaucugagcaugaacgacuuuacgaccaucccucuggcugugcucaauaugcccgcccuggaguggcuugauaugggcuccaacaaacuggaacagcucccugacacaauugagagaaugcagaaucugcauacccuuuggcugcaacggaacgaaaucacaugucucccgcagaccaucagcaauaugaagaaccuggggacgcugguccucucuaacaauaaacugcaggauauucccgugugcauggaggagauggccaaccuucgcuucgugaauuuuagagacaacccucugaagcucaaggucucccugcccccuagcgaaggaacagaugaggaagaggaacgggagcuguucggccuucaguuuaugcacaccuauauccaagagucucgcagacgggcugaccaucagguuaauggcuccacaacccuccccauuagcaucaacaccgauggguga

SEQ ID NO: 71637 - RNA, 2061 nt, Artificial Sequence
  derived and/or modified sequence opt5 from LRRC49__Homo_sapiens__NP_060161
augauccccggcaaguacagaagcguguccgggcgggccgcuaacaaugucaacugcggacugcaccucguuauucagaccucuagccugccugagaaaaauaagguggaguucaaacuuaacaaggacacauccucuuuuccgggccgccugcuccaacaugaucuggagagaaauuauagcucccggcagggggaccacaucaaccuugugucuagcucccugagcucuuuccccauucuccagcgcuccagcgaagagaaaauccuguacucugauagacugucccucgaacggcagaagcugacggucuguccuauuaucaauggagaggaccaucuucgccugcucaacuuucaacacaauuucaucacccggauucagaacaucagcaaucugcagaaacuuauuucucuggaucucuaugacaaccagaucgaggaaauuuccggccugagcacacugagaugccuccgcgugcugcuucuggggaaaaauagaaucaagaaaauuuccaaccucgagaaucugaagucucuugauguucuggaccuccauggaaaccaaaucaccaaaaucgaaaacauuaaucaccugugugagcugcgggugcucaaccuggcccgcaauuuucuuagccacgucgauaaccugaauggccucgacucccugacagagcuuaaccugagacauaaucagaucaccuucgugcgggauguugacaaccuccccugccugcagcaccuguuucucagcuucaauaacauuucuuccuuugauagcgugucuugucuggcggacagcuccucucuuagcgacaucacauucgauggcaauccuauugcucaggaauccugguacaagcauaccguccugcaaaacaugaugcagcuccgccagcuggacaugaagagaaucacggaggaagaacggagaauggccagcgugcuggccaaaaaggaagaggagaaaaagcgcgaaucucacaaacaaucccuucucaaggagaaaaagcggcugaccaucaauaacguggcuagacagugggaucugcagcagcaacgcgucgccaauauugcuacaaacgaagaccggaaggauagcgacucuccccaggauccuugccagaucgacggguccacccucagcgccuuuccggaggaaacaggaccccuggauuccggccuuaacaaugcgcugcaggggcucucuguuauugacaccuaucugguggagguggauggagacacgcugagccuuuacggcuccggggcccucgagucucuggacagaaacuggagcguccaaacagcuggaaugaucaccacaguguccuucaccuuuauugaguucgaugaaaucguucaggugcugccuaaacucaagaucaaauuccccaauagccugcaccuuaaguuuaaagaaaccaaccuggucaugcuccagcaguucaaugcccuggcucaacugcgccggauugaccagcuuacaaucgauccucagggcaaccccgugguuaauuuuacgcucuggaaguauuacgugcuguucagacugucucauuuuuccaugcagaagauuaacggcaccgaggucacacaaaaugacaugaucauggccgaacgccucuucgggauucuggcgcacguggccagcucugagcuuccgcaguaccggcugaucuccauucucggagaugcuagaaagaagcaguuucgcuaucugcuggagagcaaaggcaagaaaccugggaucaucaacgaagagaauaacgacucuaagcggcuugucggagaaaauaccaacagagccacacucaauuacaccacgcgggauuucuauaacgagaagcuggaggaaauuaaagagaagaaaaaguuuuguaaaacauacaucgaagaccuggugaaggaggcuaccgaaauuaacaugaagaaugaggcccuccaaaaacuguggccccagauguucaucgagcuuguucgcgaugccgugauugaaaucagaaacaagaauagcuauaugaaacugugccuccagcagaucaccgaccaaaaguga

SEQ ID NO: 71638 - RNA, 2142 nt, Artificial Sequence
  derived and/or modified sequence opt5 from LRRC4B__Homo_sapiens__XP_011525822
auggccagagcucggggcagccccugcccuccgcugcccccugggcgcauguccuggccccacggagcccuccuguuccuuuggcuguuuucuccuccccucggcgcugggggaggcgggguggcggucaccagcgccgccggaggcggcuccccuccggcuacaucuugucccguugccugcagcuguuccaaccaggcuucuagagugaucugcacgcggcgcgaccuggccgaggugccugcgagcauucccgucaauaccagauaccuuaaccugcaagaaaaugggauccaggugauucggacagauaccuucaagcaucuccgccaccuggagauccugcagcucuccaaaaaccugguuagaaagauugaagugggagccuuuaauggccuuccuagccugaacacacucgagcuguucgacaaucggcuuaccacaguccccacccaggcuuuugaauaucugucuaaacuccgcgagcuguggcugagaaacaauccgaucgaguccaucccuagcuacgccuucaaccgggugcccucucuccgcagacuggaucuuggggaacugaagcggcucgaguauauuuccgaagcugccuuugagggacugguuaaucuucgcuaccugaaccucggcauguguaaucugaaagacaucccuaaccugacggcgcucgugagacuggaggaacuugagcugagcgggaaucggcucgaucugauuagacccggaucuuuccaaggccuuaccucccugcgcaagcucuggcugaugcaugcccaggucgcuacaaucgaacggaacgccuuugacgaucucaagagccuggaggaacugaaccuuucccacaauaaccugaugucucucccccaugaccuguucaccccucugcacagacuugagcgcgugcaccucaaucauaacccguggcacugcaauugugaugugcuguggcugagcugguggcucaaagagacaguccccuccaacaccacgugcugugcucggugccaugccccugccggccugaaggggagauauauuggagaacuugaccagagccacuuuacauguuacgcucccguuaucguggagccucccaccgaucugaaugugacagaaggcauggcggccgagcucaaaugccgcaccgggaccucuaugacauccgucaacuggcugacgccgaauggaacccugaugacacacggcagcuaucgggugagaauuucuguucuucaugacgggacccucaacuucacaaaugugaccguccaggauacgggacaauacacaugcauggugaccaacagcgcuggcaauaccacagccuccgccacccugaacguuucugcuguggacccugucgccgcgggcgggacaggaagcggcgggggaggccccgggggcuccggaggcgucgggggaggcagcgggggauacacguauuuuaccacagugaccguggaaacacuggagacccagccuggcgaggaagcucuccagccccgcgggacggagaaggaaccucccggcccgaccacagacggaguuuggggcgggggacggccuggcgaugccgccgggcccgcuucuuccagcaccacagcccccgcuccuagaucuucccgcccgaccgagaaagccuucacggugcccaucacagacgucaccgaaaaugcgcugaaggaucuugacgaugugaugaagacaaccaaaaucauuaucggauguuucguugccauuaccuuuauggcugccgugaugcuggucgcuuucuacaagcuccggaaacagcaccaacugcauaagcaccauggcccuacaagaacgguggagaucauuaacguggaggacgaacugcccgccgcgagcgccguuuccgucgcugccgcugccgccguggcuucugggggcggagugggcggggauagccaccuugcgcucccugcccuggagcgggaccaccugaaccaucaccauuaugucgcugccgccuuuaaagcucacuacuccucuaaucccagcggaggcgggugcggaggcaaggggccucccggccucaacuccauccacgaaccgcugcuuuucaaaagcggaucuaaggagaaugugcaggagacccagaucuga

SEQ ID NO: 71639 - RNA, 1923 nt, Artificial Sequence
  derived and/or modified sequence opt5 from LRRC4C__Homo_sapiens__NP_001245348
augcugaacaagaugacccuccacccccagcaaaucaugauuggcccuagauucaaucgggcccuguuugacccgcuucuggugguccuccuggcucugcagcugcucguuguggccgggcuggugcgcgcgcagacaugccccagcgucuguuccugcucuaaccaguucagcaaagugaucuguguuagaaagaaucugcgggaggugccugauggaauuuccacgaacacccgccuccugaaucuucaugaaaaccaaauccagauuaucaaagucaauucuuuuaagcaccugagacaucucgagauccugcagcuuagccggaaccacauucgcacaaucgaaauuggcgcuuucaaugggcuggccaaccucaauacccuggagcuguuugacaacagacucacaaccauccccaauggagccuucguguaccuguccaaacuuaaggaacuguggcuccggaacaauccuauugagucuauccccagcuaugcuuuuaaccgcauuccuucccugagacggcuugaucugggcgagcucaagcgccugagcuacaucucugaaggggccuucgagggacuguccaaccucagauaucugaaucuugcuaugugcaaccugcgggaaaucccgaaucucacaccccugauuaaacuugacgagcuggaucucagcggcaaccaucugucugccauccgcccuggcuccuuucaggggcugaugcaccuccaaaagcuguggaugauucagagccagauccagguuauugagagaaaugcguucgacaaccuucaaucucugguggaaaucaaucucgcccacaacaaucugacccugcuuccccaugaucucuuuacgccucugcaccaucuggagcggauccaccuccaccauaaccccuggaauuguaacugcgacauucuguggcuuuccugguggaucaaagauauggcuccgagcaauaccgccuguugcgcuagauguaacacaccucccaaucugaagggacgcuacauuggcgaacucgaccagaacuauuuuaccugcuacgccccugucaucguggagccucccgcggaucugaacgugacagaagggauggccgcugagcugaaaugucgggccuccaccucucuuacgagcgucuccuggauuacacccaauggaaccguuaugacacacggcgcuuauaaggugagaaucgccgugcucagcgacgggacccugaacuucaccaaugucacagugcaggauacgggaauguauaccugcaugguuucuaacuccgugggcaauacaaccgccagcgcuacacugaacgucaccgcggccacgacaaccccguucucuuacuucagcaccgugacaguugagaccauggaacccucccaagacgaggcucgcacaacggacaauaacgugggcccuacccccgucguggauugggaaacaaccaaugucacaaccucucucacgccucagagcacccgguccacagagaagaccuuuacaauccccgugaccgacauuaacagcgggaucccgggaauugaugaaguuaugaaaacgacaaagaucauuaucggcugcuucguggccauuacccugauggccgcugucaugcuugugaucuuuuacaaaaugagaaagcagcaucaccgccagaaucaucacgccccuacacggaccguugagaucauuaacguggacgaugagaucaccggggacacacccauggaaucucaccuuccuaugcccgcgauugagcaugaacaccucaaucauuacaacuccuauaaaagcccuuucaaucacacgaccacagucaacaccaucaacucuauucacuccagcgugcaugagccccugcugaucagaaugaacuccaaggauaaugugcaagaaacacagaucuga

SEQ ID NO: 71640 - RNA, 1962 nt, Artificial Sequence
  derived and/or modified sequence opt5 from LRRC4__Homo_sapiens__XP_011514763
augaagcugcucuggcaagugaccguccaccaucacacauggaacgccauccugcuucccuucguuuaccugacggcucagguguggauucucugcgccgcgaucgcugccgccgcuagcgccggcccucagaauuguccguccgugugcucuuguagcaaccaguuuuccaaagucgugugcaccagacgggggcugucugagguuccccagggcauuccuagcaauacacgcuaucuuaaccugauggaaaauaacauccaaaugauucaggcugacaccuucagacaucuccaccaucuggaggugcugcagcucggacgcaauuccauccggcagaucgaagucggggccuuuaacggacuggcgucucuuaauacacuggaacucuucgauaacuggcugaccgugauucccagcggcgccuuugaguaccuuuccaagcugagagagcucuggcugcggaauaacccuaucgagagcauucccucuuaugcuuucaaucgcguuccuucccugaugagacucgaccugggggaacuuaaaaagcuggaguacaucagcgaaggagccuuugagggccucuucaaccugaaauaucuuaaucugggcauguguaacauuaaggauaugccgaaccucacaccccugguggggcuggaggaacucgagaugucuggaaaucacuuuccugaaauccggcccggcuccuuccacgggcugagcucucuuaagaaacugugggucaugaacucccaagugagccucauugagcgcaaugcuuuugacggacuggccucccuuguggaacugaaccucgcgcauaauaaccugucuagccugccucacgaucucuucacgccccugagauaccuugucgagcugcaucuccaccacaauccguggaacugcgacugugauauccuguggcuggccugguggcuucgggaguauaucccuaccaauucuaccugcuguggccgcugccaugcucccaugcacaugagagggcgguaccucguugaaguggaccaggccagcuuucaguguucugcuccuuucauuauggaugcuccccgcgaccugaacaucuccgagggaagaauggccgaacugaagugccggacacccccuaugagcucugugaaauggcuccugccgaauggcaccguccuuagccaugccuccagacacccccgcauuucugugcugaacgauggcacacucaauuucagccauguucugcuguccgacaccgggguguacacgugcauggucacaaacguggcgggaaauagcaacgccucugcuuaucuuaacguuuccaccgccgagcucaauacaagcaacuacuccuuuuucaccaccgugacagucgaaacgaccgagaucuccccugaggauacaacccggaaguauaaacccgugccuacaaccagcacgggcuaccagcccgccuauacaaccuccaccacaguccugauucaaaccacaagagugccgaagcagguugcugugccugccacggacaccacagacaagaugcagaccucucuggaugaagucaugaaaacaaccaagaucaucauuggguguuuuguggcgguuacgcuccuggcugccgccaugcuuaucguguucuacaaacugcgcaagcggcaccaacagagaagcaccgucacagcugcccgcaccguggagauuauccagguggacgaagauauucccgcugccacauccgcggccgcuaccgccgcuccuucuggaguuagcggcgagggggccgucgugcuccccacgauccacgaccauaucaauuauaacacauacaaaccugcgcacggagcccauuggaccgaaaauucccugggcaacagccugcaccccacagugaccaccauuucugagccguacaucauucagacacacacgaaggauaaaguccaagagacccagaucuga

SEQ ID NO: 71641 - RNA, 942 nt, Artificial Sequence
  derived and/or modified sequence opt5 from LRRC52__Homo_sapiens__NP_001005214
augagccuggccuccggccccgggccuggauggcuccuguucucuuuuggcauggggcuugugagcggauccaagugcccgaacaauugucugugccaggcucaagaggucaucuguaccggcaaacagcucacagaauacccccuggacauuccucuuaacacgagacggcuguuccucaaugagaaccgcaucaccucucugcccgccaugcaccuggggcuccugagcgaucuuguuuaucuggacugccagaauaaccggauuagagaagugauggauuacacauuuaucggaguguucaagcucauuuaucuggaccuuuccucuaauaaccugaccagcaucuccccuuuuacauucagcguccucucuaaucuggugcagcugaacaucgcgaauaacccccaucuccugucccuucacaaauuuaccuucgcuaauacaaccagccugcgcuaccucgaucugagaaacacgggccuucaaacccuggacucugccgcccucuaucaucugacaacccuggagacacucuuucuguccggcaauccuuggaaguguaacugcagcuuccuugauuuugcuauuuuccugaucguuuuucacauggacccgucugaugaccucaacgccaccuguguggaacccacggagcugacaggguggccuauuacccgggucggaaauccccuucgcuacaugugcaucacacaucuggaucacaaagacuauauuuuccuccugcugaucggcuucuguauuuuugcugccgggaccguggcggccuggcucaccggaguuugcgcugugcuguaccagaacacaagacacaaguccagcgaggaagaugaggacgaagccggcacgcgggucgaggugucccgcagaaucuuccagacccagacaucuagcgugcaagaguuuccucagcuuaucuga

SEQ ID NO: 71642 - RNA, 924 nt, Artificial Sequence
  derived and/or modified sequence opt5 from LRRC59__Homo_sapiens__NP_060979
augaccaaggccggcagcaaagggggaaaccugagagacaagcucgauggcaaugagcuggaccuuucccugucugaucucaacgaagugcccgucaaagagcuggcugcccuuccuaaggcgacaauccuggaccucagcugcaauaaacugacgacccugccguccgauuucugugggcucacacaccugguuaaacuugaccugucuaagaacaaacuccagcaacugcccgcugauuuuggacggcuugugaaucugcagcaucucgaccugcugaacaauaagcucgugacccugccugucagcuucgcccagcuuaaaaaccugaaguggcucgaucugaaagacaauccccuugauccugugcuggccaagguugcuggcgacugccucgaugaaaagcaguguaaacaaugcgccaacaaggugcugcagcacaugaaagcuguccaggccgaccaggagcgcgaaagacaacggcgccuggagguggagagagaagcggagaagaaacgggaagccaagcagcgcgcuaaagaggcccaggagagagaacuccggaagcgcgagaaggcugaagagaaagaaagacggcgcaaggaguacgacgcccugaaagcggccaagagagagcaggaaaagaagcccaagaaagaggcuaaucaagccccuaaguccaaaucugggagccggccgcgcaagcccccucccagaaaacauacacgguccugggcuguucuuaagcugcuccugcuucugcuccuguuuggaguggccggcggccuggucgccuguagagugaccgaacuccagcagcaaccucugugcacaagcgugaacaccauuuaugauaaugcuguccaggggcuucgccggcacgagauccugcaguggguucuccagacggacucucaacaguga

SEQ ID NO: 71643 - RNA, 780 nt, Artificial Sequence
  derived and/or modified sequence opt5 from LRRC61__Homo_sapiens__XP_011514822
auggaucccccugccgagaagccgggcgaagcugggggacugcagaucacaccccaacuccugaaaagcagaaccggcgaguucucccuugaaucuauucugcuccugaaacuucgggggcugggacucgccgaccugggcugccugggggagugucucggacuggaauggcuugaccugagcggcaacgcgcucacgcaccugggcccucuugcuucccugcgccagcucgccgugcugaaugucucuaacaauagacugaccgggcucgagccccuggccacaugcgagaaccuucagagccugaaugcugccggaaaccuccuggcuaccccuggccagcuucaaugucuggccgggcuccccugccuggaauaccugcggcuccgcgauccucuggcgagacuuuccaauccgcugugugccaaccccucuuauugggcugccguucgggagcuccugccuggacuuaaggugaucgacggcgaacgcgugauugggagaggaagcgaguuuuaccagcugugccgggaucucgacuccagccugcgccccucuuccagcccuggccccagagcuacagaggcccagccgugggucgaaccuggcuauugggagucuuggcccucccggucuagcuccauccuggaagaggcgugucgccaguuccaagauacccuccaggaaugcugggaccuggauagacaggccagcgacucccuugcucaggccgagcaagugcugucuagcgcugggccuacauccagcuuuguuuucuga

SEQ ID NO: 71644 - RNA, 1764 nt, Artificial Sequence
  derived and/or modified sequence opt5 from LRRC63__Homo_sapiens__NP_001269389
augcagaagcccccucugcuccugagacggccgcuucccccuaaauucaccaagcugagccuccacgagaaaaagacacauacggccaaaaccggcaagaucgaaucccugcacguggcuuuuacagaggacgaaaccacaucuauuaagauggaucgcaccagauuccccgacguccuucggaaccaaagccugacaccuaucaauauucagaacaucuuucucgaucauugcguucaggagcgcgugaccgccauuuccucuccccagaaaagcacgaagcacgugagagaacaaaucccugacaccgcgacaggguccaucuucuuuccgcauuguaauucugcuagcacccggauuuucggaaaacagacaaacaagauggaguccagccgcaaauuuaagaccaugaaggaugucuacacggagaaaagacuggaaaauauccugauucucucuuccaaguucagcaaacccaagucuacaccuggcuccgugaucgcccagaaacuggagaagaugcaccccaaacaccagccucuucccgaaagcccgggguauaccuaccaacauauuucucgggaccuguccgccacaguuccuagcccuccucccaugaccguguccaugaagcccgagggacaguggcccgagcacuuuaagucuaccgcuacacucacgcugcgcgucaccgaguucccgggcuuugugagccuucccacaccuguucugcccagaaaaccucaucggcaguccgugaucgaaacccucgucacagaaaacgggaauauugagagcgugcccaagcagaucccgccuagacccccugaaggacugaccaaaacggagaagaucgagucugaaauucacgugguccgcggcgagggcuucaaaacaguugccgcuacccgguaugaaaccaucacagccaugaccaaccuggcgauugugaauugccaaguguacgggcgcaacgcccucaaucugaagggauuuuucauccuuaacugucccgaucugacaccucucgcuuuccagcugauuuaucuuaaucuguccuuuaacgaccuccacuacuuccccacggagauccugugccugaagaaucuccagauccugaaacuuagaaacaacccgauuaaggaaaucccuagcgagauucaacagcuggaguuucuccggaucuucaccauugccuuuaaucugaucacaguccuucccaucggccuguucucucucagcuaucuggaggaacuggauguguccuacaacgaacucaccuuuauucccaaugagauccagaaacugagaucucuugaaaagcugacaguugacgggaacgagcucagcuucuuuccucauggcauucugaaacugaaucuuaccaagauccaguucgagaacaauuuuacgcacccguguuucuggcgcgauaacuaccucaauaacccccaacagcugacccagauuaucucccuguuuauugugcagaauaagcuccauaaauucuaugacaagaucccugucgaagugcaaaaacugcuuaagugcacaagccggugugaguggugccacggacccaaauucggggaaggauuuagaguuauccgcucuugugauauuuucggcgcuucccagcugccugugauguuuuacgucugcagccccucuuguuaucggagaaucaaggaguccagcuucgugcucgacggcuccccuucucgccggauugcccuggacgucgagcugagcaaggaacuuuga

SEQ ID NO: 71645 - RNA, 1044 nt, Artificial Sequence
  derived and/or modified sequence opt5 from LRRC69__Homo_sapiens__NP_001123362
augaccgagagacugcucaucaaggcccugagcggcgggaaaaacacaaagauuaucacgcuuaauggcaaaaagaugaccaaaaugcccuccgcucugggaaagcucccugggcugaagacacuugugcugcagaacaaucucauuccgaaagucugccccgaacuguguaaccugacccaacucacaacccugaaucuuggaaacaaucugcucgaggaaguuccugaggaaaugaaguaccugacaucucuuaaaaaccugcaccucagcggcaaucggaucugccgcuucgcccccggggcgugugacggacugcagaaccugauucuccugaaucuuaacaauaaccaucugacccagcucccucaggagguguccagacugaagucucuuacguauaugagcaucaauuacaaccaacuggcuuccaucccccgggagcucugcuuucuggaaaaccugguggagcuccagcugaauuauaaccagcuuauuuguaucccugaagagauuaaauuccugaagaagcuccagaaacugcuucuggcccgcaauaacaucggcguccucccggaggaacugugcgaucugaagaaacuccggauucuggacaucgccggcaauauuauccaaaucuuucccucuggguuccaggaucuuaagcugagagaguuuuacugugaaggaaacccucucuuccugcagcagcccgugauuagcacccaacaggagaauguuuggucccugcaggaaaucacaagccgcuuugugaugaaccaacuugcugagaauaacccuuuccucauggacgauauugagagauauccccagguccggucuaugaucucccagggcaaaaccugcgccauuugugggcaguacuuuaucacaguguggcuggaaugcguucgcuucgugccgccucccaaggacuggaaaaucagcaagaaucugaagcucgucccucugcaagugcuuauuuguucuuauaaaugcuuuacccagagagaucccaaccuguucggaaucgcucagguguga

SEQ ID NO: 71646 - RNA, 1401 nt, Artificial Sequence
  derived and/or modified sequence opt5 from LRRC6__Homo_sapiens__NP_036604
augggcuggaucaccgaggaccugauuagacggaacgccgaacacaaugauugcgugaucuucagccucgaggaacugucccuucaucagcaagagauugaacgccuggagcacaucgacaagugguguagagaucucaaaauucuguaccuucagaacaaucugaucgggaagaucgagaacgucucuaaacucaagaaacuggaauaucugaaucucgcucugaacaauauugagaagaucgaaaaccuugagggaugcgaggaacuggccaagcucgaccugacaguuaauuuuauuggcgagcuuagcuccaucaaaaaccugcagcauaauauucaccucaaggaacuguuccugauggggaaccccugugcgucuuuugaucauuaccgggaguucgugguggcuacgcucccucagcugaaauggcuugacggaaaggaaaucgagccgagcgagcgcauuaaagcccugcaagauuauuccgucaucgaaccccagaucagagagcaggaaaaggaccacugccucaagcgggccaaacugaaggaggaagcucagcgcaaacaccaagaggaggauaagaaugaagacaaaagaucuaacgccggcuuugaugggcggugguacaccgacauuaaugcuacacuuagcucccuggagagcaaggaucaucuccaggccccugacaccgaagaacacaacaccaaaaagcuggacaacucugaagaugaccuggaguucuggaauaagcccugucucuuuaccccugagucccgccuggaaacacuuagacauauggagaaacagcggaagaaacaggaaaagcugagcgagaaaaagaagaaagugaagcccccucgcacccucaucacggaggauggaaaagcgcugaacguuaaugaaccgaagauugacuucucucuuaaagauaacgagaagcaaaucauucuggaccucgccguguauagauacauggauaccucccugaucgacgucgaugugcagcccacauauguucgggugaugaucaagggcaaaccuuuucagcugguccuccccgcugaagugaagccugacucuagcuccgccaaacgcagccaaaccacaggccaccuggugauuugcaugcccaaggucggggagguuaucaccggaggccagagagcuuucaaauccaugaagacgacaucugaucggagcagagaacagaccaauacacgcuccaagcacauggagaaacuugagguggacccgagcaagcauucuuuuccugacgugaccaacauuguccaggagaaaaagcacacaccccggagacgcccugagcccaaaaucauucccuccgaagaggauccuacauucgaagacaauccggaggugcccccucugaucuga

SEQ ID NO: 71647 - RNA, 1467 nt, Artificial Sequence
  derived and/or modified sequence opt5 from LRRC74A__Homo_sapiens__NP_919263
augcacauccaguuccccagcaagccuacccugccgagagccugcugggagggccggauuacagcugggucccccggaaugccucccgacgaaaucgagauugaaccugugcgccaaucuagcgauaaaaugcucuacugugaggccgaaucucccccuacggucgagaagguuaaaccggcgagagagaacuccgaaaccgaccuggagaucgaagaugacgagaaguuuuucacaaccggccagaaagagcuuuaucuggaggcuugcaagcucauggggguggugcccgucagcuacuuuauucggaauauggaagaauccuaugugaaccugaaucaucacggacuuggcccucgcgggacaaaggccaucgccaucgcucugguuucuaacauggccgugaccaaacucgagcuggaagauaauuguauuauggaggagggaguccugagccucguggaaaugcugcaggagaacuacuaucuucaggaaaugaauaucuccaacaaucaucugggccucgagggcgcuagaauuaucagcgacuucuuugaacggaacucuuccagcauuuggucucuggagcuuuccgggaaugauuucaaggaggacagcgccgcgcugcucugccaagcccugucuacaaacuaccagaucaaaaagcuggaucucucccacaaucaguuuagcgacguuggaggcgaacaucuggggcagaugcuugcuauuaacgugggacugaccucccucgaucugucuuggaauaacuuccacacgcgcggcgccgucgcucuuuguaacgggcugagaggaaaugugacccucacaaaacuggaccugagcaugaacggcuuuggcaaugagguggcccucgcgcugggggaaguccuucggcugaaccgcugccucguuuaucuggauaucggaggcaaugacaucgggaacgagggagccuccaagauuagcaagggccuugaaucuaaugagucccugagagugcucaaacuguuccugaaccccaucaauauggacggggcuauucuccugauccuugccauuaagcggaacccuaaaagccgcauggaggaacuggauaucucuaaugugcucgucagcgagcaauuuaugaagacccuggacggaguguacgcuguucacccccagcuggauguggucuucaaagccgugcagggccuuuccccgaagaaaacaaucuuucuccugaccaacccuaugaagcugauucagucuuacgccgaccaacauaagaucacgauuguugauuucuucaaaagccucaaucccacaggcaccaugaagauguccguggacgaauuucagaaagucaugaucgagcagaacaaggugccucugaaucaauaucaggucagagaggugauuaaaaagcuggaugaaaagacagggaugguuaacuucagcuuucuuaacaccaugaaacccuga

SEQ ID NO: 71648 - RNA, 4944 nt, Artificial Sequence
  derived and/or modified sequence opt5 from LRRC7__Homo_sapiens__XP_011540138
auguggauggagaaccugaucagaggccggaaucccccucaguaccaacgcagcccgugcaaggaagugagagccgcucuccggaaacgccccgaggaagaacugcagugucuugaaaugaccacaaagagaaaaauuaucgggcggcuggucccuugccgcuguuucagaggagaggaggaaauuaucuccguucucgacuauucucacugcagccugcaacaggugcccaaggagguguuuaacuucgaacggacgcuugaggagcuguaccucgaugccaaucagauugaagaacugccuaaacagcuguuuaacugucaggcgcuccgcaagcuguccauccccgacaaugaucuuucuaaccugccuaccacaaucgcuagccucgucaaucugaaggaacuugacauuuccaaaaacggcgugcaggaguucccggaaaauaucaagugcuguaaaugccugaccauuaucgaggccucuguuaaccccauuagcaagcucccugauggguuuacacaacugcugaaucucacccagcuguaucuuaacgacgccuuccuggaguuucuccccgcuaauuucggaagacuggugaaacuucggauccuggaacuccgcgagaaccaucugaagacacugccuaaguccaugcacaaacucgcccagcuggaaagacuugaucugggcaauaacgaguuuggggaacuccccgagguccuggaccagauucaaaaccuucgggagcuguggauggauaauaacgcucuccaggugcugccgggaagcaucggcaagcugaaaaugcucguuuaccuggacaugucuaagaaucgcaucgaaaccguggauauggacauuuccggcugugaggcccuugaagaucugcuccugagcucuaacaugcugcagcaacuuccugacuccaucgggcuccugaaaaagcugacgacccucaaagucgacgauaaucagcugacaaugcuucccaacaccauuggaaaucugagccuccuggaggaguucgacugcucuuguaacgagcuggagucccuuccuagcacaaucggcuaucuccauucccugagaacccuggcgguggaugaaaauuuucuccccgagcugccccgggaaauugggucuugcaagaacgugacggucaugagccuuagauccaauaagcuggaguuccucccugaggaaaucggacagaugcagaaacugcgcguucugaaccuuagcgacaaucggcucaagaaccugccguuuucuuucacaaaacugaaggagcucgccgcucuguggcuuuccgauaaucaaagcaaagcccugaucccccuccagaccgaagcucacccugagacaaagcagagagugcugaccaacuacauguucccccagcaaccucgcggcgacgaagauuuucagucugacagcgauuccuucaaccccacccugugggaggagcagcggcagcaaagaaugacaguggccuuugaguucgaggacaagaaagaagaugacgagaaugcggggaaggucaaagaccuuucuugccaggccccgugggaacgcggacagcggggcauuacgcuccagccugcuagacugagcggcgauuguugcacccccugggcccgcugugaccaacagauccaggauaugccugugccccaaaacgacccucagcuggcuugggggugcauuuccggacuccagcaggagcggagcauguguacaccccugccgguugccgcccaaucuaccacacuuccuucccugagcggcagacagguggagaucaaucucaagcgcuaucccacccccuacccugaagaucugaaaaacauggucaagucugugcagaaucugguugggaagccgucccauggagugcgggucgagaacagcaaucccacggcuaacacagaacagaccgugaaagagaaguacgaacacaaauggccugucgcgcccaaggagauuaccguggaggacuccuuuguucacccugccaaugaaaugagaaucggcgagcuucaucccucucuggcugaaacaccucucuaucccccgaaacuggugcuccuggggaaggauaagaaagagagcaccgacgaguccgaagucgauaagacacacugccuuaacaauucugugagcuccggaacguacagcgacuauucuccuucccaagccagcucuggcuccagcaacacccggguuaaagugggcucucugcagacaaccgccaaggaugcuguccauaauagccucugggggaaccgcaucgcccccuccuucccucagccccuggacagcaaaccgcugcuuucucagagagaggcggugccucccggaaauauuccucaacggcccgauagacugcccauguccgacacauuuaccgacaacuggacggauggcagccacuacgacaacaccggguucguggcugaagagacaaccgccgaaaaugccaacuccaauccucuccugucuagcaagucccgcucuacaagcucccacggacggagaccgcucauccgccaggauagaauuguuggcgucccccuggagcuugagcagucuacccaucggcacacgccugaaacagaggugcccccuagcaaccccuggcaaaauuggacccgcacaccuuccccguuugaagacagaaccgcuuuccccagcaaacuggagaccacaccuacgaccucuccccucccugaacggaaggagcauaucaaggaguccacagaaauucccagcccguuuucuccuggggugcccugggaguaucacgauuccaaccccaaucgcagccugucuaacgucuucucccagauccauuguagaccugaaagcuccaaaggcgugauuagcaucucuaagagcaccgagcggcugagcccccuuaugaaagacaucaagucuaauaaauuuaagaagucccaguccauugaugaaaucgacauuggaacauacaaaguuuauaacaucccucuggagaauuacgccucuggcagcgaucaccucgggucccacgagcgcccggacaagaugcugggacccgaacauggcaugucuagcauguccagaagccagucugugccuaugcucgaugacgagaugcugaccuacggguccagcaaaggaccccaacagcagaaggcuucuaugacgaaaaaggucuaucaguucgaucaauccuucaacccucagggcagcguggaaguuaaggccgagaaacggauucccccgccuuuucagcacaaucccgaguacgugcagcaagcguccaagaacaucgccaaagaccuuaucucuccucgcgcuuauagaggguaucccccuauggaacagauguucagcuuuucccagcccagcgucaaugaggacgccgugguuaacgcucaguucgccucucaaggcgcgcgggccggauuucugagacgcgcugauucccuggugagcgccacagaaauggcuauguuccggagagucaacgagccgcaugaacucccucccaccgaccgcuacggccggcccccuuacagagggggacuggaucgccagucuagcgugaccgugacagagucccaguuucuuaagcggaauggcagauaugaggacgaacacccgucuuaccaagaggucaaagcccaggccgggagcuuccccguuaagaaccugacccagcgccggccucucuccgcuagaucuuacagcacagaauccuauggagcgagccagacgcggcccgugucugcccgcccuaccauggcugcccugcucgagaagauucccuccgauuacaaucugggcaacuauggggacaaaccuagcgauaauuccgaccuuaagacaagaccgacccccgugaaaggcgaagagucuugcggaaagaugccugccgauuggcggcaacagcugcugcgccacaucgaggcuagacggcucgacagaaacgccgcguacaaacauaauacagucaaccugggcaugcuucccuaugggggaauuagcgcuaugcacgccggccgcuccaugacccugaaucuccagacgaagucuaaauuugaucaucaggaacugccucuccaaaagacccccagccagcaguccaacauccuggacaaugggcaggaggacgugagcccgucuggacaauggaacccuuacccccuuggccggagagauguucccccugacacaauuaccaagaaagccgggucccacauccagacacugaugggcagccagucucugcaacaucgcucccgggaacagcagcccuaugagggaaauaucaacaaggugaccauucagcaauuccagagcccucucccgauccagauucccucuagccaggcuacaagaggcccucaacccgggcgcugucugauccagaccaaaggacagcgguccauggauggcuacccugaacaguuuugcgucagaauugagaagaaucccgggcuuggauucucuaucagcggcggcaucuccgggcaaggaaacccguuuaaaccuagcgacaagggcauuuucgugacgcgcguucagcccgaugggccugccuccaaucugcuccagcccggagacaagauccugcaggcgaacggccacucuuucgugcacauggagcaugaaaaagcuguccuccugcuuaagagcuuucaaaacacaguggaucugguuauucagcuguucccucucagagggcugcuuuuuggacugaauguggagaaagccuccggcucugaaaagaaacucaucaccgucgacccccacuacagcugggugcuguaucugcagaccugucuccuuacaaagguguacaccccgaaguccaugugcggcacgucugaggucauucauaaacaagcccagcggagcaagaaacuggaguccccucacgggcauguuccccgcuga

SEQ ID NO: 71649 - RNA, 2433 nt, Artificial Sequence
  derived and/or modified sequence opt5 from LRRC8A__Homo_sapiens__NP_062540
augauccccgugaccgagcugagauacuucgccgacacacagccugcuuaucggauucucaagccguggugggaugucuuuacggacuacaucagcauuguuaugcugaugaucgccguguucggcgggacccuucaagugacacaggauaaaaugauuugccugcccuguaagugggucaccaaagacuccugcaacgauucuuuucgcggaugggcggcuccuggccccgaaccuacauaucccaauagcaccauccucccuacaccggacaccgggcccacgggaaucaaguacgaucuggacagacaccaguauaacuacguggaugccguuuguuaugagaaucggcuucauugguucgccaaauacuuuccuuaccuggugcuccugcacacccugauuuuccucgcuugcuccaacuuuugguucaaguuuccccgcacaucuagcaagcuggaacauuucgucuccauccuucugaaauguuuugacucuccuuggaccacaagagcccucagcgagaccgugguugaagaguccgaucccaagccggcuuucagcaaaaugaauggcucuauggacaagaaauccagcacggugucugaggaugucgaagccacagugccuaugcugcagcggaccaagucccgcauugagcaagggaucguggacagaagcgaaacaggaguccuugacaagaaagagggcgagcaggcgaaggcccuguuugaaaaaguuaagaaauuccggacccacguggaggaaggcgauauuguguaucgccucuacaugagacagaccaucauuaaggucaucaaauucauccugauuaucugcuauacaguguacuauguucauaacauuaaguuugacguggauuguacggucgacaucgagucucugaccggguaccggacauaucgcugcgcucacccccucgccacccuguucaagauucuugcuuccuuuuacaucagccuggugaucuucuacggacucauuuguauguauacacugugguggaugcuuagacggucccugaaaaaguacucuuuugaaagcauccgcgaggaguccagcuauucugauauuccugacguuaaaaaugauuucgccuuuaugcuccaccugaucgaccaguacgauccccuguauuccaagagauucgcgguguuucucagcgaagucucugagaacaaacugcggcaacuuaaucugaacaaugaauggacccucgacaagcugagacagcgccuuacgaagaacgcccaggauaaacuggagcuccaucuguucaugcugagcggcauucccgacacaguguuugaccucgucgaacuggaggugcuuaagcuggagcucaucccugauguuaccaucccgcccuccauugcucagcugaccgggcugaaagaacuuuggcucuaccacacagccgcuaagaucgaggccccugcccuggcuuuccugcgggaaaaucucagagcgcugcauauuaaauuuaccgacaucaaggagauuccccuuuggaucuauucucugaagacacucgaggaacugcaccugacgggaaaccuuagcgccgagaauaaccgcuacauugugaucgauggccuccgggaacugaaaagacugaagguccuccgccugaaauccaaccuuagcaagcugccucaagugguuaccgacguggggguccaccuccagaaacugucuaucaauaacgagggaacaaagcugauugugcuuaauucccucaagaaaauggcuaaccugaccgaacuggagcucauccggugcgaucuggagcgcauuccccauagcaucuucucucuucacaaucugcaggaaauugaccucaaggauaacaaucugaaaacaaucgaggaaaucauuuccuuccaacaucugcacagacuuaccugucucaagcugugguacaaccauaucgccuauauuccgauccagauuggcaaucugacgaaccucgagcggcuguaccuuaauagaaacaaaaucgaaaagaucccuacccagcuguuuuauugccgcaaacuccgguaccuggaccugagccacaauaaccuuacauuccugcccgccgauauuggccuccugcagaaucuccaaaaccuggcuaucaccgccaacagaauugagacacuuccucccgagcuguuucagugccggaagcuccgcgcgcugcaccuggggaauaacgugcuucagucccugccuucuagaguuggagaacucaccaaucugacgcagaucgagcuccggggcaacagacuggaaugucuucccgucgagcugggggaaugcccgcuccugaagcgcagcggacuggugguggaggaggaccuuuucaauacacugccucccgaagucaaagagcggcucuggagagcugauaaggaacaagccuga

SEQ ID NO: 71650 - RNA, 2412 nt, Artificial Sequence
  derived and/or modified sequence opt5 from LRRC8C__Homo_sapiens__XP_011540584
augauccccgugaccgaguucagacaguuuagcgaacaacagccugccuuccggguccugaagccguggugggacguuuuuacagauuaccucuccguggcuaugcugaugauuggcguguucgggugcacgcuucaggucaugcaggacaaaaucauuugucugcccaagcgcgugcaaccugcccagaaccacucuagccucuccaauguuucucaggcgguggcuagcaccacaccccugccucccccuaaaccgucccccgccaacccuaucaccgucgagaugaagggacuuaaaacagaucuggaccuccagcaauauucuuuuauuaaucagaugugcuacgaaagagcccugcauugguaugcuaaguacuuccccuaucuggugcucauccacacccugguuuuuaugcuuuguagcaacuucugguuuaaguucccuggcuccagcucuaaaaucgagcauuuuauuuccauccuggggaagugcuucgauagccccuggacaacccgggcccucucugaaguguccggagaggacagcgaggaaaaagauaaucgcaagaacaauaugaacagaucuaauacgauucaguccggcccggaggacagccuggucaacucccagucucuuaaaagcaucccugaaaaguuugugguggauaaguccaccgcuggggcccuggacaaaaaggagggagagcaagcgaaagcccucuucgaaaaggucaaaaaguuccggcugcacguugaggaaggcgauauucuguacgcuauguaugugcgccagacagugcucaaagucaucaaguuucugauuaucaucgccuacaauagcgcucuugugucuaagguucaguucaccguggacuguaacgucgauauucaagacaugacaggcuacaaaaauuuuuccugcaaccauaccauggcccaccuguucagcaagcucucuuuuuguuaucugugcuucgugagcaucuacgggcuuacgugucuguauacacucuacuggcuguuuuauagaucccugcgggaguacucuuucgaauauguucgccaggagaccggaauugacgauauccccgacgugaaaaaugauuuugcguucaugcuccacaugauugaccaguacgauccucuguacagcaagagauuugccgucuuccuuuccgaggugagcgaaaacaaacugaagcagcucaaccugaauaacgaguggacacccgacaagcugcggcaaaaacugcagaccaaugcucauaaccgccucgaacugccccugaucaugcucucuggccugccugauaccgucuuugagaucacagaacuucagucccugaagcucgagauuaucaaaaaugugaugauuccggccacgaucgcucagcuggacaaccugcaagagcuuagccuccaccagugcucuguuaagauucauuccgccgcccugagcuuccugaaagaaaaucucaaggugcuguccgucaaguucgaugacaugagagagcuucccccuuggauguaugggcugcggaaccucgaggaacuguaccuggugggaucucuuagccacgauaucucccgcaauguuacccucgaaucucugagagaccugaaaagccucaagauccuguccauuaaaagcaacgugucuaagaucccccaggcugucguggacguguccagccaccuucagaaaauguguauucauaaugauggcacaaagcugguuaugcucaacaaucugaagaaaaugaccaaccugacagagcuugagcucguccacugcgaccuggaacggaucccucaugcgguguuuucucugcucucccugcaagagcuugaucugaaggaaaauaaccucaaaagcauugaggagaucgugucuuuccagcaccugagaaagcugaccguccuuaaacucuggcauaacagcauuacguauauccccgaacacaucaagaaacugacaucccuggagcgccucagcuuuucucacaauaagauugaagugcugccgucccaucuuuuccugugcaacaagauccgguaccucgaccugagcuauaaugauauuagauuuaucccucccgagauugggguucugcagucccuucaguacuucucuaucaccuguaacaaaguggaaagccugccugacgagcucuauuuuugcaagaaacugaagacccucaaaaucggaaagaacucccugucuguccuuagccccaagauuggcaaucuucucuuccuguccuaccuggaugugaaaggcaaucacuuugagauccuuccucccgaacugggggacugucgcgcccucaagcgggcuggacugguuguggaggaugcccucuucgaaacacugccgucugacgucagagagcaaaugaaaaccgaauga

SEQ ID NO: 71651 - RNA, 3099 nt, Artificial Sequence
  derived and/or modified sequence opt5 from LRRCC1__Homo_sapiens__NP_208325
auggaggccgcugccgcgguggucgcugccgaagccgagguugaaaacgaggacggcgauagcuccugcggggacguguguuucauggauaagggacugcagucuaucagcgaacucucccuggacucuacccuucacgcugugaaucugcauugcaacaauauuagcaaaaucgaggccauugaucacaucuggaaccuccaacaucuggaccuuuccucuaaucagauuagcagaaucgagggccugaacacacucacgaagcuguguacccugaaucucuccugcaaccugaucacaaaagucgaagggcuugaggaacugauuaaucucacccggcugaacgugagcuacaaucacaucgaugaccuuucuggacugauuccccuccauggcaucaagcacaaacugcgcuauauugaucugcacuccaacagaaucgacagcauucaucaccuccugcaguguaugguugggcuucauuuucugacaaaucucauccuggagaaggauggagacgauaacccugugugccggcuuccgggcuaccgcgcugucauccugcagacccucccccaacugcggauucuggacuguaagaauaucuucggcgagccugugaaccucacagaaauuaacucuucccagcugcagugccuugaggggcugcucgacaaucugguuagcucugauagcccccuuaacaucuccgaagacgagauuaucgauagaaugccugugaucaccgcccccauugacgaacuggucccucucgagcaguuugcguccacgccgucugaugccgugcugaccagcuucauguccgugugucaaagcucugagcccgaaaagaauaaccacgagaaugaccugcagaacgaaaucaagcuccagaaacuggaugaccagauucuucaacugcucaaugagacauccaacagcaucgauaauguccuggaaaaggacccucgccccaaaagagauaccgacauuacaucugagagcgacuauggaaaccggaaggagugcaaucgcaagguuccuagacgguccaaaauccccuacgaugcuaagaccauccagacgauuaaacaccauaacaagaauuauaacucuuuugugagcuguaaucgcaaaaugaagccgccuuaccugaaagaacuuuauguguccagcucucucgccaacugccccaugcugcaggaguccgaaaagccuaagacagagaucauuaaagucgaccaaagccacucugaagauaacaccuaccagucccugguggagcagcucgaccaggagagagaaaagcgguggcgcgcugagcaagccgaaaauaaacugauggauuacaucgacgagcuucauaagcacgcgaacgagaaagaagauauucauagccuggcccuccugacaaccgacagacugaaggagaucauuuuccgggaaagaaauuccaagggccagcuugagguuauggugcacaaacuccagaacgaaaucaagaaacugaccgucgagcugaugaaggcuaaagaucagcaagaggaccaccucaagcaucugcgcacacuugaaaagacgcuggagaaaauggaacggcagaagagacagcagcaagccgcucagauccgccucauucaggagguggaacugaaagccucugccgcugaucgggagaucuaucugcuuagaaccagccuccaccgcgagcgggaacaggcgcaacagcugcaucagcugcucgcccugaaggagcaagaacacagaaaagagcuugaaacacgcgaguuuuucaccgacgcugauuuucaggacgcccuggccaaggagauugcuaaggaagagaaaaagcacgaacagaugaucaaagaguaccaggagaagauugacguucucucccaacaguauauggaucuggaaaaugaguuccggaucgcccugacaguggaagcgagacgcuuucaggacgucaaagauggguucgagaacguggcuaccgaacuugccaagucuaaacaugcccucaucugggcucagcggaaggagaaugagagcuccagccugauuaaggaccugacgugcauggucaaagaacaaaagacaaaacucgccgaggugucuaagcugaaacaggaaaccgcugccaaccuucagaaucagaucaacacccuggagauucucaucgaagaugacaagcaaaaguccauucagaucgagcugcugaaacacgagaagguucagcuuaucagcgaacuggcggccaaagagucucucauuuuuggacugagaacagaacggaagguguggggccaugagcucgcucaacagggguccagccuggcccagaaucgcggaaaacuugaagcucagaucgagucucugagcagagagaacgaaugucuccggaagaccaaugaguccgauagcgacgcccugagaauuaagugcaaaaucauugaugaccaaacagaaacgauccgcaagcugaaagauugucuucaggagaaggacgagcacaucaaacggcugcaggaaaagauuaccgagaucgaaaagugcacacaggagcaacucgaugaaaaaucuucccagcuggacgagguccucgagaagcuggaaagacauaacgagcgcaaagaaaaacuuaaacagcagcugaagggcaaagagguggaacucgaggagauuagaaaggcguacagcacccugaaucggaaguggcacgacaaaggcgaacugcuuugucaccuggagacacaaguuaaggaagugaaagagaaguucgaaaacaaagagaagaagcucaaagccgagcgcgauaaguccaucgaacugcagaaaaacgcuauggagaagcuccauucuauggacgaugccuucaaaagacaggucgacgcuauuguggaagcccaccaggccgagaucgcucaacuggcgaaugagaagcagaagugcauugauagcgccaaccuuaaagugcaucagaucgaaaaggagaugcgggaacugcuggaggaaaccuguaaaaauaagaaaacgauggaggcuaagaucaagcaacucgccuuugcccugaacgagauucagcaggacauguga

SEQ ID NO: 71652 - RNA, 1923 nt, Artificial Sequence
  derived and/or modified sequence opt5 from LRRFIP1__Homo_sapiens__NP_001131022
auggacaugggcacccaggggagcggaagaaagcggcugcccaaccgcgagagacucacagccgaagaugacgcucugaaucaaaucgcccgggaggcggaagcucgccuugccgccaaaagagcugcccgggcugaggcccgcgaaauuagaaugaaggagcuggagcggcagcagaaagaaaucuaccaggugcaaaagaaauauuacggccucgauacgaaguggggagacauugagcaguggauggaagauuccgagcgcuauucuagacggagccgcagaaacaccuccgcgucugacgaggaugaacggaugagcgucgggucccgcggcucucugagaagccagccugaccuugaguacgggggaccguaugccuggacaaauggcuacgauggcgaacuguaugggucccagagccucaaccggagaucuggacgccccuccugccuguacagcgcugcccggccuucuggcuccuacagagcuagcguucuggacgaggggucuuucggaggcacccgccggggguccacaagcggauccagagcccccucugaauauagcggccaccucaauuccagcucucgcgcguccagccgggccucuagcgcuagagccuccccugugguggaggagcgccccgaaaaggauuuuaccgagaaaggcucucggaacaugccugggcugagcgcugccacacuugccucccugggaggcaccagcucuagacgcggguccggagacacgagcaucucuauugauaccgaggcuuccauccgggagaucaaggaacucaaugagcugaaagaccaaauucaggacgucgagggcaaguacaugcaggggcuuaaagaaaugaaggauagccuggcggagguggaagagaaguauaaaaaggccaugguuuccaacgcucagcucgacaaugagaaaacaaacuucauguaccaaguggauacccugaaggacaugcugcucgaacuggaggaacagcuugccgagucuagacggcaguaugaagagaaaaauaaggaguuugaacgcgagaaacaugcccacagcauccugcaauuccaguuugcugaagucaaggaggcccucaagcagagagaagagaugcuggaggaaauucggcagcuucaacagaaacaggcguccucuaucagagagauuagcgaucugcaggaaacaaucgaguggaaggacaaaaagauuggagcucucgaacgccaaaaagaguucuuugauuccgugcggagcgagagagacgaucugcgcgaagagguugugaugcugaaggaagaacucaagaaacauggcaucauccugaacucugaaauugccaccaauggcgagacguccgacacacuuaacaaugucggguaccagggaccgaccaagaugacaaaagaggaacugaacgcccucaagagcaccggcgaugggacccuggacaucagacuuaaaaagcugguggacgagcgggaaugucuccuggagcagauuaagaaacugaagggacagcucgaggaacgccagaaaaucggcaagcuggauaaccuuagaucugaggacgaugugcuggaaaaugggacagacaugcacgucauggaucuccaacgggacgcuaaccgccagauuuccgaucugaaauucaagcuggccaagagcgagcaggaaaucacggcucuugagcaaaauguuaucagacucgagucucaggugagccgguauaaauccgccgcggaaaacgccgagaagauugaagacgagcugaaagcugaaaagcgcaaacugcagagagagcuccggagcgcccuggauaagaccgaggaacuugaggugucuaauggccaucuggucaaacgccucgaaaagaugaaggcuaacagauccgcccugcugagccaacaguga

SEQ ID NO: 71653 - RNA, 1275 nt, Artificial Sequence
  derived and/or modified sequence opt5 from LRRFIP2__Homo_sapiens__NP_001127841
augggcacccccgccagcgggagaaagcggacaccugugaaagaccgcuucuccgcugaggaugaagcccugucuaacaucgcgagagaggcugaagcccggcucgccgcuaagcgcgccgcuagagccgaggcgcgggacauucgcaugagagaacuggagcggcagcaaaaagagcuugaugaaaagagcgacaaacaguacgccgagaauuauacgcgcccguccucuagaaacagcgcuuccgccaccacaccccugucuggaaauagcucccggcgcggcagcggggauaccucuucccucaucgacccugauacaagccugucugaacuuagagacauuuacgaucugaaggaccagauccaggaugucgagggacgguauaugcaaggccucaaggagcugaaagaaucccugagcgagguugaagagaaguacaaaaaggcuauggugucuaacgcccagcucgacaaugagaaaaacaaucugauuuaucagguggauacccuuaaggacgucaucgaggagcaggaagaacaaauggcggaauuuuaccgcgagaacgaagagaaguccaaagagcuggaaagacagaagcacaugugcagcgugcuccagcauaaaauggaggaacugaaggaggggcuucggcagagagacgaacugaucgagaaacacggacucguuauuauccccgauggcacaccuaauggcgacgugucccaugagcccgucgccggggcuauuaccgugguuucucaagaagccgcucaggugcuggagagcgccggagaaggcccucuggauguccgccuccggaagcuggccggggagaaagaggaacuucugucccagaucagaaagcucaagcugcaacuugaggaagaacgccagaaauguagccggaacgacggaacggugggcgaucuggcugggcuccagaauggaucugaccugcaguucauugaaaugcaaagagaugcgaaccgccagaucuccgaguauaaguuuaaacugagcaaggccgagcaggacauuaccacacucgaacagucuaucagccggcuggagggccaagugcuuagauacaaaaccgcugccgaaaaugccgagaaggucgaagaugagcugaaggcugagaaacgcaagcuccagcgggaacugagaacagcccuugacaaaaucgaggaaauggagaugaccaacucccaccuggcgaagcgccucgagaaaaugaaggcuaaucggacggcccugcuggcccagcaguga

SEQ ID NO: 71654 - RNA, 6048 nt, Artificial Sequence
  derived and/or modified sequence opt5 from LRRK1__Homo_sapiens__XP_011520315
auggcuggcaugagccagcggcccccuuccauguacuggugcguggggccggaggaaucugcuguuugucccgagcgggccauggaaacccugaacggagcgggcgacacagggggaaagccuagcacgcgcggcggggaucccgcugccagaucccggcgcaccgagggaaucagagccgcuuaucggcgcggcgacagaggcggggcccgggaucuccuggaagaggcuugcgaccaaugugccucucagcuugagaaaggacagcugcucagcauuccugcggccuacggcgaucuggaaaugguucgcuaucuucuguccaagagacucguggagcugcccacagaaccuaccgacgauaauccggcuguggucgccgcuuacuucgggcacacagccgugguucaggagcugcucgagucucugcccggaccuugcagcccccaacggcuucugaacuggaugcucgcgcuggccugucagcgcggccaccuugggguggucaaacugcucgugcugacccacggagcugacccugaauccuaugccguuagaaagaaugaguuucccgugaucguccggcugccgcucuacgcugccauuaaaagcggcaacgaagauaucgccauuuuccugcuucgccacggcgcuuauuuuugcucuuacauccugcucgacuccccugaucccagcaagcaccuccuuagaaaguacuucaucgaggcgucuccucugcccuccagcuaucccgggaaaacagcccuccgggugaaguggucucaucugagacugccuuggguggaccucgauuggcugauugacaucuccugucagauuaccgaacuugaccugagcgcuaauugccucgccacgcugccguccgucauccccuggggacuuauuaaccugcgcaaacucaaucugucugauaaccaccugggcgagcucccugggguucagagcuccgacgagaucauuuguagccggcugcuugaaaucgauaucucuuccaauaagcugagccaucugcccccuggauuucugcaccugucuaaacuucaaaagcucaccgccagcaagaacugccuggagaaacuguucgaagaggaaaaugcuacaaacuggauuggccucagaaagcugcaggagcuugacaucuccgauaauaaacugaccgagcuccccgcccuguuucugcacucuuucaagagccuuaacucccucaaugugagccgcaacaaccugaaaguguuuccggacccuugggcguguccccugaagugcugcaaggcuucucggaaugcccucgaaugucugccugauaagauggccgucuucuggaagaaccaucuuaaagacguggauuuuuccgagaaugcucugaaggaaguuccccucgggcuguuccagcuggacgcccuuauguuucucagacugcagggaaaccaacuggcugcccucccuccccaggagaaauggacaugccgccagcugaagacccuugaucugagccggaaucaacucggcaaaaacgaagacggccugaagacgaagagaauugcguucuucacaacccgcgggcggcagagaucuggaacagaggccgcuuccgugcuggaguuuccggccuuccuuagcgaaucccucgagguccugugucugaaugacaaccaccucgauaccgugccucccucuguuugccugcuuaaaagccuguccgaacucuaccugggcaauaaccccgggcugcgcgagcuuccuccggagcugggacagcucggcaaucuguggcagcucgacaccgaagaucugacaaucucuaacgugcccgcugagauucaaaaggaagggccuaaagccaugcuuagcuaucugcgggcgcagcucagaaaggccgagaaauguaagcugaugaagaugaucaucgucggacccccucggcagggaaaauccacgcugcuugaaauucugcagaccggccgcgcuccccaagugguccacggggaggccacaaucagaaccacaaagugggagcuccagcggccugcuggaagcagagccaaaguggaaucuguugaguuuaaugugugggacauuggcgggcccgccuccauggcuaccgucaaccagugcuucuuuacggauaaggcgcuguacgugguuguguggaaucucgcccugggagaagaggcugucgccaaccuucaguucuggcugcucaacaucgaagccaaagcuccgaaugccguggugcugguugucggcacacaucuggaccuuauugaggcgaaguuucgcguggagcggaucgcuacccugagagccuaugugcucgcccugugucgcagcccuucuggguccagagcuaccggcuuccccgauaucacauuuaagcaccuccaugaaauuagcugcaaaucucuggagggacaagaaggccuucggcagcugaucuuccacgucaccuguagcaugaaggacgugggguccacaauuggaugccagcgccuggccggcagacucaucccucggagcuaccugucucuucaggaggcgguucuggcugaacaacagcgcagaucccgggaugacgaugugcaguaucucacggaccgccaacuggagcagcucgucgagcagacccccgauaacgacauuaaagacuacgaagaucugcagagcgccaucuccuuucuuauugagacagggacccugcugcauuucccggacacaucucacggacucagaaaucuguacuuucuugauccuaucuggcugagcgaaugucuccaacggaucuucaacauuaagggcucccgcucuguggccaaaaaugggguuaucagagcugaggaccugcggaugcuccuggugggcaccggauucacgcagcagaccgaggaacaguauuuucaauuccuugccaaguuugagauugcucugcccgucgccaacgauagcuaccugcucccucaucugcuucccuccaaacccggccuggacacacaugggaugagacacccuaccgcgaauacaauccagcgcguguucaagaugucuuuuguuccggugggauucuggcagcgguuuauugccagaaugcucaucagccuggcugaaauggaucuccagcuguucgagaacaagaaaaauaccaagucccgcaaccggaaagucacgaucuauagcuuuacaggcaaucaaagaaaccgcugcucuaccuuccgggugaagagaaaucagacaauuuacuggcaggaagggcuucuggugaccuuugacggaggcuaucuguccgucgagagcucugauguuaacuggaaaaagaagaaauccgggggcaugaagaucgugugccaaagcgaggugcgcgacuucucugccauggcuuuuauuaccgaucaugucaauucccucaucgaccagugguuccccgcccugacagccacggaaagcgauggaaccccucuuauggagcaguacgugcccuguccuguuugcgaaacagcuugggcgcagcacaccgaccccuccgagaaaagcgaagacgugcaauauuucgauauggaggacuguguccugacagccauugagcgggauuuuaucucuugcccuagacacccggaccuccccgugccucugcaggaacugguucccgaacucuucaugaccgauuuuccugcucggcuuuuccuggaaaacagcaagcuggagcauuccgaagacgagggcucugugcucgggcagggaggcagcgggacggucaucuaccgcgccagauaccagggacaacccguggccguuaaacgguuucacauuaagaaguucaaaaacuuugcuaaugugccggccgauacaaugcugcgccaucuuagagcgaccgacgcuaugaagaacuucuccgaguuucggcaggaagccucuaugcugcacgcccuccagcauccuuguaucgucgcucugauuggcaucagcauucacccccugugcuucgcccucgagcuugcgccccuguccucucugaauaccgugcucagcgaaaacgcuagagauuccagcuuuaucccucugggccacaugcuuacacagaaaaucgccuaucaaauugccucugggcuggcuuaccuccauaagaaaaauaucauuuucugugaccugaaguccgauaacauccugguguggagccucgacgucaaggagcacauuaauaucaaacuuucugacuauggaauuucccgccagagcuuccaugagggcgcccuggggguugaaggaacccccggcuaccaggcuccugagauccggccgagaaucguguaugaugaaaagguggacauguuuuccuacgggaugguccuguaugagcuccugucuggacagcgccccgcccuuggccaccaucaacugcagauugcgaaaaagcucagcaaaggcauccggccugugcuggggcagcccgaagagguucaauucagacgccugcaggcccucaugauggagugcugggauacaaagccugaaaaacggccccuugcucuguccguggucagccagaugaaggacccgacguuugccaccuucauguacgagcuguguugcggaaagcagacagccuuuuucucuucccaaggccaggaauacaccguggucuuuugggaugggaaagaggaaagcagaaacuauacaguggucaauaccgagaagggacucauggaggugcagcgcauguguugcccuggcaugaaagucucuugccagcugcaagugcagagaagccuuuggacggccaccgaagaccagaagauuuacaucuauacacugaaagggauguguccccucaacaccccucagcaagcccuggauacacccgcuguugugaccugcuuccuggcggucccugugauuaagaaaaauuccuaccucguucuugccggacuggcugacggccugguggccgucuuucccguggugcggggcacaccgaaagauucuuguagcuaucucugcucccacaccgccaaccgcucuaaguucagcaucgcugacgaggaugccagacagaauccuuaccccguuaaagcgauggaagucgugaacuccgggagcgaggugugguauucuaauggacccggccugcuugucaucgacugugcuucccuggaaauuugccggcgccucgagccuuacauggccccgagcauggugacguccguuguguguucuagcgaggggagaggagaagaggucguguggugccuggaugacaaggccaacucccugguuauguaccacucuacaaccuaucagcucugugcucgguacuuuugcggcgugcccagcccucuuagagacauguuccccguccgcccucuggauaccgaacccccugccgcgucccauacagccaacccgaaagugcccgagggggacagcaucgcugauguuucuauuauguauuccgaggaacugggaacccaaauccucauucaccaggagagccugacggacuacuguucuauguccagcuauucuagcuccccuccccggcaggccgcuagaucuccuagcucccuucccagcuccccggccucuagcuccucugugccuuuuagcacagauugcgaagacuccgauaugcugcauacccccggcgcugccucugaccgcagcgagcacgaucucacacccauggacggcgaaaccuucucccagcaucugcaagcggucaagauccuggccgugcgggaucucaucugggugccuagaagagggggcgacgucauuguuaucggccuugagaaggauagcggggcucagcgcggaagagugauugccgugcugaaagcucgggagcugacaccccauggcguccucguggacgccgccguuguggcuaaggacaccgucgugugcacguucgaaaaugagaacaccgaauggugucuggcgguuuggcgcggguggggagccagagaguuugauaucuucuaccagucuuaugaggagcuuggccggcuggaggcuugcacacgcaaaagacgguga

SEQ ID NO: 71655 - RNA, 7584 nt, Artificial Sequence
  derived and/or modified sequence opt5 from LRRK2__Homo_sapiens__NP_940980
auggccagcggauccugccaggggugugaagaagacgaagaaacccugaagaagcucaucgugagacugaauaauguccaggagggaaagcagauugaaacacuuguucagauccuggaggaucuccugguguucacguacucugagcacgcuagcaaacuuuuucagggcaagaacauucacgugccccugcucaucguccuggacuccuauaugcggguggccucuguucaacaggugggguggagccugcucugcaagcugauugaagucuguccuggaaccaugcagucccuuaugggcccgcaggauguggggaaugacugggagguucugggagugcaccaacucauccugaagaugcuuacaguccauaacgcgucugugaaucugagcgugaucggccucaagacccuggaucugcuccugacauccggcaaaauuacccuucugauccucgacgaagagagcgauauuuucaugcugaucuuugacgcuaugcacucuuuccccgccaacgaugagguccagaaacuugggugcaaagcccugcauguucucuuugaacgcguguccgaggaacagcugacagaguucguggaaaauaaggacuacaugauucugcucagcgcucugaccaacuuuaaagaugaggaggaaaucguccuucacgugcugcacugucuccauucucuggccauuccuugcaauaacguugaggugcuuauguccggaaaugucagauguuauaacaucgugguugaagcuaugaaggccuuccccaugagcgagcggauccaggaagugucuugcugucugcuccaccgccugacgcugggcaacuuuuucaacauucucguccugaaugaggugcaugaguuugucgugaaggcgguucaacaguacccugaaaacgccgcccuucaaaucuccgcucugagcugccucgcucugcugaccgagacaauuuuccuuaaccaagaccucgaagagaaaaaugaaaaccaggagaaugaugacgagggggaagaggacaagcuguuuuggcuggaagccuguuauaaagcgcucaccuggcacagaaagaacaaacacgugcaggaggccgcuugcugggcccugaauaaccuucugauguaccaaaauucccuccaugagaagaucggagaugaagacggccacuuccccgcucaucgggaggucaugcugucuaugcugaugcacagcuccagcaaagaaguguuccaagccucugccaacgcucuuuccacacuccuggagcagaauguuaacuuucgcaagauucugcucagcaaggggauccaucugaaugugcuugaacugaugcagaaacacauccacucuccugaggucgcggagagcggaugcaagaugcucaaccaucuguucgaaggcuccaauaccucucuggauauuauggccgcuguggugccgaaaauccuuacgguuaugaagagacacgagacaagccuccccguccagcuggaagcccugcgggccauucuccauuuuaucgugccuggcaugcccgaggaaucccgcgaggacaccgaguuccaccacaaacugaacauggugaagaagcaauguuuuaaaaaugauauucauaaacuuguccuggcugcccucaacagauucaucgggaacccuggaauccagaaaugcggccugaaggugauuagcucuaucguucacuuucccgacgcgcuggaaaugcuuucccucgagggggcuauggauagcgugcugcauacacugcagauguauccggacgaucaggaaauucaaugucucggacugucucuuaucggcuaccugauuaccaaaaagaaugucuucaucgggaccggacaccuccuggccaagauucugguguccagccuuuaccgguuuaaagacguugccgagauccagacaaagggcuuccagacgauccuggcuauucucaaacuguccgccucuuuuagcaagcuccuggugcaucacuccuucgaucuugucaucuuucaccagaugucuagcaacauuauggaacaaaaagaccagcaguuccugaaucucugcuguaagugcuucgcuaagguggccauggacgauuaucugaaaaacguuaugcuggagcgcgcgugugaccaaaauaacuccaucaugguggagugccuucugcuccugggcgccgaugcuaaucaggccaaggaagggagcucucucauuugucaggucugcgagaaagaauccagcccuaagcugguggagcuucugcucaacucuggauccagagagcaggacgugcggaaagcucugaccaucagcaucggcaagggggauucucaaauuaucagccugcuucugcgcagacucgcccuggacgucgcgaauaacuccauuugucucggaggcuuuugcaucgggaaaguugaacccagcuggcugggcccucuuuuccccgauaagacaucuaaucugcggaagcagaccaacauugccuccacacuggcuagaauggugauccgcuaccagaugaaaagcgccguggaggaaggaaccgcuuccggcucugacgggaauuuuagcgaggauguccucuccaaguucgacgaauggacguuuauccccgauucuagcauggacuccguguucgcccagucugaugaccuggacagcgagggauccgagggcagcuuucuuguuaaaaagaaaucuaacuccauuagcgugggggaguucuaucgggaugccguccugcaaagaugcucuccuaaucuccagcgccauuccaacagccugggaccgaucuuugaccacgaagaucuccugaagcggaagagaaaaauucuuucuuccgacgauagccugcgcuccagcaagcugcagucucauaugcggcacagcgacuccaucucuagccucgcuuccgaaagagaguacauuacaucucuggaucuuagcgcgaacgaacugcgcgacaucgaugcccucucccagaaauguugcaucucugugcaucuggagcaccucgagaagcuggaacuucaccaaaaugcucugaccagcuucccccagcagcugugugagacccucaaaucccugacacaucuugaccugcacagcaacaaguuuaccucuuucccuuccuaucuccugaagaugagcugcauugccaaucucgauguuucucggaacgacaucggccccuccgugguccuggauccuacagugaaaugucccacgcuuaagcaauuuaaucugagcuacaaccagcuguccuucguuccggaaaaucucaccgacguggucgagaaacuggaacagcuuauucuggaggggaacaagaucucuggcauuugcagcccucucagacugaaagagcugaagauccucaaucuuuccaagaaccauauuagcucucuguccgaaaauuuccuggaggccugucccaaaguggagagcuuuucugcucgcaugaacuuccucgccgcgaugccuuuucugcccccuagcaugacaauccuuaagcugucccagaauaaauucucuugcauccccgaggcuauucucaaccugccgcaucugcggagccucgacauguccucuaaugauauccaauaucuuccuggacccgcccacuggaaaagccugaaccugagagagcuccuguuuucccauaaccagauuagcauccuugaccugucugaaaaagccuaccucuggucccggguggagaagcugcaccugagccauaauaaacucaaggaaauucccccugagaucggcugucuugaaaaccugaccucccuggaugucucuuacaaucucgagcugcgcagcuucccgaacgagauggggaaacuuuccaaaaucugggaccugccccucgaugaacugcaccugaauuuugacuucaagcauauuggaugcaaagcuaaggauaucauuagauuucuccagcagcggcuuaaaaaggccguuccuuauaacagaaugaagcugaugaucgugggcaauacagggucuggaaaaaccacgcugcuccaacagcugaugaagaccaaaaagagcgaccuuggcaugcaguccgcgacaguggggauugaugucaaagacuggcccauccagauccgcgauaagcggaagagagaccuggugcucaacguuugggacuucgcuggccgcgaggaauuuuacagcacccacccucacuucaugacacaaagagcccuguaucuggccguguacgaucucucuaaaggacaggcugaggucgacgccaugaagcccuggcuuuucaauauuaaagcucgggccuccagcucuccugugauccugguuggcacccaucuggauguguccgacgaaaagcagcgcaaagcguguaugagcaagauuacgaaggagcuccugaacaaaagaggguuucccgccauccgggauuaucacuucgucaaugcuacagaggaaucugacgcccuugcuaagcugcgcaaaaccauuaucaacgagagccucaauuuuaagauuagagaucagcugguggucggacaacugaucccggacugcuacguggaacucgagaaaaucauucuuuccgaacggaagaacguuccuaucgaguuccccgugauugaucgcaagagacugcugcagcucguccgggagaaucagcugcaacuugacgaaaacgagcugccucaugccgugcacuuucucaaugaaucuggcguucugcugcacuuccaggaucccgcccuccagcuuagcgaccuguauuuuguggagccgaaauggcugugcaagaucauggcucagauucucacagucaaaguggagggguguccuaagcaucccaaaggaaucaucucccgcagagauguggaaaaguuccugagcaaaaagcggaaguuuccuaaaaacuacaugucccaauacuucaaacuucuggagaaauuucagauugcgcuccccaucggcgaagaguaucugcugguucccucuagccucuccgaccacagaccugucauugaacuuccgcauugcgagaacucugagaucauuauccgccuguacgaaaugcccuauuucccuaugggguuuuggagccggcugaucaauagacuccuggagauuucccccuacaugcuuucuggccgcgaacgggcccugagaccuaaccgcauguauuggcggcagggaaucuaccucaauuggagccccgaggcuuauugucuggugggcuccgaagugcuggacaaccacccugagagcuuccucaagauuaccgucccgucuugcagaaaaggguguauccuucugggacaggugguugaucauauugacucccugauggaggaaugguuccccggccuccuggagaucgauauuugcggggaaggagagacccuucugaagaagugggcccucuacagcuuuaaugacggcgaagaacaccagaagauucugcuggaugaccucaugaagaaagccgaggaaggcgaucugcuugugaacccugaccagccccgccugacaaucccuauuucucagaucgcucccgaucucauucuggccgaccuuccgcggaauaucaugcugaacaaugaugagcucgaguucgagcaggcgccugaguuucugcugggggacggauccuucggcagcgucuacagagcugccuaugaaggggaggaaguggccguuaagauuuuuaacaaacacacgucucuccggcugcuucgccaagagcuggugguccucugucaucugcaccaucccucccuuaucagccugcucgcugccggaaucagaccccggaugcuggugauggaacuggcguccaagggcagccucgaucgccugcuucagcaggacaaggcuucucugaccagaacacuccaacaccggauugcccugcacguugccgacgggcuuagauaccugcauagcgcuaugaucauuuaucgcgaucucaaaccucacaaugugcugcuguucacccucuaccccaacgccgcuaucauugccaagaucgcggacuauggaaucgcccaguacugcugucggaugggcauuaaaacauccgagggcaccccuggguuuagagcuccggaggucgcccgcggaaaugugaucuauaaccagcaggcugauguguacucuuucggccugcuucuguacgacauucucacgacagggggacggaucgucgaaggccugaaguuucccaaugaguucgaugaacuugagauucaagggaaacugccugaccccguuaaggaauauggaugcgccccuuggcccaugguggagaagcucaucaaacagugucugaaggagaacccgcaggaaagaccuaccagcgcccagguguuugauauucugaacuccgcugagcucgucugccugacccgccggauccuucugcccaaaaaugugaucguugaaugcaugguggcgacacaucacaacucuagaaaugccagcauuuggcucggcuguggccauaccgaccgcgggcaacuguccuuccuugaucugaacacagagggauacacgucugaagaggucgcugacagcagaauccucugccuggcccuggugcaccucccuguugagaaggaauccuggauugugagcggcacccagucugggacacugcuugucaucaauaccgaggauggcaagaagcggcacacacuggagaagaugaccgacuccgugacgugucucuauugcaacagcuuuucuaagcaguccaagcagaaaaauuuccugcuugucggcaccgccgacgggaagcuggcuauuuucgaggauaaaacagugaagcucaaaggagccgcgccccugaagauccugaacaucggcaauguuagcaccccucucaugugucuguccgagucuacaaacagcaccgaacgcaaugugauguggggcgggugcggaacaaagaucuuuuccuucagcaacgacuuuaccauccaaaaacuuauugagacgagaacaucucagcuguucuccuacgcugccuuuagcgauucuaauaucauuaccguggucguugacaccgcccucuauaucgcuaagcagaacagccccgugguggaagucugggauaaaaagacagagaaacuguguggccuuaucgacugcgugcauuuccugcgggaaguuauggugaaggagaauaaggaguccaaacacaagaugucuuacagcgggcgcgucaaaacccucugucugcagaagaacacggcccuguggauuggaacaggcgggggacauauccuucugcucgaucuguccaccagacggcucauuagagugaucuauaacuuuugcaauucuguccgcgugaugaugacagcgcaacugggcagccuuaaaaacguuaugcuggugcugggcuacaaucggaagaacaccgaagggacacagaagcagaaagagauucaauccugucucaccgucugggacaucaaucugccgcacgaagugcagaaccuugagaagcauauugaaguuagaaaagagcuggccgagaagaugcgccggacgagcguggaauga

SEQ ID NO: 71656 - RNA, 2151 nt, Artificial Sequence
  derived and/or modified sequence opt5 from LRRN1__Homo_sapiens__NP_065924
auggccagaaugagcuucgugaucgcugccugccagcugguccucggccugcuuaugaccucccugacagagucuagcauucaaaacuccgaauguccccagcucugcguuugugagauccggccuugguuuacgccgcagucuaccuaccgcgaagcgacaaccguggacugcaaugaucugagacuuacacggauucccagcaaccuguccucugacacccaggugcuccugcugcaaagcaauaacaucgcuaagacagucgaugagcuccagcagcuguucaaucuuaccgaacuggacuuuucccagaacaauuucacgaacauuaaagagguggggcucgccaaucugacccaacuuacaacccugcaccucgaggaaaaccagaucacagagaugaccgauuauugucugcaggaccugagcaaucuccaggaacuguacaucaaccauaaucaaauuucuacgaucuccgcccacgcuuuugccggacuuaagaaccugcuccgccugcaucuuaauagcaacaaacugaagguuauugauucuagaugguucgacuccacaccuaaccucgagauccugaugauuggcgagaaucccgugaucgggauucuggauaugaacuuuaaaccucucgcuaaucugcggagccuuguccuggccggaauguaucucaccgacauccccggcaacgcgcugguggggcuugauucucuggaaucccucagcuucuacgacaauaagcugguuaaggugccucagcuggcccuccagaaagucccgaaccugaaguuucuugaucugaauaaaaaccccauccacaagauucaagagggagacuucaaaaauaugcuccgccugaaggaacugggcaucaacaauaugggcgagcuuguguccguggacagauaugcucucgauaaccugccugaacugacaaagcucgaggccaccaauaaccccaaacugucuuacauucaucggcuugcuuuucgcagcgucccugcccuggagucccucaugcugaauaacaacgcgcugaaugccaucuaucagaagaccguugaaagccuucccaaccucagagagauuucuauccacuccaauccgcugcggugcgacugugugauccacuggauuaacagcaauaaaacaaacauccgcuucauggaaccucugucuauguuuugcgcuaugcccccugaguacaaggggcaucaggugaaagaaguccucauucaggauagcuccgagcaaugucugcccaugaucucucacgacagcuuccccaauagacuuaacguggauauuggaacgaccguuuuccuggacugccgggccauggcugagccugaaccggagaucuacugggugacacccaucggcaauaagauuaccgucgaaacacucuccgauaaauauaagcugagcucugaggggacccuggaaaucuccaacauucagaucgaggacagcggacgcuacacguguguggcccagaauguucagggcgccgauacaagaguggcuaccauuaaggucaacgggacccuucucgacggaacacaagugcugaaaaucuaugucaagcagaccgagucucauuccauucuggugagcuggaaaguuaauuccaacgugaugacaucuaaucucaaguggagcuccgcgacgaugaaaaucgauaacccucacaucaccuacacagcccggguccccguggacguucacgaauauaaccugacccaucuucagccuucuacagacuacgaggugugccugaccgucagcaauauucaccagcaaacgcagaaguccugcgugaacgugaccacaaagaaugcugccuuugccguugauaucagcgaccaggaaaccucuacagcucucgccgcggucaugggcuccauguucgcugugauuagccuggccucuaucgccguguauuuugcuaaaagauucaagcgcaaaaacuaccaucacucccugaagaaauacaugcagaagaccagcucuauuccccuuaaugagcucuauccgccucugaucaaccugugggagggcgauagcgaaaaggacaaagauggguccgccgacacgaagcccacacaagucgauaccagccggucuuacuauaugugguga

SEQ ID NO: 71657 - RNA, 2142 nt, Artificial Sequence
  derived and/or modified sequence opt5 from LRRN2__Homo_sapiens__NP_006329
augagacugcucguggccccucugcuucuggcuugggucgccggcgcgaccgcugccguuccuguggugccguggcacguccccugcccuccccagugugccugccagauccggccuugguacacaccccgcagcuccuauagagaggcuacgaccguggacuguaacgaucucuuccugacagccguuccuccggcccuucccgccgggacccagacacugcuccugcagucuaauagcauugugcgggucgaccaguccgaacugggauaccucgcgaaccugaccgagcuugaucugucucaaaauagcuuuuccgacgcccgcgauugcgacuuccaugcucucccucagcugcuuucucugcaccucgaagagaaccagcugacaagacuggaagaucauagcuuugccggccucgcuucccugcaggagcuuuaucugaaucacaaccaacucuaccggaucgcuccccgcgcguucagcgggcugucuaaucuucugagacuccaucugaacuccaaucugcuccgggccauugacagccgcugguuugagaugcugccuaaccuugaaauccugaugauuggaggcaauaagguggaugcuauccucgacaugaacuucagaccccuggccaaucuucggucucugguucucgcugggaugaaccugcgcgagaucuccgauuaugcccuggaaggacuccagagccuggagucucuuuccuuuuacgacaaucagcuggccagagugccgcggcgcgcucucgagcaggucccuggccugaaauuccuggaucuuaacaagaacccccuccaaagagugggcccuggggacuuugcgaauaugcugcaccugaaagaacucggacugaacaauauggaggaacuugugagcauugacaaguucgcccuggucaaccuccccgagcugaccaaacuggauaucacgaauaacccccggcuuuccuuuauucacccuagagcuuuccaucaccucccgcagauggaaacccugaugcugaauaacaaugcccucucugcccugcaucagcaaacaguugagagccuucccaaccugcaggaggugggccuccacgggaauccuauccgcugugacugcgugauucggugggcuaacgccaccggaacaagaguccgcuuuaucgaaccccaguccacccugugugcggagccucccgaucugcagcggcuuccggugagagaaguuccuuuccgcgagaugacggaccacugccucccccugauuagcccucggucuuuucccccuucccugcaaguggcuagcggcgaaucuaugguccuccauuguagagcccuggccgagcccgagccggaaaucuauugggugacacccgcugggcuucgccugacccccgcccacgcuggacggagauaccgcguuuaccccgagggcacacucgaacugcggagagugaccgccgaggaagcgggccuguauaccugcgucgcccagaaucuugugggggcugauacaaagacggucagcgugguugugggacgggcccuccugcagccuggccgcgacgaggggcagggacuggagcucagaguccaagaaacccauccguaccacauccugcuuuccugggugacacccccuaacaccguuucuacaaaucugaccuggagcuccgcuagcucucuccggggccagggggccacggcgcuggccagacugccccgcggaacacauuccuauaacauuacccggcuucugcaggcuaccgaguacugggccugucuccagguggcuuucgccgaugcccacacacaacuggcuugcgucugggcgagaaccaaggaagccacaagcugccaccgcgcucucggcgacagaccuggccugaucgccauucuugcccuggcugugcuccugcuggccgcggggcuugcugcccaucugggaacgggccagccccggaaaggggugggaggccgcagaccucugcccccggccugggcuuucuggggguggucugccccuuccguucgggucgugagcgcgccccucgugcucccuuggaaccccggccgcaagcugccgagauccucugagggagagacccuucugccuccccucagccaaaauuccuga

SEQ ID NO: 71658 - RNA, 2127 nt, Artificial Sequence
  derived and/or modified sequence opt5 from LRRN3__Homo_sapiens__NP_001093128
augaaggacaugccccugagaauccacgugcuccugggccuugccauuaccacacugguccaggcuguugauaaaaagguggacugcccucggcucuguacgugcgagauccgcccgugguucacccccagaagcauuuacauggaagccuccacaguggauuguaacgaccuggggcuucugaccuuuccugcgcggcuccccgcuaauacacaaauccugcugcuccagaccaacaauauugccaaaaucgaguacucuacagauuucccugucaaccugaccggacuugaccugagccagaauaaccucuccucugugacgaauaucaacguuaagaaaaugccccagcugcuuagcguguaccuggaagagaauaagcucaccgaacugccugagaagugccuguccgagcucucuaaccugcaagaacuuuauauuaaucauaaccugcucagcacaaucuccccgggcgccuuuauugggcugcacaaucuucugcgccuccaucugaacagcaauagacugcagaugaucaacucuaaaugguucgaugcucuccccaaccuggagauucuuaugaucggagaaaauccuauuauccggaucaaggacaugaacuuuaaaccccugauuaaucuccgcucccuggucaucgccggcauuaaccuuaccgagaucccugauaaugcucugguggggcucgagaaccuggaaagcauuucuuucuacgacaauagacugaucaagguuccccacguggcccuccagaaagucgugaaccugaaguuucuugaucugaauaagaacccgaucaaucggauucgcagaggagacuucuccaacaugcuccaucugaaagagcugggcaucaauaacaugccugaacuuauuagcaucgauucucucgcgguggacaaucugcccgaccugcggaagauugaggccacaaacaacccucgccucuccuauauccaccccaaugccuuuuucagacugcccaaacuugaaagccugaugcucaacuccaaugcucugucugcucuguaccacggcaccaucgagagccuuccuaaccucaaggagauuuccauccauagcaauccgauucggugugauugcgucauccgcuggaugaacaugaauaaaacgaacauuagauuuauggaacccgacucucuguucuguguugauccucccgaguuucaggggcaaaaugugagacaggugcacuucagagacaugauggaaaucugccugccucucauugcccccgaguccuucccgagcaaccugaaugucgaagcgggaucuuaugugagcuuucauugucgcgccacagcugagccucagcccgagaucuacuggaucaccccuuccggccagaaacuucugcccaacacacucaccgauaaauucuacguucacucugaagggacccuggacauuaauggagugacaccuaaggagggcgggcuguauacgugcaucgccaccaaccuugucggagcugaucucaagagcgugaugauuaaaguugacggcuccuuuccccaagauaauaacggcagccugaacaucaagauucgggacauccaggccaauucugugcuggucuccuggaaagccagcucuaagauccucaaauccagcgugaaguggacagcuuucgucaagaccgaaaacucccacgcggcccagucugcucggauuccgagcgaugugaaaguuuacaaucugacacaucuuaacccuuccaccgaguauaagaucuguauugacauccccacgauuuaccaaaagaaucgcaagaaaugcgugaacgucacaaccaaggggcugcaccccgaccagaaggaauaugagaaaaauaacaccacaacccucauggccugccugggaggccugcuugggaucaucggagugauuugucucaucucuugccugagcccugagaugaauugugauggcgggcauuccuacguucggaacuaucugcagaagccgacauuugcccucggagaacuguaucccccucuuauuaaucugugggaggcuggcaaagaaaagagcacgucucucaaagugaaggccaccgucaucggccugcccacaaacauguccuga

SEQ ID NO: 71659 - RNA, 2223 nt, Artificial Sequence
  derived and/or modified sequence opt5 from LRRN4__Homo_sapiens__NP_689824
augagacagacccugccccuccugcuucugacagugcuccggccuagcugggccgacccgccccaagagaaggucccucuguuccgcguuacgcagcagggccccuggggguccucuggaagcaacgcuaccgauuccccuugcgaaggccuucccgccgcggacgcuacagcccugacccucgccaauagaaaccuggagcggcugccugggugucucccgcgcacacugagaucucuugaugcuagccacaaucugcuccgggcccuguccaccucugaacuuggacaucuggagcagcuccaagugcugacacugcgccacaacagaaucgcugcccuccgguggggccccgggggaccugcgggccugcauacccuugaccugagcuacaaucagcucgccgcucugcccccuugcacgggccccgcccuuuccagccugcgcgcucucgcccuggcggggaacccgcugagagcccuccagccucgggcuuuugccuguuuccccgcucugcagcuucugaaucucucuugcaccgcccugggacgcggcgcccaagggggaauugcugaagcggccuuugcuggcgaggauggggccccucuugugacacuggagguccucgaccuguccggaaccuuccuggaaagaguggagagcggcuggauccgggaucuccccaaacugacaucucuuuaucugcgcaagaugcccagacucaccacgcuggaaggcgacauuuuuaaaaugacaccuaaccugcagcagcuugauugucaggacuccccggcccucgcuagcguugccacccacaucuuccaagauacaccccaucuccaggugcugcuguuucagaauugcaaccugucuuccuucccucccuggacccuugacagcucccaaguccugucuauuaaucucuuugggaacccucugaccuguagcugcgaucuguccuggcuucucacagacgcgaagcggacggugcugagcagagcugccgacaccaugugugcccccgcugccggaucuuccggcccguucagcgcuucucugagccucucccagcugccugggguuugccagucugaucagagcacaacccuuggagccucccaucccccuuguuuuaaucgcagcacauacgcgcaaggcaccacgguggcccccucugcugccccugcuacacggcccgccggggaccagcaguccgucagcaaagcgccgaacgugggaucuagaaccaucgccgcuuggccucacuccgaugcccgcgagggcaccgcucccagcacaaccaauuccguggccggccacucuaacagcuccgucuucccccgggccgcuucuacaacgagaacccagcaccgcggggagcaugcgccugaacugguucucgagccggacaucagcgccgcuuccacaccccuggccagcaagcugcuuggaccuuuucccaccucuugggaucgguccauuagcucuccucaacccggccagagaacacacgccaccccucaggcucccaacccgucccucagcgaaggggagaucccugugcugcugcucgacgauuauucugaagaggaggaaggacgcaaggaggaagugggcacgccccaccaggacgucccuugcgauuaccaucccugcaaacaucugcaaaccccgugugccgagcuucagcggagauggcgcugccgguguccugggcugagcggcgaagacacaauucccgauccucccagacuccagggagugaccgagacaaccgacacguccgcgcugguucacuggugcgcucccaauagcgugguccacggcuaucagauccgguacucugccgaggggugggccggaaaccaauccgugguuggcgugauuuaugcuacagcccgccagcauccucuguacgggcuuagcccgggaaccacauacagagucugugugcucgcggcuaaucgggccggccugucccagcccagaucuagcggguggcgcuccccuugcgccgcuuucaccaccaagcccucuuucgcccugcuccugagcggccuuugugcugccuccggacugcuccuggcgucuacagucgugcugagcgccugccuuugucggagaggccaaacgcuggggcuccagcgcugcgacacccaccugguugcuuauaaaaacccugccuuugaugacuacccccucggacugcagacaguguccuga

SEQ ID NO: 71660 - RNA, 1569 nt, Artificial Sequence
  derived and/or modified sequence opt5 from LRRTM1__Homo_sapiens__NP_849161
auggacuuccugcuccugggccuuugccuguacuggcuccugagacggcccagcggggugguccuuugucugcucggagccugcuuucagaugcugccugcugccccguccggcuguccccaacugugccgcugugaggggagacuccuguauugcgaagcgcuuaaccugaccgaggcuccucacaaucucucuggacugcuuggccugagccuccgguacaacucccugucugaacugcgcgccgggcaguucacaggacucaugcagcugacguggcuuuaucuggaucauaaucacaucuguagcguucagggcgacgccuuucaaaagcucagacgggugaaagagcugacccuuuccucuaaccagauuacacagcugcccaauaccacauuccgcccuaugcccaaccucagaagcguggaucuguccuacaauaagcugcaggcucucgccccugaccuguuucauggccuucggaaacugaccacacuccacaugcgcgcuaacgccauccaauucgucccggugagaauuuuucaggauugccggagccugaaguuccuugacaucggguauaaucagcugaaaucucucgcgcgcaacuccuuugccggacuguucaagcugaccgaacuccaucuggagcacaaugaucuuguuaaggugaacuuugcucacuuccccagacugauuagccuccauucucugugucugcggcgcaauaaagucgccaucgugguuuccagccuugacuggguguggaaccucgagaagauggaucugucuggcaaugaaaucgaguacauggaaccucacgucuuugagacggugccccaucugcagucccuccaacuggacagcaacagacuuaccuauauugagccucggauccugaacuccuggaaaucucucacaagcauuacccuggcugggaaucugugggauugcggaagaaacgugugugcccuugcguccuggcucaauaacuuccagggccgcuacgacgggaaucugcagugcgccagccccgaauacgcucaaggagaggauguccuggacgccguuuaugcuuuccaccucugcgaagacggcgccgagccgacaucuggccaucugcuuuccgccgugaccaaccggagcgaucuggggccucccgcuucuagcgcgacgacacucgccgacggaggcgaagggcagcacgauggaaccuuugagccugcuacaguggcccugcccggcggggagcacgccgaaaaugcuguccagauccauaaggugguuaccggaaccauggcccugauuuucuccuuucuuaucgugguccucgugcuguacguuucuuggaaauguuuccccgcgagccugagacagcuccgccaaugcuuugugacacagcggagaaagcagaagcagaaacaaacgaugcaccagauggcugccauguccgcccaggaguauuacgucgacuauaagccuaaccauauugaaggcgcucuggugaucaucaaugaguacggcagcuguaccugccaccagcaaccggcccgcgaaugugaggucuga

SEQ ID NO: 71661 - RNA, 1551 nt, Artificial Sequence
  derived and/or modified sequence opt5 from LRRTM2__Homo_sapiens__NP_056379
augggccugcacuucaaguggccccucggggcuccuaugcuggcugccaucuacgcgaugagcauggugcuuaaaaugcugccggcucucggaauggccugucccccuaagugcagaugcgagaaacugcuguuuuauugugacucccagggcuuccauucuguccccaacgccaccgauaaggggagccugggacucucccugcggcacaaucauauuacagaacuggagcgcgaccaauuugcuucuuucagccagcucacguggcugcaccuugaucauaaccagaucuccaccguuaaagaagacgccuuucagggccuguacaagcucaaggagcugauucuuucuagcaauaaaaucuucuaucugccuaacacaaccuuuacacaacucauuaaucugcagaaccuggaucucuccuucaaucagcugagcucucuucaccccgaacuguuuuacgggcucagaaagcugcagacccuucaccuucgguccaacagccuccgcacaaucccugugagacuguucugggacugccggucucuggaguuucucgaucuguccaccaaucgccuuagaagccuggcucggaacggauucgccggccucaucaaacugcgcgagcuucaucuggaacacaaucaacucacgaagauuaacuuugcgcauuuccugagacugucuucccuccacacccuguuccuucaguggaauaaaaucagcaaccugacauguggcauggaguggaccugggggacacucgaaaagcuggaccugaccggaaaugagauuaaggccaucgaucuuacgguguuugagacaaugccgaaccucaaaauucugcugauggacaacaauaagcucaacucccuggauucuaaaauccuuaauagccugcggucccucaccacagucggccugagcgggaaccugugggaaugcucugcucgcauuugugcccuugcuuccuggcucggaucuuuccagggcagaugggagcacucuauccugugccauagccccgaccacacccagggggaagauauccuggacgccgugcauggauuucaacucuguuggaaucuguccaccacaguuacggugauggcgaccacauaucgggacccuaccacagaguacaccaagcgcauuucuagcuccagcuaucacgucggcgauaaagaaauccccacgacagccggcauugcugugaccaccgaggagcauuucccugaacccgacaacgccaucuuuacacagagaguuauuaccgggacaauggcccuucuguucagcuuuuucuuuaucaucuucauuguguuuaucucccggaagugcuguccgccuacgcucagacgcauucggcagugcagcaugguccaaaaucacagacagcugcgcucucagacccggcugcacauguccaacaugagcgaucagggacccuacaaugaguacgaaccuacacaugagggccccuucaucauuaucaacggguauggacaaugcaaaugucagcagcuucccuacaaggaaugcgagguguga

SEQ ID NO: 71662 - RNA, 1746 nt, Artificial Sequence
  derived and/or modified sequence opt5 from LRRTM3__Homo_sapiens__NP_821079
augggcuucaacgugaucagacugcucagcggguccgccgucgcucugguuauugcccccaccgugcuucugacaaugcucucuagcgcggagcggggaugcccuaagggcugucgcugcgaagggaaaaugguguacugugagucccagaagcugcaagaaaucccgucuagcauuuccgcuggaugccuuggccugucucucagauauaauagccugcagaaacugaaguacaaccaguuuaaagggcucaaucagcugacguggcuuuaucuggaccacaaccauaucuccaauauugaugagaacgccuucaauggaauccggcgccucaaggaacugauccuuagcucuaacagaauuuccuacuuucugaauaacaccuuccggcccgucacaaaucuccgcaaccuggaccugagcuauaaucaacuccacucucugggcuccgagcaguuuagaggccuucggaagcugcucagccugcaucuucgcucuaacucccugagaaccaucccugugcggauuuuccaggauugucgcaaucucgagcugcuggaccucggguacaacagaauccggagccuggcccgcaacguuuuugcuggaaugauuagacuuaaagaacugcaccucgagcauaaucaguucuccaagcugaaccuugcccuguuuccccggcucgugucucugcaaaaucuguaucuccaguggaacaaaaucagcgucauuggccagacaauguccuggaccuggagcucucugcagagacuugaucuguccgggaaugaaaucgaggcuuucagcggaccuucuguguuucaaugcguucccaaccuccagcgccugaaucuggacagcaacaaacuuacauucaucggccaggagauucucgauuccuggaucucucugaaugacauuagccuggccgggaacaucugggaauguucccggaauauuugcagccucgugaacuggcugaagucuuuuaagggacuuagagagaauaccaucaucugugcguccccuaaggaacugcaaggcgucaacgugauugaugccgugaaaaauuacagcaucugcggcaagucuacgaccgagcgcuucgaccucgcucgggcccugccgaaacccacauucaagccuaaacugcccagaccuaagcacgaauccaaacccccgcuuccucccaccgucggggcuacagagccuggacccgagaccgaugccgacgcggaacacauuagcuuucauaagaucauugccggcuccguugcucucuuccugucugugcuggugauccuccuggucaucuacgugagcuggaagcgcuaucccgccuccaugaaacagcuucagcagcggucucugaugagacgccaccggaagaaaaagagacaaagccucaaacagaugacgccuuccacacaggaguuuuacguugauuauaagccgaccaacacagaaaccagcgagaugcugcugaacgggaccggacccuguacauacaauaagucuggcucccgcgaaugcgagauuccucuuagcaugaacgugucuacguuccucgcuuaugaccagcccaccaucuccuacugcgggguccaucacgagcugcugagccacaaaucuuuugaaacaaaugcccaagaggacaccauggaaacacaucucgagaccgaacuggaucuuagcacgauuacaaccgccggacggaucuccgaccacaagcagcagcuggcuuga

SEQ ID NO: 71663 - RNA, 1773 nt, Artificial Sequence
  derived and/or modified sequence opt5 from LRRTM4__Homo_sapiens__NP_001128217
augggcuuccaccugaucacccagcucaaggggaugagcgugguccugguucuucugcccacacuccugcuugugaugcugacgggagcccaaagagcuugcccuaaaaacugucggugcgacggcaagauuguguacugugagucccaugccuuugcggauaucccggaaaauauuucugggggaagccagggccucucccugcgcuucaacucuauccagaaacucaagagcaaucaguuugcugggcugaaccaacugauuuggcuuuaucuggaccacaauuacaucuccucugucgaugaggacgccuuccagggaaucagacggcucaaagaacugauucuuagcuccaacaagaucaccuaucugcauaauaagacauuucaccccgugccuaaccuccgcaaucuggaucugagcuacaacaaacuccagacccugcagucugagcaauucaagggccuuagaaaacugauuauccuccaucugcgguccaauagccuuaagacaguucccauucgcguguuucaggacugcagaaaccuggauuuccucgaccugggcuauaaucggcugcgcucucucuccagaaacgccuuugcugggcugcuuaaacugaaggaacuccaccuggagcacaaucaguucagcaagaucaacuuugcccauuucccucggcuuuuuaaccugcgcucuauuuaccuccaguggaauagaauccgguccaucagccaaggacugaccuggacaugguccucucugcacaaccucgaucugagcggcaaugacauucaggggaucgagcccggaaccuucaaaugucuuccuaaccugcagaagcucaaucuggauuccaacaaacugacgaauauuagccaagaaaccgucaacgcuuggaucucucuuauuuccaucacacucagcggcaauaugugggagugcucucgcagcaucuguccgcuguucuauuggcugaagaacuuuaaagggaauaaggaauccaccaugauuugcgccggacccaaacauauccagggcgagaaggugucugacgcgguugagacauacaacauuuguagcgaagugcaggucgugaauaccgagagaucccaccucgugccucagacgccccaaaagccucugaucauuccccggccgacaaucuucaaaccugaugucacccagagcacauuugaaacccccucuccuucccccggcuuccagauccccggggccgagcaggaauacgagcacguuagcuuucauaagauuaucgcuggaucuguggcccuuuuccuguccguggcuaugauucuccuggucaucuaugugagcuggaaaagauacccugccuccaugaagcaacugcagcagcacucucuuaugaaacgccggagaaagaaggcgcgcgagagcgaacggcagaugaacuccccgcuccaagaguauuacguugacuauaaacccaccaauucugaaacaauggacauuagcgugaacggcuccgggccuugcacguacaccaucagcggaucuagagagugugaaaugccccaucacaugaagccucugcccuauuacuccuacgaucagccggucauuggcuauugccaggcccaucagccucugcacgugacaaaaggguacgagaccguuagccccgagcaagacgaaucuccuggacucgagcugggccgcgaucacuccuuuaucgcuacaaucgcccggagcgcugcccccgccauuuaucuugaaagaaucgcuaacuga

SEQ ID NO: 71664 - RNA, 2091 nt, Artificial Sequence
  derived and/or modified sequence opt5 from LRSAM1__Homo_sapiens__NP_001177652
augccccuguucuuuagaaagcggaaaccuagcgaggaagcccgcaagagacucgaguaccagaugugccuggcuaaagaagccggcgcggacgauauccuugacauuuccaagugugagcugucugaaaucccguucggggcuuuugcuaccugcaaagugcuccaaaagaagguccugauuguucacacaaaccaucuuacgagccugcuccccaaauccuguucucugcugagccucgccaccaucaaggugcuggaucuucacgacaaucagcugacagcccucccugaugaccugggacagcuuaccgcccuccaggugcugaacgucgagcggaaucaacugaugcagcugccccgcuccauuggcaaccucacacagcugcagacccuuaaugugaaagauaacaagcugaaagagcucccugacacaguuggggaacugagaucucuucggacccugaauaucagcggaaacgagauccaacgccucccccagaugcuggcucaugugagaacgcuggaaaugcucucccuggaugccagcgcgauggucuauccuccgcgggaggugugcggcgccgggaccgcugccauucuucaguuccuguguaaggagucuggacucgaauacuaucccccuucccaguaccugcuucccauccuggagcaagacggcauugaaaauagccgcgauucuccugacggccccacagauagauuuucccgggaggaacucgaguggcagaaccgcuucagcgacuaugagaagagaaaagaacagaagaugcuggagaaacuggaauuugagcggcgccucgaacuggggcaaagagagcacacccagcuucugcagcagucuuccagccaaaaggacgagauccuccagacaguuaaagaggaacagucccggcuggaacagggacugucugagcaucaaagacaccuuaaugcugaacgccagcggcuccaggagcagcugaagcaaaccgagcagaacauuagcuccagaauccagaaacugcuccaggauaaucaacgccagaaaaagagcucugaaauucugaagucccuugagaacgaacggaucagaauggagcagcugaugagcaucacgcaagaggaaacagagucucuccgccggagagacguggccagcgcgaugcagcagaugcugaccgaauccugcaagaaucgccugauucagauggccuacgagucucaacggcagaaccuuguccagcaggcuuguagcuccauggccgaaauggaugagagauuccaacagauccucagcuggcagcagauggaccaaaacaaagcuauuucucagauccugcaggaguccgccaugcaaaaggccgcuuuugaagcgcuccaggugaaaaaggaucugaugcaccgccagauucggagccaggagaugaucucugaacaaagaugggcccuguccagccuucugcagcagcuccugaaggagaaacagcaacgggaagaggagcugcgcgaaauccuuacagagcucgaagcuaaguccgagaccagacaggaaaauuauuggcugauucaguaccagcggcugcucaaccaaaaaccgcugucucuuaagcugcaggaggagggcauggaaagacagcucguggcccugcuggaggaacuuagcgccgagcauuaccucccuaucuucgcucaccaucgccugucccuggaccuccugucucagaugagccccggggaucuugccaaagucggaguuuccgaggcgggccugcaacacgaaauucuccggagagugcaggagcugcuggacgcugcccgcauccagccugaacuuaagccucccaugggggagguggucacccccacagccccgcaagaacccccugagagcgugagacccucugcuccucccgccgagcuggaaguucaggcuuccgagugcguggucugucucgaacgggaggcccagaugauuuuucugaauugcggacacguguguugcugccagcaauguugccagccgcuccgcacguguccucugugcagacaggauaucgcgcagcggcuucgcaucuaucauagcucuuga

SEQ ID NO: 71665 - RNA, 810 nt, Artificial Sequence
  derived and/or modified sequence opt5 from LRTM1__Homo_sapiens__NP_001291318
augacccugaaccucagcaauaacucccugucuaaucuugcccccggcgcuuuccacgggcugcagcaucuccaagugcugaaccuuacacagaauagccugcucucccuggagucuagacuguuucacagccucccucagcugcgggaacuugaccuguccucuaacaauaucagccaucucccgacgucccugggagagaccugggaaaaccuuacaauucuggccguccagcaaaaucagcuccagcagcuggaucgcgcgcugcucgagagcaugcccucuguuagacugcuucugcucaaggacaaccuguggaaaugcaauugucaccuucugggccucaagcuguggcuggaaaaauucguguacaaagggggacucaccgauggcaucauuugcgaguccccugacacauggaaggggaaggaucugcuucggaucccccaugagcuguaucaaccuuguccccucccugcuccggaccccgugagcucucaggcccaguggccuggauccgcccacggcgucgugcugagacccccugaaaaccacaaugcuggcgagcgcgaacuucuggagugcgagcucaagcccaaaccgcggccugccaaccugcgccaugcuauugccaccguuaucaucacagggguggucuguggaauugugugccugaugaugcucgcggccgcuaucuacggcuguaccuaugccgcuauuacggcccaguaccacgggggaccccuggcgcaaaccaaugauccuggcaagguugaagagaaagaaagauuugacagcucucccgccuga

SEQ ID NO: 71666 - RNA, 477 nt, Artificial Sequence
  derived and/or modified sequence opt5 from LRTOMT__Homo_sapiens__NP_001138779
augaacaagagagacuacaugaauaccagcgugcaggagcccccucuggauuauuccuuccggucuauccacgucauucaagaccucguuaacgaggaaccgcgcacaggccugagaccccuuaaacggagcaaguccgggaaaucucugacgcagagccucuggcugaauaacaaugugcuuaacgaucugcgcgacuuuaaucagguggccucccagcuccuggaacauccugagaaccuggcuuggaucgaucucucuuucaaugaccugaccagcauugaucccguccuuacaaccuuuuucaaccuguccgugcucuaccugcacggaaauagcauccaaagacuuggcgaaguuaacaagcuggccgugcucccucggcugcgcucucugacacuccaugggaaucccauggaggaggaaaaaggauauagagucccuggcuccguggagaugccgcaccggcccccuuga

SEQ ID NO: 71667 - RNA, 1017 nt, Artificial Sequence
  derived and/or modified sequence opt5 from LSAMP__Homo_sapiens__NP_002329
auggugagacggguccagcccgaccgcaagcaacugccucucguucugcuuagacugcucugccugcuuccgaccggccugcccgugcggagcguggauuucaaccgcgggacagacaauaucacggucagacagggagauaccgccauucuccggugugugguugaggacaaaaacuccaagguggcuuggcugaaucgcucuggcaucauuuuugccgggcacgauaaauggagccuggacccuagagucgaacucgagaagcggcauucccuggaauacucucuucgcauccagaaaguggauguuuaugacgagggaagcuacacaugcuccgugcagacccaacacgaacccaagacaucucaggucuaucugauuguccaggugccucccaagaucagcaacaucuccagcgaugugaccguuaaugagggcucuaacgugacacucguguguauggcgaaugggagaccugagccggucauuaccuggcggcaucugacgcccaccggacgcgaguucgaaggcgaagaggaguaccuugaaauccugggcauuacaagagagcaguccgggaaauaugaaugcaaggcugccaacgaggugagcucugccgacguuaaacaagugaaggucaccgugaauuacccucccacaaucaccgaauccaaaagcaacgaggcuacgacaggacggcaggccucucucaagugugaggcuuccgccguuccugcgcccgauuuugaaugguaucgcgacgauaccagaauuaauagcgccaacggccuggagaucaaguccacagaagggcagucuagccugaccgugaccaaugucacagaggaacacuacggaaacuacacgugcguggcugccaauaaacucggcgucaccaacgcuucccuggugcuuuuccggccggggagcguuagaggaauuaacggcucuaucucccuggccgugccucucuggcugcuugcggccagccugcucugucugcugucuaagugcuga

SEQ ID NO: 71668 - RNA, 1083 nt, Artificial Sequence
  derived and/or modified sequence opt5 from LSM11__Homo_sapiens__NP_775762
auggaggaaagagagcggggcgcccgcagcgcuggggccggaucccccgcgagaccuccgucuccccggcuggacgugagcuccgauucuuucgacccucuccuggcucuuuacgcuccccgccugccucccaucccuuauccgaacgcccccugcuuuaauaacgucgccgaauacgagagcuuccucagaaccggcguucgcgggggaggccgggggagaggacgggcccgcggcgcugccgcgggcuccggggugccugccgcucccggaccuucuggcagaacacggcgcagacccgaugccccggcuccugaccccgaacggauucagcgccugagacggcuuaugguggccaaggaggagggggauggagcggccggcgcugggagacgcggaccuggccggagcagaaaagcuccccgcaauguccugacgcggaugccccuccacgaaggcuccccucugggggagcugcauagauguauccgcgaaggagugaagguuaacgugcacauucggaccuuuaaaggccucagaggggucugcacaggauuccugguggccuuugacaaguucuggaauauggcccuuaccgauguugacgagacauaucgcaaaccggugcugggcaaggccuacgagcgggauagcucucucacccugacaagacuuuuugaccgccugaagcuccaagauuccagcaaaaaggaagcugacucuaaauccgcggucgaggauagcacccugucucgguauucccagacgagcaccuggaagcuggccuccgugugggggagagcugacacaggacggggcucucauaaacgcagcagauccgugcccagcucucuccaggccuccgcccgggaagagagcagaucugaacugagcggccgcaccacacggaccgacggguccucugucggaggcacguucagcagagcuacaacccuuucccgcgggcagagcagaaagaagaaacggaagccuaaaguugauuaccaacagguguuuacacgccacaucaaccagauuuucaucagaggagagaaugugcugcucguccaucuggcccaguga

SEQ ID NO: 71669 - RNA, 402 nt, Artificial Sequence
  derived and/or modified sequence opt5 from LSM1__Homo_sapiens__NP_055277
augaacuacaugcccggcaccgccagccugaucgaggacauugauaagaaacaccucgugcugcuuagagacgggcggacacugaucggauuccuccgcuccauugaucaguuugcuaaucugguccuucaucaaacgguugaaagaauccacgugggcaagaaauauggggacauuccucggggaaucuucgugguccgcggcgagaacgugguucugcucggggaaaucgaucuggagaaggaaucugacaccccgcugcaacaggugagcauugaggagauccucgaggaacagagagucgaacagcagacaaaacuggaggccgagaaacuuaaggugcaggcgcugaaggaucggggacucuccauuccccgcgcugacacccuggaugaauacuga

SEQ ID NO: 71670 - RNA, 288 nt, Artificial Sequence
  derived and/or modified sequence opt5 from LSM2__Homo_sapiens__NP_067000
augcuguucuacagcuuuuucaagucccucgugggcaaagacgucguuguggagcugaagaacgaucuuucuaucugcgggacccugcacagcguggaccaguaucucaauauuaaacugacagauaucuccgucacggaccccgaaaaguacccucauaugcuuucugugaaaaacuguuuuauuagaggaagcguugugcgguauguccaacugccggccgaugagguggacacccagcuccugcaggaugcugcccgcaaggaagcgcugcagcaaaagcaguga

SEQ ID NO: 71671 - RNA, 309 nt, Artificial Sequence
  derived and/or modified sequence opt5 from LSM3__Homo_sapiens__NP_055278
auggccgacgauguggaccagcaacagaccacaaacacggucgaggaaccccuggaucucaucagacugagccuugacgagcggauuuacguuaagaugcgcaaugauagagaacugcggggccgccuccacgcuuaugaccagcaucugaacaugauccuuggggauguggaggaaaccgugacaaccauugagaucgacgaggaaacauacgaggaaauuuauaaauccaccaagagaaauaucccuaugcuguucguccggggagauggcgugguucucguggccccgccccugcgcgucggguga

SEQ ID NO: 71672 - RNA, 420 nt, Artificial Sequence
  derived and/or modified sequence opt5 from LSM4__Homo_sapiens__NP_036453
augcugccccucagccugcuuaagaccgcccagaaccacccuaugcugguggagcucaaaaauggcgaaacauacaacgggcaucuggucuccugcgacaauuggaugaacaucaaucuuagagagguuauuuguacgucucgggauggagacaaguucuggcgcaugccggaaugcuauaucagaggcagcaccauuaaauaccugcggauccccgaugagauuaucgacauggugaaggaagagguggucgcuaaagggcgcggaagaggcgggcuccaacagcagaagcagcaaaagggacggggcaugggcggggccggacgcggcguguuugggggaagaggccgcgggggaaucccuggcacaggccgggggcagcccgagaaaaagccuggaagacaggcgggcaaacaguga

SEQ ID NO: 71673 - RNA, 276 nt, Artificial Sequence
  derived and/or modified sequence opt5 from LSM5__Homo_sapiens__NP_036454
auggccgcuaacgccaccacaaaucccagccagcugcucccucuggagcuuguggacaagugcaucggcucccggauucacaucgucaugaaaucugauaaggaaauuguugggacgcugcucggauucgacgauuuugugaacauggugcuggaggacgucaccgaguucgaaaucacaccggaaggcagacgcauuaccaaacuugaucaaauccugcucaaugggaacaauaucacaaugcuggugcccggaggcgaggggccugagguuuga

SEQ ID NO: 71674 - RNA, 243 nt, Artificial Sequence
  derived and/or modified sequence opt5 from LSM6__Homo_sapiens__NP_009011
augagccugagaaagcagacccccuccgacuuccucaaacaaaucauuggccggccuguggucguuaagcugaacucugggguggauuaccgcggagugcuugccugccuggacggcuauaugaauaucgcucucgagcagacagaagaguacgucaacgggcagcugaaaaauaaguauggagaugccuuuauuagaggcaacaaugugcuuuacaucagcacgcagaaacggcgcauguga

SEQ ID NO: 71675 - RNA, 312 nt, Artificial Sequence
  derived and/or modified sequence opt5 from LSM7__Homo_sapiens__NP_057283
auggccgacaaggagaagaagaaaaaggaaagcauccuggaucucuccaaauacauugacaagaccaucagagugaaguuccagggcgggcgggaggcuucuggcauucugaaaggauuugauccccuucugaaccucguccuggacgggacaaucgaauauaugcgcgauccugacgaucaauacaaacuuacggaggacaccagacagcugggacucguugugugccggggcacaagcgugguccugauuuguccgcaggaugggauggaagccauccccaauccuuucauccagcaacaggacgcguga

SEQ ID NO: 71676 - RNA, 834 nt, Artificial Sequence
  derived and/or modified sequence opt5 from LSP1__Homo_sapiens__NP_001013273
augcugcucagccugaagcccuccgaggccccugaacuugacgaggaugaaggcuucggggacuggucucagagaccggagcaacggcagcagcacgaaggagcucagggcgcccuggauagcggggagcccccucaaugccgcucccccgagggagaacaggaggacagaccuggccuccaugcguacgaaaaagaggauucugacgaggugcaccuggaagaacuuagccuguccaaggaagggcccggaccugaggauaccguccaggacaaccucggcgcugccggcgccgaagaggagcaggaggagcaucaaaaaugucagcagccgcggacacccucuccucugguucuggaagggacgaucgagcagagcuccccuccccucagccccaccacaaagcugauugaucgcaccgaaucucuuaauagauccaucgagaaaagcaacucugugaagaagucccaaccggaccugccuauuagcaaaaucgaucaguggcucgagcaguauacacaagcuauugaaaccgccggacggacacccaagcuggcucgccaggccucuaucgagcuuccuuccauggcgguggccagcaccaaauccagaugggaaacgggcgagguccaggcucagucugccgcuaagacccccagcugcaaagacaucguggccggggauauguccaaaaagagccugugggaacaaaagggaggcucuaagacauccagcaccauuaaaucuacacccagcgggaagcgguacaaauuuguugcgaccggacacggcaaguaugagaaagugcucgucgagggcgggccugccccguga

SEQ ID NO: 71677 - RNA, 1890 nt, Artificial Sequence
  derived and/or modified sequence opt5 from LSR__Homo_sapiens__NP_001247418
augcagcaagacggccugggggugggaaccagaaacggcagcgggaagggacgguccguccaccccucuuggcccuggugcgccccgcgcccccucagauacuucggccgggaugcucgcgccagacgggcgcagacagcugccauggcccugcuugcugggggacugagccgcggccucggcucccauccugccgcugccgggagagacgcgguuguguuuguguggcugcuucugucuacgugguguaccgcccccgcucgggccauccaggucacagugagcaauccuuaucacguugugauucucuuccagcccgucacccugccuugcacauaccaaaugaccuccacaccgacccagcccaucgugauuuggaaauauaagucuuuuugucgcgauagaaucgcugacgccuucagcccugcguccguugauaaccagcugaaugcccagcucgcugccggaaaccccggcuacaauccuuauguggagugccaagacagcguccggacggugcgcguggucgcuaccaaacaggggaacgccguuacacugggagauuacuaucagggcagacggauuaccaucacagggaaugccgaccuuaccuuugaucagacggcuuggggagacucuggcguguacuacuguuccguggucagcgcgcaagaucugcagggcaacaaugaagccuaugcugagcucaucgugcuggacuggcuuuucguuguggucgugugccuggccgccuuucucauuuuccugcugcucgggaucuguuggugccaguguugcccccauacauguugcugcuacguucgcuguccgugcuguccugauaagugcuguugccccgaagcucuguaugccgcgggaaaagcugccaccucuggcgugccuuccauuuacgcccccagcacauaugcucaccuuucucccgccaagaccccuccgcccccugcuaugauccccauggggccugccuacaacggauaucccggcggguacccgggagacgucgacagauccagcuccgcgggcggccaagggucuuacgugccucugcuccgggauaccgacagcuccgucgccagcgugagaucuggauaucgcauucaggcuucccagcaggaugacagcaugcggguucuguacuauauggagaaggaacuugccaauuuugaucccucuagaccugggcccccuagcggccgcguggagcgggcuauguccgaggucacaucucugcaugaagacgauuggagaagccgccccucccggggaccggcccucacgccuaucagagacgaggaauggggcgggcacagcccccgcucuccccggggcugggaucaagagccugcgagagagcaggccggaggcggguggcgcgcucggagaccgcgggcccgcuccguggacgcucuggaugaccugacacccccuagcaccgccgaaucuggauccagaagccccaccuccaacggcgggcggucuagagccuacaugccuccccgcagccgguccagagacgaucucuaugaccaggaugacucucgcgauuucccuagaagccgggacccccacuacgaugacuuucgcuccagagagcggccgccugcugauccccgcagccaucaccauagaacacgggacccucgcgauaauggaucuagauccggcgaccugcccuaugaugggcggcuucuggaagaggcgguucgcaaaaagggcagcgaagagagacggagaccgcacaaagaggaagaggaagaggccuacuacccucccgcuccuccucccuauucugaaaccgacucccaggccagccgcgagcggagacucaagaaaaaccuggcccuuucucgcgagagccugguggucuga

SEQ ID NO: 71678 - RNA, 2199 nt, Artificial Sequence
  derived and/or modified sequence opt5 from LSS__Homo_sapiens__NP_001001438
augaccgagggcacaugccugagacggcgcgggggacccuacaagacggaaccugccaccgaccucggcagauggcggcugaacugugagcgcgggagacagacauggaccuaucuucaagaugaacgggcuggacgcgagcagacaggccuggaagccuacgcgcucgggcuggacaccaaaaauuauuucaaggaucuuccgaaagcucacacagccuuugagggagcccugaacggcaugaccuucuacgugggccuccaggcugaggacgggcauuggacgggagauuauggcgggccccuguuucugcucccuggacugcuuauuaccugccacgucgccagaaucccccugccugcuggcuaccgggaagagaucguucgcuaucucagaagcgugcagcugcccgacgggggauggggccuucauauugaagauaaguccacaguguucggcaccgcccugaauuacgucucucuccggauccugggggugggaccugacgauccggaccugguucgcgcgagaaacauucuccacaaaaagggcggggccguggcuauccccagcuggggaaaguuuuggcuggccguccuuaauguguacuccugggagggccugaacacacucuucccugagauguggcuguuucccgauugggcuccugcccaucccucuacccuuuggugucacugccggcaaguuuaucugccgaugagcuacuguuaugcggugcgccucuccgccgcugaagacccucugguccagucucugagacaggagcucuacguggaagauuucgccagcaucgacuggcuggcucagcggaauaacguggcccccgacgagcuuuauacgccucacuccuggcugcucagagucguuuacgcccugcuuaaucuguaugaacaucaccauagcgcucaccuccgccaacgggcggugcagaaacuguacgagcacauuguggccgaugacagauuuacaaagucuaucuccauugggcccaucagcaaaaccauuaacaugcugguccgcugguacguggauggacccgcuucuacagccuuccaggagcauguuucccggaucccugacuaucucuggaugggccuggauggcaugaagaugcaggggaccaauggaagccaaauuugggacaccgccuuugcuauccaggcccuucuggaagcgggcgggcaccauagaccggaguucucuuccugccuccagaaagcucacgaauuucugcgccugagccaagugcccgauaacccucccgacuaccagaaguauuaccggcagaugagaaagggaggcuucuccuucucuacacuugauuguggguggaucgucagcgacugcacggccgaggcccucaaagcugugcugcugcuccaggaaaaguguccucauguuaccgagcacauuccccgcgagcggcugugcgaugccguggcuguccuucugaauaugagaaacccggacggcggauuugccacauaugaaaccaaacgcggcgggcaccuccuggagcugcuuaauccuuccgaaguguucggagacaucaugauugauuacacauaugucgaguguaccagcgcggugaugcaagcccucaaguacuuucauaaacgguuccccgaacacagagcugccgagauccgggagacgcugacacagggccuggaauuuugccgcagacagcagcgggcugacgggucuugggagggauccuggggcguuugcuucaccuacgggaccugguuuggccucgaagccuucgcguguaugggacaaacauauagagauggcaccgccugcgcugaggugagccgcgccugugacuuucugcuuucucggcagauggcugaugggggauggggcgaggacuucgaaagcugcgaggaaagacgcuaccugcaguccgcccagucucaaauucauaacacauguugggccaugauggggcucauggcugucagacacccugauaucgaggcgcaggaacggggagugcgcugccugcuggagaagcagcuucccaacggcgacuggccucaggagaauaucgccgggguuuuuaacaaaagcugugcuauuuccuauacgagcuacagaaauaucuuccccauuugggcccucggccgguuuucucaacuguauccggaacgcgcccuggcuggacacccuuga

SEQ ID NO: 71679 - RNA, 201 nt, Artificial Sequence
  derived and/or modified sequence opt5 from LST1__Homo_sapiens__NP_995309
augcugagcagaaacgacgauaucugcauuuacggcgggcucggacugggcgggcuucugcuccuggccgugguccuucuguccgcuugucucugcuggcugcaccggcgcgcccccucuguucuggugcccggaccgggccuccugagagcggggaccccucuuuguaucagcgcugaggccgccuccgcucagcaauga

SEQ ID NO: 71680 - RNA, 1836 nt, Artificial Sequence
  derived and/or modified sequence opt5 from LTA4H__Homo_sapiens__NP_000886
augcccgagaucguggauaccugcagccuggccuccccugcuucugucuguagaacaaagcaccuccaucugcggugcagcguugacuucacgcgcagaacccuuacaggcaccgccgcgcugacagugcagucccaagaagacaaccuccggucucuggugcuugauaccaaagaccugacaauugagaaggucgugaucaaugggcaggaaguuaaauacgcucucggagagcgccagagcuauaagggcuccccgauggaaauuucucugcccaucgcccugagcaaaaaccaggagauugugaucgagaucuccuuugaaaccagcccuaagucuuccgcccuccaauggcugacgcccgagcagaccagcgggaaggaacacccuuaccuuuucucucagugucaggcuauucauugcagagccauccugcccugucaagauacaccuuccgucaaacucaccuauacagcugaggugagcguuccgaaggagcugguggcccuuaugucugcgauucgggacggagaaacccccgauccugaggaccccucccgcaaaaucuacaaguuuauucagaaagucccuauccccugcuaucugauugcccucguggugggcgcucuggaaagcagacagaucgggccgcggacgcuggucugguccgagaaggaacagguugagaagucugccuacgaguucagcgaaacagaguccaugcucaaaaucgcugaagaucugggaggcccuuauguguggggccaauacgaccuucuggugcugcccccuagcuuucccuacgggggaauggagaaucccugucucaccuucgucacaccuacccuucuggccggcgauaagucucucuccaacgugauugcgcacgaaaucagccauucuuggaccgggaaucugguuacaaacaaaacgugggaccacuuuuggcugaaugagggacacaccguguaucucgagcgccauauuugcggcagacuguucggggaaaaguuucggcacuucaacgcccuuggaggcuggggcgagcugcagaauagcgucaaaacauuuggggaaacccauccguucacaaagcucgugguugaucugaccgacaucgaccccgauguggcuuacuccucugucccuuaugagaaaggauuugcccuucuguucuaccucgaacagcugcugggcgggcccgagauuuuccucggauuucugaaggcuuauguggagaaguucagcuacaaauccaucacgacagacgauuggaaggacuuucuuuauagcuacuucaaagauaaggucgacgugcugaaccaaguugauuggaaugccuggcucuacucuccuggccugcccccgaucaaaccuaacuaugacaugacccugaccaaugccuguauugcucuuucccagcgcuggaucacagcgaaggaagaugaccucaacagcuuuaaugccaccgaucugaaggaccugucuucccaccagcucaacgaguuccuggcucagacacuucaaagagcuccccugccucucgggcacauuaaacggaugcaggaaguguacaacuuuaaugccaucaacaauagcgagauucgcuucagauggcugcggcugugcauccaguccaagugggaggacgccaucccccuugcccucaaaauggcgacggaacagggaagaaugaaguuuacccgcccucuguucaaagaucuggcugccuuugacaagucucaugaucaagccguccggacauaucaggagcacaaggcuagcaugcaucccgugaccgccaugcucguuggcaaagaccugaagguggauuga

SEQ ID NO: 71681 - RNA, 618 nt, Artificial Sequence
  derived and/or modified sequence opt5 from LTA__Homo_sapiens__XP_011512920
augacacccccugagagacuguuccucccgcgggugugcggcaccacgcugcaccuucugcuccuggggcuucugcucguccugcugcccggagcccagggccucccugggguuggacugacccccagcgcugcccaaacagcgcgccagcauccuaagaugcaccuugcucauuccacccugaaacccgccgcccaccucaucggcgacccuucuaagcagaacagccugcuuuggagagcuaauacagaucgggccuuucugcaggacggguucucccucucuaacaauagccugcuggugccgaccuccggaauuuacuuuguguauucucaagucguguucagcggcaaggcuuacucccccaaagccacaagcucuccucucuaucuggcgcaugaaguucagcuguuuuccagccaguaccccuuccacgugccucuucucucuucccagaaaauggucuaucccggccugcaagagccguggcuucacagcauguaccauggggccgcuuuucagcugacccagggagaucagcucucuacgcacaccgacggcaucccucaucuggugcugucccccagcacaguuuucuuuggggccuucgcucucuga

SEQ ID NO: 71682 - RNA, 1077 nt, Artificial Sequence
  derived and/or modified sequence opt5 from LTB4R2__Homo_sapiens__NP_062813
augagcgugugcuacagacccccuggcaacgagacccugcucuccuggaagaccucucgggccacggggaccgcuuuccugcuucuggccgcgcuccugggacuuccgggcaauggguuugucguuuggagccuggcuggauggcgccccgccagaggccggccucucgccgcuacacuggugcugcaccucgcccuggcugacggggccgugcuucugcucacaccccuguucgucgcguuucuuacccgccaggccuggccucugggacaagcuggcuguaaagccguguauuacguuugcgcucucuccauguaugccucugugcugcugaccggccuccugagccuucagagaugucuggcggucacacggcccuuccucgccccucgccugagauccccggcucuugcccggcgccugcuccuggcuguguggcuggccgcccuccugcuugcuguucccgcggccguguacagacaucuguggcgggaucgcgucugccagcucugucacccuucucccgugcaugcugccgcccaccugagccuugaaacccugacggcuuuugugcucccuuucgggcugaugcugggaugcuauuccgucacccucgccagacugcggggcgcgcgcugggggagcggaagacauggcgcucggguugggagacuugugucugccaucgugcuggccuuuggacuccugugggcucccuaccacgccgucaaccugcuucaggcuguggccgcgcucgccccgccugagggcgcucuggccaagcugggcggggcuggacaagccgcgcgcgccggcacaaccgcucucgccuucuuuuccagcucuguuaaucccgugcuguaugucuucacagcuggggaccuucugccucgggccggacccagauuucucacccgccuguucgaaggcuccggggaggcccggggaggcggcagaagccgcgaagggacgauggagcugcggacaacaccccagcuuaaagugguuggacagggcagagggaacggagauccuggcgggggcauggagaaggacggaccggaaugggaucucuga

SEQ ID NO: 71683 - RNA, 1059 nt, Artificial Sequence
  derived and/or modified sequence opt5 from LTB4R__Homo_sapiens__NP_001137391
augaacaccacaagcuccgccgcucccccuucucugggcguggaguucaucagccuccuggccauuauccuucuguccgucgcgcucgcuguugggcugccgggaaauucuuuugugguguggagcauucuuaagagaaugcagaaacgguccgucacggcccugauggugcucaaccuggcccuggcugaccucgccguucugcuuaccgcucccuucuuucugcacuuccucgcccaaggcacauggucuuuugggcuggcgggaugccgccuuugucauuacgugugcggcgucagcauguaugccuccgugcugcucaucaccgcuaugagccuggauagaucucuggccguugcucggccuuucgugucccagaagcuccgcacaaaagccauggcgagacggguccuggccgggauuugggugcuuagcuuucugcucgcuacccccgugcuggccuaccgcacagucguuccuuggaagaccaauaugucucuuuguuuccccagauauccuuccgaaggacaccgggcuuuucaucugaucuucgaggccgugacgggcuuucuccugccguuccuggccguggucgcuagcuacucugacaucggccgcagacuccaggcgcggcgcuuuagacggucccgcagaaccgggcggcuggugguucuuauuauccugacauucgccgcuuucuggcuccccuaucacguggucaaccuggccgaagccgggagagcucuugccggccaggcggcugggcugggacucgugggcaaacgccugagccuggcccggaauguucucauugcccuggcuuuucuuuccucuagcgugaacccuguccuguacgccugcgcugggggaggccuccugagauccgccggcgugggguucgucgcgaagcugcuugagggaaccggcagcgaagccucuuccacacgccggggaggaagccucggccaaaccgcuagaucugggcccgccgcucuggagccuggacccagcgagucccugacggccucuagcccgcucaagcugaaugaacuuaacuga

SEQ ID NO: 71684 - RNA, 735 nt, Artificial Sequence
  derived and/or modified sequence opt5 from LTB__Homo_sapiens__NP_002332
augggcgcccuggggcucgagggaagaggcgggcggcugcagggacgcggcagccuucugcucgcuguggccggggcgaccucccuggucacacuucugcucgcuguucccaucacggugcuggccgugcuggcccucgucccucaagaccagggaggccuggugaccgaaacagcugauccgggcgcccaggcucagcaagggcuuggauuccagaagcugcccgaggaggaaccugaaaccgaccucucucccggccugccugccgcgcaccuuauuggggcgccccugaaaggacagggccucgggugggagacaaccaaggagcaggcuuuucugacaagcggaacccaauucuccgaugccgaaggccuggcucucccucaggacggccuguacuaucuuuacugccugguuggguauagaggacgggccccgcccggcgggggagauccucagggccgcucugugacgcucagaagcucccuguaccgggccgggggagccuauggccccggcaccccugagcuucugcucgaaggggcugagacagucacccccgugcuggacccggcccgcagacagggauacggcccucugugguauacaucuguuggguuuggaggccucgugcaacugcggcgcggggagagagucuacgugaacaucagccaucccgauaugguggacuucgcucggggcaaaaccuuuuucggagccgucaugguuggcuga

SEQ ID NO: 71685 - RNA, 4188 nt, Artificial Sequence
  derived and/or modified sequence opt5 from LTBP1__Homo_sapiens__NP_000618
auggacaccaagcugaugugccuccuguucuuuuucagccuucccccucugcucguguccaaccacacaggcagaaucaaagucguuuuuacgccgucuauuuguaaggugaccugcacaaaagggagcugucagaauagcugcgagaagggaaacaccacaacccugaucucugaaaauggccaugccgcugauacacuuaccgccacgaacuuccggguggucauuugucaucugcccugcaugaaugggggacaauguagcucccgcgacaaaugccaguguccucccaacuuuaccggcaagcucugccagaucccugugcacggggcgucuguucccaagcuguaccagcacagccaacagccuggaaaagcucugggcacacaugugauucacuccacccacacacucccgcugaccgucacgagccagcagggcgugaagguuaaauuucccccuaauaucgugaacauccaugucaagcaucccccugaggccucugugcaaauucaccagguguccagaaucgaugggcccacaggacagaaaaccaaggaagcccagccgggccaaagccaggucucuuaucaggggcuuccuguucaaaagacacagaccauucacuccaccuacagccaccaacaggugaucccccauguguauccugucgcugccaaaacacagcugggacgguguuuccaggagacgauuggcucucagugcgggaaggcucuccccggacuguccaaacaggaagacugcuguggcaccgugggcacaagcuggggguucaauaagugccaaaaaugucccaagaaaccuuccuaccacggauauaaccagaugauggagugccuuccgggcuacaagcgcguuaauaacaccuuuugucaggauaucaaugagugccagcugcaaggggugugucccaacggagaaugccucaauacaaugggcucuuauagauguaccugcaagauuggguucggaccugaccccacguuuagcuccugugucccugaucccccggugaucagcgaggaaaaaggcccuugcuaccggcugguuucuuccggccgccagugcaugcauccccugagcgugcaccucacaaagcagcuguguugcuguucugucgggaaagccuggggaccucauugcgagaaguguccccuuccuggcaccgcggccuucaaagagaucugccccgggggaaugggcuacaccgugagcgggguccacagacggcgcccgauucaccaucacgugggcaagggaccuguuuuugugaagcccaaaaacacacagcccgucgcuaaguccacccauccuccgccccugccugccaaagaggaacccguggaagcucucacauucucuagagagcacggcccugggguugccgaacccgagguggcgacggccccucccgagaaggaaaucccgagccuggaccaagagaaaaccaaacuugaaccuggacagccccagcuguccccuggcauuagcacaauccaccuccauccccaauucccggucgugauugagaagaccucuccucccgugccuguugaagucgcucccgaggccuccacaagcucugcuucccaggugaucgcccccacccaggugacggagaucaacgaauguaccgucaauccugauauuugcggggccggacacuguaucaaccugccggugcgguauacaugcauuuguuacgagggcuaucgcuuuagcgaacagcaaagaaagugcguugacaucgaugagugcacccaggugcagcaucuguguucccaggggcggugcgaaaauacagagggcucuuuccucuguauuugccccgcuggauuuauggcgagcgaggaaggcaccaacuguaucgacgucgaugagugccugcgcccugacguguguggggaaggacacugcguuaauacggugggcgccuucagaugugaguacugcgacuccggguaucggaugacacaaagaggacgcugugaggauaucgacgaaugccuuaaccccucuaccugcccugaugagcagugugucaauagccccggcuccuaccagugcgugccuuguacagaaggguuucggggcuggaacggacagugccuggacguugaugagugucucgaaccgaaugugugcgcuaacggcgacuguagcaaucuggaggggucuuauaugugcuccugucauaagggauacaccagaacccccgaucacaaacacugccgcgacauugaugagugucaacagggcaaccuuugcgucaaugggcagugcaagaacacagaaggauccuuccgguguacgugcggccaaggguaccagcugucugccgccaaagaccagugugaggauaucgacgaaugccagcauagacaccucugugcucauggccaaugccgcaauaccgagggauccuuucagugugugugcgaccagggcuaucgggccagcgggcugggagaucacugugaagacauuaacgagugccuggaggauaagucugugugucagagaggcgacugcaucaacacagcggggagcuacgauugcaccuguccugacggauuccaacucgaugacaauaagacaugccaggauauuaacgaaugugagcaucccggccugugcggcccucagggggaaugucuuaauaccgagggauccuuucacugcgucugucagcaaggcuucagcaucucugcugacgggcgcacgugcgaagauauugacgaguguguuaacaauacagugugcgauucccacggauuuugugacaacaccgccggcagcuuccggugccuguguuaucagggguuucaggcuccccaggacggacaaggcugcguggaugucaaugagugcgaacuccuguccggcguguguggggaggccuucugcgaaaacguugagggaucuuuccugugugugugcgccgacgagaaucaggaauacagcccgaugaccggccaguguagaucccgcacaucuaccgaucuugacgucgauguggaccaaccuaaagaggaaaagaaagagugcuauuacaaccucaaugaugcuagccugugugacaacguucuggcccccaaugugacaaagcaggaaugcuguugcacguccggggcgggauggggcgauaacugugagaucuuucccugcccuguccucgggaccgccgaguucacagaaaugugccccaaaggaaagggcuuugugccugcuggcgagucuagcuccgaagccgggggagagaauuauaaagacgcugaugaaugucugcuuuucggccaggagaucugcaagaacggguuuugucugaacacccggccgggauacgagugcuacuguaagcagggcacauauuacgaccccguuaaacuccaaugcuucgauauggacgaaugucaggacccuagcucuugcauugaugggcagugugugaauaccgagggauccuauaacugcuuuuguacgcaucccaugguccuggacgccagcgaaaagagaugcauccggccugcggagucuaaugaacagauugaggagaccgauguguaccaagaccugugcugggaacaccuuuccgaugaguauguguguagccgcccccucgucggcaaacagacaaccuacacagaaugcuguugccuguauggcgaggccugggggaugcagugugcucugugcccgcucaaggacucugaugacuacgcccagcuguguaacaucccuguuaccggaagacggcaacccuacggcagagaugcucuuguggacuucuccgagcaguauacaccugaagccgaucccuacuuuauucaggaccgcuuccugaauagcuuugaggaacuccaagccgaggaaugcgggauccugaacggaugugagaauggccggugcgugagaguccaggagggguauaccugugacugcuucgauggauaccaucuggacacggcuaaaaugacaugcguggauguuaacgaaugugacgagcuuaauaaccgcaugucccucugcaagaaugcgaaguguaucaacaccgauggcagcuauaaaugccugugucugccuggcuacgugcccucugacaagccgaauuauugcaccccucucaacacagcccugaaucuugaaaaagauagcgaccuggaguga

SEQ ID NO: 71686 - RNA, 5466 nt, Artificial Sequence
  derived and/or modified sequence opt5 from LTBP2__Homo_sapiens__NP_000419
augagaccccggaccaaggcgcgcuccccuggcagagcucugcggaauccguggcgcggguuccugccccugacacuugcccuguuugugggagcgggccacgcucagagagacccuguggggcgguacgagcccgccggaggcgaugccaaucgccucagacggccugggggauccuaucccgcugccgcugccgcgaaaguuuacucucuguuccgcgaacaggacgccccuguggcuggccuucagccgguggagagagcccagcccggcugggggagcccucggcgccccacggaagcugaggccagacggccuucccgcgcgcagcaaucuagacggguccagcccccggcccagaccagacgcagcacaccucugggacagcaacagcccgcuccucggaccagagccgcucccgcccucccccgccugggcacaccucagcgguccggggccgcuccgcccaccccucccagaggacgccugacaggccggaacgugugcgggggacagugcugcccuggcuggaccacggccaauucuaccaaccacuguaucaagcccguuugcgaaccgccuugucaaaauagaggcagcugcucccgcccccagcucugugugugccggagcggguuuagaggagcccgcugugaggaggucauuccugaugaagaguucgacccccagaacucucggcuggcuccuagacggugggccgaacgcucccccaaucuuagacggagcucugccgcuggcgaggggacacuggccagagcgcaaccgccugcuccccagagcccucccgccccgcagucucccccugccggaacccucucuggccugucccagacacaccccagccaacagcauguggggcuuucccgcaccguucggcugcacccuacggcuacagccucuagccagcucuccagcaacgcucugcccccuggacccggccuggagcagagagauggcacccaacaggccgugccgcucgaacauccuucuucccccugggggcugaaucuuacagagaaaaucaagaaaauuaagaucgucuuuaccccuaccauuugcaagcagacaugugcgcgcggacacugcgccaacagcugcgaaagaggcgacacgaccacacuguauucucaaggcgggcacgggcaugaucccaaaagcggguuccggaucuacuuuugucaaaucccgugccucaauggcggacgcuguauuggcagagacgagugcugguguccugcuaacuccaccgggaaguucugccaucugcccaucccucagcccgaucgggaacccccuggacgcggcucuagaccgcgggcccuucuggaggcuccccucaaacagagcacauuuacccugccucuguccaaucagcucgccagcgugaaccccucucuggugaagguccauauucaccacccucccgaggcguccguucaaauccaucagguggcccaggugcgcgggggagucgaagaggcucuuguggaaaauagcguugagacgagaccuccgcccuggcugccugccucucccggccacucccucugggacagcaacaacauuccugcucgguccggggaacccccgcgcccucugccucccgccgcccccagaccccggggccuucugggaagauguuaucucaauacagugaacggccaaugcgcuaauccucugcuggagcucaccacccaggaggauuguugcgggucugucggagcguucuggggcgugacacugugugccccgugucccccucgccccgcuagcccuguuaucgaaaacgggcagcuugagugcccccagggauacaaacggcugaaucucacccauugucaagacauuaacgaaugccugacacugggccuuuguaaggaugccgagugcgugaauacgagaggguccuaucucuguaccugccgcccgggccugaugcuggacccuucucggagcagaugugucuccgacaaggccaucagcaugcuccagggacugugcuaccgcucucuuggccccgggacauguacccugccucucgcucagcggaucacaaaacagauuugcuguugcuccagagugggaaaggccuggggcagcgaaugcgagaaauguccccugccugggaccgaggcguuucgcgaaaucugccccgcuggacacggcuacacguaugccucuuccgauauucggcugagcaugagaaaggccgaggaagaggagcuugcucggccgccucgcgaacaagggcagagaucuagcggcgcccuccccggacccgcggagcggcagccucugcgcgucgugaccgacacauggcuggaagcuggcaccaucccggauaaaggggacucccaggccggacaaguuacaaccagcgugacgcaugcccccgcuugggucacaggcaacgccaccacaccucccaugccugagcaggggauugcugaaauccaggaggagcaagugacccccucuaccgauguucucgugacacuguccacgccuggaaucgacagaugugccgcgggcgccaccaaugucugcggcccggggacaugugugaaccuucccgauggauaccggugcguguguagcccuggcuaucagcugcaccccucccaggcuuacugcaccgacgauaaugaaugucucagagacccuugcaaggggaaaggacgcuguauuaaccggguuggcucuuauagcugcuucugcuaccccggguauacacuggccaccuccggagcuacgcaggagugucaagauaucaaugaaugcgagcagccgggcgucuguucuggcgggcagugcacaaacaccgaaggaagcuaccacugugagugcgaccagggcuacauuauggugagaaaggggcauugucaagacaucaaugagugccgccacccuggaaccugucccgauggccggugcgugaacucccccgggucuuauacaugucuggccugcgaagagggauacagaggccagagcggcuccugcgucgacgugaacgaaugucuuaccccugggguuugcgcccauggaaaguguacaaaucucgagggcagcuuucgcugcucuugugaacagggguaugaggugacguccgaugagaaaggaugccaggacgucgaugaaugugcuagccgggcgucuugccccaccggccugugucugaacacagagggguccuucgccugcagcgcuugugaaaauggauacugggugaacgaggacggcaccgccugcgaggaucucgacgaaugcgccuucccuggcguuuguccgucuggggugugcacaaauaccgcuggauccuuuagcuguaaggauugcgacggcggguauagacccuccccucugggagauagcugugaggacgucgaugaaugcgaggacccccaaucuagcugucuuggcggggaaugcaaaaacacggugggauccuaccagugucugugcccucagggcuuccagcucgccaauggcaccguuugugaggacgugaacgagugcaugggggaggaacacugugcgccccacggagaaugccucaauucucauggcagcuuuuucugccugugugcuccgggguuugucuccgccgagggaggcacaucuugccaagauguggacgaaugugccaccacagauccuugcgucgggggacacugugucaacaccgagggcagcuucaauugccuuugugagacaggcuuucagcccuccccugaaucuggggagugcguugacauugaugaaugugaggacuauggagaucccgugugcggcaccuggaagugugaaaacagcccuggguccuaccgcugcgugcucggaugccagcccggcuuccauauggcuccgaauggggacuguaucgauaucgacgagugcgccaacgauacgauguguggaagccacggcuuuugcgacaauacagauggcucuuucagaugucugugcgaccaaggguuugagauuuccccuagcggaugggacugugucgaugugaacgaaugcgagcugaugcucgcgguuuguggcgcugcccugugcgaaaacguggaggggucuuuccuuugucugugcgccuccgaccucgaggaauacgaugcucaggagggacauugccggccccgcggcgccgggggccagagcauguccgaagcucccaccggagaccacgccccugcgccgaccagaauggauuguuauucuggccagaaagggcacgcccccugcagcuccguccugggacggaauacaacccaagcugaguguugcuguacgcagggcgccagcuggggagacgcuugcgaucuguguccuucugaagacuccgccgaguuuagcgagaucugccccucuggaaagggcuacauuccuguggaaggggccuggacauucggccagaccauguauacagaugcugacgaguguguuaucuucggacccggccuuugcccuaacgggcgcugucugaauaccgugcccggauacgucugccucugcaacccgggcuuucauuaugaugcgagccacaagaaaugugaagaccaugacgagugccaggaucuggccugugaaaauggggagugcgugaacacagagggauccuuccacuguuuuugcucuccuccccucacccuggaccuuagccaacagagauguaugaacuccacgucuagcaccgaagaucugccugaccaugauauucacauggacaucugcuggaagaaaguuacaaacgauguguguuccgagccccuccggggccacagaaccacauacaccgaaugcuguugccaggacggggaggcuuggagccagcaaugcgcccuguguccgccucgcagcuccgaagucuaugcccagcugugcaauguggcucggauugaggccgagagagaagcgggcgugcauuuccgccccggauacgaguacggccccgggccugaugaccuucacuauagcaucuacggacccgauggcgcuccuuuuuauaacuaccuggggccggaagacacgguccccgagccugccuuccccaauacagccggacauuccgcugaucggaccccuauccucgagucuccccugcagccuagcgaacuccaaccgcacuauguugccucccaccccgagccucccgcgggcuuugaaggccugcaggccgaggaaugugggauucuuaacggaugcgagaauggcagaugugugcgggugcgcgagggguacacaugcgacuguuucgaaggauuucagcuggacgcugcccauauggcuugcgucgaugugaacgagugugacgaucucaauggcccugccguucugugcgugcacggguauugugaaaacaccgagggaucuuacagaugccauugcagccccggcuacgucgcugaagccggcccgccucacuguaccgcgaaggaguga

SEQ ID NO: 71687 - RNA, 3912 nt, Artificial Sequence
  derived and/or modified sequence opt5 from LTBP3__Homo_sapiens__NP_001123616
augcccggcccuagaggggccgcuggaggccuggccccggagaugcgcggggcgggagcugccggccuccuggcccuucugcuccugcuucugcuccugcugcucgggcugggaggccggguggaaggcgggcccgcuggagagagaggcgccgggggaggcggggcucuugcccgggaacgcuucaaggucguuuuugcgccugugaucugcaaaagaaccugucugaagggacagugccgggacagcugucaacagggcuccaacaugacacucauuggcgagaaugggcacucuacggauacccugacaggaagcggcuuccgcguggucgugugcccccuuccuuguaugaacgggggacagugcuccucuagaaaucagugucugugucccccugacuuuaccggccgguucugccaaguuccggccgggggagcuggcggcgggacaggaggcagcgggcccggacucucccgcaccggcgcccugucuacaggggcucugccuccccucgccccugaaggcgauagcguggcguccaaacaugccaucuacgcuguccaggugauugccgaucccccgggaccuggcgaggggcccccugcucagcacgccgccuuucugguuccccuuggacccggccagaucagcgcugaggugcaagcgccuccgcccgucgugaacgugagaguccaucacccucccgaagccucuguucaggugcaucggauugaguccagcaaugcugaaucugccgccccuucccagcaucugcucccccacccgaagccuagccacccccgcccucccacccagaaaccucuggggagaugcuuccaagacacgcuucccaagcagccguguggaucuaacccucugcccggccucaccaagcaggaggacugcugcggguccaucggcacagcuuggggacaaagcaaaugucacaagugcccccagcugcaguauaccggcgugcagaaaccugggccgguccggggagaggugggcgccgauuguccccaaggguacaagcgccucaauuccacacauugccaggacaucaacgaaugugcgaugccuggaguuugcagacacggcgauugucugaauaaccccgggucuuaucggugcguguguccucccggccacagccugggaccuuccagaacccagugcauugcugacaaacccgaggaaaagagccuuuguuuucgccuggucucuccggagcaucagugccaacacccucucacgacacggcugaccagacagcuuugcuguugcuccgugggcaaggccuggggagcccgcugucagcggugccccacagauggaaccgcugccuucaaagaaaucuguccugcuggcaagggguaccauauucugaccagccaccagacacucacgauccaaggagagucugacuuuagccuguuccugcaucccgauggcccgccuaaaccccagcagcucccugagucccccucucaggcgcccccuccggaagacaccgaggaagagagagggguuacaaccgacagccccguguccgaggaacgcagcguccaacagucucacccuacagccaccacgacacccgcccggccuuaucccgagcugauuuccagaccuagcccgcccaccaugcgcugguuucuuccugaucugcccccuucucgguccgcuguggaaaucgcccccacccaggucacagagaccgacgaaugcagacucaaucaaaacauuuguggccacggagagugcgugccgggcccucccgauuacagcugucauugcaaucccggguaucgcucccacccucagcaucgguacuguguugacgugaacgaaugcgaggcugagcccugcggaccuggcagagggaucuguaugaauacaggaggcucuuacaacugccacuguaaccggggcuaucgccugcacgucggggccggaggcagaagcugcguggaucugaaugaaugugcgaagccgcaucuuugcggggacggaggcuucuguaucaacuuucccgggcacuacaaaugcaauuguuauccuggauaccggcucaaggccuccagacccccuguuugcgaggauauugacgaaugucgcgaucccucuagcugcccggacggcaaaugcgagaacaagccuggcuccuucaaguguaucgcuugccagcccggguaucggagccagggaggcggggccuguagagaugugaaugagugcgcugaaggaucuccuuguucccccggcuggugcgagaaccugccugggagcuuccgcuguacgugcgcccaaggauacgcccccgcuccggacggcagaucuugucuggacgucgaugaaugcgaggcgggcgacgugugugauaaugggauuugcuccaacaccccugggagcuuucagugccagugucucucuggcuaucaucugagccgggaccgcucccacugcgaagauaucgacgagugugauuuccccgccgcuugcauugggggagacuguaucaauacaaacggcagcuacagaugccuuuguccccaggggcaucggcuggugggaggccgcaaaugccaagauaucgacgaguguucucaggauccuucccucugccugccgcacggcgccuguaagaaucugcaggggagcuacguuugcgucugcgacgaaggauuuacccccacacaggaucaacacggcugugaggaaguggagcagccucaucacaaaaaggaaugcuaucuuaacuucgacgacaccguguuuugugauuccguccucgccacgaaugugacccagcaagagugcuguugcucucugggggcuggauggggcgaccauugugagauuuaccccugcccuguuuauagcuccgccgaguuccacucucugugucccgaugggaaaggauacacacaggacaacaauaucgugaacuauggcauuccugcgcauagagauaucgacgaaugcaugcucuuuggcagcgaaauuuguaaggaggggaagugcgucaacacccagccgggauacgaauguuauugcaaacagggcuucuacuacgaugggaaucugcuugagugcguggacguugaugagugucuggacgaauccaacugccggaauggagugugugagaacacacgcggcggguauagaugcgcuuguacgcccccugccgaauacucucccgcccaacggcagugccucagcccugaggagauggaugucgacgaaugucaggaucccgcugccugccgcccgggaagaugugugaaucugccuggcuccuaucggugcgaguguagaccucccuggguucccggccccagcgggcgcgacugccagcugccugaaucuccggcggagcgggcucccgaaagacgcgacgugugcuggucccaacggggagaggauggcaugugugccgggccucuugccggacccgcucucaccuuugacgauugcuguugcagacagggccgcggguggggagcccagugucggccuugucccccgagaggcgcuggcagccacugcccuacaucucaguccgagagcaacucuuucugggacaccagcccccugcugcucgggaagccuccccgcgaugaagacuccuccgaggaagauagcgacgagugccggugugucucuggaagaugcgugccucggcccggcggggccgugugugaaugcccgggaggcuuucaacuggaugcgagccgcgccagaugcgucgacaucgaugagugucgggagcuuaaucagcgcgggcugcucugcaaauccgaaagauguguuaacacaucuggcagcuuccggugcguguguaaggcuggauuugccagaucccgcccucacggcgcuugcgugccccagcggagacgcuga

SEQ ID NO: 71688 - RNA, 4875 nt, Artificial Sequence
  derived and/or modified sequence opt5 from LTBP4__Homo_sapiens__NP_001036009
augcccagaccuggcaccagcgggcggcgcccgcugcuccuggugcuucugcucccccuguucgccgcugccacauccgcggcuucuccuagccccuccccuucucaggucguugaggugcccggagugccuagcagaccggccuccgucgccgugugccgguguugccccggccaaacgucucgcagaagccgguguauccgcgcuuuuugcagaguucgguccugucagccuaagaaaugcgccgggccccagcgcugucuuaacccugugcccgcugucccgagcccuucucccuccgugagaaagcggcagguuagccugaauuggcaaccucucacccugcaggaagcccgcgcgcugcucaaaagacggcgccccagaggacccggcgggcggggacugcuuagacgccggccuccgcagagagcccccgcuggcaaggccccugugcugugcccccucauuugucacaacggcggggucugcgugaaaccugaccgcugucugugucccccggauuucgcuggaaaguuuugccagcuucauucuuccggcgcccggccucccgcgccugccgugcccgggcugacaagaagcgucuacaccaugccucucgcuaaucaccgcgacgaugagcauggaguugccucuaugguguccgugcacgucgaacauccccaagaggcuagcgugguugugcaccaggucgaacggguguccggcccgugggaggaggccgacgccgaagcuguugcgagagccgaggcugccgcccgcgcugaagccgcggcuccuuauacagugcuggcccagucugcuccccgggaggauggguacagcgacgcuuccggauucggcuauugcuuuagagagcugcgcggcggggaaugcgccagcccccucccuggacugcggacccaggaggucuguugcagaggcgcugggcuugccuggggagugcacgauugucaacugugcucugaacggcucggcaacuccgagcgcgucagcgcgccggacgggcccuguccuacaggauucgaaagagugaauggcucuugcgaggauguugacgagugugccaccggcgggcggugccagcauggagaaugugcuaacacgagaggcggguauaccugcgugugccccgauggauuucugcuugacagcucccgcucuagcuguaucucccagcacgucauuagcgaggccaagggcccuugcuuccgggugcugagagaugggggcuguucucuccccauccugcgcaauauuacaaaacaaaucugcuguugcuccagaguuggaaaggcuuggggccgggggugucagcugugcccucccuuuggaagcgaaggcuuccgcgagaucuguccggccgggccuggauaccauuacucugcguccgaccucagauauaacacccggccccugggccaggaaccuccccgcgugagccuuucccagccgagaacacugccugccaccucucggcccagcgcuggguuucucccuacgcaccgccuggagcccagacccgagccucggccggacccccgcccuggccccgaacuuccucugcccuccauuccugccuggacaggaccggagauccccgaaucuggcccuagcuccgggaugugccaaagaaauccccaggucuguggaccuggccggugcauuagcagacccucuggguauaccugcgcuugugauuccggauuccgccucagcccgcagggcacacggugcaucgacguggaugaguguagacgcgugccuccucccugcgcccccgggcggugugaaaacucucccggcuccuuuagaugcguuuguggaccuggcuuccgcgccgggccgcgggcugcggagugccuggacgucgaugagugucacagagugcccccucccugcgaccugggacgcugugaaaauaccccuggcagcuuccucugcgugugccccgccggguaccaggcugccccgcauggagccucuugucaagaugucgacgagugcacccagagcccuggccugugugggcggggcgcuugcaaaaaccuucccggauccuuuagaugugugugcccugccggcuuccgggggagcgcgugugaagaggauguugacgagugcgcucaggaacccccucccuguggaccgggccgcugcgauaauacagccgggucuuuucacugugccugcccugcuggauucagaucccggggccccggcgcccccugccaggacguggacgagugugcgcgcagcccuccgcccugcacguacgggagaugugaaaacaccgagggauccuuucaaugcgucuguccuaugggcuuccagcccaauacagcugggucugaaugcgaggauguggacgagugugaaaaccaucuggccugcccuggacaggaguguguuaacagccccggcuccuuucagugccggaccuguccuucugggcaccaucuccacagaggacgcugcacagauguggacgaaugcagcuccggcgccccgcccuguggcccucacgggcauugcaccaauacggagggaucuuuccgguguagcugcgcucccggcuacagagccccuuccgggcgccccggaccgugugcugaugucaacgaaugccuggagggcgacuuuuguuucccucacggggagugccugaauacagauggcagcuuugccuguaccugcgcgcccggcuaucggcccggcccuagaggggccucuugucuugacguggaugaaugcuccgaggaagaccucugucaaagcggaauuugcaccaacacagauggcucuuucgagugcaucugucccccugggcaucgcgcuggaccggaccuggccuccugccuggauguugacgaaugucgggagagaggccccgcucucugcgggagccagcgcugugaaaauucuccuggauccuacagaugcgugcgggacugugaucccggcuaucacgccggcccugaagggaccugcgacgaugucgacgagugucaggaauacggacccgagauuugcggcgcccaacgcugugagaacacaccggggagcuauagaugcacgccugcuugcgaucccggauaccagccuacccccggcgggggaugucaggacguggaugaaugccggaaucgcuccuuuuguggcgcgcacgccgugugccagaaccugccuggcagcuuccaaugucuuugcgaccagggguacgagggagcuagagauggccggcauugugucgacguuaaugaaugcgagacacugcaggggguguguggagccgcccucugcgaaaacguggagggcucuuuccugugugucugccccaauagcccggaggaauuugauccuaugaccgggagaugcgugccuccccgcacauccgcuggaaccuuccccggcucucagccgcaagcccccgcgagcccuguucugcccgcucggccucccccucccccgcuuccuagacgccccuccacgccucggcagggccccguggggucuggaagacgggaguguuauuuugacaccgccgccccggaugcuugcgacaacauccucgcccgcaaugucacauggcaggaauguugcuguaccgugggcgagggguggggaagcggcugcagaauccagcaauguccugggacagaaaccgcggaguaccagucccugugcccccacggacggggcuaucuggcucccucuggcgaccucagccugcgcagagauguugacgagugucagcuuuuccgggaucaagugugcaaguccggggucugugugaacacggccccuggauacagcugcuauugcucuaauggcuacuauuaccauacacagcgccuggaauguauugacaacgaugagugcgccgacgaggagcccgcuugugaagggggaagaugcguuaacaccgugggcuccuaccacuguacaugcgagccuccgcucguccuggaugggagccagcggcgcugugugucuaaugagucccagagccuggacgauaaccuuggcgugugcuggcaagaagucggagccgaccucguuuguucccaucccagacuggaucggcaggcuaccuauaccgagugcuguugccuguacggcgaagccugggggauggacugcgcgcucuguccugcccaggacucugaugacuuugaggcucugugcaaugugcuuagacccccugccuauagcccuccccgcccgggaggcuucgggcugcccuacgaguauggaccugaucucggacccccuuaccaggggcugcccuauggcccggaacuguacccuccucccgcccuucccuacgaccccuauccuccgcccccuggacccuuugcccggagagaggccccuuacggcgcuccccgcuucgauaugccggacuuugaagaugacgggggaccuuauggcgaguccgaagcgcccgccccucccgggccgggaacacgguggccuuacagaagccgcgauacgcggagaucuuuccccgagcccgaggaaccucccgagggcggguccuaugcuggcagccucgccgaaccuuacgaggaacuggaggccgaggaauguggaauccuggacggcugcaccaacgggcgcugugugcgggucccggagggauuuacaugcagauguuucgauggcuaucgccucgacaugacccggauggcuugcguggauauuaaugaaugugacgaggccgaagcggcuucuccccugugcguuaacgccagaugucuuaauacagacgggagcuuucgcugcaucugcagaccuggauucgcccccacccaccaaccucaccauugugcucccgcccggccucgcgcguga

SEQ ID NO: 71689 - RNA, 1251 nt, Artificial Sequence
  derived and/or modified sequence opt5 from LTBR__Homo_sapiens__NP_001257916
auggaggccaccggcaucagccuggcuucccagcucaaggugcccccuuacgccucugaaaaccaaacaugcagagaccaggagaaagaauauuacgagccgcagcaccggauuuguugcagccgcugucccccugggacguaugucuccgcgaagugcucuagaauccgggauaccguuugugcuacaugcgccgaaaauagcuacaacgagcauuggaauuaucugaccauuugucagcuuugccgccccugugacccugugaugggacuggaggaaaucgcccccugcacauccaaaagaaagacccaaugucggugccagccuggcauguucugcgcugccugggcucucgaguguacacacugcgaacugcuuucugauuguccgcccgggaccgaggccgagcugaaagacgaagugggaaagggcaacaaucauugcgucccuuguaaggcggggcacuuucagaacacgagcucccccagcgcccgcugccagccucauaccagaugugagaaucaaggacucguggaagcugcccccggcacagcucagucugauaccacaugcaaaaacccgcuggagccucugcccccugaaauguccggcaccaugcucaugcuggccguucuucugccccucgcguucuuucugcuucuggccacgguguucagcuguauuuggaagucucaccccucccucugccggaaacuggggagccugcucaagcgcagaccucagggagagggcccgaaucccgucgcugggucuugggagccucccaaagcccacccuuacuuucccgaccuggugcagccgcuucugccuaucuccggagauguuagccccguguccacaggccucccugcugcccccguccuggaagccggggugccucaacagcagucuccccuugaccugacccgggagccgcaacucgaaccuggagagcagagccagguggcucauggcacaaacggcauccacgucaccgggggauccaugaccauuacaggcaauaucuauauuuacaacgggcccguucugggagggcccccuggcccgggagaucugcccgcgacgccugaacccccuuaccccaucccugaggagggcgaccccggcccgccugggcucagcacaccccaucaggaagauggaaaggccuggcaccuggcugagaccgaacacuguggcgccaccccuucuaaucgcgggcccagaaaccaauucauuacacaugacuga

SEQ ID NO: 71690 - RNA, 453 nt, Artificial Sequence
  derived and/or modified sequence opt5 from LTC4S__Homo_sapiens__NP_665874
augaaggacgagguggcccugcucgcugccgucacccugcuuggcguucugcuccaggcguacuucagccugcaagugaucuccgcuagacgggccuuucgcgugucucccccucuuacaacggggccgcccgaauuugagagagucuaucgggcccaggugaacugcagcgaauacuuuccucuguuccucgcuacccuguggguugccggaauuuucuuccacgagggcgcugccgcgcugugugggcucguguaucuguuugcccgccuuagauacuuccagggauaugcucgguccgcccagcugcgccucgcuccccuguacgccucugcgagagcccuuuggcugcucgucgcucuggccgcucugggccuccuggcccauuuucuuccugccgcucugcgggcggcccuccuggggcgccuuagaacacugcuccccugggcuuga

SEQ ID NO: 71691 - RNA, 2001 nt, Artificial Sequence
  derived and/or modified sequence opt5 from LTF__Homo_sapiens__NP_001186078
augagaaaggugcgggggcccccugucagcugcaucaaacgcgacuccccgauucaguguauccaagccauugcugagaacagagccgaugcgguuacccuggacggcggauucaucuacgaagcuggccucgcccccuauaagcugcggccuguggccgcugagguguacgggacagaacgccagcccagaacgcacuauuacgccgucgcugugguuaaaaagggaggcucuuuucagcuuaaugagcugcaggggcucaaaagcugccauaccggacugcggcgcacagccggcuggaacgugccuauuggcacccuuagacccuuccugaauuggacagggccuccggaacccaucgaggcggccgucgcucgguuuuucuccgccucuugugugccuggagcugauaagggccaauuucccaaccucugccgccugugugccgggaccggagagaauaagugcgcguucagcucccaggaaccuuauuuuucuuacagcggcgccuucaaaugucugagagacggggcuggagauguugccuuuauccgggaguccacaguguucgaagaccucagcgaugaggcugagcgcgacgaauaugagcugcuuugccccgauaacaccagaaagccggucgacaaauuuaaggauugucaccuggcccgggugccuucucaugccguggucgcucgcuccguuaauggcaaagaagacgcgauuuggaaccuccugagacaggcccaggagaaguucggcaaggauaaaagccccaaguuucaacuuuucgggucuccuuccggacagaaagaccuccuguucaaggacagcgcuaucggcuuuucucgggugccucccagaauugauuccgggcuguaccugggaagcggcuacuucacggccauccagaaucuccgcaaauccgaagaggagguggccgcucggagagcccgcgucguguggugcgcgguuggggaacaggagcugcggaaguguaaccaauggucuggacuuagcgaaggcuccgugaccugcagcucugcuuccacaaccgaggacugcauugcccugguccucaaaggcgaagccgaugcuaugagccuggacgggggauauguguacacagccggcaagugugggcuuguucccgugcuggcugagaauuauaagucucagcagagcuccgauccggaccccaacugcgucgauagaccuguggagggauaccucgccgucgcggugguucgccggucugacaccagccugacguggaacuccgugaaaggcaagaaaagcugucacacagccgucgauagaaccgcuggguggaauauccccaugggccugcucuuuaaucaaacaggaucuugcaaguucgacgaauauuuuucccagagcugugccccuggcucugauccccgcuccaaccugugcgcucuuuguauuggggacgagcagggagaaaacaaaugcgugccgaauagcaacgagcgguacuauggcuacaccggggccuucagaugucuggcggaaaaugccggagacguugcuuuugugaaggaugucaccgugcuccagaacacagacggcaauaacaaugaggccugggcuaaggaucugaaacuugccgacuucgcccugcucugccuggaugggaagcgcaaaccugugacggaggcucgguccugucaucuggcgauggcccccaaccacgcuguugucucuagaauggacaagguggaacggcucaaacaagugcugcuucaccagcaggccaaguuuggccgcaauggaagcgauugcccugacaaguucugccuguuucaguccgagaccaaaaaccuccuguucaaugauaacacagaaugucuggccagacuucauggcaagaccacauacgagaaauaucucgggccccaauacgucgcuggaaucaccaaucugaagaaaugcucuacgagcccucugcucgaggccugugaauuucugcggaaguga

SEQ ID NO: 71692 - RNA, 2205 nt, Artificial Sequence
  derived and/or modified sequence opt5 from LTK__Homo_sapiens__NP_001129157
augggcugcugggggcagcugcucgugugguucggagccgcuggcgccauccuguguagcucccccgggucucaagagaccuuucuuagaagcuccccucugccgcucgcgucucccagcccucgggaccccaaggucuccgcuccucccucuauucuggaaccugccagcccgcuuaacucccccggaacagagggcagcuggcuguucucuacgugcggggccuccggacgccacggcccuacccagacacagugugauggcgcuuacgccgggaccagcguuguggugacagucggagcugccggccagcucagaggggugcaacuguggcggguucccggaccuggccaguaucugaucucugcguacggggccgcuggaggcaaaggcgccaagaaucaucucucccgcgcucacgggguguuugucagcgccauuuucucucugggacuuggcgaaucccuguauauccucguggggcagcagggagaggacgcgugccccggcgggagcccggaaucccaacugguuugucuuggagagucuagagccguggaggaacaugcugccauggauggcagcgagggcgucccugggucccggcgcugggcuggaggcgggggaggcgggggcggagccaccuacguguuuagagugcgggccggcgaacuggagccccuccuggucgcugcugggggaggcgggcgcgccuaucugagaccucgggaccgcggaagaacacaggcuagccccgagaaacucgaaaaccggucugaggcccccggcuccgggggccgcggaggcgccgcugggggagaugccagcgaaaccgacaaucugugggcggauggcgaggacgggguuucuuucauucacccuagcuccgaacuuuuucugcagccgcucgcugugacggagaaccauggagagguggaaaucagacggcaccugaauugcucucacuguccccuuagagauugccaguggcaagccgagcugcagcucgccgaaugucugugcccugagggcauggaacuggcugucgacaacgugaccuguauggaucuccauaagcccccugggccccugguucuuaugguggccgucguggcuacaagcacccugucccuccugaugguuugcggcgugcuuauccugggaggcgccuggccggggccuguccucgcgagcgccacacgcugccaccggggauuccccucucaguguuacuccgcucaaacccugccugagcugugcagcccccaggacgagcucgauuuucugauggaagcccuuauuaucucuaaauucagacaucagaauauugugcgcugugucggccugucccuccgggcuacgccuagacugauccugcuugagcucaugagcgggggagacaugaaguccuuucugcgccacucucggccccaccugggccagccgagcccucucgugaugagagaccugcuucaacuggcccaggauauugcgcaggggugccauuaucucgaagagaaccacuucauccaucgcgacauugccgcucggaauugucugcuguccugcgccggccccucuagaguugcuaagaucggagauuuuggcauggcccgcgacaucuaccgggccagcuacuauagacgcggggaucgggcgcuucuccccgugaaauggaugccuccggaagcguuccuggagggaauuuucacauccaagaccgacagcuggucuuuuggcguccugcucugggagaucuucucccugggguacaugcccuauccuggaagaacaaaccaggaagugcuugauuuuguugugggcggcgggcggauggaucccccuagaggaugucccggcccugucuaccgcauuaugacccaaugcuggcagcacgagcccgaacugcggccgagcuucgccucuauccucgagagacugcaguauuguacccaggacccugacgugcuuaauucccugcuccccauggagcuggggccuacacccgaagaggaaggaacgagcggccuggggaaccgcucucucgagugccugagaccgccucaaccccaggaacuuagcccugagaaacugaaguccuggggaggcagcccccucggccccuggcugucuuccgggcugaaaccucuuaagagccggggacuccagccgcagaaucuguggaaccccaccuaccgcuccuga

SEQ ID NO: 71693 - RNA, 1299 nt, Artificial Sequence
  derived and/or modified sequence opt5 from LUC7L3__Homo_sapiens__NP_057508
augaucagcgccgcucagcugcucgacgagcugaugggcagagaucggaaccuugcccccgacgaaaagcgcuccaaugugagaugggaucacgagucugucugcaaauacuaucuguguggguucugcccugcggaacucuuuaccaacacacggagcgaccugggaccgugugagaagauucaugaugaaaaucuucgcaaacaauacgagaaguccucuagauucaugaaaguuggcuaugagcgggacuuucugcgcuaccuccagagccugcuggcugaaguggagagacggauccgcagagggcacgcccggcucgcccugucccagaaccagcaaucuagcggagcugccggccccacggggaagaaugaagagaagauucaggugcuuaccgauaaaaucgacguccugcuccagcagauugaggaacugggauccgagggcaagguggaagaggcucaaggcaugaugaaacuuguugaacagcugaaggaggagcgcgaacuccugagaagcacaaccucuacaaucgaguccuucgccgcgcaggaaaaacagauggaggugugcgaagucuguggggccuuucugaucgugggagaugcucaaagccggguugacgaucaucucaugggcaagcagcacaugggguaugccaagauuaaagcuaccguggaggagcugaaggaaaaacuucgcaagagaacagaggaaccugaccgggaugagagacugaaaaaggaaaaacaggagcgcgaggaacgggagaaggaaagagagcgcgagcgggaagagagagaacgcaagcggagacgcgaggaagaggagcgggaaaaagagagagcccgcgaccgggaaagacggaagcgcucuagaucccggagcagacauucuucccgcaccagcgaccggagaugcucccgcucuagagaucacaaacggagccgcuccagagagcggcgcagaagccggucucgcgacagacggcgcuccagaagccacgaucggucugaaagaaagcaucgcagccgguccagagaccgccggagaucuaaaagccgcgaucggaaguccuacaagcacagaagcaaaucucgcgaccgggagcaagauagaaaguccaaagagaaggaaaaacggggaagcgacgauaagaagucuuccgucaaaagcggcucccgcgagaagcagucugaagacacgaacaccgagagcaaagaauccgauacaaagaaugaggugaacgggaccucugaggacaucaaaagcgaaggagacacacaguccaauuga

SEQ ID NO: 71694 - RNA, 978 nt, Artificial Sequence
  derived and/or modified sequence opt5 from LUC7L__Homo_sapiens__NP_060502
augagcgcccaggcucaaaugagagcccugcucgaccagcugaugggcaccgcgcgggauggggacgagacacgccagagagugaaguucacggaugaccgggucugcaaaucccaccuucuggauuguugcccccaugacauccucgcuggaacccgcauggaucugggcgaauguacaaagauucacgaccuugcccugagagccgauuacgagaucgcuucuaaagaacgggaccucuuuuucgagcuggaugccauggaccaucuggagagcuuuauugcugaaugcgaucgcagaaccgagcucgccaagaaacggcuggcggaaacacaggaggaaaucuccgccgagguuucugcuaaggccgagaaggugcacgaacuuaacgaggaaauugggaaacugcucgcuaaggccgagcaacugggagcggaaggcaauguggacgagagccagaaaauccuuauggaggucgaaaaggugcgcgccaaaaagaaggaggcugaagaggaauauagaaacuccaugccugccucuagcuuccagcagcaaaaacugcggguuugugaggugugcuccgcuuaccucgggcugcaugacaaugaucgcagacuggccgaccacuuuggaggcaagcuccaccugggcuucauccagauucgggagaaacuugaucagcugcgcaagaccgucgccgaaaaacaggagaagagaaaccaagaccggcucagacgccgggaagagagagaacgcgaggagcggcugagcagacgcucugggucccggacaagagaucgccggagaagccgcucucgggacagacggcgcagacgguccagaagcaccucucgcgaacggagaaaacuuucccgcagcagaucccgggaucgccauagacggcaccgcucuagaagccggucccauagccgcggacacagacgggcuucucgcgacagauccgcgaaguauaaguga

SEQ ID NO: 71695 - RNA, 1017 nt, Artificial Sequence
  derived and/or modified sequence opt5 from LUM__Homo_sapiens__NP_002336
augagccuguccgccuucacccucuuucuggcucuuaucggcgggacaucuggacaguacuaugacuacgauuucccccugagcauuuauggccaauccucuccuaacugcgccccggaguguaauugccccgaaagcuacccuuccgcgauguauugugacgagcucaagcugaaaucugugcccauggucccucccgggaucaaguaccuuuaucugagaaacaaucagauugaucacaucgacgaaaaggcuuuugagaacguuacggaucuccaguggcugauucuggaccauaaucuccuggaaaacagcaagaucaaaggacggguguucuccaaacuuaagcagcugaaaaagcuccacaucaaucauaacaaucugaccgagagcgugggcccucuuccgaaaucucuggaggaucuccaacugacacacaacaagauuaccaaacugggguccuuugaaggacucgucaaucugacauucauccaucuucagcacaaccgccugaaggaggacgccgugagcgccgcuuuuaagggccucaaaucucuggaauaccuugaucuguccuucaaucagauugccagacuccccagcggccugccuguuucucugcucacccuguaccuugacaacaauaagaucuccaacauucccgaugaguauuuuaaacgguucaacgcucugcaguaccuccgccugagccacaaugagcuugccgacuccgggaucccuggaaacucuuuuaaugugagcucccuggucgaacucgaucugagcuauaacaagcugaaaaauauucccacagugaacgagaaucucgaaaacuacuaucuggagguuaaucaacuugaaaaguucgacaucaaaucuuuuugcaagauccugggcccgcucuccuacagcaagauuaaacaucugagacuggacgggaaccggaucucugagaccagccuuccucccgauauguaugagugucuccgcguggcgaaugaagucacgcugaacuga

SEQ ID NO: 71696 - RNA, 687 nt, Artificial Sequence
  derived and/or modified sequence opt5 from LURAP1L__Homo_sapiens__NP_981948
auggaggacagcccccugccugaucucagagacaucgaacugaaacuuggccggaaggugccggagucccugguccgcucucucagaggggaggaacccguuccucgggaacgcgauagagaccccugcggaggcagcgggggaggcgggggaggcggcgggggauguuccucuagcuccucuuacugcagcuucccucccucccugagcagcuccucuucuuccagcccuaccucuggcuccccgcgggggagccacuccucugcccuugagcgccuggagacaaagcuccaucugcugagacaggaaauggugaaccuccgggcuacggaugugcgccugaugagacaacuucuggucauuaaugagagcaucgaauccauuaaauggaugaucgaggagaaggccaccauuacaagccggggaucuucccucagcggcucucuguguagccuucuggaaucccagucuaccagccuccgcggguccuauaacagccugcacgacggaucugauggccuggacggcaucuccguggggagcuaccucgauacacuggcggacgauguucccggacaucagaccccuucugaccuugaucaguuuuccgacagcucccugaucgaggacucucaagcucuccacaaaagacccaagcuggauagcgaauauuacugcuucggcuga

SEQ ID NO: 71697 - RNA, 942 nt, Artificial Sequence
  derived and/or modified sequence opt5 from LUZP4__Homo_sapiens__NP_057467
auggccagcuucagaaagcugacccucuccgagaaagugcccccuaaccacccgucucggaagaaagucaauuuucuggacaugagccuugaugacaucauuaucuacaaggaacuggagggcacaaacgcugaagaggagaaaaauaagcgccagaaccauuccaagaaagaaucucccagcagacaacaguccaaggcccaccggcaucgccacagacggggguauucucgcugcagaagcaauuccgaggaaggaaaccaugauaaaaagccuagccagaaacccucuggcuucaaguccgggcagcacccucucaauggacaaccccugauugagcaggaaaaguguagcgacaacuacgaggcgcaggcugagaaaaaucagggccaaucugaagggaaccagcaccaguccgagggaaauccugauaagagcgaagagucucagggccaaccggaagagaaccaucacuccgagcggagccgcaaucaucuugaaagaucccugucucagagcgaccggucccagggccaacucaaacgccaccacccccaguaugagagaagccaugggcaguacaagcggucucacggacaguccgaacgcagccauggccacucugagagaagccaugggcacuccgaacggucucacggacauagcgagagaucccacggccauagcaaacgcucucggucccaaggggaucugguugacacgcagagcgaucugaucgccacccagagagaccucauugccacacagaaggaucugaucgcuacccaacgcgaccuuaucgccacacagcgggaucugauugugacccagagagaccucguggcuacagagcgcgaccugaucaaccagucuggacggucccacggccaaagcgaaagacaccagcgcuauuccaccggcaaaaauacgauuaccacauga

SEQ ID NO: 71698 - RNA, 177 nt, Artificial Sequence
  derived and/or modified sequence opt5 from LUZP6__Homo_sapiens__NP_001122091
augaaaagcgugaucuccuacgcccuguaucagguccaaaccggcucucuccccguuuacagcuccgugcugacaaagucuccucuucagcugcagacggugauuuauagacucaucguccagauucaacaccugaacaucccgagcuccucuagcacccauuccagccccuucuga

SEQ ID NO: 71699 - RNA, 2973 nt, Artificial Sequence
  derived and/or modified sequence opt5 from LVRN__Homo_sapiens__NP_776161
auggggcccccuagcuccucuggcuucuacgugagcagagccgucgcucugcuccuggccggacuuguugcggcucugcuccuggcccuugccgugcuggcugcccucuauggccacugcgagcgggugccgcccuccgaacugccugggcugcgcgaccucgaggcugaaucuucucccccucugagacagaagcccaccccuacaccgaaacccuccucugcccgggagcuugcggucacgaccacaccuagcaacuggagacccccuggacccugggaucaacugcgccucccgccuuggcuggugccccuucauuacgaccuggaacucuggccucagcugcggcccgaugagcugcccgccggcucccucccuuuuaccgggcgcguuaauaucacagugagauguaccgucgcuacaagccggcugcuucugcacucucucuuccaggacugcgagcgcgccgaagugagaggaccgcugucccccggcaccggcaacgcuacgguugggcgggugccugucgaugacgugugguuugcccuugauaccgaguauauggugcuggaacucagcgagccccugaagccuggaucuuccuacgagcugcagcucagcuucucuggccuggucaaagaagaccuucgcgaggggcuguuucucaauguuuauacagaucaaggagaaagacgggcgcugcuugccucccagcuggagcccaccuucgcucgcuacguguuuccguguuucgacgaaccugcccucaaggcuacauuuaacauuaccaugauccaucaccccagcuauguggcccuguccaauaugccuaaacugggccagucugagaaggaggaugucaacgggagcaaguggacggugacaaccuucuccacaacaccccauaugccuaccuaccucguugccuuugugauuugcgacuacgaucacgucaauagaaccgaacggggaaaagagaucagaauuugggcucgcaaggacgcgaucgccaacggcagcgcugacuucgcccugaauaucacgggccccauuuuuagcuuccuugaagaucuguucaacaucuccuauagccucccgaaaaccgacauuaucgcccugccuucuuuugauaaucacgcuauggagaacugggggcugaugauuuucgacgaaagcggacuucuccuggagcccaaggaucagcugacagagaaaaagacccucaucuccuacgugguuucucaugaaauuggccaccaaugguuugggaaucuggugacaaugaacugguggaauaacaucuggcuuaacgagggauucgccagcuauuuugaguucgaagucaucaauuacuuuaaccccaagcugccucggaaugaaauuuucuuuuccaacauccuccauaauauucugagagaggaccacgcgcuggugacccgcgcugucgccaugaaaguggagaacuucaagacgagcgaaauccaggagcuuuuugauauuuucacauauucuaaaggcgccuccauggcucggaugcucagcuguuuucugaaugaacaccuguucguuucugcccucaaguccuaccugaaaaccuucagcuauuccaacgcugagcaggacgaucuuuggagacauuuucagauggccaucgacgaucaaucuaccgugauccugccggcgacaauuaagaauaucauggacagcuggacccaccaguccggguuccccgucauuacacucaacgugucuacgggaguuaugaaacaggagccuuuuuaccuggaaaauaucaagaaccgcacccugcuuacaagcaaugacaccuggauugugcccauccucuggaucaagaacggcacaacccaaccucuggucuggcuggaucaguccagcaaaguguuccccgagaugcaagugucugacuccgaucaugacuggguuauucucaaucugaacaugacgggcuacuaucgggucaacuacgauaaacuuggguggaaaaagcugaaucagcagcucgaaaaagacccuaaggccauccccgugauucacagacugcagcugaucgaugacgcuuuuagccuuucuaagaacaauuauauugagaucgaaaccgcccucgagcugacaaaauaccuggcugaggaagaugagauuaucguguggcauaccguccucgugaaccugguuacacgcgaccuuguguccgaagucaauaucuaugauauuuacagccugcucaagcgguaucugcugaaaagacuuaaccugaucuggaauauuuacucuaccaucauucgcgagaacgugcucgcccugcaggacgauuaccucgcgcugaucagccuugaaaagcuguucguuacggccugcuggcucggacuggaggacugucugcagcuuuccaaagagcuguuugcuaaguggguggaccacccggaaaaugagaucccuuaucccauuaaggaugucgugcucugcuacggcaucgcccuggggagcgacaaagaaugggauauucuccugaacacauauaccaauacaaccaacaaggaggaaaagauccaacuugcuuacgccaugucuuguuccaaggacccuuggauucugaaucgguauauggaguacgccaucagcaccucccccuucacaucuaacgagacgaauaucauugaaguuguggcuagcuccgaggucggaagauauguggcgaaagauuuucucgugaacaacuggcaggccgucucuaagcgguacggcacccagagccugaucaaucugauuuacacaaucgggcgcaccguuacaaccgaccuucagauuguggaacugcaacaguucuuuuccaacaugcucgaggagcaccagagaauccgggugcaugcuaaucugcagacgaucaagaacgaaaaucucaaaaacaagaaacugucugccagaauugccgcuuggcuucgccggaauacauga

SEQ ID NO: 71700 - RNA, 669 nt, Artificial Sequence
  derived and/or modified sequence opt5 from LXN__Homo_sapiens__NP_064554
auggagauucccccuaccaacuacccggccagcagagcugcccugguggcgcagaauuauaucaacuaccaacagggcacaccccaccgggucuucgaaguucagaaggugaaacaggcuuccauggaggacaucccugggcgcggacauaaguaucaccucaaauuugccguggaagagauuauccaaaagcaggucaaagugaauugcacggccgaaguucuguaccccucuaccggccaggagacagcuccugaggugaacuucaccuuugaaggggagacaggaaagaaucccgaugaagaggacaacaccuucuaucagagacuuaagagcaugaaagagccucuggaagcccaaaauauuccggauaacuuuggcaaugucucccccgagaugacacucgugcugcaucuugcuuggguugccuguggguacaucaucuggcagaacucuaccgaagacacgugguauaagauggugaaaauucagaccgucaaacaggugcaacggaaugaugacuucaucgagcuggauuacacaauucuccugcacaacaucgcgagccaggaaauuaucccuuggcagaugcaagugcuguggcauccccaguacggaaccaaggucaagcacaauucccgccucccuaaggagguucagcuggaguga

SEQ ID NO: 71701 - RNA, 387 nt, Artificial Sequence
  derived and/or modified sequence opt5 from LY6D__Homo_sapiens__NP_003686
augagaaccgcccugcuccugcuugcugcccuggcgguggcuacaggccccgcccucacgcugcggugccacgucuguaccagcuccucuaacugcaagcauagcguuguguguccugccuccucucgcuucugcaaaacaaccaauacaguggagccgcuuagagggaaccuggucaagaaagacugugcugaaagcugcacccccuccuacacacuccagggacaagugucuagcggcaccuccagcacgcaguguugccaggaggaucuguguaaugaaaagcugcacaacgccgcuccuacccggacagcccucgcgcauucugcccugucccuugggcuggcucucagccugcuugccguuauccuggcucccucucucuga

SEQ ID NO: 71702 - RNA, 396 nt, Artificial Sequence
  derived and/or modified sequence opt5 from LY6E__Homo_sapiens__NP_001120685
augaagaucuuccugcccgugcuccuggccgcccuucugggcgucgagagagcuagcucccucaugugcuuuucuugucugaaccagaaaagcaaucuuuacugccugaagccuaccauuuguuccgaccaagauaacuauugcguuacagugucugcgagcgcugggaucggaaaucucgugacguucggccacucccugucuaaaaccuguagcccggccugccccauuccugaaggggucaacgugggaguugccuccaugggcaucagcuguugccagucuuuucuguguaauuucuccgcugccgacgggggacuccgggcuagcgugacacugcuuggcgccggccugcuccugucucuucugcccgcgcuccugcgcuuugggccuuga

SEQ ID NO: 71703 - RNA, 606 nt, Artificial Sequence
  derived and/or modified sequence opt5 from LY6G5B__Homo_sapiens__NP_067044
augaaggugcacaugcuggucggcguucucgugauggugggguucaccgucggaaaagugcccguuccugacaucagaacaugccauuuuugucugguggaggauccgagcgucggcugcauuuccgggucugaaaaguguacgaucagcuccucuagccuuugcauggugauuaccaucuacuaugacguuaaagugcgguucauuguccgcggauguggccaguacaucuccuauagaugccaagagaagcggaacacauacuuugccgaauauugguaccaggcucaguguugccaguaugauuacuguaauucuuggagcagcccccaacugcaguccucucucccugagccccacgaccgcccucuggcccuuccccuguccgauagccagauccagugguucuaccaagcgcucaaccugucucugccucucccgaauuuucaugcugggaccgaacccgacggacuggauccuauggugacacuuucccugaaccucggccugagcuucgccgagcuuagacggauguaucuguuucucaauucuuccggccugcuggugcucccccaggccgggcugcuuaccccucaccccagcuga

SEQ ID NO: 71704 - RNA, 453 nt, Artificial Sequence
  derived and/or modified sequence opt5 from LY6G5C__Homo_sapiens__NP_079538
augagauucauggccggccccgcugggagccagucccugggaccucucugcuuucacucuagcccgcaagcccuguacaccgugcuucugaucguccucguuaugaugucccugguguucggcaaguuugugcccgucaacugggagccuccccagccucuucccuucccuaaauaucugcgguguuaccgcugccuccuggaaacaaaggagcuggggugucuccugggaucugacauuugccuuacgccggcgggcagcuccuguaucacccugcauaaaaagaacucuagcggguccgaugugaugguuagcgacugcagaucuaaagaacagauguccgauuguagcaauacacggaccucucccguguccggauuuuggauuuucagccaguauugcuuucucgacuucuguaaugauccucaaaaccgcggccuguacacacccuga

SEQ ID NO: 71705 - RNA, 378 nt, Artificial Sequence
  derived and/or modified sequence opt5 from LY6G6C__Homo_sapiens__NP_079537
augaaggcccugaugcuccugacccuuagcgugcugcucugcugggucuccgcugacaucagaugucacucuugcuacaaaguucccgugcugggcuguguggaucggcagagcugccgccuugagccugggcaacagugucugacaacgcaugccuaucucggaaagaugugggucuucuccaaccugagaugcggcaccccggaggaacccugucaggaagcguuuaaucagacaaaccggaaacuggggcucaccuacaauacaaccugcuguaacaaggacaauugcaacucugcuggaccucgccccaccccugcccugggccuuguguuccugacaagccucgccgggcugggacuuuggcugcuccacuga

SEQ ID NO: 71706 - RNA, 894 nt, Artificial Sequence
  derived and/or modified sequence opt5 from LY6G6F__Homo_sapiens__NP_001003693
auggccgugcuguuccuccugcuuuuucugugcggcacaccccaggcugccgacaacaugcaagcgaucuacgucgcucucggggaggccguugaacugccuuguccgagcccucccacccuucacggagaugagcaucuguccugguucugcucucccgccgcuggcagcuuuacgacccucguggcccaggugcaggucgggagaccugcucccgacccuggaaagccgggccgggaaucccgccugagacugcucgggaauuauucucuguggcuugagggaagcaaagaagaggaugccggccgguacuggugugcggugcugggccagcaccauaacuaucaaaauuggcgcguuuacgacgugcucguccugaaggggucccagcuuucugccagagcugccgauggaagccccugcaacgugcugcucuguuccguugugccuagccggcgcauggacucugucacauggcaggagggcaaagggcccgugagaggacgggugcaguccuucuggggcagcgaagcugcccugcugcucgucugcccuggggagggacugucugaaccccgcuccagacggccgcgcauuaucagaugucuuaugacccacaauaagggcguuagcuuuucucuggcggccuccauugaugcuagcccugcccucugcgcucccuccacaggcugggacaugccuuggauccugaugcuucugcucaccauggggcaaggaguggugauucuggcccugucuaucguccucuggcggcagcgcgugagaggcgcccccgggcgggaugcuagcaucccccaguucaaaccugagauucagguuuaugagaacauccaucuggcgagacuuggaccgcccgcccacaagccucgcuga

SEQ ID NO: 71707 - RNA, 498 nt, Artificial Sequence
  derived and/or modified sequence opt5 from LY6K__Homo_sapiens__NP_059997
auggcccugcucgcucugcuucugguggucgcccuccccagaguuuggaccgacgcgaaccugacagcucggcagcgcgauccugaggacagccaaagaacggaugaaggcgacaaucggguguggugccacgugugugagcgcgaaaacaccuucgagugccagaauccgagacgguguaaguggacagaacccuacugcgucaucgccgccgugaaaauuuuuccucgcuucuuuaugguugcuaagcaguguuccgccgggugcgcugccauggagagacccaaaccugaggaaaagcgguuccuucuggaggaacccaugccguuuuucuaucucaaauguugcaagauccgcuacuguaaccuggagggaccucccauuaauucuagcguguuuaaggaguaugcgggcuccaugggggaaucuugcggaggccuguggcucgccauccugcuucugcucgcuagcauugccgcugggcugucccuuucuuga

SEQ ID NO: 71708 - RNA, 5622 nt, Artificial Sequence
  derived and/or modified sequence opt5 from LY75-CD302__Homo_sapiens__NP_001185688
augagaaccggaugggccacaccccggagaccugcugggcugcucaugcugcuuuucugguuuuucgaccuggccgaaccgagcggcagagcggcuaacgaucccuuuacgaucgugcacggcaauaccgggaaaugcauuaaaccugucuacggauggaucguugccgacgauugugacgaaacagaagauaagcucuggaaaugggugucccaacaucggcuguuccaccuucauucucaaaagugccugggccucgacauuaccaaaagcgugaacgaacugcgcauguuuuccugugauucuagcgccaugcugugguggaagugcgaacaccauucccucuauggggcugccagauaccggcuggcucuuaaggacggacacggcacagccaucucuaaugcgagcgaugucuggaaaaagggcggguccgaagagagccugugugaccagcccuaucacgagauuuacacccgcgauggaaacucuuauggcagaccuugcgaguuccccuuucucaucgacgggacauggcaucacgauuguauccuggacgaggaccauuccggaccuuggugcgccaccacgcuuaauuacgaauaugaucggaaauggggcauuugucugaagccggagaacgggugcgaggacaauugggagaaaaacgagcaguucggaagcuguuaccaguuuaauacccaaacagcucucucuuggaaggaagccuacguguccugccagaaccagggcgcugaucugcugagcaucaauucugccgcggagcucaccuaucugaaggaaaaagagggcauugccaagaucuucuggauugggcuuaaccagcuguacuccgcucgcggaugggaguggagcgaccacaaaccccucaauuuucugaacugggauccugacagacccuccgccccuacaaucggcgggucuagcugcgcucggauggaugccgaauccggacuuuggcagagcuucucuugugaggcccagcugcccuauguuugccgcaagccgcucaauaacaccguggaacugacggacgucuggacauacuccgauaccagaugugacgcuggcuggcugccuaacaauggguuuugcuaucuccuggugaacgagagcaauucuugggauaaagcgcacgccaaguguaaggcuuucagcuccgaccuuauuucuauccauagccuggccgacguugaaguggucgugacaaagcuccacaacgaggauaucaaggaggaaguguggauuggacugaaaaauaucaacauucccacccuuuuccagugguccgacggcaccgaggucacacugacguacugggaugaaaaugagccuaacguucccuauaauaagacccccaacugcgugagcuaccucggcgaacuggggcaguggaaagugcaaucuugugaggagaagcugaaauacgucugcaagcggaagggagaaaaacucaaugacgccuccagcgauaagauguguccuccggacgagggcuggaaacgccauggggaaacaugcuauaagaucuacgaggaugaggugcccuuuggaaccaacuguaaucugacaauuaccucuagauucgaacaggaguaucuuaacgaccugaugaaaaaguacgauaagucccuccggaaauauuuuuggacgggccugagagacguugauagcugcggggaauacaauugggcuacagugggcggacgccggagagccgucaccuucuccaacuggaacuuucuggagccugcgucucccggcgggugcguggcuaugagcaccggaaaguccguuggcaaaugggaagugaaggacugucgcucuuucaaagcccuuagcaucugcaagaagauguccgggccucucggacccgaggaggccagcccgaaaccugaugaccccuguccugaaggcuggcagucuuuucccgcuucccugagcugcuauaaggucuuccacgccgagcggaucgugagaaaacgcaauugggaagaggcugaacgguuuugucaagcccugggggcgcaucucucuuccuucagccacgucgacgagauuaaggaguuucugcacuuccuuacagaucaguuuucuggccagcauuggcuguggaucggacucaacaaaagaagcccugaccugcagggcuccuggcaauggagcgaucgcacccccgugucuacaauuaucaugccgaaugaguuccagcaggacuacgauauucgggacugcgccgcuguuaagguguuccacagaccuuggcgccggggguggcauuuuuacgaugacagagaguucaucuaucugcggcccuuugccugugauacgaaacuugaaugggucugccagauccccaagggacgcaccccuaagacaccggacugguacaaccccgauagagcuggcauucacgggccuccccucaucauugagggauccgaauauugguucguggccgaccugcaccugaauuacgaggaggcgguucucuauugugccagcaaccauuccuuucuggcuaccaucacaucuuucgugggccuuaaagccauuaagaauaaaaucgcuaacauuagcggggauggccaaaagugguggauccggaucuccgaauggccuauugacgaccacuuuaccuacucuagauaucccuggcaucgcuucccugucacguuuggagaggaaugccuguacaugagcgccaaaaccuggcucaucgaucugggcaagcccacagacuguuccaccaagcugccguucauuugcgagaaauacaaugugucuagccuugagaaguauuccccugauagcgccgcuaaagugcagugcucugaacaguggauccccuuucagaacaaguguuuccucaaaauuaagccuguuucccugacauuuagccaagcgucugauaccugccacuccuacgggggaacgcugcccagcguccucucucagaucgagcaggacuucaucacaucccugcuuccggacauggaagccacccuguggauuggccuccgguggacagcuuaugagaagaucaauaaauggaccgauaacagagaacugaccuacagcaauuuccauccucugcuuguguccgggcgccuccgcauucccgagaacuuuuucgaggaagagagccgguaucacugugcccugauccugaaucuccagaagucuccuuuuacaggaacguggaacuucaccagcugcuccgaacgccacuuugugucucugugucaaaaauacagcgaggucaaguccagacagacacuucagaacgccucugaaaccgugaaauaucugaauaaccucuacaagauuauccccaagacacugaccuggcauagcgcuaaacgggagugccugaaguccaauaugcaacuuguuucuaucacggaccccuaccagcaggccuuccugagcgugcaggcgcuccugcacaacuccagccucuggauuggccuguuuucucaagaugacgagcuuaauuucgggugguccgauggcaaacgccugcauuuuagcagaugggcugaaacaaacggacagcucgaggacugugucgugcuggacaccgauggcuucuggaagaccguugacugcaaugauaaccagccuggggccaucuguuauuacucuggaaaugaaacagagaaagaagugaagccggucgacuccgugaaaugccccagcccuguucugaacacccccuggauuccuuuucagaauuguugcuauaacuucaucauuacaaagaaucggcacauggccacgacccaagaugaggugcauacaaagugccagaaacuuaaccccaagucccacauccugucuauccgcgacgagaaagaaaauaacuucguccucgagcagcugcucuacuuuaacuauauggcuagcugggugaugcugggcauuaccuacagaaauaagucccuuaugugguucgauaaaacaccucugagcuauacccacuggcgggccgggcgcccgacgaucaagaacgaaaaguuucucgcgggacugucuaccgacggcuucugggauauucagacauuuaaagugaucgaggaggcugucuacuuccaucaacacuccauucuggccuguaagaucgaaaugguugacuacaaagaggaauauaauaccacacuuccccaguuuaugccuuacgaggauggcauuuauagcgugauccagaagaaagugaccugguacgaagcccugaacaugugcucucaaagcgggggacaucucgcuuccguccacaaucagaacggccagcuguuccucgaggacaucgugaagagagauggguuuccccuguggguuggacuuucuagccacgacggcuccgagucuagcuucgaaugguccgacgggagcacauuugauuauauuccuuggaagggacagaccucucccggcaauugugugcugcuggacccgaaaggcacguggaagcaugagaaaugcaacuccgucaaggauggggccaucuguuacaaaccuacaaagagcaagaaacucucccggcugaccuauucuagcagaugccccgcugccaaggaaaauggaucccgcuggauucaauacaaaggccacuguuacaagucugaccaggcgcuucauagcuucuccgaggccaaaaagcugugcagcaagcacgaucauucugcuaccaucguguccauuaaagacgaagaugagaacaaguuuguuagccggcucaugagagagaauaacaauaucacaaugcgcguguggcuggggcucucucagcacuccgucgaccagagcuggucuuggcuggauggaagcgaagugaccuucguuaaaugggagaacaaguccaaaucuggcguggggcgguguagcaugcuuaucgccuccaaugaaacguggaagaaagucgagugcgaacacggauucggcagagugguguguaaggucccccuggacugcccuagcuccacauggauucaauuucaggauucuugcuauaucuuccugcaggaggcuauuaagguugagagcaucgaagacgugcgcaaccaguguaccgaucauggcgccgacaugauuuccauccacaaugaggaagagaacgccuuuauccucgacacacugaaaaagcaauggaaagggcccgaugacauucuucugggaauguucuacgauaccgacgaugcuucuuuuaagugguucgacaacagcaauaugacauuugauaaauggaccgaccaggaugacgaugaggaccucguggacacgugcgcguuccugcauaucaagaccggcgaauggaagaaagggaacugugaggucuccucuguggaaggaacacucugcaagaccgccauuccuuauaaacggaaguaccugagcgauaaucacauccuuauuuccgcucugguuaucgccagcacagugauucugaccguccucggcgccaucaucugguuucuguauaaaaagcacucugacuccagauucacgacaguguuuagcaccgcuccgcagucucccuacaacgaggauuguguucuuguggucggggaagagaaugaguauccugugcaguucgacuga

SEQ ID NO: 71709 - RNA, 5169 nt, Artificial Sequence
  derived and/or modified sequence opt5 from LY75__Homo_sapiens__NP_002340
augagaaccggcugggccacaccccggagaccugcugggcugcucaugcugcuuuucugguuuuucgaccuggccgaaccgagcgggagagcggcuaacgaucccuuuacgaucgugcacggcaauaccgggaaaugcauuaaaccugucuacggauggaucguugccgacgauugugacgaaacagaagauaagcucuggaaaugggugucccaacaucggcuguuccaccuucauucucaaaagugccugggccucgacauuaccaaaagcgugaacgaacugcgcauguuuuccugugauucuagcgccaugcugugguggaagugcgaacaccauucccucuauggggcugccagauaccggcuggcucuuaaggacggacacggcacagccaucucuaaugcgagcgaugucuggaaaaagggcggguccgaagagagccugugugaccagcccuaucacgagauuuacacccgcgauggaaacucuuauggcagaccuugcgaguuccccuuucucaucgacgggacauggcaucacgauuguauccuggacgaggaccauuccggaccuuggugcgccaccacgcuuaauuacgaauaugaucggaaauggggcauuugucugaagccggagaacgggugcgaggacaauugggagaaaaacgagcaguucggaagcuguuaccaguuuaauacccaaacagcucucucuuggaaggaagccuacguguccugccagaaccagggcgcugaucugcugagcaucaauucugccgcggagcucaccuaucugaaggaaaaagagggcauugccaagaucuucuggauugggcuuaaccagcuguacuccgcucgcggaugggaguggagcgaccacaaaccccucaauuuucugaacugggauccugacagacccuccgccccuacaaucggcgggucuagcugcgcucggauggaugccgaauccggacuuuggcagagcuucucuugugaggcccagcugcccuauguuugccgcaagccgcucaauaacaccguggaacugacggacgucuggacauacuccgauaccagaugugacgcuggcuggcugccuaacaauggguuuugcuaucuccuggugaacgagagcaauucuugggauaaagcgcacgccaaguguaaggcuuucagcuccgaccuuauuucuauccauagccuggccgacguugaaguggucgugacaaagcuccacaacgaggauaucaaggaggaaguguggauuggacugaaaaauaucaacauucccacccuuuuccagugguccgacggcaccgaggucacacugacguacugggaugaaaaugagccuaacguucccuauaauaagacccccaacugcgugagcuaccucggcgaacuggggcaguggaaagugcaaucuugugaggagaagcugaaauacgucugcaagcggaagggagaaaaacucaaugacgccuccagcgauaagauguguccuccggacgagggcuggaaacgccauggggaaacaugcuauaagaucuacgaggaugaggugcccuuuggaaccaacuguaaucugacaauuaccucuagauucgaacaggaguaucuuaacgaccugaugaaaaaguacgauaagucccuccggaaauauuuuuggacgggccugagagacguugauagcugcggggaauacaauugggcuacagugggcggacgccggagagccgucaccuucuccaacuggaacuuucuggagccugcgucucccggcgggugcguggcuaugagcaccggaaaguccguuggcaaaugggaagugaaggacugucgcucuuucaaagcccuuagcaucugcaagaagauguccgggccucucggacccgaggaggccagcccgaaaccugaugaccccuguccugaaggcuggcagucuuuucccgcuucccugagcugcuauaaggucuuccacgccgagcggaucgugagaaaacgcaauugggaagaggcugaacgguuuugucaagcccugggggcgcaucucucuuccuucagccacgucgacgagauuaaggaguuucugcacuuccuuacagaucaguuuucuggccagcauuggcuguggaucggacucaacaaaagaagcccugaccugcagggcuccuggcaauggagcgaucgcacccccgugucuacaauuaucaugccgaaugaguuccagcaggacuacgauauucgggacugcgccgcuguuaagguguuccacagaccuuggcgccggggguggcauuuuuacgaugacagagaguucaucuaucugcggcccuuugccugugauacgaaacuugaaugggucugccagauccccaagggacgcaccccuaagacaccggacugguacaaccccgauagagcuggcauucacgggccuccccucaucauugagggauccgaauauugguucguggccgaccugcaccugaauuacgaggaggcgguucucuauugugccagcaaccauuccuuucuggcuaccaucacaucuuucgugggccuuaaagccauuaagaauaaaaucgcuaacauuagcggggauggccaaaagugguggauccggaucuccgaauggccuauugacgaccacuuuaccuacucuagauaucccuggcaucgcuucccugucacguuuggagaggaaugccuguacaugagcgccaaaaccuggcucaucgaucugggcaagcccacagacuguuccaccaagcugccguucauuugcgagaaauacaaugugucuagccuugagaaguauuccccugauagcgccgcuaaagugcagugcucugaacaguggauccccuuucagaacaaguguuuccucaaaauuaagccuguuucccugacauuuagccaagcgucugauaccugccacuccuacgggggaacgcugcccagcguccucucucagaucgagcaggacuucaucacaucccugcuuccggacauggaagccacccuguggauuggccuccgguggacagcuuaugagaagaucaauaaauggaccgauaacagagaacugaccuacagcaauuuccauccucugcuuguguccgggcgccuccgcauucccgagaacuuuuucgaggaagagagccgguaucacugugcccugauccugaaucuccagaagucuccuuuuacaggaacguggaacuucaccagcugcuccgaacgccacuuugugucucugugucaaaaauacagcgaggucaaguccagacagacacuucagaacgccucugaaaccgugaaauaucugaauaaccucuacaagauuauccccaagacacugaccuggcauagcgcuaaacgggagugccugaaguccaauaugcaacuuguuucuaucacggaccccuaccagcaggccuuccugagcgugcaggcgcuccugcacaacuccagccucuggauuggccuguuuucucaagaugacgagcuuaauuucgggugguccgauggcaaacgccugcauuuuagcagaugggcugaaacaaacggacagcucgaggacugugucgugcuggacaccgauggcuucuggaagaccguugacugcaaugauaaccagccuggggccaucuguuauuacucuggaaaugaaacagagaaagaagugaagccggucgacuccgugaaaugccccagcccuguucugaacacccccuggauuccuuuucagaauuguugcuauaacuucaucauuacaaagaaucggcacauggccacgacccaagaugaggugcauacaaagugccagaaacuuaaccccaagucccacauccugucuauccgcgacgagaaagaaaauaacuucguccucgagcagcugcucuacuuuaacuauauggcuagcugggugaugcugggcauuaccuacagaaauaagucccuuaugugguucgauaaaacaccucugagcuauacccacuggcgggccgggcgcccgacgaucaagaacgaaaaguuucucgcgggacugucuaccgacggcuucugggauauucagacauuuaaagugaucgaggaggcugucuacuuccaucaacacuccauucuggccuguaagaucgaaaugguugacuacaaagaggaauauaauaccacacuuccccaguuuaugccuuacgaggauggcauuuauagcgugauccagaagaaagugaccugguacgaagcccugaacaugugcucucaaagcgggggacaucucgcuuccguccacaaucagaacggccagcuguuccucgaggacaucgugaagagagauggguuuccccuguggguuggacuuucuagccacgacggcuccgagucuagcuucgaaugguccgacgggagcacauuugauuauauuccuuggaagggacagaccucucccggcaauugugugcugcuggacccgaaaggcacguggaagcaugagaaaugcaacuccgucaaggauggggccaucuguuacaaaccuacaaagagcaagaaacucucccggcugaccuauucuagcagaugccccgcugccaaggaaaauggaucccgcuggauucaauacaaaggccacuguuacaagucugaccaggcgcuucauagcuucuccgaggccaaaaagcugugcagcaagcacgaucauucugcuaccaucguguccauuaaagacgaagaugagaacaaguuuguuagccggcucaugagagagaauaacaauaucacaaugcgcguguggcuggggcucucucagcacuccgucgaccagagcuggucuuggcuggauggaagcgaagugaccuucguuaaaugggagaacaaguccaaaucuggcguggggcgguguagcaugcuuaucgccuccaaugaaacguggaagaaagucgagugcgaacacggauucggcagagugguguguaaggucccccugggcccugacuauacagcuauugccaucauuguugccacccugagcauccucgugcugaugggaggacuuauuugguuucuguuccaacgccaucggcuccaccuggcuggcuuuuccucugugagauacgcgcagggggucaacgaggaugagaucaugcuccccagcuuccaugacuga

SEQ ID NO: 71710 - RNA, 489 nt, Artificial Sequence
  derived and/or modified sequence opt5 from LY86__Homo_sapiens__NP_004262
augaagggcuucaccgccacacuguuucucuggacgcugaucuuccccagcugcuccgggggaggcgggggaaaggcuuggccuacccacguggucuguucugacagcggccuugagguucuguaccaguccugcgauccgcuccaagacuuuggguucucuguggaaaaauguagcaaacagcugaaguccaacauuaauaucagauuuggaauuauccuucgggaggauauuaaagaacuguuccucgaccuggcccugaugucucagggcagcuccgugcucaacuuuagcuaucccaucugcgaggcggcucugccuaaguucucuuuuuguggccgcagaaagggggaacagaucuacuaugccggacccgucaauaacccugaguucacaauuccccaaggcgaguaccaggugcuucuggaacucuauaccgagaaacgguccacaguugccugcgcuaaugccaccaucauguguagcuga

SEQ ID NO: 71711 - RNA, 393 nt, Artificial Sequence
  derived and/or modified sequence opt5 from LY96__Homo_sapiens__NP_001182726
augcugcccuuccucuuuuucagcacccuguuuuccucuaucuucacagaggcccagaagcaauacugggugugcaacagcuccgacgcuucuauuagcuauacguacuguggcagagaucuuaaacagcuguauuuuaaucucuacaucaccgucaacacaaugaaucugccuaagcggaaagaaguuauuugccgcggguccgacgaugacuauucuuucuguagagcccuuaagggagagaccgugaacacaaccaucagcuuuuccuucaaaggcauuaaguuuagcaaggggaaauacaagugcguggucgaagcgaucucuggauccccggaggaaaugcuguucugucucgaguuugugauccugcaccagcccaauagcaacuga

SEQ ID NO: 71712 - RNA, 582 nt, Artificial Sequence
  derived and/or modified sequence opt5 from LY9__Homo_sapiens__NP_001028839
augguggcccccaagagccacaccgacgauugggcuccuggcccguucuccucuaaaccccagagaagccaacugcagaucuuuuccucuguccuccagacaagccugcuuuuccugcucauggggcugcgggccuccggaaaggacucugcgccuacgguugugagcggcauucuugggggauccgugacccugccccucaacaucagcgucgauacagagauugaaaaugugaucuggauuggcccuaaaaacgcucuggccuuugcccgccccaaggagaauguuaccaucauggugaaaucuuaccuggggagacucgacaucacaaagugguccuauagccugugcauuucuaaccuuacccugaaugaugcuggauccuacaaggcccagaucaaccaacggaauuucgaagucacaaccgaggaagaguuuacccucuucguguaugcuccuuuuauugagaaacugagcguucaugugaucgaaggcgaccaccgcacgcuucuggagggcucugggcucgaauccauuaucagcacacuggccgagccgagagucuccgugcgggagggauga

SEQ ID NO: 71713 - RNA, 1056 nt, Artificial Sequence
  derived and/or modified sequence opt5 from LYL1__Homo_sapiens__XP_006722815
augaccggccuggacugggccguggggagcgucuucggaggccucggguccgcuuuugagguuaucgugucuguggucggaagccagggcugcuacgggggaugucugcaaugggaauggggcucccuuaagcagcuguggucuacauucagagauagcaacggcaaaaaucggcgcgugauucucgagguuuccacgcccaccucugggagcaugugcccuccgcaggcccaggcggaagugggacccacaaugaccgagaaggcugaaauggucugugccccuucccccgccccugcucccccuccgaaacccgccagcccugggcccccucaaguggaggagguuggccacagaggaggcucuagcccgccccggcugccucccggggugccugucaucucccuuggacauucucgcccucccggcguggcuaugcccacaaccgaacugggcacacucagaccgccccugcugcagcucuccacccuggggacggccccucccacccuugcgcugcacuaucauccucaccccuuucucaacagcguguacauuggaccggccggcccuuucucuaucuuucccuccagccggcugaagcgcagaccuucccauugcgagcuugaccuggcugaagggcaccagccccagaaagucgcccggcgcguuuucacaaauucuagagagcgguggcgccaacagaacgugaauggagcuuuugccgagcucagaaagcugcugccuacccaucccccggaucggaagcucagcaaaaacgaagugcugcgccuugcgaugaaguauauuggcuuccuggucagacuccugcgggaccaggccgcugcccuugcugccgggccuacaccucccggacccagaaaacgcccggugcaccggguucccgaugacggcgccagacgcggcuccgggcggagagcugaggcggccgcucgcagccagccugcucccccugccgaucccgacggaucuccuggcggggccgcccggcccaucaagauggaacaaaccgcgcuguccccggaggugagauga

SEQ ID NO: 71714 - RNA, 1476 nt, Artificial Sequence
  derived and/or modified sequence opt5 from LYN__Homo_sapiens__NP_001104567
augggcugcaucaagagcaaagggaaggacucccugucugaugacggaguggaucucaaaacccagcccgucccugagagccaacugcuuccgggccagagauuccagacaaaggaccccgaagaacagggggauauuguuguggcccuguacccuuaugacggaauccaccccgaugaccucuccuuuaaaaagggcgaaaagaugaaagugcuggaggaacauggggagugguggaaggcuaaaucucuucugacgaagaaagagggauucauuccuagcaacuacgucgccaagcucaauacccuggaaacagaggaaugguuuuucaaggauaucacccggaaagacgcggagcgccaacugcucgcucccggcaacuccgccggcgccuuucugauuagagagucugaaacacuuaaggggagcuucucccugagcgugcgggauuuugacccuguucacggagaugugaucaaacauuauaagauccgcucucucgacaauggcggguacuauauuuccccgagaaucaccuuccccuguauuagcgacaugaucaaacacuaccagaagcaggcugauggacugugccggcgccuugagaaagccuguauuucuccuaagccccagaagccuugggacaaagaugcuugggaaauccccagagaguccauuaagcuggucaaacggcucggcgccgggcaauuuggagaaguguggaugggcuauuacaacaauagcacaaagguugcggugaaaacccugaagccgggcacgaugucuguccaggccuuccuggaggaggcuaaccucaugaagacccugcagcaugacaaacuugugcgccuguacgccguggucacaagagaggagccuaucuauaucauuaccgaauacauggcuaaggggucccuccuggauuuucuuaaaagcgacgagggaggcaagguucugcuccccaaacugaucgauuucuccgcccagauugcggaagggauggccuauaucgagcggaagaauuacauucaccgcgaccugagagcugccaacgugcucgugucugagagccugaugugcaagaucgcugauuuuggacuugcccgggucaucgaagacaaugaguauacagcccgcgaaggcgcuaaauucccuauuaaguggaccgcgcccgaggccaucaacuucggguguuuuacgauuaaauccgauguguggagcuucggaauccugcucuacgaaauuguuacauauggcaagauccccuacccuggcagaaccaaugcugacgugaugacagcccugucucaaggguaccggaugccgagagucgagaacugccccgacgagcuuuaugauaucaugaaaauguguuggaaggaaaaggccgaggaacgcccuaccuuugacuaccugcaguccgugcucgaugacuucuauaccgcuacagagggacaguaccaacagcagcccuga

SEQ ID NO: 71715 - RNA, 294 nt, Artificial Sequence
  derived and/or modified sequence opt5 from LYNX1__Homo_sapiens__NP_803253
augcagcugggcaccgggcuccugcuugccgcugugcugagccuccaacuggccgcggcugaggccaucuggugccaccaguguacaggauucggcgggugcucccauggaucuagaugucuucgggacagcacgcacugcgucaccacagccacccgcguucuguccaacacagaagaucucccccuggugaccaagaugugucauauuggcugcccugacaucccgucucuggggcucggacccuacgugagcauugcuuguugccagacaucccuguguaaucacgauuga

SEQ ID NO: 71716 - RNA, 426 nt, Artificial Sequence
  derived and/or modified sequence opt5 from LYPD1__Homo_sapiens__NP_653187
augugggugcugggcaucgccgcuaccuucugcgggcucuuucugcuucccggauucgcccugcagauucaauguuaccagugcgaggaauuucagcucaacaaugacuguagcuccccugaguucaucgucaacugcacaguuaaugugcaggauaugugucaaaaggaagugauggagcagucugcgggcauuauguauagaaaaagcugcgcuuccucugccgccugucugaucgcuagcgccggguaccaguccuuuugcucuccgggaaaacuuaacagcgucuguauuuccugcuguaauacgccccugugcaacggcccucggcccaagaagcgcgggagcucugcuuccgcccucagaccuggacugcggaccacaauccuguuccucaaacuggcgcuuuuuagcgcccacugcuga

SEQ ID NO: 71717 - RNA, 378 nt, Artificial Sequence
  derived and/or modified sequence opt5 from LYPD2__Homo_sapiens__NP_991108
augagaggcacccggcuggcccuccuggcucuugugcuggccgcgugcggggagcucgcucccgcccugcgcuguuacgucugcccugaaccgacaggaguuagcgacugugugacgaucgcuaccugcacaaccaacgagacaauguguaagaccacacuuuauuccagagaaauuguguaccccuuccagggcgauucuaccgucacgaaaagcugcgccuccaaguguaaaccuucugacguggaugggaucggacaaacccugcccguuagcugcuguaauacagagcucugcaacguggacggcgccccugcucucaauucccugcacuguggggcccugacccugcuuccccugcucucucugcggcuuuga

SEQ ID NO: 71718 - RNA, 1041 nt, Artificial Sequence
  derived and/or modified sequence opt5 from LYPD3__Homo_sapiens__NP_055215
auggaccccgccagaaaggcuggcgcccaggcgaugaucuggaccgcuggguggcugcuccugcuucugcuccggggaggcgcccaagcccuggagugcuacagcugugugcagaaagcugaugacgggugcuccccuaacaagaugaaaacagucaagugugccccgggaguugaugugugcacggaagcugugggcgccgucgagaccauucacgggcaguucucucuugcggugcgcggauguggcagcggccugcccgggaaaaaugacagaggacucgaucugcauggccugcucgccuuuauccagcugcaacagugcgcucaggaccgguguaacgccaagcucaaucugacaucccgcgcucucgauccugccgggaacgaaucugcguaucccccuaauggaguugagugcuacagcugugugggccuguccagagaagccugccaggggaccucucccccugucgugagcuguuauaacgcuuccgaccacguuuacaagggaugcuucgauggcaaugugacacuuaccgccgcuaacgucacagugagccugccggugcggggcugcguccaagacgaguuuuguacccgcgaugggguuacgggacccggcuucacccucucuggguccugcugucagggaagcagaugcaauucugaccugcggaacaaaacauauuuuuccccucgcauucccccucuggugagacuucccccgccugagcccaccacaguggccagcaccacgucugucacaaccuccacaagcgccccugugcggcccaccuccaccacaaagcccaugccugcuccgacgucucagacaccccgccagggcguugaacaugaggcgagcagagaugaggaaccucggcugaccgggggagccgcuggccaccaagaccgcuccaauagcggccaguaccccgccaaagggggaccucagcaaccccauaacaagggcuguguggccccgaccgcugggcuugccgcgcugcuccuggcugucgccgccggagugcuucuguga

SEQ ID NO: 71719 - RNA, 636 nt, Artificial Sequence
  derived and/or modified sequence opt5 from LYPD4__Homo_sapiens__NP_001278348
augggcccccagcaccugagacucgugcaacuguucugccuucugggggccaucagcacccucccucggauguccuguggagcuggcugcuacaagacacagaaagggacggcccgcggagucguuggcuuuaagggguguucuagcuccucuagcuauccggcgcagauuuccuaccuggugucucccccuggagugagcaucgcuuccuauagcagagucugccggucuuaccuuuguaacaaucugaccaaccucgagcccuucgugaaacugaaggccuccacaccuaaaagcauuaccucugccuccugcagcugucccacaugcguuggcgagcauaugaaggacugucugccuaauuuugugaccacaaacucuugcccgcucgcugccuccaccuguuauagcuccacgcugaaguuccaggcuggcuuucuuaauaccacauuccugcucauggggugcgcccgcgagcacaaccaacugcuugcggauuuucaucacaucggaucuauuaaagucaccgaagugcugaauauccucgaaaagagccagaucguuggcgccgcuuccagcagacaggaccccgccuggggagugguccuggggcuccuguucgcuuuucgggauuga

SEQ ID NO: 71720 - RNA, 756 nt, Artificial Sequence
  derived and/or modified sequence opt5 from LYPD5__Homo_sapiens__NP_001026919
auggccaugggcgugcccagagucauccugcucugccuguucggggcugcccuuugucugaccggaagccaggcgcuccaaugcuacuccuuugagcacaccuauuucggcccuuuugaccugcgggcuaugaaacuuccgucuauuagcuguccccaugaaugcuucgaggccauccugucccucgauacgggguaccgcgccccuguuacccuggugagaaagggauguuggacagggcccccugcuggccagacccagucuaacgccgacgcucugcccccugauuauagcgugguccggggaugcacaaccgacaaguguaaugcccaccucaugacacaugaugcgcugccgaaccuuucccaggcccccgacccucccacccugucuggcgcugaaugcuacgccuguauuggcgugcaccaagaugacugcgcuaucgggcgcagcagacggguucagugucaucaggaucagacggccugcuuucaaggaaauggccgcaugaccguggggaacuucuccgucccuguguauauuagaacaugccaccggcccagcuguaccacagagggaaccacgucuccguggacagcgaucgaccuccagggcuccugcugugaaggguaccugugcaaucgcaaaagcaugacccagccuuuuacaucugccuccgcuaccacacccccuagagcccuucagguucuggcucuccugcugcccgugcuccugcuugucggacugagcgccuga

SEQ ID NO: 71721 - RNA, 516 nt, Artificial Sequence
  derived and/or modified sequence opt5 from LYPD6__Homo_sapiens__NP_001182614
auggagcccggcccugcccuggcuuggcuccugcuucugagccuccuggccgacugccuuaaggcggcucaguccagagauuucaccgugaaagacaucauuuaccugcacccgucuacaacgcccuauccugggggauuuaaguguuuuaccugcgaaaaagccgccgauaacuacgaguguaaucggugggcucccgacaucuauugcccucgcgaaacaagauacuguuauacccaacauacaauggaggucaccggcaacagcauuuccguuacaaagcggugcgugccccucgaagagugucugucuaccgggugccgcgauagcgagcacgaaggacauaaaguguguacguccugcugugagggcaauaucugcaaccugccucucccgagaaaugaaaccgacgccacauucgcuaccacaucucccauuaaccagaccaaugggcacccucggugcaugagcgucaucguguccugucuguggcuuuggcugggacucaugcuguga

SEQ ID NO: 71722 - RNA, 714 nt, Artificial Sequence
  derived and/or modified sequence opt5 from LYPD8__Homo_sapiens__NP_001078943
augaagggcauccugguggccgggauuaccgcuguccucguugccgcgguggagagccuguccugcgugcaguguaacucuugggaaaaaucuugcgucaauuccaucgcuucugagugucccagccacgccaacacauccugcauuucuagcuccgccagcagcucccuugaaacgccugugagacuguaccaaaauauguucuguagcgcugagaacugcucugaagagacccauaucacagccuuuaccguucacguguccgcugaggaacauuuccacuuugucagccaguguugccagggaaaggaguguucuaauacauccgacgcccucgauccgccccugaaaaacgugagcuccaaugcggaaugcccugccuguuaugagucuaacggcaccagcugccgggggaagcccuggaaaugcuacgaggaggaacaguguguuuuccuuguggcugaacugaagaaugacauugaguccaagagccucguccugaaaggaugcucuaacguguccaaugccacaugucaauuucugagcggcgaaaacaagacccucgggggagugaucuuccgcaaauuugagugcgcuaaugucaacucucugacgccuaccagcgcccccacaaccucccauaauguuggcucuaaggcgagccuuuaucugcucgcccuggcuucccuucugcucagaggccugcugccuuga

SEQ ID NO: 71723 - RNA, 645 nt, Artificial Sequence
  derived and/or modified sequence opt5 from LYPLA1__Homo_sapiens__NP_001266286
augugcggcaacaauaugagcacaccccucccugccaucgugccggcugccagaaaggcgaccgcugccgucauuuuccuccacgggcugggagacacgggccaugggugggccgaggcuuuugccggaauccgguccucucacauuaaauacaucuguccccaugcuuucgauauuaucggccuuagcccugacucccaggaagaugagucugggaucaagcaagccgcggaaaacauuaaagcccugaucgaccaggagguuaagaaugggauucccagcaaccgcaucauucucggcggcuuuucccagggaggagcucugucucuuuauaccgcccugacaacccagcaaaaacucgcuggcgugacagcccugagcugcuggcugccucucagagcguccuucccccaggggccuaucggaggcgccaaucgggauauuagcauccugcagugucacggggacugcgauccgcuugugccccugauguuuggaucucucaccgucgaaaagcugaagacacuugugaacccugcuaauguuaccuucaaaacguacgagggcaugaugcauuccagcugucagcaagagaugauggacgugaagcaguuuaucgauaaacugcugcccccuauugacuga

SEQ ID NO: 71724 - RNA, 666 nt, Artificial Sequence
  derived and/or modified sequence opt5 from LYPLAL1__Homo_sapiens__NP_001287699
auggccgcugccagcggcuccgugcugcagagaugcaucgucucucccgcggggcggcacagcgcuucccucauuuuccugcauggaucuggcgacagcgggcaaggacuucgcauguggaucaagcagguucugaaccaggaucucaccuuucagcacauuaaaaucauuuacccuacagccccgcccagauucaagaucacgaaugacuguccugagcaucuggaauccaucgaugugaugugccaagugcuuaccgaccugauugaugaggaagucaaaucuggcaucaagaaaaaccggauucucaucgggggauuuagcaugggcggcuguauggccauucaccuggcuuaucgcaaucaucaggacguggccgggguuuucgcucuguccagcuuucucaacaaggccucugcgguguaccaggcccugcagaaguccaauggaguccuucccgagcuguuccaaugccacggcacagcugaugaacucgugcugcacagcugggccgaggagaccaacucuaugcuuaaaucccuggggguuacaaccaaguuucauagcuucccuaauguguaucacgaacucucuaaaacagagcuggacauccugaagcucuggauucugaccaaacuucccggagaaauggagaagcagaaguga

SEQ ID NO: 71725 - RNA, 369 nt, Artificial Sequence
  derived and/or modified sequence opt5 from LYRM1__Homo_sapiens__NP_001289765
augaccaccgccacgagacaggaggugcugggccucuaccggagcaucuuccgccuggcuagaaaguggcaagccaccuccgggcagauggaagacacaauuaaagagaagcaguauauccuuaacgaagcgcggacccuguuucgcaaaaauaagaaccucacagauaccgaccugauuaaacagugcaucgaugaguguacagcuagaauugaaaucggacuucacuacaagauccccuauccucggccgauucaucugcccccuaugggccucacaccccugcgcgggagaggacugcggucucaagagaagcuccgcaaacugagcaagccugucuaccuuagaucccacgacgagguuucuuga

SEQ ID NO: 71726 - RNA, 393 nt, Artificial Sequence
  derived and/or modified sequence opt5 from LYRM4__Homo_sapiens__NP_001158312
auggccgcuagcuccagagcccaggugcugucucucuaccgggcgaugcugcgcgagagcaagagauucuccgcuuauaacuaccggaccuaugccguccgcagaauccgggacgccuuucgcgaaaauaaaaacguuaaggaucccguggagauucaaacacuugugaauaaagcuaagagagaccugggcgucauccggcgccagauggauucucacagcguggcccaggcugggguucauuggaacgaccucuccucucugcagccucuuccgcccugguucaaacaauuuagcugccugucccucccuagcucuugggauuacagacggacgcccccucgccuggccaauuucuguauucuguccagagacgugaucagccucuauuga

SEQ ID NO: 71727 - RNA, 315 nt, Artificial Sequence
  derived and/or modified sequence opt5 from LYRM7__Homo_sapiens__NP_859056
augggcagagccgugaagguccugcaacucuucaaaacccugcaccggacacgccagcagguuuuuaagaacgacgcuagagcccuugaggcggcucggauuaaaauuaaugaagaguucaagaacaauaaaagcgaaacguccucuaagaagaucgaggaacugaugaaaauugggagcgauguggagcuccugcuucgcaccuccgugauccagggaauccauacagaccacaacacccugaagcucguccccagaaaagaucugcugguggagaauguuccuuacugcgacgccccgacacagaagcaauga

SEQ ID NO: 71728 - RNA, 237 nt, Artificial Sequence
  derived and/or modified sequence opt5 from LYRM9__Homo_sapiens__NP_001070148
auggcuccccugccuggcgccgagcucgugagacggccgcugcagcuuuaccgcuaucugcucagaugcugucaacagcugcccaccaaggggauccagcagcacuacaaacaugccguccggcagagcuuccgcguucacuccgacgaagauaacccugagcggauucaacagaucauuaagagagcgaucgaagacgcugauuggauuaugaauaaauauaagaaacagaacuga

SEQ ID NO: 71729 - RNA, 11406 nt, Artificial Sequence
  derived and/or modified sequence opt5 from LYST__Homo_sapiens__NP_001288294
augagcacagacuccaacucucuggccagagaguuccucacagaugugaaucggcugugcaacgcugucguucagcgcguggaagccagagaggaagaggaagaggagacgcacauggccacccuuggccaauaccuggugcaugggcggggauuucuccugcuuacaaagcugaauagcaucauugaccaagcucucaccugucgcgaggaacuccugacacuccugcuuucccugcucccccuggucuggaaaaucccugugcaggaagagaaggccaccgauuucaaccuuccccugucugccgacauuauccucacaaaagagaagaauagcuccucucagagaagcacccaagaaaaacugcaccuggagggcuccgcucucagcucucagguuuccgccaaggugaacgucuuucggaagucccgcagacagcggaaaauuacgcaucgcuauucugugagagaugcucggaagacccagcuguccacaagcgacucugaagccaauuccgaugagaaagggaucgcgaugaacaagcaccgcagaccccaucuucugcaccacuuccucaccagcuuuccuaaacaagaccaucccaaggccaagcuggaucggcuugcuacaaaagaacagaccccucccgacgccauggcucuggaaaauagccgcgagaucauuccuagacagggaucuaacacggauauccucagcgaaccggccgcgcuguccguuauuagcaauaugaacaauucucccuucgaccugugccacgugcuccugucccuucuggagaaggucuguaaauuugaugugacacucaaccauaauagcccucuggccgcuucugugguccccacccuuacagaguuccuggccggcuuuggggacugcuguagccucuccgacaaccuggagucucggguugugagcgcuggauggaccgaagaaccuguggcccugauccagagaaugcuguuccgcaccguccugcaccuucuguccguggauguuagcacagccgagaugaugcccgaaaaccuccggaagaaucugacggagcugcuuagagcugcgcucaaaauucgcaucugccuggaaaagcaaccggacccuuuugcgccccggcagaaaaagacccugcaggaggugcaagaagauuucgucuuuucuaaguacagacaccgcgcucuccugcuuccugagcugcucgagggcgugcugcagauucugaucuguugccuucaguccgccgccagcaaccccuucuauuucucucaggcuauggaccucguucaagaauuuauccagcaucacggcuucaaucuguuugagacagccgugcugcagauggaauggcucguccugcgggauggggugcccccugaggcguccgagcaucuuaaagcucugauuaacagcgucaugaagaucauguccaccgugaaaaagguuaaaucugaacagcuccaccauagcauguguacaagaaagcgccaccggagaugcgaguacucccacuucaugcaucaccaucgcgaccugucuggacugcuugugagcgccuuuaagaaucaagucuccaaaaacccguucgaagagaccgccgauggcgacguguauuaccccgaacgguguugcugcauugcuguuugugcccaccagugccucagacugcugcagcaggcuagccucucuuccacgugugugcaaauccugagcgggguccacaauauuggaaucugcuguugcauggauccuaagucugugaucauuccccuucugcaugccuuuaaacucccugcgcugaagaacuuccagcagcacauccugaauauucuuaacaaacucauccuggaccagcugggcggggccgagauuucccccaagaucaagaaagcugccuguaauaucugcacaguggauagcgaccaacucgcucagcuggaggaaacccuucagggaaaccugugugacgccgagcucucuagcucccugagcucuccguccuaucgguuucaaggcauucugccuagcuccggcucugaagaucuucuguggaagugggacgcgcucaaagccuaccagaauuucguuuuugaggaagaucgccugcauagcauccagauugcuaaccacaucugcaaucucauucagaaggggaacaucgucgugcaauggaaacuguacaacuauauuuucaaucccgugcuucagagaggagucgagcuggcccaucacugucagcaccucuccgugaccucugcucagagccauguuugcucccaccauaaccaaugccugccucaggacgugcugcagaucuacgucaagacacuucccauccugcucaagucucgggugauuagagaucuguuucucagcuguaauggcguuucccagaucauugagcugaacugccuuaaugggauccgcagccacucucugaaagccuucgaaacccucauuaucucccugggagagcaacagaaggacgccagcgugccugauaucgacggcauugauaucgaacagaaagagcugucuuccguccauguggggaccagcuuccaccaccaacaggcuuauucugacagcccccagucccuuuccaaguuuuacgcgggacugaaagaagccuauccgaagcggagaaaaacgguuaaccaggaugugcauauuaauaccaucaaccucuuccugugugucgcuuuucucugcgugagcaaggaggccgagucugaccgcgaaagcgccaaugauuccgaggacacaucuggcuacgacagcaccgcuuccgaaccucugucucacaugcuucccuguauuagccuggagucccuggugcuccccucuccugagcauaugcaccaagccgcggauaucuggagcaugugcagauggaucuauaugcuguccagcgucuuccagaagcaguuuuaccggcuuggcggguuccgcguuugucacaaacugauuuuuaugaucauucagaaacuguucagaucucauaaagaggaacaaggaaagaaagaaggcgacacauccgugaacgagaaucaggaucugaaccggaucagccagccgaagcgcaccaugaaggaagaccuccugucucuugcuauuaaauccgaucccaucccuagcgagcuggggucccugaagaaaucugccgacagccucggaaagcuggagcuucagcacaucuccagcauuaauguggaagaggucucugccacggaagcugcccccgaggaagcgaaacuguuuaccucccaagagagcgagacaucucuccagagcaucagacugcucgaagcucugcuugccauuugccugcauggcgcccggaccucccagcagaagauggagcuggaacucccuaaccaaaaucugucuguggagagcauccuuuucgaaaugcgcgaucaccugucccagucuaagguuauugagacacagcucgcuaaaccccuguuugacgcccuccugagaguggcucuugggaacuacagcgccgauuucgagcauaacgacgcgaugaccgaaaagucccaccaaagcgccgaggaacugucuucccagccuggcgauuuuagcgaggaggcugaagacucccaguguugcucuuucaaacugcucgucgaggaagagggauaugaagccgauagcgaguccaaucccgaggacggcgaaacgcaggacgaugggguggaccugaagucugagacagaaggauucagcgcuuccagcucuccgaacgaucuucuggagaaucucacccaaggcgaaaucauuuacccugagaucuguaugcuggagcugaaccuccuuuccgccagcaaagccaagcuggacguucuggcucacguguuugaaucuuuccucaagaucauucggcagaaagagaagaaugucuuucugcuuaugcagcaggggacagugaaaaaccugcucggaggcuuccuguccauccugacccaagaugacagcgauuuucaggcgugccagcgcguucucguggaccuucuggucucucugaugagcuccagaaccugcucugaggaacucacacugcuucugcggauuuuccucgaaaagagccccuguacgaaaauccugcugcucgggauucuuaagaucaucgaguccgauaccacaaugagcccuucccaguaucugaccuuuccccugcuccaugccccgaaucugucuaacggcgugagcucccaaaaauacccuggaauccuuaauucuaaggcuaugggccugcucagacgcgcccgggugagcagauccaagaaagaggccgaccgcgaaucuuucccccaccggcugcugagcuccuggcauaucgcuccuguccaccucccccuucuggggcagaacugcuggccccaccugagcgagggauuuucuguuucccucugguucaauguggaauguauucaugaggccgagagcacaaccgaaaagggcaaaaagaucaaaaagagaaacaagucucugauucuuccugauuccagcuuugacgggacggagucugaccgcccggaaggagcggaguauaucaaucccggcgaacggcugaucgaggaggggugcauucacaucauuucccucggcagcaaagcucugaugauccaggugugggccgauccucauaacgccacacugauuuucagagucuguauggacuccaaugaugacaugaaggcugugcuccuugcccaaguugaaagccaggagaacaucuuccugcccucuaaauggcagcaccuggugcucaccuaccugcagcaaccucagggaaagcgccggauucauggcaaaaucagcaucugggucuccgggcagagaaagcccgaugugacccuugacuuuaugcugccucggaagacaucucucagcuccgauucuaacaaaaccuucugcaugauuggacacugucugagcucccaggaagaguuucugcaacucgcgggcaagugggaccuugggaaucugcuccucuucaacggagcuaaaguuggcucucaggaagccuuuuaucuguacgccugcgggccgaaucacacaagcgugaugcccuguaaguacggcaaaccugucaacgauuauuccaaguacaucaauaaggagauucuucgcugcgagcagaucagagaacuguucaugacgaaaaaggacguggauauuggacuccugaucgagagccugucugucguguauaccacauacugucccgcucaguauaccaucuacgaaccuguuauucggcucaaaggccaaaugaagacacagcuuucccagcgccccuuuagcucuaaagaggugcaguccauccugcuggaaccgcaucaccucaagaaccugcaaccuaccgaguauaagacgauucaggggauccuucaugagauuggaggcaccgggaucuucgucuuucuguucgccagagugguugaacucagcuccugcgaggaaacacaggcucuggcccugcgggugauccucucucuuauuaaauacaaucaacagagaguccacgagcuggagaacugcaauggacugagcaugauccaccaggugcucauuaagcagaaauguaucgugggcuuuuacauucugaagacccuucuggaaggcugcuguggggaggacaucauuuauaugaacgaaaauggagaguucaaacucgauguugacuccaacgcgaucauccaagacgucaagcugcuggaggaacuccuucuggauuggaaaauuuggagcaaggccgagcagggcgugugggaaacacugcucgcugcccuggaggugcuuauccgcgcugaccaucaccagcagauguuuaauauuaagcaacugcucaaagcccaggucgugcaucacuuccugcugaccugccagguucuccaggaauacaaggaggggcaacugacacccaugccccgggaaguguguagaucuuucgucaaaaucauugccgaggugcuuggauccccucccgaucuggagcuccugaccaucaucuuuaacuuccuucuggcuguucauccuccgacgaauacauaugugugccacaaccccaccaauuuuuacuucagccuccacauugacggcaagaucuuucaggaaaaaguccgcucuauuauguaucugcggcauagcuccucugggggaagaagccugauguccccuggcuucauggugaucucucccagcggcuuuaccgcguccccuuacgagggggaaaacagcucuaacauuaucccccagcaaauggccgcucacaugcuccgcucccggagccugccggccuucccuacauccucucuucugacccagagccagaagcucacgggaucccugggcuguucuaucgauagacuucagaauauugccgacacauauguugcuacccaaagcaagaaacagaacucccuggggagcucugauacacucaagaaaggaaaggaggacgccuuuaucuccagcugcgaaucugcgaaaaccgugugugagauggaggcuguccuguccgcccaggugagcgugucugauguccccaagggcguucugggguucccuguggugaaggccgaccauaaacagcucggagcugaaccccgcuccgaggaugacagcccuggcgaugaaucuugccccagacggccggacuaccugaagggccuugccagcuuucaacgcucccacagcacaauugcgucccuggggcucgccuucccuucucagaauggaagcgcugccgucggcagauggcccucccugguggaccggaacaccgaugacugggagaauuuugcuuacucucuuggguaugagcccaacuacaaucgcacggccagcgcucauuccguuaccgaagauugucuggugccuaucugcugcggacucuaugagcugcugucuggcguccuccugauucuuccggacgugcugcucgaagauguuauggacaaacugauccaggccgauacacuucuggugcucgucaaccaccccagcccugcgauucagcaaggggugaucaagcugcuggacgccuacuucgcuagagccuccaaagagcagaaggauaaguuccucaaaaaucggggauuuagccugcuugcuaaccagcuguaucuccacagaggcacccaagaacugcuugaguguuucaucgagauguuuuucggccgccauauugggcuggacgaagaguuugaucucgaagacguccggaauaugggacuguuccagaaguggucugugauccccauucugggccucaucgagacaucccuguacgacaacauucuucugcacaaugcccuccugcuucugcuccagauccugaacagcugcucuaaaguugccgauaugcugcucgacaaugggcugcuuuaugugcuguguaacaccguggcugcgcucaacggacuggaaaagaauaucccuauguccgaguacaaacuucuggccugcgauauucagcaacucuuuaucgcugucacgauucaugccuguuccucuuccggcagccaguacuucagaguuaucgaggaccugauugugaugcugggguaucuucagaacucuaagaauaaacgcacacagaacauggccguggcucugcaacuccggguccugcaggccgcgauggaauuuaucagaaccacagccaaucacgauuccgagaaccucaccgacagccugcagagccccuccgcuccucaccaugccgugguucagaagcggaagucuaucgcuggaccgcgcaaauucccccuugcccaaaccgaaagccugcugaugaagaugagauccguggcgaaugaugagcuccacgucaugaugcagcggcgcaugucucaggaaaacccuagccaggccacagagacggagcuggcucaaagacuucagcggcugaccgugcucgccgucaaucgcauuaucuaccaggaauuuaacuccgacauuaucgauauucugagaacacccgagaaugugacccaaucuaaaacaagcguuuuccagaccgaaaucuccgaggagaacauucaucacgaacagagcucuguguuuaauccuuuccagaaggagaucuucacguaucucgucgaaggcuuuaaaguguccaucggcagcucuaaggcuuccgggagcaagcaacaguggacaaaaauucugugguccugcaaggagaccuuccggaugcagcugggacgccuucugguucauauccucucucccgcccacgcugcccaggaaagaaaacaaauuuuugagaucgugcacgagccgaaccaucaggaaauucugcgggacugucuuagcccuucccugcagcacggcgcgaagcucguccuguaccucucugagcugauccauaaucaccagggggaacugaccgaggaggaacuuggaacagccgagcugcucaugaacgcucugaaacuuugcggccacaaguguauuccgcccagcgccuccaccaaggcugaucugauuaaaaugaucaaggaggaacagaagaaguaugaaacagaggaaggggugaacaaagccgccuggcagaagacggugaauaacaaucagcaaagccucuuccagagacuggacucuaaguccaaagauauuagcaagaucgcggcugacauuacccaggccguuucucugagccagggaaacgagcgcaaaaaggucauccaacauauccggggcauguacaaaguggaccucuccgcuucuagacacuggcaggagcugauucagcagcuuacacaugaucgcgccgugugguaugacccuaucuacuaccccaccagcuggcaacuggauccuacagaaggcccgaaucgggagagacgccggcuccagagaugcuaucugaccauucccaacaaguaccuucugcgcgaccggcagaaauccgaagaugucguuaagccuccccucagcuaucuguuugaggacaagacgcacucuuccuucagcuccaccgugaaagauaaggccgcuucugagagcaucagagugaaucgccgguguauuuccgucgccccuucuagagaaacagcgggggagcugcuccugggaaaaugcggcauguacuuuguggaagacaacgccagcgauaccguugaguccucuagccuucagggggaacuggagcccgcuuccuucagcuggacauaugaggaaaucaaggaggugcauaaacgcugguggcaacucagagacaaugccgucgaaaucuuucugaccaacggacggacacuucugcucgcuuucgauaauacgaaggugcgcgacgacguuuaccacaacauucugaccaauaaccugccgaaucuccuggaguauggcaacaucacagcccuuaccaaccugugguacaccgggcagauuacaaauuuugaauaccucacgcaccugaacaagcaugcgggaagaucuuucaaugaucuuaugcaguauccuguguuucccuucauccuggccgacuacgucuccgagacccucgaucugaacgaccugcucauuuaucggaaucugagcaaaccuaucgcugugcaguacaaggagaaagaagauagauauguggacacauacaaguaucuugaggaagaguaccggaaaggcgcccgcgaagaugaccccaugccucccguccaaccguaccacuauggcucucauuacuccaacagcgggaccguucugcacuuccucgugagaaugccucccuuuacaaagauguuccuggcuuaucaggaucagucuuuugacauucccgaucggaccuuccauagcacgaauacaaccuggcgccuuuccagcuuugaguccaugaccgacgugaaggagcugaucccugaguucuuuuaccucccggaguuccuggucaacagagaaggauuugauuucggcgugcggcaaaauggggagcgcguuaaccacgugaaucugcccccuugggccagaaacgacccccggcucuuuauccugauucaccgccaggcucuugagucugacuaugucagccagaauaucugccaguggauugaucugguguucggauacaaacaaaagggcaaagccuccguucaggcgaucaacguguuucauccugccacauauuucgggauggacgucucugcuguggaagaucccguucagagacgggcccucgagaccaugauuaagacauacggccagaccccucgccaacuguuccacauggcucaugugagcagacccggagccaaacuuaauaucgaaggcgagcugccggccgcggucgggcuccuggugcaguuugcuuuccgggaaacgcgcgagcaggucaaggagaucacauacccuagcccccugucuuggauuaagggacucaaauggggcgaauauguggggagcccuuccgcccccguuccgguggucuguuuuagccagccucacggagagagauucggcucucugcaagcccuucccacccgggcuaucugcgggcuguccagaaacuuuugucuccugaugacauacagcaaggaacagggcgugcgcucuaugaacuccaccgacauucaguggagcgccauccugucuuggggauaugcugauaauauucuccggcuuaaauccaagcaaagcgagcccccugugaacuucauccagucuucccagcaguaccaaguuacgagcugcgccugggugcccgacuccugucagcuguuuaccggcagcaaaugcggggucaucacagcguauaccaauagauucacaucuagcaccccuuccgaaauugagauggagacacagauccaccuguacggacauaccgaagagauuacgucucucuuuguguguaagccguauagcauccugauuuccguuucucgcgauggcacaugcaucauuugggaccuuaaccggcuguguuacgugcagagccucgccgggcacaagucccccgucaccgcugugagcgccucugaaaccuccggagauaucgcuacagucugcgacagcgccggcgggggcucugaucugagacuguggaccgugaauggagaccuuguuggccaugugcacugucgcgagaucauuugcuccgucgcguucagcaaccaaccugaaggggugucuaucaauguuauugccggaggccucgagaacgggaucgugcggcugugguccacaugggaucugaaacccgucagagagauuacguuuccuaagagcaauaaacccaucaucucccucaccuucucuugugacggacaucaccuguacacagcuaacagcgacggcaccgugauugccuggugccgcaaggaucagcagcggcuuaaacagccuauguuuuauuccuuccugagcucuuacgcugccggcuga

SEQ ID NO: 71730 - RNA, 969 nt, Artificial Sequence
  derived and/or modified sequence opt5 from LYVE1__Homo_sapiens__NP_006682
auggccagaugcuucagccuggugcuccugcuuaccuccaucuggacaacgcggcugcucguccagggcucucugcgcgcugaggaacuuagcauucaaguuuccuguagaaucauggggauuacccuggugucuaagaaagccaaccagcagcucaauuuuacagaggcgaaggaggcuugccggcugcugggacucagccuggccggcaaagaccagguggaaaccgcccuuaaggcuuccuucgaaacauguucuuacgggugggucggagauggcuuugugguuaucagccgcauuucccccaacccuaaaugcgggaagaauggagugggcguccugaucuggaaggugccgguuagcagacaauucgccgcuuauuguuacaacucuuccgacaccuggacaaauagcugcauccccgagauuaucaccacgaaagauccuauuuuuaacacccagacagccacccagacaaccgaguucaucgugucugacuccacguauagcgucgcgucucccuacuccacaauuccugcccccaccacaaccccuccggcucccgccagcaccuccaucccucggcgcaagaaacucauuugugugacagaaguguuuauggagacgucuaccaugagcacagaaaccgagcccuucgucgagaauaaggcugccuuuaaaaacgaagcggccggcuucgggggaguuccuacagcucugcuugugcuggcccuccuguuuuucggcgcugccgccgggcugggauuuugcuaugugaagagauacgucaaggcuuuccccuucaccaauaaaaaccagcaaaaggagaugaucgaaacgaaagugguuaaggaggaaaaagcgaaugauuccaacccgaaugaggagagcaagaaaacagacaagaacccugaagagucuaagucccccagcaaaaccaccgugcggugucucgaagccgaggucuga

SEQ ID NO: 71731 - RNA, 447 nt, Artificial Sequence
  derived and/or modified sequence opt5 from LYZ__Homo_sapiens__NP_000230
augaaggcccugaucgugcucggccugguccuucugagcguuaccgugcaggggaaaguguucgagagaugcgaacucgcucggacacugaagcgccuuggaauggacggcuacagagggauuucccuggccaacuggaugugucucgcgaaaugggagucuggauauaauacgcgggcuaccaacuacaaugccggcgaucgcagcacagacuaugggaucuuucaaauuaacuccagauacuggugcaaugauggaaagacccccggcgccgucaacgcuugucaccugucuugcagcgcccugcuccaggacaauaucgcugaugccguggcgugugccaaacggguugugcgcgacccucagggcauuagagcuugggucgccuggcggaaccgcugccagaauagagaugugcggcaauauguucagggguguggaguguga

SEQ ID NO: 71732 - RNA, 585 nt, Artificial Sequence
  derived and/or modified sequence opt5 from LYZL1__Homo_sapiens__NP_115906
augcaggacgcuccccugagcugccucuccccuaccaaguggucuagcguguccucugccgauagcacagagaaauccgccucuggcgcggggacgagaaaccugccguuccaauuuugucuucggcaggcucugcgcaugaaggccgccggaauccucacccugauuggcugccuugucacaggggcugaaagcaaaaucuacaccagauguaagcuggccaaaauuuucucccgggcuggacucgacaauuauuggggcuuuagccuggggaacuggaucugcauggccuacuaugagucuggauacaauacaaccgcgcagacaguucuggaugacggcuccauugauuauggcaucuuccagaucaacagcuuugccuggugucgcagagggaagcucaaggaaaauaaccacugccauguggcuuguucugcccugauuaccgacgaucuuacggacgcuaucauuugcgcccggaaaaucgugaaggagacccaaggaaugaauuacuggcagggcuggaaaaagcacugugaagggcgcgaucuguccgaguggaaaaagggaugcgaggucagcuga

SEQ ID NO: 71733 - RNA, 585 nt, Artificial Sequence
  derived and/or modified sequence opt5 from LYZL2__Homo_sapiens__NP_898881
augcaggacgcuccccugagcugccucuccccuaccaaguggucuagcguguccucugccgauagcacagagaaauccgccucugcggcuggcacgagaaaccugccguuccaauuuugucuucggcaggcccugcgcaugaaggccgcugggauccucacccugauuggaugccuugucacaggcgccgaaagcaaaaucuacaccagauguaagcuggcuaaaauuuucucccgggccgggcucgacaauuauuggggauuuagccugggcaacuggaucugcauggcguacuaugagucuggguacaauacaaccgcccagacaguucuggaugacggauccauugauuauggcaucuuccagaucaacagcuuugcuuggugucgcagaggcaagcucaaggaaaauaaccacugccauguggccuguucugcucuggugaccgacgaucuuacggacgccauuaucugcgcgaaaaagauugucaaagagacccaagggaugaauuacuggcagggauggaagaaacacugugaaggccgggaucuguccgacuggaagaaggauugcgaggugagcuga

SEQ ID NO: 71734 - RNA, 447 nt, Artificial Sequence
  derived and/or modified sequence opt5 from LYZL6__Homo_sapiens__NP_001186880
augaccaaggcccugcucaucuaccuggugagcuccuuccuugcucugaaccaggccucucucauuagcagaugcgaccuggcgcaaguccuucagcuggaggaucucgacggcuuugaaggguauucccugucugauuggcugugucucgcuuucguugagagcaaauuuaauaucuccaagauuaacgaaaaugccgacggaucuuucgauuacggccuguuucagaucaacagccacuauuggugcaaugacuacaaauccuauagcgagaaccuuugucauguggauugccaggaccugcucaaucccaaccugcuugccgggauucacugugcuaagcggaucgugucuggagcccgcggcaugaauaacugggucgaauggagacugcauugcuccgggcggccucucuucuacuggcugacaggaugucgccugagauga

SEQ ID NO: 71735 - RNA, 849 nt, Artificial Sequence
  derived and/or modified sequence opt5 from LZTFL1__Homo_sapiens__NP_001263307
augagauucgcccggagcaagcgcggccugagacucaaaaccguggacuccugcuuucaggaucugaaggagucucggcuugucgaagacacauucacgaucgaugagguuagcgaagugcugaacgggcuccaagcugugguccacuccgagguggaaucugagcugauuaauaccgccuacacaaacguucuucugcuccgccagcuguuugcgcaggcugagaaaugguaucugaagcuccagaccgacaucagcgaacuggagaauagagaacuucuggagcaaguggccgaguucgaaaaagccgagauuacauccucuaacaagaagcccauccucgaugucaccaaaccuaagcuggcuccgcuuaaugaaggaggcacagccgagcugcucaacaaagaaauucugcggcugcaggaggagaaugaaaagcucaaaagccgccugaagaccaucgagauccaggcuacgaacgcccuugacgaaaaguccaaacuggagaaggcgcuccaggaucugcaacuugaccaggggaaucagaaagauuuuauuaaggcccaggaccugagcaaccucgaaaauaccguggcugcccugaaaucugaguuccaaaagacacugaacgauaaaaccgagaaucagaagucccucgaagagaaccuggcuacagccaagcaugaccuucugagaguucaggaacaacuccacauggcggagaaagaacuggagaagaaauuucagcagaccgccgcuuaccggaauaugaaggagauccuuacgaaaaagaacgaucagauuaaggaccugcgcaaaagacucgcccaauaugaacccgaggacuga

SEQ ID NO: 71736 - RNA, 2523 nt, Artificial Sequence
  derived and/or modified sequence opt5 from LZTR1__Homo_sapiens__NP_006758
auggccggccccgggagcaccggaggccagaucggggcugccgcgcuggcuggaggcgccagauccaagguggccccuucugucgacuucgaucacagcugcuccgacucuguugaguaccucacacugaacuuugggccguucgaaacggugcaucgguggcgcagacuucccccuugugaugaguuugugggagcucggcgcagcaaacacaccgucguggccuauaaggacgcuauuuacguuuucggcggcgauaaugggaaaacaaugcugaacgaccuccugagauuugaugugaaggacugcuccuggugucgggccuucaccacaggaacacccccugcgccccgcuaucaucacucugccgucguguacggcagcuccauguuuguuuucgggggauauaccggcgauaucuacagcaauucuaaccuuaaaaauaagaacgaccuguuugaauauaaguucgcuaccgggcaauggacggaguggaaaauugaaggaagacucccuguggcccgguccgcucauggcgccaccgucuacagcgauaagcuguggaucuuugcgggcuacgacgggaaugcccgccugaacgauauguggacaauuggacuccaggacagagagcugaccugcugggaggaaguggcucagucuggcgagaucccgcccuccuguugcaauuucccuguggccgucugucgggacaaaauguuuguuuucagcgggcagucuggagcuaagaucacaaacaaucuuuuccaauuugaguucaaagauaagaccuggacgcgcauucccacagaacaccuucucagaggcuccccucccccgccucagcggcgcuaugggcacaccaugguggccuuugacagacaucuguacguguucggaggcgccgcugauaacacacuucccaaugagcugcacugcuaugacgucgauuuucagaccugggaagugguucagccuagcuccgacucugaggugggcggggcggaaguccccgagcgggccugugcuagcgaagaggugcccacccucacauacgaggaaagaguuggauucaagaaaucccgcgauguguuuggccuggacuucgggacgaccagcgccaagcaaccuacacagccggccucugagcugcccuccggacggcucuuucaugcugccgcggucaucagcgaugcuauguauauuuucggcgggaccguggacaacaauaucagaucuggcgaaauguaccgcuuucaguucagcugcuauccuaaauguacacugcacgaggauuacggacggcuuugggaauccagacaguuuugcgacgucgaguucgugcugggcgagaaggaagagugcguucaagggcacguggccauugucaccgcccgcucucgguggcucagacgcaaaaucacgcaggcucgggaaagacuggcccagaagcuggagcaagaagcugcccccgugccucgcgaggcgcccggaguugccgcuggcggggcccggccgccucugcuccauguggcuauuagagaggccgaagcgcggcccuucgagguccugaugcaguuucuguacacagacaaaaucaaguauccucgcaagggacacguggaagaugugcuccugaucauggacguuuacaaacuugcccugagcuuccagcucuguagacuggagcagcuuugccggcaauauauugaggcuuccgucgaucugcagaacgugcucguggucugugaaagcgccgcuagacugcagcugucucagcucaaggagcauugccugaacuuugugguuaaagaaucccacuucaaucaagugaucaugaugaaggaguuugaacgccuuagcucuccccugauugucgagaucgugcggagaaaacagcagccucccccgcgcaccccucucgaccagcccguugauauuggcaccucccugauccaagacaugaaggccuaccuggagggggccggcgcugaguucugugauaucacacuucuccuggacggacaucccagaccugcgcacaaggccauucuggcugcccggagcuccuauuuugaagccauguuccgcucuuuuaugccggaagauggccaggugaacaucagcauuggggagaugguccccuccagacaggcuuucgaaucuaugcuccgguacaucuauuacggagaggugaauaugccucccgaggacagccuguaccuuuuugccgcgccuuauuacuauggcuucuacaacaaucgccugcaggcuuauugcaaacaaaaccucgaaaugaauguuaccgugcagaacguccugcagauucuggaggccgccgauaagacacaagcucuugacaugaaaagacacugucuccauaucaucgugcaccaguuuacgaagguguccaaacugcccacccugcggagccucucucagcagcugcuucuggauauuaucgacucccucgccagccauauuucugacaagcaaugcgcggaacugggggcugauaucuga

SEQ ID NO: 71737 - RNA, 1791 nt, Artificial Sequence
  derived and/or modified sequence opt5 from LZTS1__Homo_sapiens__XP_011542689
augggcagcguguccucucugaucagcgggcacuccuuccauucuaagcacugcagagccagccaguacaaacuccggaaguccucucaucugaaaaagcugaaccgcuauagcgacggacugcucagauuuggcuucucccaagauagcgggcacggaaaaucuuccagcaagaugggcaagucugaggacuuuuucuacauuaaagucucccagaaggcucgggggagccaucaccccgauuauaccgcccugucuuccggagaccuuggcggccaggcggggguugauuuugacccuagcacaccgcccaaacugaugccuuucuccaaucagcucgaaaugggaucugagaagggcgcugugcgccccacggccuuuaaaccugugcugcccagaagcggggccauccugcacuccagcccugaaucugcuucccaucaacuccacccggcucccccugauaagcccaaggagcaggaacugaaaccuggacuuuguagcggcgcccugucugacagcgggcggaacuccaugucuagccuccccacccauuccacaucuagcuccuaccagcuggauccgcuugucaccccugugggacccacaagccgcuucggcggcucugcccacaauauuacccaggggaucguucugcaagacuccaacaugaugagccucaaggcgcuguccuuuucugauggaggcagcaaacuggggcacuccaauaaggccgacaaaggaccuucuugcgugagaagccccauuuccacagaugaguguagcauccaggagcucgaacagaagcugcuugagcgggaaggcgcucugcagaaacuccaacgcucuuucgaggagaaggaacuggccuccagccuugcuuaugaggaaagaccccggcgcugcagagacgagcuggaagggccugagccgaagggaggcaacaaacucaagcaggccucucagaaaucccaacgggcgcagcagguccugcaucuucaggugcuccaacugcagcaggagaagcgccagcuuagacaagaacuggagagccucaugaaagaacaggaccugcuugagaccaagcugcggucuuacgaaagagagaagacgagcuuuggccccgcccucgaggaaacccagugggagguuugucagaaauccggggaaaucagccugcugaagcaacagcucaaagagucucagacagaagugaaugcuaaggccuccgagauucugggacuuaaagcucagcugaaggauacccgcggcaagcucgaggggcuggaacugcggacacaagaccuugagggagcccucagaaccaaaggccuggaacuggaggucugcgagaacgaacuccagcgcaagaaaaaugaggccgaacugcuucgggagaaggugaaccugcucgaacaggagcugcaagagcugagagcucaggcggcccuugcucgcgauauggggccucccacguucccugaagacgugcccgcccuccagcgggagcuggaaagacugcgcgccgagcuccgggaagagagacagggccacgaucaaaugagcuccggauuucagcaugagcgccuggucuggaaagaagagaaggaaaagguuauccaguaucagaaacaacuucagcagucuuacguggcuauguaccagcggaaucaaagacuggagaaggcccuccagcagcuggcgcggggcgacagcgcuggggaaccgcuggagguggaucuugagggagccgacauuccuuaugaagauaucauugccacagagaucuga

SEQ ID NO: 71738 - RNA, 576 nt, Artificial Sequence
  derived and/or modified sequence opt5 from M6PR__Homo_sapiens__NP_001193953
auguuccccuuuuacagcugcuggagaaccggccugcuccugcuucugcucgccguggcuguccgggaguccuggcagacagaagagaagacgugugaccugguuggggaaaaaggaaaggagucugaaaaagagcuugcccuggugaagcgccucaaaccucuguucaacaagagcuuugaguccaccgugggccaagggucugauacauauaucuacauuuucagagucugccgggaagcgggaaaucacaccagcggcgcugggcuggugcagaucaacaaguccaauggaaaagagacaguugugggccgccucaacgaaacccauauuuuuaauggcucuaacuggaucaugcugauuuauaaagggggagacgaguacgauaaucacuguggcaaggagcagagacgggccgucgugaugaucagcugcaaccgccauacacuugccgacgggugugauuucguuugcagauccaagccgcggaaugugcccgcugccuaucgcggagucggcgacgaucagcugggggaagagagcgaagagagagacgaucaccuccugccuauguga

SEQ ID NO: 71739 - RNA, 2304 nt, Artificial Sequence
  derived and/or modified sequence opt5 from MAATS1__Homo_sapiens__NP_203528
augagccacgccgugaccaucgaggaaccccaggcucaaccucaggucucccagacaagauaccgggagcgcucuagagccggcagccauauuuccucuaaccgggcguaugacuuccuguacgauccgcucuuuaucguuagcuccgaaaaggaccacacgcaggcuaauauucaagccacccugauccgcucuagacuucggaaagugccccgcuucaagacaauguuuagcaaccugauucauuauccuagauacucccucuauuggagcaaaucugaucccgugccucccuucaucucccgggaguggaaggggcacaaagaaaagcaucgcgaggcccugagacagcuuaccacaaccgacgcuagcuuucagaugccuaaggaggucuacgaagauccggaggugacaggcaaaaaucgguauaaguacuucgaacgccccuuucugccuuucuuucagcaaaugcccuucaacguuguguacgccgucucuaaagcugagccuuauaccuuucccccgacguccaccaagcaccucagcaucccuucuaaauccacagugggaacccagacagacuacagagaugccgacguucagaccgaucccuauagcccugaguacguggucugccaggacuccauucccgaacugcugacgcucgcgacacugaccugggggcggggacuucccgccggccaagcugagguggaaaugaucgagcgcgccagagaaaagcgggcuugggaggccucucugccugcgcucagcgauacaucccaguucgagaagagacgcaaaaugaugaaugaaauggagcggaaggaaugggccuuuagagagcaggaaauugagaaacugcaagagauccgccuugaagugcugaaggagcuccugcggaaaagagaagagaaccagaaugaagucaacaugaagcaccugaaugcucgcuggagcaaacuccaggaggggaaggaggccaagauggcuaaaauucagcggacccauguuucuaccaucagaaagcuggugggaaaacgcaagaacauugaaggcaaacuugagcggagaaauaucaucaaggacuauuccgauuacgccagccaaguguauggcccgcugucucgccucggguguuuccccgacaacaauagcgaagacuucgucgugaagaacuacuaccugaauacauaugagggacuuguugagcuggaauccugccucccugauuuugugacgcagccccagauucgggccccuaaacccaaggucaucaccacaaaagcuggcuuccugaagagagcggcccggcuggacuacgagcucgcugaagugcacaaagcccugcuugauaagaagaacaaaguucuggaggugaagaaaccgccucgcuuucuccagagaaaccccauuccucaaccccggcugccuacccccacacuugaaaugaccucuaaugaggaggaagagauggaaauggccgucaucuaucugcagaagcuccugagagggcgcgugguccagaacaugauguucgagggaaaagaaaagcggcuggagcucauucaggagcugagaacgugucaugcccuucaagaagacgagaagcuggugaaaaaggcugaaaaacagguuacacucgcgcugcagcgccagagaaaucugcacgagcacaaggugagccuugucgaaaaccaucucgcuggccuggaggggcgggcccuggccgauauguuugacuuccucuccaaagagcuggugcgccuucaagaagagagacggauccacgcuuuuguuaugcuggccgaacgccagagacgggugcgcgaggcugaggaaagcggaagacggcaggucgagaagcaacgccucagagaagaggaugaaaucuucaaagagguggugaagguucaucacucuaccauuuccagcuaccuggaggacaucauucugaauaccgaagccaacacagcggaggaacaggcccgggcugagaucgaaaagauggccgagaaaauuaaugauaucgcuuaugagauggaaucuagacgcaccuaccuucaguccgaggaaaucgucgccgagcucguguauagcuuucugauuccggaagugcagaaguacuucgucaaagagaaggugcggaacgcgcaaagaaaacauauccuggccgcucaccagauuauccacuccuacacagagucuaugguucagaagaagcucacggaaggcgagcaggacgaagccagcaaugcugccaugcugcuugagaaagagacccaaaacgaaaauaacuccuga

SEQ ID NO: 71740 - RNA, 1080 nt, Artificial Sequence
  derived and/or modified sequence opt5 from MAB21L1__Homo_sapiens__NP_005575
augaucgccgcucaggccaagcugguguaccaccucaacaaguauuacaaugagaagugccaagcgagaaaagcugccauugccaagaccauccgggaagucuguaaaguugugagcgacgugcugaaggaggucgaagugcaggagccccgcuucauuuccucucuuaacgaaauggauaauagauaugagggccuggagguuaucagcccuacagaauuugaggugguccucuaccugaaccagauggggguguucaauuuuguugacgauggaucccuuccgggcugcgcugugcugaagcucucugacgggcggaaacgcagcaugucccugugggucgaguucauuacggccucuggauaucugagcgcuagaaagauccggucccgcuuucagacccucguggcccaagcgguggauaaauguagcuacagagacgucguuaagaugguggccgauacaucugaagugaaacugcggauccgcgacagauaugucgugcagauuacccccgcuuucaagugcacaggcaucuggccucgguccgccgcucauuggccccuuccucacauucccuggccugggccgaaccgcguugccgaggugaaggcggaaggauuuaaucugcucagcaaagagugucauucucuggccggcaagcaguccagcgcugaaucugaugccuggguccuucaguucgcugaggccgaaaacagacugcaaaugggcgggugccggaaaaagugucucuccauccugaaaacccugcgcgacagacaccucgagcugcccggacagccucuuaauaacuaccauaugaagacacuggugagcuacgagugcgaaaaacacccccgggaguccgauugggacgaaucuugucucggcgauagacugaaugggauucuucugcagcucaucagcugccugcagugucgccggugcccucacuauuuucugcccaaccucgaccuguuccaaggaaagccgcauuccgcccuugagaaugcugcgaagcagaccuggagacuggcccgcgaaauucucacgaacccuaaaagccuggagaaacuuuga

SEQ ID NO: 71741 - RNA, 1080 nt, Artificial Sequence
  derived and/or modified sequence opt5 from MAB21L2__Homo_sapiens__NP_006430
augaucgccgcucaggccaagcugguguaccaacucaacaaauauuacaccgagagaugccaggcgcggaaggcugccauugccaaaacaauccgcgaagucuguaagguugugagcgacgugcugaaagaggucgaagugcaggagcccagauucauuuccucucuuagcgaaaucgaugcucgguaugagggccuggagguuauuuccccuacggaauuugaggugguccucuaccugaaucagauggggguguucaacuuuguugacgauggaucucuuccgggcugcgccgugcugaagcucagcgacgggcgcaagagauccaugucucugugggucgaguucaucaccgcuagcggauaucuguccgcccggaaaauccgcagcagauuucaaacacucguggcgcaggccguggauaaguguucuuaccgggacgucguuaaaaugauugcugauaccuccgaagugaagcugcgcaucagagagcgguaugugguccagauuacacccgccuucaaaugcaccggcaucuggccucgcagcgcugcccaguggcccaugccucacauucccuggccugggccgaauagaguggcggaaguuaaggccgagggauuuaaccuucugucuaaggaauguuacucccucacaggcaaacaaagcucugcugaguccgacgccugggugcugcaguucggcgaagcugagaaucggcuucugaugggagggugccgcaacaagugucucagcguccugaaaacccugagagaucggcaucucgagcugcccggccagccucuuaauaacuaccacaugaagacgcugcuccuguaugaaugcgagaaacaucccagagaaaccgacugggaugaguccugucuuggggaccgccugaauggaauccuccugcagcugauuucuugccuccaaugucggagaugcccucacuacuuucugcccaaccuugaucuguuccagggcaagccgcauagcgcccucgaauccgccgcuaaacagacauggcgccuggcgcgggagauccuuaccaauccuaagagccuggacaagcucuga

SEQ ID NO: 71742 - RNA, 1089 nt, Artificial Sequence
  derived and/or modified sequence opt5 from MAB21L3__Homo_sapiens__XP_011538928
augaaguaccugaccgugggcgaccucgaggauugccugcuuaacaaagucgaccugagacggcagcaaaucagccaggccguugaagaggugcagaaggugguccaccaucucacaacgaauauuuccaaccaggauauccgcuuccaagcugugcccuauucugacaccuacaaugaaaacauuaaaguucuggccccuagccaguuucuugugacagucccgaucaaggggcuggcgggauauagagaggcucgggaacagcacuggcgcuacuauacccuccagggcacaagacugcccuguccucugcgggaucccgaggggcuccaacaguggcuggagguggaacaguucaugaaaucccuuuggcaguggcaugagaccgacguuaauauugauggagacaucgugccugccaagguccugcucguguuucgcaagcugguggaaaacgccgucagaacaugccaccuuucuggcaaaguuagccugcucgggaaucgguccgcuguguggguggccgucgagaccucugcuuaccaaguggagcuggaacugguucccgccguggagaucccuacgaccuggagcaagaaagcgcgcuggccgagaugucuccagcgguggcccucccaggaacgcgucgagugcauuaagagcuucggauuuaaccugcuugccuguucuaauuaucauuggcaacuguccuuccucagagcugaacaggugcugcuugagcagcuggaugaggacggcggcugccggcgcaaauguuuucagguuaugagacaccucaaggaagauaucuggugcccugggaaccggcccgugauuacaagccaccaucugcaaaccguccuguucuggacaugugagaaguacccucacuuuaaagacuggcaaguguucucuaaggccuuucucagacugguccgcaaacuucauaagugcgugucccagcacuuccugaaacacuacuuuguucggaauagcaaccucuuccaguguaccaaucccacggaacuggauacaguggcucagaaacuugccaccuuccugaagaacccgcagaucggaccucccuga

SEQ ID NO: 71743 - RNA, 2559 nt, Artificial Sequence
  derived and/or modified sequence opt5 from MACC1__Homo_sapiens__NP_877439
augcugaucaccgagagaaagcacuuccggagcggccgcauugcccaguccaugucugaagcuaaccucaucgacauggaggccgggaaacugagcaaguccugcaauauuacagaaugucaagaucccgaccuucugcauaacuggccugaugcguuuacgcucagaggaaauaacgcuucuaaaguggccaauccguucuggaaccagcugagcgccuccaaucccuuucuugacgauaucacccagcugcggaacaaucgcaagagaaacaauauuucuauccucaaagaggacccuuuccuguuuugccgggaaaucgagaacggcaauagcuucgauuccagcggggacgagcuggauguccaccagcuccugcgccaaacaucuuccagaaacagcggacggucuaaguccguuagcgaacuucuggacauucucgaugacaccgcucaugcccaccagucuauccauaauuccgaucagauucugcuucacgaccuggaguggcucaagaacgaccgcgaggcuuacaaaauggccuggcugagccagagacaacuggcgcgguccugucucgaucugaacacaaucucucagagccccggcugggcccagacccagcuugcugaagugacaauugccugcaaggugaaucaccaagggggauccguccagcugccugagagcgacaucaccgugcauguuccccagggccacguggcugucggcgaauuucaagaggugucucuccgcgccuuccuggauccuccgcauaugcuuaaccacgaccuguccuguacgguuagcccccuccuggaaauuaugcuggggaaucucaacaccauggaggcgcugcuucuggaaaugaaaaucggagccgaggugagaaaggauccuuuuucucaggucaugacagagauggugugccuccacagccugggcaaagaagggcccuucaaggugcuuuccaauuguuauaucuacaaggacaccauucaggucaaacugaucgaucucucucagguuauguaucuggugguggcugcccaagcuaaggcccugccuagccccgccgcuacaauuugggacuacauccauaaaaccacguccauuggaaucuauggcccgaaguacauccacccuagcuuuacagucgugcucaccguuugcgggcauaacuauaugcccggacagcugacaauuucugauaucaaaaagggcggcaaaaauauuuccccuguggucuuccagcuuugggggaagcagagcuuucugcucgacaagccccaagaucugucuaucuccauuuucagcugugaccccgacuucgaggugaaaaccgaaggagagcggaaggaaaucaaacagaagcagcuggaggcgggcgagguugugcaccagcaauuucuuuucucccucgucgaacaucgcgagaugcaccuguuugauuucugcgugcaggucgaaccuccgaacggggagcccguggcccaguuuucuaucaccacaccugaccccacgccuaaucugaaaagacucagcaaccugcccggauaccuucagaagaaggaagagauuaaauccgcuccgcugucuccuaagauccucguuaaauaccccaccuuccaagauaagacacugaauuuuagcaacuauggcgugacccugaaagccguccuucggcaguccaagauugacuacuuccucgaguauuuuaagggggauacaaucgcccugcugggagaaggcaaagugaaggcuauuggccagagcaaaguuaaggagugguacguggggguccucagaggaaaaaucggccuggugcacuguaagaaugugaagguuauuucuaaagaacaagucauguucauguccgacagcguguuuaccacgcgcaaccuucuggagcagaucgugcucccucugaagaaacugacauauaucuacucugucgugcuuacccucguuuccgagaagguguaugauuggaaaguccuggccgacgugcugggguacagccaucucucucuggaagauuucgaccagauucaggcggauaaggagagcgaaaaaguuuccuacgugaucaagaaacuuaaggaggacugccacaccgaacggaauacaagaaaguuucuguaugagcucauugucgcucugcugaaaauggauugccaagagcuuguggcccgccucauccaggaagccgcuguucugaccagcgccgugaagcugggaaaaggcuggcgggagcucgcugaaaagcuggucagacuuacaaagcagcagauggaggccuacgaaauuccccaucgcgggaacacgggcgacguggcgguggagaugauguggaaaccugccuaugacuuccuguacaccuggucugcucacuauggaaacaauuaccgggauguccuccaagaccugcaguccgcccuggauagaaugaagaaccccguuacaaaacacuggcgcgagcuuaccggcgugcugauccucgugaauagccuggaaguccuccgggugacagcuuucuccaccucugaggaaguuuga

SEQ ID NO: 71744 - RNA, 978 nt, Artificial Sequence
  derived and/or modified sequence opt5 from MACROD1__Homo_sapiens__NP_054786
augagccugcaguccagacucucuggccggcuggcccaacuucgcgcugccgggcagcugcucgugcccccuagaccgcggcccggacaccuggcgggcgcuacccgcacaagaagcuccacgugcgggccucccgccuuccuuggagucuuuggccggcgcgccagaaccucugcugggguuggagccuggggcgcugccgcggugggccggacagccggggugcgcaccugggcuccucuggccauggcugccaaggucgaccucagcacauccaccgauuggaaagaggcgaagucuuuccugaaaggacugagcgacaagcagagagaggaacauuacuuuuguaaagauuucgugcggcucaagaagauccccacauggaaagaaauggccaagggcguugcugugaaagucgaggaaccucgcuauaagaaagacaagcagcugaacgagaagauuucccuucugagaagcgauaucaccaaacucgagguggacgccauuguuaaugcugccaacucuucccugcuugggggaggcgggguggauggaugcauccaccgggccgcuggcccgcugcucacggacgaaugucgcacccugcaaagcugcaagacaggcaaagcgaagauuaccgggggauacagacugcccgccaaauaugucauccauacagugggcccuaucgcuuacggggagcccucugccucccaggccgcugaacuccggagcuguuaucugucuucccuugaucugcuccuggagcacagacuucgcagcguggccuuuccuugcauuuccaccggagucuucggcuaccccugugaggcggcugccgaaaucguucuggccacgcuccgggaguggcuggaacagcauaaggacaaaguggauagacugauuaucugcguguuucucgagaaggacgaagauauuuaucgcucucggcugccgcacuacuucccugucgcuuga

SEQ ID NO: 71745 - RNA, 642 nt, Artificial Sequence
  derived and/or modified sequence opt5 from MACROD2__Homo_sapiens__NP_001028259
augaacgaguucuuuagcguggacgauaauaacgaagaggaagaggacgucgaaaugaaggaggauuccgacgagaauggccccgaagagaaacagucuguugaagagauggaggaacaaagccaggaugccgacggggugaacaccgugacagucccuggaccggcuuccgaggaagccguggaggauugcaaggacgaagauuucgcgaaagacgagaauaucacgaagggcggggagguuaccgaucacucugugagagaccaggaucaucccgacggacaggaaaacgacagcaccaaaaaugagauuaagaucgaaacagagucccaaucuagcuacauggaaacagaggagcuguccagcaaccaggaagaugcugucauuguggagcagccugaaguuaucccccucaccgaggaccaggaagagaaggagggcgaaaaagccccuggggaggauacaccccggaugccuggaaagucugaaggcuccagcgaccuggagaauaccccgggccccgauguggagaugaacucucaagucgacaaagugaaugauccuacggaaucccagcaggaggaccagcuuauugccggggcucaagaugaagccaaggagcagcgcaacggaaccaaauga

SEQ ID NO: 71746 - RNA, 2157 nt, Artificial Sequence
  derived and/or modified sequence opt5 from MAD1L1__Homo_sapiens__NP_001291452
auggaggaccugggcgaaaacaccauggugcucagcacacugagaucccuuaauaacuucaucucucagcgggucgaagggggaagcggccuggauauuuccacgucugcccccgggagccuccaaaugcaguaccagcaguccaugcaacuggaagaacgcgcugaacagaucagaucuaagagccaccuuauucagguugagcgggagaaaaugcagauggaacugucccauaagcgcgccagaguggagcucgaacgggcggcuagcaccucugcccgcaauuaugagagagagguggaccggaaccaagaacugcugacacgcaucagacagcuccaggagcgggaagccggagcugaggagaaaaugcaggagcaacuggagcgcaauagacagugccagcaaaaccuugaugccgcuuccaagcggcugcgcgaaaaagaggacagccucgcccaggcgggcgaaaccauuaaugcccugaaggggagaaucucugagcuucagugguccgucauggaucaggaaaugcgggugaagagacuggagagcgagaaacaagaacuccaggagcagcuggaccugcagcacaagaaaugucaagaagcuaaccagaagauccaggagcuccaggccucucaagaagcucgcgccgaucaugagcagcagauuaaagaccuggagcagaaacuuucccugcaagaacaggaugcggccaucguuaagaauaugaaaagcgagcucgugcggcugccuagacuugaacgcgagcugaagcagcuccgggaggaauccgcucaccugagagagaugcgcgaaacaaacggacugcuccaagaggaacuggagggccuucagcggaaacugggcagacaggagaagaugcaggaaacccucgucgggcuggagcuugaaaaugagcgccugcucgccaaacugcaaucuugggaacggcuggaccagacaaugggacucagcauuagaaccccggaggaucugucccgcuuugugguugagcuucagcagcgggaacuggcucucaaggacaaaaacagcgccgugacgucuuccgccagaggccuggagaaggcucggcaacagcugcaggaggagcuucgccaggucagcgggcaacuccuggaagagagaaagaaacgggagacccaugaagcgcuggccagacgccuccagaagcgggugcugcuucugacaaaagagagagauggaaugcgcgcuauccucggcucuuacgacagcgaacugacccccgccgaguauuccccucagcugacaagacggaugcgcgaggccgaagacauggugcaaaagguccacucucacagcgcugagauggaagcccagcuuucccaggcgcucgaggaacuugggggacagaaacaaagagcugauaugcuggagauggagcucaagaugcucaagagccagucuuccagcgccgaacagucuuuccuguuuucccgggaggaagccgacacccugcgccugaaaguugaggaacuggagggcgagagaagccggcuggaagaggaaaagcgcaugcuugaggcucagcucgaaagacgggcccugcaaggcgauuacgaccagucccgcacgaaagugcugcauaugucucucaaucccacaagcguggcuagacagcggcugagagaggaucacucccagcuucaagccgagugcgaacgccugcgggggcuccugagagcgauggagcgcggaggcaccgucccugccgaccuggaagcugccgcugccucucuucccagcuccaaggagguggcggagcucaaaaagcagguugaaagcgccgagcugaagaaccagcggcugaaagaaguguuccagacaaagauucaagaguuuagaaaggcuuguuauacccucaccggguaccagaucgauauuacaacggaaaaucaguaucgccugaccucucuuuacgccgagcauccuggagacugccugaucuucaaggcuacauccccgagcggcucuaaaaugcaacuccuggagaccgaauuuucccacacagucggggagcugaucgaagugcaccuucggagacaggauagcauucccgccuuccugucuagccucacccuggagcucuuuucccgccagacgguugccuga

SEQ ID NO: 71747 - RNA, 921 nt, Artificial Sequence
  derived and/or modified sequence opt5 from MAD2L1BP__Homo_sapiens__NP_001003690
auggccagagugccccugggccggagccucacccuguccccucgccuugagcacaacgggaugacaucugcucaucacaauuucagacugccgggaagccgggacucccccgccucugcgagccaggucgcugaaaucauugaucucgagugguacgaaaaguccgaggaaacgcaugccucucaaaucgagcugcuugagaccagcuccacacaggaaccucugaacgccagcgaggcuuuuugcccccgcgacuguaugguuccugugguguuccccggcccugucucucaggaagggugcugucaguuuaccugcgagcuccugaaacacauuauguaucaaagacagcagcugccgcuccccuacgagcagcugaagcauuucuaucggaaaccuagcccccaagccgaagagaugcuuaagaaaaagccucgcgcuacaaccgaaguguccucuagaaagugucagcaggcccuggcggagcucgaauccguucugagccaccuugaggacuuuuucgcccggacacuggugccccgcguccucauccugcugggaggcaaugcucucucuccgaaagaguuuuacgaacuggaucuuucccugcucgccccuuauagcguggaucagucccugucuaccgcugccugccuuagacggcuguuccgcgcgauuuuuauggccgacgcuuucagcgagcuccaagcucccccucugauggggacgguugugauggcccagggacacagaaacuguggcgaagauugguuucggcccaagcugaauuaccgcguccccuccagaggccauaaacucaccgugacacugagcugcgggcggccuucuaucagaaccacagccugggaggacuauaucugguuccaggccccggugaccuuuaagggauuccgcgaauga

SEQ ID NO: 71748 - RNA, 618 nt, Artificial Sequence
  derived and/or modified sequence opt5 from MAD2L1__Homo_sapiens__NP_002349
auggcccugcagcucagcagagagcaaggcaucacccugcggggguccgcugaaauuguggccgaguucuuuucuuucggaaucaacagcauucuuuaccagcgcggcaucuaucccuccgaaacauuuacgagaguccagaaguacgggcugacccuccugguuacaaccgaccuugagcugauuaaauaucucaauaacgugguggaacagcugaaggauuggcuguacaaaugcucuguccaaaagcucgugguugugaucagcaauaucgaguccggagagguccuggaacgguggcaguucgacauugagugugauaaaacagcgaaggacgauucugcuccucgcgaaaagagccagaaagccauccaggacgagauuagauccgugauccggcaaauuaccgccacaguuaccuuucuuccgcugcucgaggugagcugcucuuucgaucugcuuaucuauacggacaaggaucuggucgugcccgaaaaaugggaggaauccggcccucaguuuauuaccaacagcgaggaagugcgccucagaucuuucacaaccacaauccacaaggucaauuccaugguugcuuacaaaauccccgugaacgacuga

SEQ ID NO: 71749 - RNA, 636 nt, Artificial Sequence
  derived and/or modified sequence opt5 from MAD2L2__Homo_sapiens__XP_011538809
augaccacacugacgagacaggaccucaacuucggccaaguggucgccgauguucugugcgaguuucuugaaguggcugugcaccugauccucuacguccgggagguguaucccguugggauuuuccagaagcgcaaaaaguacaaugugccuguccagaugagcugucauccggaacugaaccaguauauccaagacacccuucacugcgugaaaccccugcucgagaagaaugauguugaaaaaguggucguggugauucuggacaaggagcauagaccugucgagaaguuuguuuucgaaaucacacagcccccucugcucuccauuucuagcgauucccugcuuucucacguggagcagcugcuccgggccuuuauccugaaaaucagcgugugugacgcgguccuugaucauaaucccccuggaugcaccuucacagugcugguucacacccgcgaagcugccacaagaaacauggagaagauucaggugaucaaagacuuuccguggauucucgccgaugagcaagacguccacaugcaugauccccggcugaucccucugaagaccaugacguccgacauucucaaaaugcagcuguacguggaggaacgcgcucacaagggcucuuga

SEQ ID NO: 71750 - RNA, 1149 nt, Artificial Sequence
  derived and/or modified sequence opt5 from MADCAM1__Homo_sapiens__NP_570116
auggacuucggccuggcccuccugcuugcugggcugcucggacugcuucugggccagagccuccaagugaagccccugcaggucgagccuccggaacccguuguggccguggcgcugggggcuuccagacagcugaccugccggcucgccugugccgaucgcggagcuucuguccaguggagaggccuugacacaagccugggggccgugcaauccgauacgggacggucuguucucaccgugcgcaacgcuagccuguccgccgcgggcacaagagucugcgugggcucuugugggggacggaccuuucagcacacaguucagcuucugguguacgccuucccugaccagcucaccgucagccccgcugcccuggugccuggcgaucccgagguggcuugcacagcccacaaagucaccccuguugacccgaaugcgcuguccuuuagccuccuggugggagggcaagaacuugagggcgcccaggcucuggggcccgaagugcaggaggaggaagaggaaccucagggagaugaggacguccucuuccgcgugacggagagauggcggcugcccccucuuggcacccccguuccgccugcccuguauugucaagcuacaaugcgccuccccggccuggaacugucucacagacaggccaucccugugcuccauucccccaccagccccgagccuccggauacaaccucucccgaauccccugacacgacaagccccgagucuccugauaccacaucccaggaacccccggacaccaccagcccugagcccccugauaagacaucccccgagccugcuccccaacaggggucuacgcacaccccgcggagcccuggauccacacgcaccagacggcccgaaauuagccaggccggccccacacagggggaggucaucccuaccggaucuuccaaaccggcgggcgaccaacugcccgccgcucuuuggacgagcucugccgugcuggggcuccugcuucuggcccucccuacauaccaucuguggaagcgcugcagacaccuggcugaagacgauacccaucccccugccagccuccggcugcuuccccagguuuccgcgugggcuggacugagaggcaccggccagguggggauuucuccuagcuga

SEQ ID NO: 71751 - RNA, 4746 nt, Artificial Sequence
  derived and/or modified sequence opt5 from MADD__Homo_sapiens__NP_569831
auggugcagaagaaaaaguucugccccagacugcucgacuaccuggucaucguuggcgcccggcacccuagcuccgauucuguggcucaaaccccggagcuucugcgcagauauccccucgaagaccauacagaguuuccucugcccccugauguggucuucuuuugucagcccgaagggugccuuagcgugcggcagcgcagaaugucccugcgggacgauacgucuuucguuuuuacccucacagacaaagauaccggagugacacgcuacggcauuugugucaacuucuaucgcagcuuucagaagcggaucuccaaagagaagggggaaggaggcgccgggucucgcggaaaggagggcacccacgcgacaugcgcuagcgaggaaggcgggaccgaguccagcgaaucuggauccagccugcaaccucugucugccgacuccacgccggaugugaaucagagccccagaggcaaacggcgcgccaaggcugggucuagaucccggaacagcacccucacaucccuguguguucuuucucauuacccuuucuuuagcaccuuccgcgagugccuguauacacucaaaagacugguggacuguugcuccgagcggcuucugggaaagaaacucggcauucccagagggguccagcgcgauaccauguggcggaucuuuacgggaagccugcugguggaagagaagucuuccgcccuccugcacgaccuuagagaaauugaggcuuggaucuaccgccugcuccggagcccugugcccgucucuggccagaagagaguugauaucgaagugcugccgcaagagcuucagccugcccugacauucgcgcuccccgacccuagccgcuuuacccugguggacuucccccugcaucucccccuggagcuucugggcgucgaugccugucuccaggugcugacaugcauucuucuggaacacaaaguugugcuccagucccgggacuauaaugcucugucuaugagcgucauggccuucguggcuaugaucuacccucuggaguacauguuuccgguuauuccccuccugccuaccuguauggccuccgcggaacaacuucugcucgcccccaccccuuauaucauuggggugcccgcuagcuucuuucuguacaagcuggauuucaaaaugccggacgaugucuggcuuguggaccucgauucuaacagagucaucgccccuacaaaugcugaggugcugcccauucugccugaacccgagucccucgagcugaagaaacaccuuaagcaggcccuggccagcaugucucucaacacgcagccuauccugaaucuggaaaaauuucaugagggacaagaaaucccccuucuccugggccgcccguccaacgaccugcagagcaccccuuccacagaguucaauccccucauuuaugggaacgauguugacucuguggaugucgcuacccggguggcgaugguuagauuuuucaauagcgccaacgugcugcagggauuucagaugcacacacgcacccuucggcuguuccccagaccugucguggcuuuucaagccggcuccuuccucgccucucggccgcgccagacgcccuuugcugaaaagcuggccagaacacaggcgguggaguacuucggggaguggauccugaauccuaccaacuaugcuuuccagcggauucauaauaacauguuugaccccgcccuuaucggagacaagccuaaaugguacgcccaccaacuccagcccauucacuauagaguuuacgauagcaacucccagcuggcugaagcccugagcgucccucccgagcgcgacucugauuccgaaccgaccgacgauagcggcucugacuccauggauuacgacgauagcucuagcuccuauagcucucucggcgacuucguguccgagaugaugaagugcgauaucaauggggacacaccuaacguggauccccugacccaugcugcccuuggagacgcgagcgaggucgaaaucgacgagcugcagaaucaaaaagaagccgaggaaccuggccccgauuccgagaacucucaggagaauccgccucuccggagcuccucuagcacaacggcuuccucuagccccuccaccgugauucacggggccaacagcgaaccugcugacucuacagagauggaugacaaggccgcgguuggaguguccaaaccccugcccagcgucccuccgucuaucggcaaguccaauguggauagacgccaggccgaaauuggggagggcagcguuagacggcgcaucuacgacaaccccuauuuugaaccucaguacggauucccgccugaggaggaugaagacgagcaaggcgaaucuuauacccccagauuuucccagcaugugagcgggaaucgggcucagaagcugcuucgcccuaacucccucagacuggccagcgauucugacgcugagagcgauucccgggccucuagccccaauuccacagucucuaacaccagcacggaaggauucggcgggauuauguccuuugccucuagccuguaccgcaaucacuccaccagcuucucucucuccaaccugacacuucccaccaaaggagcuagagagaaggcgacaccuuuucccagccugaaaguguucggccucaauacccugauggagaucguuacggaagccgggccuggcucuggagagggcaaccggcgcgcucugguggaccaaaaguccagcgucaucaaacauucccccacagugaagagagaaccgccuucuccccaggggcggagcuccaacagcucugagaaucagcaguuucuuaaggaggugguccacuccguucuggauggacaaggcgugggguggcucaacaugaaaaaggugagacgccugcucgaaagcgagcagcugcgggucuucgugcuuucuaaacugaauagaaugguucagagcgaagacgacgcccgccaggauauuauccccgacguggagauuucccggaaggucuauaaaggaaugcucgaucugcugaagugcaccgugcuuucucuggaacaaagcuacgcccacgcuggccucgggggcauggccuccaucuuuggacugcucgagauugcgcagacacauuacuauucuaaggagccugacaaaagaaagcgcagccccaccgaauccguuaacaccccugugggcaaagauccggggcuggcuggacggggcgaccccaaggccauggcccagcuuagagucccucagcuggggccccgcgcuccuagcgccacaggaaaaggccccaaggagcucgauacgcggucucugaaagaagagaauuucaucgcguccauugaacuguggaacaagcaccaagaggugaagaaacagaaggcucuugagaaacagagaccggaaguuaucaagccuguguucgaccugggggagaccgaagagaaaaagagccaaaucuccgccgauucuggcgucagccucacauccucuagccagcggaccgaccaggauuccgugauuggagugagccccgccgucaugaucagaucuuccagccaggacucugaaguuuccacaguggugagcaauucuagcggcgagacccugggggcugacuccgaucucucuagcaacgccggagacggcccugggggagagggcuccguccaucuggcuagcuccagaggcacgcuuucugauagcgaaauugagacaaauuccgccaccucuaccaucuuugggaaggcgcacagccugaaacccuccauuaaggaaaaacuggccggaucuccuauccggacaagcgaggacgugucccaacgcguuuaccucuaugagggccugcuugggagagauaagggaagcaugugggaccagcuggaagaugcugccauggagaccuucucuaucuccaaagaacggagcacacucugggaccagaugcaguuuugggaggaugcuuuccuggacgccgugaugcucgaaagagagggcauggggauggaucaaggaccccaggagaugauugaccgcuaccugucucuuggcgaacacgaucggaagagacuggaggacgacgaagaucgccugcucgccacgcugcuucauaaccugaucuccuauaugcuccugaugaaggucaauaaaaacgacauucggaagaaagugagacgccucaugggcaagagccacaucgggcugguuuacucucagcagauuaaugaggugcuugaucaacuggcuaaccugaauggacgggaccucuccaucuggagcuccggcagcagacauaugaaaaagcagaccuuugucgugcacgcggggacagauaccaacggagacaucuucuuuauggaagucugugaugacugcgugguucugcgcucuaacauuggcacaguguaugagagauggugguacgagaagcugaucaauaugaccuacuguccgaaaacgaagguccugugccucuggcggcgcaacgggagcgaaacccagcugaauaaauucuauacaaagaaauguagagagcucuacuauugcgugaaggauuccauggaacgggccgcugcccgccagcaaucuauuaaaccuggacccgagcugggcggcgaauuucccguucaggaccuuaagaccggggagggaggccugcuucaggugacacucgaggggaucaaccugaaguucaugcauaaucaauuucuuaaacugaagaaaugguga

SEQ ID NO: 71752 - RNA, 1191 nt, Artificial Sequence
  derived and/or modified sequence opt5 from MAEA__Homo_sapiens__NP_001017405
auggccgugcaggagagcgcugcccaacuguccaugacccucaagguccaggaauaccccacacugaaaguuccuuaugagacgcuuaacaagagauuccgggcggcucagaaaaauaucgaccgcgaaaccucucacgugacaaugguggucgccgagcuggaaaagacccucagcggcugcccggccguggauuccguugugucucugcuugacggggucguggagaaacugagcguucucaagagaaaggcuguggaguccauucaggccgaagaugagucugcuaaacuguguaagcggcgcaucgaacaucugaaagagcacagcuccgaccaacccgccgcggccagcgucuggaagagaaaacggauggaucgcaugaugguggagcaucuccugagaugcggauacuauaacacagcugugaaacuugcccggcagucuggcauugaagaccuggucaauaucgagauguuucucaccgcuaaggaaguugaggaaucccuggagcgcagagagacagccaccugucuugcguggugccacgauaacaagagccggcugcgcaagaugaaaucuugucucgaguucucccugcggauucaggaauuuaucgaacugaucagacagaauaagcgccucgacgccgugagacaugcucggaaacacuucagccaagccgaggggucucagcuggaugaagugagacaggcuaugggaaugcuugccuuuccucccgacacgcacauuuccccuuacaaggaucugcucgaccccgcccgcuggcggaugcugauccagcaauucagauaugauaacuaccgccuucaucagcugggcaauaacagcgucuuuacccucacacugcaggcugggcuguccgcgauuaaaaccccucaaugcuauaaggaggacggaucuagcaaguccccggacugucccgugugcagccggucucucaauaaacuggcccagccucuucccauggcucacugugccaacuccagacugguuugcaagaucagcggcgaugugaugaaugagaacaauccucccaugaugcucccgaacggcuacgucuacggguauaauucucugcuuagcauucgccaggacgauaaagugguuuguccucggacaaaggaaguguuccauuuuucccaggccgagaaagucuacaucauguga

SEQ ID NO: 71753 - RNA, 1212 nt, Artificial Sequence
  derived and/or modified sequence opt5 from MAEL__Homo_sapiens__NP_001273306
augcccaacagaaaggccagccggaaugcuuacuauuucuuugugcaggagaaaaucccugaacugcgcagacggggccucccggucgcccgcguugcggacgcuauucccuacugcuccucugauugggccaagccuguguucacaccccugagacggccugggaugcuugugcccaaacaaaacgucagcccuccggacauguccgcccugucucucaagggagaucaggcucugcuuggcgggaucuuuuauuuccugaauauuuuuagccacggagagcugcccccucauugugaacagcgcuuccuccccugcgagaucggcugugugaaauacucccugcaggaagggauuauggccgacuuucacucuuucaucaacccuggagagauccccagaggcuuucgguuccauugccaagcugccagcgauuccagccacaagauuccgaucucuaauuuugagcgcggccauaaccaggcgaccguucuccagaaucuguauagauucauucacccuaaccccgggaauuggccucccaucuacuguaaguccgacgaucggacgcgcgugaacuggugccuuaaacacauggccaaggcuagcgaaauuagacaggaccugcaacuccugaccgucgaggaucuugugguuggaaucuaucagcagaaauuucugaaggaacccucuaaaacauggauucggucccuccuggacguggccaugugggauuacagcucuaauacccgcuguaaguggcaugaggagaacgacauccuguucugcgcucucgccgucuguaagaaaaucgcguacugcauuuccaauagccuggccacacuuuucggcauccagcugaccgaagcucacgugccucuccaagauuaugaggccuccaacucugugacaccgaagauggucguucuggacgcugggagauaccagaaacuucgggugggaagcuccggcuuuagccauuucaauucuuccaacgaggaacagagaagcaacacccccauuggggacuauccuucucgcgccaagaucagcggacaaaauuccucugugcggggcagaggcauuacgcgccugcucgaaagcaucuccaacucuagcuccaauauccacaaauuuagcaacugugauaccucucugucccccuacaugagccagaaggacggguauaaauccuucucuagccuguccuga

SEQ ID NO: 71754 - RNA, 771 nt, Artificial Sequence
  derived and/or modified sequence opt5 from MAF1__Homo_sapiens__NP_115648
augaagcugcucgagaacagcuccuucgaagccaucaauucucagcugaccguggagacaggcgacgcucacauuaucgggagaauugaaagcuacuccugcaaaauggccggagaugacaagcauauguuuaaacaauucugucaggagggccagccccacguccuugaagcgcugucuccuccgcagacgagcgggcucucccccucucggcugagcaagucccaaggaggcgaggaggaagggccucuuagcgauaaaugcucucgcaagacccuguuuuaucucaucgcuacacugaacgaguccuucagacccgacuacgauuuuagcaccgcccggucucaugaauuuucccgcgagccuagccugucuuggguugugaaugccgugaacuguucccucuuuagcgcugucagagaggacuucaaggaucugaaaccccagcuuuggaaugccguggacgaagagauuugccuggcugaaugugauaucuauuccuacaacccugaccucgauucugacccguuuggagaggauggcagccugugguccuucaauuauuucuucuacaacaagcggcuuaaacgcaucguguuuuucagcugcagaucuauuuccggcagcacauauacccccucugaagccgggaaugagcuggacauggagcucggagaagaggaaguugaggaagagagccgguccggcgggucuggagcggaggaaacaagcaccauggaggaagaccgcgucccugugaucuguauuuga

SEQ ID NO: 71755 - RNA, 1062 nt, Artificial Sequence
  derived and/or modified sequence opt5 from MAFA__Homo_sapiens__NP_963883
auggccgcugagcuggccaugggcgcggaacuccccagcuccccucuggcuaucgaguacgugaacgacuucgaucuuaugaaguuugaagucaaaaaggagccgcccgaagccgagagauucugccaccggcugccucccgggucucucagcuccaccccucugucuacacccuguagcuccguuccuucuagcccguccuuuugcgcccccagcccuggaacgggcgggggaggcggggcuggaggcggcgggggaucuucccaggccggcggggcucccggaccucccagcggcgggccgggagccgugggcggcaccucugggaaaccugcgcuugaggaccuguauuggauguccggauaccaacaucaccucaaucccgaagcccugaaccugacaccugaggaugcuguggaagcccucauuggcagcgggcaucacggagcucaucacggcgcccaccaucccgcggccgcugccgcuuaugaggccuuccgcgggcccggauuugccggcggcgggggagcugacgauaugggcgcggggcaccaucacggagcccaccaugcugcccaccaucaccaugccgcucaccaccaucaccaucaccaccaucaccauggcggggccggccacggaggcggggcgggacaucacgucagacuggaggaacgguucucugacgaucagcuuguguccaugagcguucgcgagcugaauagacagcuccggggcuuuuccaaggaagaggugauccgccugaaacagaagagacggacccuuaagaaccgcggguacgcucaaucuuguagauucaaacggguccagcagcgccacauucuggaaagcgagaagugccagcuccaaucccagguggagcagcugaaacuggaaguuggaagacucgccaaggagcgggaccuguauaaagaaaaguacgagaaacuugccggccgcgggggcccuggaagcgcuggcggggccggauuuccgagagaacccucuccuccccaggcuggcccugggggagccaagggcacagcggauuucuuucuguga

SEQ ID NO: 71756 - RNA, 972 nt, Artificial Sequence
  derived and/or modified sequence opt5 from MAFB__Homo_sapiens__NP_005452
auggccgcugagcugagcaugggccccgaacucccuaccuccccgcuggccauggaguacgugaacgacuucgaucuucugaaguuugacgucaaaaaggaaccccucgggagagcggagcggccuggacgccccugcacaagacugcagccugcuggcucuguuagcuccacgccccuuucuaccccuuguagcuccgugccgucuagccccuccuucagcccuacagaacaaaagacccaccuggaggaucucuauuggauggccucuaauuaccagcagaugaaccccgaggcccugaaucugacaccugaagacgcuguggaggcccucaucgggucccaucccgucccgcagccucugcagagcuuugauucuuuccggggagcucaccaucaccaucaccaccaucacccccauccucaccacgccuaucccggcgcggggguggcccaugacgaacuuggaccccacgcucauccucaccaucaccaccaucaccaagccuccccgcccccuagcucugcugccucccccgcgcagcagcugccuaccagccaucccggcccgggcccucacgccacagcuuccgccaccgcugccgggggaaacggcucuguugaggaucgcuuuagcgacgaucaacucguguccaugagcgucagagagcugaaucggcaccuucgcggguucacgaaggacgaagugauuagacugaaacagaagcggcgcacccucaagaacagaggauacgcccagucuugccgguauaaacgcguucagcaaaagcaucaccuggagaaugagaaaacacagcugauccagcaaguggaacagcucaagcaggaagucuccagacuggcucgggagcgcgaugcguacaaagugaagugugagaaacuugccaacagcggcuuuagagaagcugggucuaccagcgacucccccucuagcccugaguucuuucuguga

SEQ ID NO: 71757 - RNA, 495 nt, Artificial Sequence
  derived and/or modified sequence opt5 from MAFF__Homo_sapiens__NP_001155045
augagcguggacccccuguccucuaaggcccucaaaaucaagagagagcugagcgaaaacaccccucaccuuuccgaugaggcucugaugggccucucuguccgggaacugaaucgccaucuuagagggcugagcgccgaggaaguuacacggcucaaacagcgcagacggacgcugaagaaccgcggauacgcggcuuccugcagagugaaacgggugugucaaaaggaggagcugcagaagcagaaaucugaacucgagcgcgaagucgacaagcuggccagagagaaugccgcuaugcggcuugagcuggaugcccuccgcggcaaaugcgaagcucugcagggguucgccagaagcguggcggccgcucggggaccggccacccuuguugcucccgccuccgugauuacaaucgucaagagcaccccuggcucuggguccggacccgcgcacggcccugaccccgcccauggcccugcuagcuguucuuga

SEQ ID NO: 71758 - RNA, 489 nt, Artificial Sequence
  derived and/or modified sequence opt5 from MAFG__Homo_sapiens__XP_011521881
augaccacacccaacaagggcaauaaagcccugaaggugaaaagagagccuggggaaaacggaacgagccucaccgacgaggaacuggucacaauguccguucgggagcuuaaucagcaccuucgcggccucucuaaggaagagaucgugcaacugaaacagagacggcgcacccuuaagaacagaggguacgcugccagcugccgggugaagcgcgucacacagaaagaggaacuggagaagcagaaagcggaacuccaacaggagguggagaagcuggcuuccgaaaaugccucuaugaaacuggagcucgaugcccugagaagcaaguaugaagcucugcagaccuucgcccggacaguugcucgcuccccgguggcccccgcgagaggaccucuggccgcuggccucgggccccuggucccuggaaagguggccgcuaccucuguuauuacgaucgugaaaagcaagaccgacgcccgguccuga

SEQ ID NO: 71759 - RNA, 1122 nt, Artificial Sequence
  derived and/or modified sequence opt5 from MAF__Homo_sapiens__NP_001026974
auggccagcgagcuggcuauguccaacucugaccuccccaccagcccucuggccauggaauacgugaaugauuucgaccuuaugaaguuugaggucaagaaggaaccgguugagacagauagaaucauuucccagugcggccggcugaucgcugggggaucucucagcuccacgcccaugucuaccccuuguagcuccgugcccccuagccccucuuucuccgcgccuagcccgggcucuggguccgaacaaaaagcccaccuggaggacuauuacuggaugacaggauauccccagcagcuuaacccugaggcccugggcuuuagccccgaagaugcuguggaggcccucauuucuaauucccaucagcugcaagggggauucgacggcuacgcucgcggcgcccagcagcuggcggccgcugccggggcuggagccggcgcgagccucgggggauccggcgaagagauggggccugccgcugccgucgugucugcuguuaucgccgccgcugcggcccagagcggagcuggcccccacuaucaucaccaucaccaccaugccgccggccaccaucaccacccgaccgcuggggccccuggagcggcuggcuccgccgccgcuagcgccgggggagcuggcggggccggaggcggcgggcccgcgucugccggaggcgggggaggcgggggcggaggcgggggaggcgggggagcugccggcgcugggggcgcccugcauccucaccaugcggccggaggccuucacuuugaugacagauucuccgaugagcaacuggugacaaugagcguccgggaacucaaccgccagcugagaggggugucuaaggaggaaguuauucggcuuaaacagaagcgcagaacccugaagaaucggggauacgcucagagcugccgcuuuaaaagagugcaacagcggcauguccucgaguccgaaaagaaccagcugcugcaacagguggaccaccucaaacaggagaucucucgccuggugagagagcgggaugccuauaaggaaaaauacgagaaacuugucagcuccggcuuccgcgaaaaugggucuagcuccgacaaccccagcucucccgaguuuuucauguga

SEQ ID NO: 71760 - RNA, 471 nt, Artificial Sequence
  derived and/or modified sequence opt5 from MAFK__Homo_sapiens__XP_006715836
augaccacaaaccccaagccuaauaaagcccugaaggugaaaaaggaggcuggcgaaaacgccccgguccucagcgacgaugagcugguuuccaugucugugagagaacuuaaucagcaccuucgggggcucacgaaagaggaagugacccgccugaagcaaagacggcgcacacuuaagaacagaggauacgcggcuagcugccggaucaaacgcgucacccagaaggaggagcuggaaagacagcggguggagcuccagcaagaaguugagaaacuggcccgcgagaauagcucuaugagacuggaacucgacgcccugcggagcaaguaugaggcucugcagacauucgcccgcaccguggcuagaggccccgucgccccuuccaaaguggcgacaaccucuguuauuacgaucgugaaguccaccgaacuguccagcacaucuguccccuuuuccgccgcuagcuga

SEQ ID NO: 71761 - RNA, 1110 nt, Artificial Sequence
  derived and/or modified sequence opt5 from MAGEA10__Homo_sapiens__NP_001011543
augcccagagccccuaagcggcagcgcugcaugccggaggaagaccugcaaagccaguccgagacccagggccucgaaggggcucaggcgccccuggccguggaggaagaugcuucuagcuccacaucuacgagcuccucuuucccuagcuccuuucccagcagcuccagcagcuccucuucuuccuguuacccucuuauccccagcaccccugaggaggucuccgccgacgaugaaacaccgaaucccccucaaucugcccagauugcuugcagcucccccagcguuguggccucucugccucucgaccaguccgaugagggaagcucuagccagaaagaagagucccccucuacccugcaagugcuuccggacagcgagucccugccuagaagcgaaaucgaugagaaggucacagaccucgugcaguuccugcuguuuaaauaucagaugaaggaacccauuaccaaagcugagauccucgaaucuguuauucggaacuacgaggaucacuucccucugcuuuuuagcgaggccagcgaauguaugcugcucguguucggcaucgacgucaaggagguggaucccacagggcauucuuuuguucuggugaccucccuuggacugacguaugacggcaugcucagcgauguccaguccaugcccaagaccgggauccugauucugauccucucuauuaucuucauugaaggauacugcacaccugaggaagugaucugggaggcgcugaacaugaugggccuuuaugacggcauggagcaccugauuuacggggaaccgcgcaaacuccugacccaagacugggugcaggagaauuaucuugaauacagacagguccccggaagcgauccugcccgguacgaguuucuguggggcccccgcgcucaugccgaaaucagaaagaugucccuccugaaauuccuggcuaagguuaacgggucugacccucggagcuuuccccucugguaugaggaggcccugaaagaugaagaggaacgcgcgcaagacagaaucgccacaaccgaugacacgacagcuauggccuccgcuucuucuuccgccaccggauccuucucuuacccggaguga

SEQ ID NO: 71762 - RNA, 1203 nt, Artificial Sequence
  derived and/or modified sequence opt5 from MAGEA11__Homo_sapiens__NP_001011544
augagcaagguguccaccauguucucugaggacgauuuucagagcacagaaagagcccccuacggcccucaacugcaguggucccaggaccucccgcggguccagguuuuccgcgagcaagcuaaccuggaagauagaucuccccggcgcacgcagagaaucaccgggggagaacaggugcuuuggggcccuauuacacagaucuuucccaccgugcggccugccgaccugacacgcgucauuaugccccucgaacaaagaagccagcacugcaaaccugaggaggggcugcaggcgcaggaagaggaucuuggacuggugggcgcucaagcccuccaggccgaggagcaggaggcugccuucuuuuccucuacccugaauguugggacacuggaggaacucccggcugccgaaagccccuccccuccccaaagcccucaggaggaaucuuucucccccaccgcgauggacgccaucuuuggaagccugucugaugagggcuccggcagccaggagaaggaagggccgucuacguccccugaccuuauugaucccgagagcuucucccaggacauccugcaugauaaaaucauugaccucgugcaucugcuucugcggaaguaucgcgucaaaggacucaucaccaaggcugaaaugcugggcucugugauuaagaacuacgaggauuauuuuccugaaaucuucagagaggccagcguuuguaugcaacugcucuuugggauugacgugaaagaggucgaccccacaucccacagcuacgugcuggugaccucucuuaaucuguccuaugauggaauccagugcaacgaacagagcaugcccaagucuggccuccugauuaucguccuugggguuaucuucauggagggaaauuguauuccugaagaggugaugugggaagugcugagcaucaugggcgucuacgcuggccgggagcacuuucucuucggggagccgaaacgccugcugacacagaacugggugcaagaaaaguaucucguuuacagacaggugcccggaaccgacccugccugcuacgaguuccuguggggcccccgggcgcaugccgaaacguccaaaaugaagguccuugaguauauugcuaaugccaacgggcgcgauccuacaucuuaccccagccuguaugaggacgcucucagagaagagggagaaggcguguga

SEQ ID NO: 71763 - RNA, 945 nt, Artificial Sequence
  derived and/or modified sequence opt5 from MAGEA12__Homo_sapiens__NP_001159858
augccccuggagcagagaagccaacacugcaagccugaagagggccucgaagcccagggggaggcucugggacuugugggcgcccaggcgccggcuaccgaagaacaggagacagccuccucuagcuccacgcuggucgaaguuacccuccgggaggugcccgccgcugaaucuccuagcccuccccauucuccccaaggggccuccacacugccuaccacaaucaacuacacccuuuggagccaguccgacgagggaagcucuaaugaggaacaggagggcccguccacauuccccgaucuggaaaccagcuuucagguggcucucucucgcaaaauggccgagcugguccacuuccugcuccugaaguacagagcgcgggaaccuuuuacgaaagccgagaugcuuggguccgugauucgcaacuuccaagacuuuuuccccguuaucuuuagcaaggcuucugaguaccugcagcucguguucggaauugaagucguggagguugugagaaucggccaucuguauauucuugucaccugucugggccucuccuacgaugggcugcugggagacaaucagaucgugccuaaaacaggccuccugaucauugugcuugccaucauugcuaaggaaggggauugcgcccccgaggaaaagaucugggaggagcugagcguccucgaagcguccgacggacgggaggauucuguuuuugcccacccgcgcaaacugcuuacccaggaccuggugcaagaaaacuaucucgaguacagacaggugccuggcagcgaucccgcuuguuaugaguuccugugggggccucgggcccuggucgagacauccuacgugaagguucuccaucaucugcuuaaaauuagcggaggcccccacaucucuuaucccccucugcacgagugggcuuuucgcgaaggcgaggaauga

SEQ ID NO: 71764 - RNA, 930 nt, Artificial Sequence
  derived and/or modified sequence opt5 from MAGEA1__Homo_sapiens__NP_004979
augagccuggagcagagaucccuccacugcaagcccgaagaggcccuggaagcucaacaggaggcccuuggccugguguguguccaggcggcuaccucuagcuccucuccucucguucuggggacacuugaagaggugccgacggccggaagcaccgaucccccucagucuccccaaggcgccuccgcuuucccuacaaccaucaacuuuacacggcagcgccagcccagcgagggguccagcucuagagaagaggaaggaccuuccaccagcugcauucuggagucucucuuccgggccgugaucaccaaaaaggucgcugaccuggugggcuuucugcuccugaaauaccgcgccagagagccgguuacaaaggcggaaaugcuugaguccgugauuaaaaauuauaagcauuguuuccccgaaaucuuugggaaggccagcgagucucugcagcucgucuucggaauugacgugaaagaagcugauccuacgggccacuccuacguucuggugaccugccuuggccugagcuaugacgggcuccugggagauaaccaaaucaugcccaagacaggcuuucugaucauuguccucgugaugaucgccauggaagggggacaugcuccugaggaagagauuugggaggagcuguccgugauggaagucuacgacggccgggagcacucugccuauggggagccccgcaaacuucugacccaggaucucguucaggaaaaguaccuggaguauagacaggugccggacagcgauccugcgcgguacgaguuccuuuggggaccccgcgcccuggcugaaacauccuacgugaaaguccucgaauaugugaucaagguuagcgccagagugcgguuuuucuuuccuucucugcgcgaggcugcccugagagaggaagaggaaggcgucuga

SEQ ID NO: 71765 - RNA, 945 nt, Artificial Sequence
  derived and/or modified sequence opt5 from MAGEA2B__Homo_sapiens__NP_705692
augccccuggagcagagaagccaacacugcaagccugaagagggccucgaagcccggggcgaggcucugggacuugugggcgcccaggcgccggcuaccgaggaacagcagacagccuccucuagcuccacgcuggucgagguuacccucggggaagugcccgccgcugacucuccuagcccuccccauucuccccaaggagccuccagcuucuccacaaccaucaacuacacacuguggcgccagagcgaugaggggucuuccaaucaggaagaggaggggccuagaauguuuccggaccuugaaagcgaguuccaggcugccauuucucggaaaaugguggaacugguccacuuucuccugcugaaguaccgcgcgagagagcccgugaccaaagccgaaaugcucgaguccguucugcggaacugucaagauuucuuuccugugaucuucagcaaggcuucugaguaccuucagcuggucuuuggaauugaagugguugaggugguccccaucucccaucucuauauucuggugacaugccuuggccugagcuacgacggccuccugggggauaaucaggugaugccuaaaaccggacugcucaucaucguccuggccauuaucgcuauugaaggcgacugugcccccgaggaaaagaucugggaggagcuuuccaugcuggaaguuuucgaggggcgcgaagauucuguguuugcgcacccgagaaagcuccugaugcaggaccuugugcaagagaacuaucuggaauaccggcaggucccuggaagcgaucccgccugcuaugaguuccucuggggcccucgcgcucugauugagacguccuacgugaaaguucugcaucacacccucaagaucgggggagaaccccacauuagcuaucccccucugcaugagagagcccuucgggaaggcgaggaguga

SEQ ID NO: 71766 - RNA, 945 nt, Artificial Sequence
  derived and/or modified sequence opt5 from MAGEA3__Homo_sapiens__NP_005353
augccccuggagcagagaagccaacacugcaagccugaagagggccucgaagcccgcggggaggcucugggacuugugggcgcccaggcgccggcuaccgaggaacaggaggccgccuccucuagcuccacacuggucgaaguuacgcucggggaggugcccgcugccgaaucuccugaucccccucagagcccccaaggagcuuccucucugccuaccacaaugaacuacccgcuuuggagccaguccuaugaggacagcucuaaucaggaggaagagggccccuccaccuucccugaccuggaaagcgaguuucaggccgcgcucucucggaaaguggccgaacugguccauuuccugcuccugaaguacagagcucgggagcccgugacaaaagccgagaugcuuggguccguugugggaaacuggcaauacuuuuucccugucaucuuuagcaaggcuucuuccagccugcagcucguguucggcauugaacugauggagguugaucccaucggccaccuuuauauuuuugccaccugucuggggcucuccuaugacggacugcugggcgauaaucagaucaugccgaaagcggggcuccugauuaucgugcuugccaucauugcucgcgaaggagacugcgccccugaggaaaagaucugggaggagcugucuguccucgaaguguucgagggcagagaagauagcauucugggggaccccaagaaacuucugacacagcauuuugugcaagagaacuaccucgaauaucggcaggucccuggauccgaucccgcuuguuacgaguuccuguggggcccccgcgcccugguugagaccagcuacgugaaggugcuccaccauauggucaaaaucucuggcgggccucacauuuccuauccgccccugcacgaaugggugcuuagagagggagaagaguga

SEQ ID NO: 71767 - RNA, 954 nt, Artificial Sequence
  derived and/or modified sequence opt5 from MAGEA4__Homo_sapiens__NP_001011549
augagcuccgagcagaagucucaacacugcaaacccgaagagggcguggaagcccaggaggaagcucuggggcucgucggagcccaggcgccuaccacagaggagcaggaagcugccguuagcuccucuagcccgcuggugcccggcacgcuugaggaagugccugccgcugaguccgccgggcccccucaaucuccccagggagcuagcgcccugccuaccacaaucuccuucaccuguuggagacagccgaacgagggcucuagcucccaggaagaggaagggcccagcacaucuccugacgcggagucccucuuucgggaagcccugagcaauaaggucgaugagcuugcucauuuccugcuccgcaaauacagagccaaggagcuggugaccaaagcugaaaugcuggagcggguuauuaagaacuauaagcgcugcuuucccgugaucuucggaaaagccucugaaucccucaagaugauuuuuggcaucgacgucaaagagguggauccugcgagcaauacauacacccugguuacgugucuuggccuguccuaugacgggcuccugggaaacaaucaaauuuuccccaagaccggccuucugaucaucgugcucgggacaauugccauggaaggagauucugcuagcgaggaggaaaucugggaggaacugggcgucauggggguguacgacggaagagagcacaccguguauggcgaaccgcggaaacugcucacacaggauuggguccaggagaacuaccuggaguaucgccagguuccuggcuccaaucccgccagauacgaauuucuuugggggccucgggcucuggccgagaccagcuacgugaaggugcucgaacaugucgugcgcguuaacgccagagugcggauugcuuaucccucucugcgcgaggcggcccuucuggaggaagaggaaggagucuga

SEQ ID NO: 71768 - RNA, 945 nt, Artificial Sequence
  derived and/or modified sequence opt5 from MAGEA6__Homo_sapiens__NP_005354
augccccuggagcagagaagccaacacugcaagccugaagagggccucgaagcccgcggggaggcucugggacuugugggcgcccaggcgccggcuaccgaagaacaggaggccgccuccucuagcuccacacuggucgaaguuacgcucggggaggugcccgcugccgaaucuccugaucccccucagagcccccaaggagcuuccucucugccuaccacaaugaacuacccgcuuuggagccaguccuaugaggacagcucuaaucaggaggaagagggccccuccaccuucccugaccuggaaagcgaguuucaggccgcgcucucucggaaaguggccaagcugguccauuuccugcuccugaaauacagagcucgggaacccgugacaaaggccgagaugcuuggguccguugugggaaacuggcaauauuucuucccugucaucuuuagcaaggcuucugauucccugcagcucguguucggcauugagcugauggaaguugaccccaucggccacguguacauuuuugccaccugucuugggcugagcuaugauggacuccugggcgacaaucagaucaugccgaaaacaggguuccugauuaucauccucgcgauuaucgccaaggagggagauugcgcuccugaagagaaaauuugggaggagcuguccguccuugagguguuugaaggccgcgaggacucuaucuucggggaucccaagaaacugcucacccaguacuuugugcaagaaaacuaucuggaguacagacaggucccuggaagcgaccccgccuguuacgaauuucuuuggggcccccgggcucugauugagacguccuauguuaaggugcuccaucacauggugaaaaucagcggcgggccucgcauuucuuacccgcugcugcaugagugggcccucagagaaggagaggaauga

SEQ ID NO: 71769 - RNA, 948 nt, Artificial Sequence
  derived and/or modified sequence opt5 from MAGEA9__Homo_sapiens__NP_005356
augagccuggagcagagaagcccccacugcaagccugacgaagaucucgaggcccaaggcgaagaccuggggcuuaugggagcucaggagccgaccggcgaagaggaggaaacaacgucuagcuccgauucuaaagaggaagaggugagcgccgcgggguccucuagcccuccccagucuccccagggaggcgcuuccuccuccaucagcgucuacuauacccuguggucucaauucgacgagggguccagcucucaggaagaggaggaaccuuccagcuccguugaucccgcccagcucgaauuuauguuccaggaggcccugaaacuuaagguggcugagcuggugcauuuucuccugcacaaguaccgggucaaagaaccugugacaaaggccgagaugcuggaaucuguuauuaagaacuauaaacgcuacuucccggugaucuuuggaaaggcuagcgaguucaugcaagucauuuuuggcaccgacgugaaagaaguugaucccgccggccauuccuauauccucgugacagcgcuggggcuuagcugugacucuaugcugggagauggccacuccaugccuaaggccgcucuccugauuaucguccuuggggugauccugaccaaagacaauugcgcccccgaggaggugauuugggaagcucucagcgucaugggaguuuacgugggcaaggagcauauguucuauggggaaccuagaaagcugcugacacaggauugggugcaggagaacuaccucgaauaccggcagguccccggaucugacccggcccacuaugaguuucuguggggcagcaaagcgcacgccgagaccuccuacgaaaaggugaucaauuaucuuguuaugcugaacgcucgcgagccuauuuguuaccccucucucuaugaagaggugcugggcgaggaacaagagggggucuga

SEQ ID NO: 71770 - RNA, 1011 nt, Artificial Sequence
  derived and/or modified sequence opt5 from MAGEB17__Homo_sapiens__NP_001264236
augcccagaggccaggccagcaagcggcgcgcuagagagaaacggcgccaagccagaggggaagaccagugccugggaggcgcgcaggcuaccgccgccgagaaggaaaaacucccuuccucuagcuccccggcuugucagucucccccucagagcuuccccaacgccgggaucccucaagagucccagcgggcuucuuaccccagcuccccugccagcgcggugucucugacauccagcgaugaaggagccaagggccagaaaggggagucuccgaauagcuuucacggacccuccucuuccgagagcacgggccgcgaccuucugaacaccaagacaggcgaacucguccaauuccugcuuaauaaguauauuagaaaagagccuaucacccgggaagcuaugcugaagguuauuaaccgcaaauacaagcagcauuuucccgagauccucagacgguccacagagaauguggaaguggucuucgggcuguaucugaaagagauggauccuucucgccagagcuacgugcucguuggaaagcuggacuuucccaaccagggcucccuuagcgaugggggaggcuucccgcugucugggcuccugauggugcuucuguccaccauuuuuaugcacggaaauagagccacagaagaggaaaugugggagugccucaacgcucugggcauguauaagggccggaaacauuucaucuacggggagccucaagaacuggucaccaaggaccucgugcgcgagggauaucuggaauaccagcagguucccagcucugauccucccagauacgaguuucuuuggggcccccgggccagagcggaaacgagcaaaaugaaggugcuggaguucgucgccaaacucaaugacaccguggcuuccacauauaagucucgcuacgaggaagcccugcgggaggaagaggaacaagcuagagcccgcgccguggcucgggauagcgcgagagcccgcgcuucccggagcuuucagccuuga

SEQ ID NO: 71771 - RNA, 1044 nt, Artificial Sequence
  derived and/or modified sequence opt5 from MAGEB1__Homo_sapiens__NP_803134
augcccagaggccaaaagagcaaacugcgggcccgcgagaagagacggaaagcucgcgaagagacccaggggcucaagguggcccacgcgacagcugccgaaaaagaggaaugcccuuccucuagcccgguccugggagacacgcccaccuccucuccugccgcuggcaucccccagaagccucagggggcucccccuacaaccacagccgccgcggccguuagcuguaccgaguccgaugagggagcuaagugccagggcgaagagaacgccucuuucagccaagcuacaaccuccacggaaagcucugugaaagacccgguggccugggaggcggggaugcuuaugcauuuuauucugagaaaguacaaaaugcgggagcccaucaugaaggccgauaugcucaaagucguggacgaaaaguauaaggaucacuucaccgagauucugaauggagcuucccgcagacuugaacugguuuuuggccucgaccugaaagaggauaacccuagcggccauacauacacccuggugucuaagcucaaucugacaaacgacgggaaucuuuccaacgauugggacuucccccggaauggacugcucaugccucugcuuggcgucaucuuucugaaagggaacagcgccaccgaagaggagauuuggaaguucaugaaugugcucggagcuuaugauggcgaggaacaccugaucuacggggaaccccgcaaauuuaucacgcaggaccugguucaggagaaguaucucaaauacgaacaggugccgaacucugauccucccagauaucaauuccuguggggaccucgggccuacgccgagacaaccaagaugaagguccuugaguuucuggcuaaaaugaauggcgcgacaccccgcgacuuccccucccauuacgaagaggcccucagagacgaagaggaacgggcucaggugcgcagcuccgugagagcccggagacgcaccaccgccacaacguuucgggcuagaucucgcgccccuuucagccgguccagccacccgauguga

SEQ ID NO: 71772 - RNA, 960 nt, Artificial Sequence
  derived and/or modified sequence opt5 from MAGEB2__Homo_sapiens__NP_002355
augcccagaggccaaaagagcaaacugcgggcccgcgagaagagacggaaagcucgcgacgaaaccagagggcucaacgugccucaggucacagaggccgaagaggaagaggcgccgugcuguuccucuagcguuuccggaggcgcugccucuagcucccccgccgcugggaucccucaggagccccagcgggccccuacgaccgcugccgcggccgcugccggagugucuagcacaaaguccaaaaagggcgcuaagagccaccagggggaaaagaaugccucuuccagccaagcgucuaccuccacaaagagccccucugaggauccucugacccgcaaauccggaagccuugugcaguuccugcucuacaaguauaaaauuaagaaguccgucacaaaaggcgaaaugcugaagaucgugggcaaaagauuucgggagcauuucccggagauucuuaagaaagccucugaagggcugagcguuguguuuggacucgagcugaacaaggucaaucccaacggccacaccuacacguucaucgacaaaguggaucugaccgacgaagagucccuccugagcucuugggauuuuccucgcagaaaacuucugaugccccuccuggggguuauuuuccuuaauggaaacuccgcuacagaagaggagaucugggaauuucugaauaugcucggcguguaugacggggaggaacauagcgucuucggagagccuuggaagcugaucaccaaagaucuggugcaggaaaaguaccucgaguauaaacaggugcccucuagcgacccgccucgguuucaauuccuguggggcccccgcgccuacgcugagacauccaagaugaaaguccuugaauuucuggccaagguuaacggcaccacgccuugcgccuuccccacacacuaugaggaagcucucaaggaugaggaaaaagcggggguguga

SEQ ID NO: 71773 - RNA, 1224 nt, Artificial Sequence
  derived and/or modified sequence opt5 from MAGEB6__Homo_sapiens__NP_775794
augcccagaggccacaagagcaaacugcggaccugcgagaagcgccaggaaacaaacgggcaaccucagggacucacgggcccgcaggccaccgcugagaaacaggaagagucccauucuagcuccucuagcuccagagccugucugggggacugccggcgcucuagcgaugcguccaucccccaagaaagccagggagugucuccuacaggcucccccgacgcugucguuagcuacucuaaguccgauguggccgccaaugggcaggacgagaaaagcccuucuaccuccagagaugcuagcgugccccaggagucccaaggagccucuccuacaggcagcccggacgcuggcgucuccgggagcaaguaugauguggccgcgaacggacaggacgaaaagucucccuccaccagccacgauguuucugugccucaggagagccagggcgccucccccacagggucuccugacgcuggagucagcggcuccaaauacgauguggccgcugaaggggaggacgaggaaagcguuucugccucccaaaaggcgauuaucuucaaacggcuuagcaaggaugccgugaaaaagaaggcuuguacccuggcccaguuucuccagaaaaaguucgagaaaaaggaaucuauucugaaagcugacaugcuuaagugcguccgcagagaguauaaacccuacuuuccgcaaauccugaaucggacgucccagcaucucgugguggccuucggagucgaacugaaggagauggacagcuccggcgagucuuauacccugguuagcaagcucggccugccuuccgaagggauucuuucuggagauaacgcccugcccaaaagcggccuccugaugucccuucugguggugaucuuuaugaaugggaacugugcuacagaggaagaggucugggaguuccucggacugcugggcaucuacgacgggauucuccacagcaucuauggagaugcgcgcaagauuaucaccgaagaccuggugcaggauaaauacguuguguacagacaggucugcaauucugacccucccuguuaugaguuucuuuggggcccccgggccuacgcugaaacaaccaagaugcgcgugcugagaguucucgccgauuccagcaacacgucuccuggccuguauccgcaucuuuacgaggacgcccugauugaugaaguggagcgggcucuccgccugagagccuga

SEQ ID NO: 71774 - RNA, 3429 nt, Artificial Sequence
  derived and/or modified sequence opt5 from MAGEC1__Homo_sapiens__NP_005453
augggcgacaaggauaugcccaccgccgggaugccuagccugcuccaguccucuagcgaguccccgcaaucuugccccgaaggagaggacagccaguccccucugcagaucccccagucuagcccugaauccgaugacacacuuuacccccugcaaagcccucagucuagauccgagggcgaagauagcucugacccgcuccagcggcccccugaggggaaagauucccagagcccccugcaaauuccucagucuucccccgagggagacgauacgcagagcccgcuucagaacucccaaucuagcccugaaggcaaggacucccugagcccccucgagaucucucaguccccucccgaaggggaggaugugcagagcccccugcaaaauccugcuucuagcuucuuuuccucugcccugcucagcauuuuccaguccagcccggagucuacccagucccccuuugaaggauucccucagagcguccugcaaauccccguuucugcggcuuccagcuccacacuugugucuauuuuucagagcuccccugagucuacccagagccccuucgaaggcuuuccgcaguccccucugcaaauccccgugagccgcucuuucuccagcacacuccugucuaucuuucaguccagcccugagagaacccagucuacauucgaaggcuuugcccagagcccccuucaaauuccugucucccccuccucuuccagcacccugcucucccuguuccagucuuuuagcgagcggacgcaguccaccuucgagggguucgcccagucuagccugcaaaucccgguguccccuucuuuuagcuccacacucguuagccuguuccagucuucccccgaacgcacccagagcacauuugagggauucccccaaucuccucuucagauuccgguguccuccucuuccagcuccacccugcucagccuguuucagucuagccccgaaagaacgcacuccacauucgagggcuuuccucagucucuucugcaaauccccaugaccagcuccuucucuagcacacuccuguccauuuuucagucuagcccugaauccgcucagagcaccuucgagggguuuccccagucuccucugcaaauccccggauccccgagcuucucuuccacccuccugagccuuuuucaguccucuccugagcggacacauagcacguucgaaggcuucccccaguccccucugcagauucccaugaccagcucuuuuuccagcacacuccugucuauccuucaaagcuccccggagucugcccagagcgcuuucgaaggguuuccucaguccccucugcaaauccccgucucuagcuccuucagcuauacccuccugucucuguuucaguccagccccgagcgcacacacuccaccuucgaaggauuuccccagucuccucuccagauuccggugagcuccucuagcuccagcucuacgcugcuuucccuguuccaaagcucucccgaguguacacaguccaccuuugagggcuucccucagagcccccuccagaucccucaaucucccccugaaggcgagaacacccauagcccgcugcagauuguucccucccugccugaaugggaggacucucuuagcccccacuacuuuccucaguccccgccccagggggaggauagccucuccccucauuauuucccccaaucucccccucagggagaagacagccuguccccucacuacuuuccccagucuccgcagggcgaggacagccuguccccucacuauuucccccaaucucccccucagggggaagauagcaugagcccccucuacuucccgcagagcccucugcaaggagaggaauuucagucuucccuucagagccccgugucuaucugcuccagcucuacaccuuccagccugccccaguccuucccugagagcucucaaagcccgcccgagggcccuguccagagcccccuccauucuccccagagcccuccggaagggaugcacucccagucuccccugcaaagcccugaguccgcccccgaaggagaggacucucugagcccucuucagauuccccaguccccucucgaaggcgaggauagccugucuucccugcauuuuccgcagagcccucccgagugggaagacucucucagcccccugcacuucccucaauuucccccgcagggcgaggauuuccaguccucccuucaaucuccugugagcaucuguuccagcucuaccucccugagccucccccagucuuuucccgaaagcccucaguccccucccgaggggccggcgcagucuccccugcaaagaccugugagcuccuucuuuucuuauacacuggccagccuucuccaguccagccacgaaucuccccaguccccucccgagggaccggcucagagcccucugcaaucccccgucucuagcuucccuuccucuacgagcuccagccugucucaguccagccccguuucuuccuuuccuagcucuaccuccagcucucucagcaaauccagccccgaguccccgcugcagucuccugugaucagcuucuccucuagcacaucccuuucucccuucagcgaagaguccagcucucccguggacgaauacaccuccagcucugauacacugcucgaguccgacagccugaccgauucugagucccugauugaaagcgagccucuuuuuacguacacccucgacgaaaaggucgaugagcuggcccgguuccugcuccugaaauaucaggugaagcaaccgaucacaaaggcugaaaugcuuaccaauguuauuucucgcuacacaggcuauuuucccgugaucuucagaaaagcccgggaguuuauugagauccuguucgggaucucccuccgcgaagucgacccugacgauagcuacguguuuguuaacacccuggaccugacgagcgagggaugccuuuccgaugaacagggcaugucucagaauagacugcucauucugauccucagcauuaucuucauuaaggggacauaugcguccgaggaagugaucugggacguccugucuggcauuggagugcgggccggccgcgagcauuuugcuuucggggagcccagagaacuucugaccaaagucugggugcaggagcacuaccucgaauaucgggagguuccuaacagcucucccccuagauacgaauuucuguggggaccccgcgcccauuccgaggugaucaagcggaaagucguggaguuccuggcuaugcuuaagaauacaguuccgaucaccuuuccuagcuccuacaaggaugcccugaaagacguggaagagagagcccaagcuauuaucgauaccacagacgauagcacggcgaccgaaucugccuccagcucugucaugucccccagcuucuccucugaguga

SEQ ID NO: 71775 - RNA, 1122 nt, Artificial Sequence
  derived and/or modified sequence opt5 from MAGEC2__Homo_sapiens__NP_057333
augcccccugugccgggcguccccuucagaaacguugacaaugauagcccuaccuccguggagcuggaagacuggguggaugcccagcaccccacagacgaggaagaggaagaggcuucuagcgccuccucuacgcucuaccuggucuuuagcccuuccucuuucagcaccuccagcucucuuauccucgggggacccgaggaagaggaagugccuuccggcguuauuccgaaccugacagagagcauccccucuuccccuccccaagggccuccccagggaccgagccagucuccucuguccagcugcuguuccucuuuuagcugguccagcuucucugaggaauccagcucucagaagggcgaggauaccgggacaugccaaggacuucccgacagcgaauccucuuuuaccuauacacuggaugagaaaguggcggaacucgucgaguuccugcugcucaaguacgaggcugaagaaccugugaccgaagccgagaugcugaugauuguuaucaaauauaaggacuacuuucccgugauucuuaaacgggcccgcgaguucauggagcugcucuuuggccuggcucuuaucgaggucggccccgaucauuucuguguguuugccaauacgguggggcugaccgacgaaggaagcgaugacgagggcaugccugaaaacucccuccugaucauuauccugagcgucauuuucaucaaggggaauugcgcuucugaggaaguuauuugggaggugcucaacgccgugggagucuaugcgggcagagagcacuuuguguacggggaaccgcgggagcugcuuacaaagguuugggugcagggacauuaucuggaauaccgcgaggucccccacuccagcccucccuacuaugaguuccucuggggcccuagagcccauucugaauccaucaaaaagaaagugcuggaguuccuugcuaagcugaauaacaccguucccagcuccuuuccgucuugguacaaagaugcccucaaggacguggaggaacggguccaggcuacaauugacaccgccgaugacgcgacggugauggccagcgaaucccugucugucaugagcuccaaugugagcuucucugaguga

SEQ ID NO: 71776 - RNA, 1932 nt, Artificial Sequence
  derived and/or modified sequence opt5 from MAGEC3__Homo_sapiens__NP_619647
augcugcuccccugccacugggugcuggacgccaccuucagcgauggcucccuugggcagugggucaagaacacaugugcuacguacgcccugucuccuguugugcucccgccccaaccucagccccggaaaaaggcgaccgacaaagauuauagcgcuuuucaucugggacaccuuagagaggugcgccuguuccucagaggcgggacauccgaccagcggauggauucucugguccugugcccuaccuacuuuaagcucuggcgcacacugagcggaucccccggccuucagcugucugaccuccauuucgggagccaaccugaaggaaaauuuucccugagacgggccgugagcguuaagcagcgcgaggaaccgcaggauuggccccuuaaugagaagagaacccuguggaaagacucugaucucccuacauggcggcgcggcaccggcuauacgcugucccugcccgccgugagcccugggaagagacucuggggagaaaaagcuggcucucugcccgaguccgagccgcuuuucaccuacacacuggacgaaaaggucgauaaacucgugcaguuucugcuucugaaguaucaagccaaggagccucucacccgggcugaaaugcagaugaacguuaucaauacauacaccggguauuuccccaugauuuuucgcaaagccagagaguucaucgagauucuguuuggaaucagccugacggaaguggacccugaucacuucuacgucuuugugaacacacucgaccugaccugugagggcucucuuuccgacgaacaggggaugccccagaaucggcugcucauucugauccuuagcgugaucuucauuaagggaaacugcgcguccgaggaagucaucugggagguucugaaugccauuggccccuggucugcucucgccggcuucgcugaugugcugagccgccuggcccucugggaguccgaagggccugaggcguuuugugaagagagcggacugagaucugccgaaggcuccgugcuugaccuggcuaacccgcaagggcucgccggacaucggcaggaggauggcagacgcgggcugacagaggcuagcccccagcagaaaaagggaggcgaagacgaggauaugccugccgccggcaugcccccucugccccaaucuccgccugaaauucccccucaggggcccccuaaaaucagcccccagggaccgccucaauccccuccccagucuccccuugacagcugcuccagcccgcuccuguggacccggcuggaugaggaaucuuccagcgaggaggaagacaccgcuacauggcacgcgcuccccgagucugaaucccugccuagauacgcccuugaugagaaggucgcugagcuggugcaguuccuccugcugaaauaucagacgaaggaacccguuaccaaggccgagaugcuuacaaccgugaucaaaaaguacaaagacuauuuuccuaugauuuucggcaaggcccacgaauuuaucgagcucaucuucgggauugcucugacagauauggaccccgacaaucauagcuacuuuuucgaagauacccuggaccucacguaugagggaucccugaucgaugaccaaggcaugccuaaaaacugucuucugauucucauccugucuaugauuuuuaucaaggggagcugcguccccgaggaagugaucugggagguucuguccgccauuggcccgauccagcgcccugcgcgggaagugcuugaguuccucucuaagcugagcuccauuauccccagcgcuuuuccuucuugguacauggaugcccugaaagacauggaagauagagcccaggcuauuaucgacacaaccgaugacgccaccgcuauggccuccgcgagccccucugucauguccacaaauuucuguccggaguga

SEQ ID NO: 71777 - RNA, 2337 nt, Artificial Sequence
  derived and/or modified sequence opt5 from MAGED1__Homo_sapiens__NP_001005332
auggcccagaagauggacugcggcgcugggcugcucggauuccaagccgaggcgagcguggaagauuccgcucugcuuaugcagacccugauggaggccauccagauuucugaagcucccccuacaaaccaggcuacggccgcugccagcccgcaauccucucagcccccuaccgcgaaugagauggccgacauccaggucagcgcugccgcugccagacccaaauccgcguuuaagguucagaacgccacaaccaaaggcccuaaugggguguacgauuucucucaagcucacaacgccaaggacgugcccaauacacagccuaaagcugccuuuaagagccagaacgccaccccgaagggacccaaugcugcguaugauuucucccaggccgcuacaaccggcgaacucgccgccaacaaaagcgagauggcuuuuaaggcccaaaaugcgacgaccaaagucgggccuaacgcuacauacaauuucucucagucccugaacgccaaugaccuugccaacagccggcccaagaccccuuuuaaagccuggaaugauacaaccaaggcccccacggcugacacacagacccaaaacgugaaccaggccaagauggcgacaucucaggccgauauugagaccgacccgggaaucuccgaaccugauggcgcuaccgcccagacaagcgcugacggcucucaagcccagaaucuggagucccgcacgauuaucagagggaaacggacccgcaagaucaacaaucucaacguugaagagaauagcuccggagaucagagacgggcgccccuggccgcuggcacauggcgcucugccccugugcccgucaccacacagaaucccccuggggcuccgcccaacgugcuguggcaaaccccucucgccuggcagaaccccagcggauggcagaaucagacggccagacaaacaccucccgcucggcaguccccgccugcgcgccagaccccucccgccuggcagaaccccguugcuuggcaaaauccugugauuuggcccaacccggucaucuggcagaauccugugauuuggcccaaccccaucguguggccuggcccggucguuuggcccaauccucuggccuggcagaaucccccuggguggcaaaccccucccggauggcagacacccccgggcuggcagggcccucccgacuggcaggggccucccgacuggccgcuuccucccgauuggccucugccucccgacuggccccucccgaccgauuggccccugccucccgacuggauuccugccgauuggcccaucccuccggacuggcaaaaccuuagacccagcccuaaccugcggcccucuccuaacucccgcgcuagccagaaucccggagccgcgcagccgagagauguggcucuccugcaggagcgggccaacaaacuggugaaguaucucaugcugaaagacuacacaaaggucccuauuaaacgcucugaaaugcuuagagauaucauccgggaguauacggacguguaccccgaaauuaucgagagagccuguuucguucuggaaaagaaguuuggcauucaacucaaagagaucgauaaggaggaacaucuguauauucuuaucagcacccccgagucccuggcugggauccucggaacaaccaaagacacaccuaagcugggccugcuccuggugauucuuggggucaucuucaugaauggaaaccgcgccucugaagcggugcugugggaggcucuccggaaaaugggccugagacccggcguucgccacccucuucugggggaccuccggaagcugcugaccuacgaauuugugaagcagaaauaccucgauuauagacgcgucccgaauagcaaucccccugaguacgaguuccuguggggacuucgguccuaucaugaaacgagcaagaugaaagugcugagauuuauugccgagguccagaagcgcgacccccgggauuggaccgcccaguucauggaagcugccgacgaggcucucgaugcccuggacgcggccgcugccgaagcugaggccagagccgaggcucgcacacggaugggcaucggggaugaagcggugucuggaccuugguccugggacgauauugaguucgaacugcuuaccugggacgaggagggcgauuuuggggaccccuggagcagaaucccguucacauuuugggcccgguaccaccaaaacgcucgcucuagauucccucagaccuuugccggccccaucauuggaccuggcgggacggccuccgcuaacuucgccgcgaauuuuggagcuaucggcuucuuuuggguugaauga

SEQ ID NO: 71778 - RNA, 1821 nt, Artificial Sequence
  derived and/or modified sequence opt5 from MAGED2__Homo_sapiens__NP_055414
augagcgacaccuccgagucuggcgccgggcugacaagauuccaggcugaagccagcgagaaggauuccucuagcaugaugcaaacgcuccugaccgugacacagaacgucgaaguucccgagaccccuaaagcguccaaggcucuugaagugucugaggacgugaaagucagcaaggccuccggagugagcaaagccacagagguuucuaagaccccggaagcucgggaggcccccgcuacacaggccuccagcaccacgcagcugaccgauacacaagugcucgcggccgaaaauaagucucuggcugccgacaccaaaaagcagaacgcugauccucaggccgucacaaugcccgcgaccgagacgaaaaaggugucccacguugccgacacaaaagugaauaccaaggcucaggagacagaagccgcuccuagccaagcccccgccgaugagccugaaccggagucugcugcggcccagucccaggaaaaccaggacacccgccccaaggucaaagcuaagaaagccagaaaggugaaacaucuugauggcgaggaggacgggagcuccgaucaaucucaggccagcggaaccacaggcgggcggcgcguguccaaggcucugauggccagcauggcgagacgggcuucucgcggaccuaucgccuuuugggccagacgggcuucccgcacgagacucgccgcuugggcccggcgcgcgcugcugagccucagaucucccaaagcccggcgcggcaaggcuagacggagagccgcuaagcugcagagcucccaagaaccugaggccccgccgccucgcgacgucgcgcuucugcagggccgggccaaugaucucguuaaauaccugcuugcuaaggaccagaccaaaauucccaucaagagaucugacaugcugaaagauauuaucaaggaauauacagacguguacccugagauuaucgaacgcgccggguauagccucgagaagguguucggaauccagcugaaagagauugauaagaacgaccaccuguacauccuccuguccacccuugaacccacagaugcuggcauucuggggaccacgaaagacagccccaagcucggacugcuuaugguccugcucucuaucauuuuuaugaauggcaaccgguccagcgaggccgugaucugggaaguucugagaaaacuggggcuccgcccuggcauucaucacucucuguucggagaugugaagaaacuuaucacagacgaguuugucaagcaaaaguaucuggauuacgcccgggugcccaauuccaaucccccugaauaugaguucuuuuggggccucagaagcuacuacgagaccuccaaaaugaagguucugaaauucgcuugcaaggugcagaagaaagaccccaaggaaugggcggcccaguaucgcgaggcuauggaagccgaucuuaaagccgcugccgaggcggcugccgaggccaaggcucgggccgaaaucagagcgcgcauggggauuggacugggcucugagaacgcugccgggccuuguaacugggacgaagccgacaucggacccugggcuaaagcccggauucaggcuggcgccgaggcgaaggccaaagcucaagaaagcggguccgccucuaccggagcuagcacauccaccaauaacagcgccucugccuccgcuagcacaucuggcggcuuuuccgcgggggccagccucacggcuacccugacauucggacuguuugccggccucgggggagccggcgcuucuaccagcggguccagcggcgccugcggauucucuuacaaguga

SEQ ID NO: 71779 - RNA, 2226 nt, Artificial Sequence
  derived and/or modified sequence opt5 from MAGED4B__Homo_sapiens__NP_110428
auggccgagggcagcuucuccgugcagucugaaagcuacuccgucgaggacauggaugaagggucugacgagguuggagaagaggagaugguggaaggcaacgauuaugaggaauuuggggcuuucggaggcuacgggacccugacauccuuugacauccacauucucagagccuucggaucccugggccccggccuucggauccugucuaaugagccuugggagcucgaaaacccggugcuggcgcaaacgcuugucgaggcucugcagcucgaucccgaaacccuggccaaugagacagccgcucgcgccgcuaacguggccagagcggccgcuagcaaucgggccgcucgcgccgcggccgcugccgcuagaaccgccuuuucccagguuguggccagccaucgggucgcuacaccucaggugucuggggaagacacccaacccacaaccuaugcggccgaggcucagggaccuacgcccgagccuccgcuggccagcccccagaccagccagaugcucguuacaucuaagauggccgcuccugaagcccccgcgaccuccgcucaaagccagacaggcucuccugcccaggaggccgcuaccgaagggcccuccagcgccugcgcuuucucccaggccccgugugcgcgcgagguggaugccaacagaccuucuacggcuuuucugggacaaaaugacgucuucgauuuuacacagcccgccggcgugagcgggauggcuuucccucggcccaaacgccccgccccugcgcaggaagccgcuaccgagggaccguccgccgcuagcggcgugccccaaacaggcccugggagagaggucgccgccacccggcccaagaccacaaaaucuggaaaggcucuugcgaaaacgcgcuggguugaaccucagaacgugguggccgcugccgccgcuaaggccaagauggcgaccuccauucccgagccggaaggcgcugccgccgcuacagcccagcacagcgcggagccuugggcuagaaugggagggaaacggaccaagaaaucuaagcaucuggacgaugaauacgagagcuccgaggaggaacgcgaaacacccgccgucccucccaccuggagagccucucagccuagccucacggugcgggcucaacuggcccccagaccgccuauggcuccccgcucccagauccccagccggcacguucuuugccugccuccgagaaaugugacacuccugcaggagcgcgccaacaaacuggucaaguaucucaugauuaaggacuacaaaaagauccccaucaaacgggcggauaugcugaaggacgugauuagagaguaugacgaacauuuuccugagaucauugaacgcgccaccuacacccuugagaaaaaguucggcauccaccugaaagaaauugauaaggaggagcaccucuacauccugguuuguacacgggacucuuccgcuagacuucuggggaagaccaaagauacaccccgccucagccugcugcucgugauucugggagucaucuuuaugaauggcaaccgggccucugaagcugugcuuugggaggcccugagaaagaugggccuccgcccugggguccggcaucccuuccugggagaccuuagaaaacugaucacggaugacuucgugaagcagaaauaucucgaauacaagaagauuccuaauuccaaucccccggaguaugaauuucuguggggccugcgggcccgccacgagaccagcaaaaugagaguucuccgguucaucgcucaaaaucagaacagagauccucgcgaguggaaggcgcauuuucuggaagccguggacgaugcuuucaaaacaauggacgucgauauggccgaggaacacgcccgggcucagaugagagcccagaugaacauuggggacgaggcgcuuaucggacgcugguccugggacgauauucaaguggaacugcucaccugggacgaggauggcgacuuuggggaugcuugggccagaauccccuucgccuuuugggcucgguaccaccaguauauccugaacucuaaccgcgccaauagacgggcgacauggcgcgcuggcguuagcuccggaaccaacggcggggccucuacgagcgugcuggacggaccuuccaccagcucuacaauuagaacccggaaugccgcucgcgccggcgcuuccuucuuuagcuggauccagcauagauga

SEQ ID NO: 71780 - RNA, 2220 nt, Artificial Sequence
  derived and/or modified sequence opt5 from MAGED4__Homo_sapiens__NP_001092270
auggccgagggcagcuucuccgugcagucugaaagcuacuccgucgaggacauggaugaagggucugacgagguuggagaagaggagaugguggaaggcaacgauuaugaggaauuuggggcuuucggaggcuacgggacccugacauccuuugacauccacauucucagagccuucggaucccugggccccggccuucggauccugucuaaugagccuugggagcucgaaaacccggugcuggcgcaaacgcuugucgaggcucugcagcucgaucccgaaacccuggccaaugagacagccgcucgcgccgcuaacguggccagagcggccgcuagcaaucgggccgcucgcgccgcggccgcugccgcuagaaccgccuuuucccagguuguggccagccaucgggucgcuacaccucaggugucuggggaagacacccaacccacaaccuaugcggccgaggcucagggaccuacgcccgagccuccgcuggccagcccccagaccagccagaugcucguuacaucuaagauggccgcuccugaagcccccgcgaccuccgcucaaagccagacaggcucuccugcccaggaggccgcuaccgaagggcccuccagcgccugcgcuuucucccaggccccgugugcgcgcgagguggaugccaacagaccuucuacggcuuuucugggacaaaaugacgucuucgauuuuacacagcccgccggcgugagcgggauggcuuucccucggcccaaacgccccgccccugcgcaggaagccgcuaccgagggaccguccgccgcuagcggcgugccccaaacaggcccugggagagaggucgccgccacccggcccaagaccacaaaaucuggaaaggcucuugcgaaaacgcgcuggguugaaccucagaacgugguggccgcugccgccgcuaaggccaagauggcgaccuccauucccgagccggaaggcgcugccgccgcuacagcccagcacagcgcggagccuugggcuagaaugggagggaaacggaccaagaaaucuaagcaucuggacgaugaauacgagagcuccgaggaggaacgcgaaacacccgccgucccucccaccuggagagccucucagccuagccucacggugcgggcucaacuggcccccagaccgccuauggcuccccgcucccagauccccagccggcacguucuuugccugccuccgagaaaugugacacuccugcaggagcgcgccaacaaacuggucaaguaucucaugauuaaggacuacaaaaagauccccaucaaacgggcggauaugcugaaggacgugauuagagaguaugacgaacauuuuccugagaucauugaacgcgccaccuacacccuugagaaaaaguucggcauccaccugaaagaaauugauaaggaggagcaccucuacauccugguuuguacacgggacucuuccgcuagacuucuggggaagaccaaagauacaccccgccucagccugcugcucgugauucugggagucaucuuuaugaauggcaaccgggccucugaagcugugcuuugggaggcccugagaaagaugggccuccgcccugggguccggcaucccuuccugggagaccuuagaaaacugaucacggaugacuucgugaagcagaaauaucucgaauacaagaagauuccuaauuccaaucccccggaguaugaauuucuguggggccugcgggcccgccacgagaccagcaaaaugagaguucuccgguucaucgcucaaaaucagaacagagauccucgcgaguggaaggcgcauuuucuggaagccguggacgaugcuuucaaaacaauggacgucgauauggccgaggaacacgcccgggcucagaugagagcccagaugaacauuggggacgaggcgcuuaucggacgcugguccugggacgauauucaaguggaacugcucaccugggacgaggauggcgacuuuggggaugcuugggccagaauccccuucgccuuuugggcucgguaccaccaguauauccugaacucuaaccgcgccaauagacgggcgacauggcgcgcuggcguuagcuccggaaccaacggcggggccucuacgagcgugcuggacggaccuuccaccagcucuacaauuagaacccggaaugccgcucgcgccggcgcuuccuucuuuagcuggauccaguga

SEQ ID NO: 71781 - RNA, 2874 nt, Artificial Sequence
  derived and/or modified sequence opt5 from MAGEE1__Homo_sapiens__NP_065983
augagccuggugucccagaacucuagacggcgcagacggcgcgucgccaaggcuaccgcccacaauagcuccuggggcgagaugcaagcgcccaacgcuccugggcucccggccgacguucccggaucugaugugccucagggccccagcgacucccagauccugcaggggcuuugcgccucugaaggaccuagcacauccgugcugcccacgagcgcugagggcccuucuaccuucgucccgcccacaauuuccgaagccagcucugcuuccgggcaaccuaccaucagcgagggacccggcacaucugugcucccuacccccuccgaaggccugagcacauccgggccgccuaccauuucuaaaggacuuuguacgagcguuacccuggccgcguccgagggcagaaauacaagccggcccccuaccucuuccgaggaacccagcacaucugugcccccuaccgccagcgaggucccguccacgucucugcccccuacacccggggaaggaaccagcacauccgugccucccaccgcuuacgagggcccgagcaccucuguugugccuacacccgaugaggggccuuccacgagcguccuccccaccccuggagaaggccccggcacaucugugccgcuggccgcuaccgaggggcucuccacaagcgugcaggccaccccugacgaaggacccuccacgucugugcccccuacagcgaccgagggccugagcaccccgguucccccuacacgcgaugaagggcccuccaccucugugccugccacacccggagagggcccuagcacguccgugcuucccgcugccagcgacgggcagucuaucucccuggucccgaccagaggaaagggcagcucuacauccgugccucccaccgcuacagagggccucagcaccucuguucagccuacggccggggaaggaagcuccaccagcgugcccccgacaccuggcgggggacugucuaccuccgugcccccuacagccaccgaggaacuuagcacguccgucccucccacacccggcgaggggccgucuaccagcguucugcccauuccuggcgaaggacucuccacaucugugcccccuaccgcuagcgauggcuccgacaccucugugcccccuacaccgggggagggagcgagcacgcugguccaacccaccgccccugauggccccggguccagcguccugccuaaccccggagagggcccgucuacacucuuuuccagcucugcuuccguggaccggaauccuagcaaaugcucucugguucuucccagcccccgcgugaccaaggccuccgucgauuccgacagcgaagggccuaaaggcgccgagggacccaucgaguucgaagugcugagagauugugaaucuccuaacagcaucuccauuaugggccucaauacaucucggguugcuaucacccugaagccgcaggaccccauggagcagaacguggccgagcuucugcaguuucuccuggucaaggaccaaagcaaauauccuauucgcgaauccgagaugagagaauacaucgugaaggaguaucggaaucaguuccccgagauucugcgcagagcggcugcccaucucgaaugcaucuuucgguucgagcugagagaacuugauccugaggcccacacguacauucugcucaacaaacuggggcccgugccguuugaaggacuugaggagucuccuaauggccccaagauggggcugcucaugaugauccugggacagaucuuccugaacggcaaucaagcuaaagaagccgagauuugggaaaugcucuggcgcauggggguucagcgggagagacgccugagcaucuuuggcaacccuaagcggcuucuguccgucgaguucguguggcagagauaucucgacuaccgccccgugacagauuguaagccugucgaauaugaguuuuucuggggaccccggucucaucuggaaaccaccaaaaugaagauucugaaauuuauggcuaagaucuacaauaaagacccgauggauuggccugagaaguacaacgaagcccuugaggaagacgcggccagagcuuucgccgagggcuggcaggcucucccccacuuccgccggcccuuuuucgaggaagccgcggccgaggugccuagcccggauuccgaaguuagcucuuauuccagcaaauacgcuccccauucuuggccugaguccagacuggagagcaaggcccgcaagcuggugcaacucuuucugcuuauggacuccacaaaacugcccauuccuaagaaagggauccucuauuacaucggacgggaaugcucuaaggucuuccccgaucugcugaacagagcugcccggacccuuaaucacguguauggcacagagcucguugugcuggacccucgcaaccacagcuacacgcuguauaauagacgggaaauggaggaaaccgaggagauugucgauuccccgaacagacccgggaauaacuuucucaugcagguccugagcuucaucuuuauuaugggaaaucaugcccgcgaaucugcuguuugggcguuccuucggggccugggggugcaggccggcagaaaacacgucaucacaugucgcuaccucucccagagauacauugacagccugcgggugccugacucugaucccgugcaauaugaguuugucuggggaccucgcgcuagacuggaaaccagcaagaugaaggcccuucgguacguugcccgcauccauagaaaagagccccaggacuggccgcagcaguaucgggaagcuauggaggaugaggccaaccgcgcggacgugggccacagacaaaucuucgugcacaauuuucgguga

SEQ ID NO: 71782 - RNA, 660 nt, Artificial Sequence
  derived and/or modified sequence opt5 from MAGEH1__Homo_sapiens__NP_054780
augcccagaggccggaagucucgcagacggcgcaacgccagagcugccgaggaaaaucggaacaaucgcaaaauccaggcguccgaggcuucugaaaccccuauggccgccagcguggucgcuuccacaccggaggacgaucugucugggcccgaagaggacccuagcacgcccgaggaagccuccaccacaccugaggaagcuagcagcaccgcccaagcgcagaagcccuccguuccuagaagcaacuuccagggaacaaagaagucucuccugauguccauucuugcccugaucuuuauuaugggcaauagcgcuaaagaggcccucguguggaaggugcuggggaaacuuggaaugcagccgggccggcaacacucuaucuucggggaucccaaaaagauugucaccgaggaauuugugcgcagaggauaccugaucuauaaaccuguuccccgguccagcccuguggaguacgaguucuuuuggggcccccgcgcucaugucgaaucuuccaagcucaaagugaugcacuucguugccagagugcggaaccgcugcagcaaggacuggccguguaauuaugauugggacuccgaugacgaugcggaagucgaggccauccugaacucuggcgcuagaggguacagcgccccuuga

SEQ ID NO: 71783 - RNA, 3750 nt, Artificial Sequence
  derived and/or modified sequence opt5 from MAGEL2__Homo_sapiens__NP_061939
augagccagcuguccaagaaccucggcgacucuagcccgccugccgaggcuccgaaacccccuguguacuccagacccaccguccugaugcgggccccucccgcgucuagccgcgcuccuccgguucccugggauccucccccuaucgaccuucaagccucccuggccgcuuggcaggcgccccagccggcuugggaagccccucaggggcaacuccccgcgccuguggugcccaugacacagcccccugcccugggaggcccgauuguccccgcuccuccccuugggggaccuaugggcaagcccccgacgccuggggugcugaugguucaucccccucccccuggagcccccauggcucagccgccuacccccggcgugcucaugguccaccccucugccccuggcgcgccgauggcccaucccccucccccugggacacccaugagccacccucccccgccuggaacccccauggcucacccucccccgccuggcacacccauggcccauccuccuccgcccgggacccccauggugcaucccccucccccuggaacacccauggcucacccuccgcccccuggcacccccauggcccacccucccccgccugggacgcccauggcccaucccccucccccuggaaccccgauggcucaucccccucccccuggcacacccauggcgcagccgccugcccccggcguucugauggcucaaccucugacccccggggugcucaugguccagccugccgcccccggagcuccgauggugcagccuccucccgccgcgaugaugacacagccccaaccguccggcgcucccauggccaaaccucccgggccuggagugcugaugauccaucccccuggcgccagagcuccgaugacccagcccccugccagcggggcucccauggcccagccugcggcucccccggcccaaccuauggccccucccgcucagcccauggccucuugggcgccccaggcccagccucuuauucugcaaauccagucccaggucauucgggcuccgccccagguuccucaaggaccccaggccccucccgcucagcucgccacgccgccuggcuggcaggccacaagccccggcuggcaagcuacccagcagggguggcaggcgacaccucugaccuggcaaaccacacaggugacguggcaggcccccgcugugaccuggcaagucccucccccgaugcgccagggaccuccucccaucagacccggcccgcccccuauccggcccgggccucccccugugcgccaggcucccccgcuuauuagacaggccccucccguuauccggcaagccccucccgugauucgccaggccccgccugucaucagacaggcgcccgcugugauucggcaggcucccccuguuauccgccaagcgcccccugugauuagacaggccccgcccgucauccggcaggccccuccccugauccgccaggccccucccccuauuagaccggcuccccaagugcucgccacacagccuccccuguggcaggcccugccucccccgccuccccuccggcaagcuccccaggccagacugccugcuccccagguccaggccgcgccucaagugccgaccgcucccccugccacacagguucccgccgcuccucccgccggaccccaggugccucagcccguccuuccugcuccccugucugccccgcucuccgcgccucaagccgugcacugccccagcaucauuuggcaggcucccaagggccagccucccguuccucacgagaucccgaccucuauggaguuccaggaagugcaacagacgcaggcccuggccuggcaggcucaaaaagcccccacacacauuuggcagccucuucccgcgcaggaagcucaacgccaggccccuccccugguccagcucgagcagccuuuucaaggggccccgcccucccagaaggcugugcagauccagcugccuccccaacaggcccaggcgagcggcccucaggcugaggugcccacccugccgcuccaaccuuccuggcaggccccucccgccguucugcaggcucaacccggacccccugucgccgcugccaauuucccgcuuggcucugccaagagccugaugacccccuccggggaaugucgggccagcucuaucgauagacgcggauccagcaaagagcggagaacaucuagcaaggaacgccgggcuccuuccaaagacagaaugauuuuugccgcuaccuucugcgcccccaaggccgugucugcugcgcgcgcccaccucccugcugccuggaaaaaccugcccgccacaccggagacguuugcuccuagcuccagcguguuccccgccaccucucaguuucagccugcgucccuuaaugcuuucaagggccccagcgccgccucugagacaccuaagucccugcccuaugcucuccaggauccguuugccugugucgaagcgcugcccgccgugccuuggguuccccaaccuaacaugaaugcuagcaaagccucccaggcugugccgaccuuccugauggccacagcugccgcgccccaggccaccgcuacgacccaggaggccucuaagacaagcgucgaaccuccccggagauccgggaaagcuacccgcaagaaaaagcaccucgaggcccaagaagacucucggggacauacacuggccuuucacgauuggcagggcccuagacccugggagaaccuuaaucugagcgacugggaggugcaguccccuauccagguuagcggggauugggaacaccccaacaccccgcggggccucucuggaugggagggcccuuccacgagccgcauucugucugggugggaaggacccuccgcuagcugggcgcugucugccugggagggcccuagcacauccagagcucuugggcucagcgaaucucccggauccagccugccgguggucguguccgagguugccucugugagcccuggcuccucugccacccaagacaauagcaaagucgaggcucagccccugucuccccucgaugaacgggccaacgcgcuggugcaguuccuucuggugaaggaccaggccaaggucccuguucaaagauccgagauggugaaagugauccuccgcgaauacaaggaugagugccuggacauuaucaaucgggcuaacaauaaacuggaaugugccuuuggguaucagcuuaaggagaucgacaccaaaaaccaugcuuacauuaucauuaauaagcucggcuaucacacaggaaaccuggucgccagcuaccuggauagacccaaguucggccuccugauggugguucuuucccugaucuucaugaaagggaacugcgugcgcgaggaccucauuuuuaauuuccuguuuaagcugggacuugaugucagagaaaccaacggccucuucgggaauacgaaaaagcugaucacagagguguuuguucggcagaaauaucuggaauaccgccggauuccuuacaccgagccggcggaguaugaguuccucuggggacccagagccuuucuggaaacaagcaagaugcuugugcugcgcuuccucgcuaagcugcauaaaaaggacccucaaucuuggcccuuucacuaccuggaagcccuugcugagugugaaugggaggauaccgacgaggaugaaccugacacaggcgauuccgcccacgggcccaccagcagaccgccuccccgguga

SEQ ID NO: 71784 - RNA, 1806 nt, Artificial Sequence
  derived and/or modified sequence opt5 from MAG__Homo_sapiens__NP_001186145
augcccagcuccaucucugccuucgaggggaccugcgugagcauuccuuguagauuugacuucccggaugaacugcggcccgcugucguucacggcgugugguacuuuaacuccccuuaucccaagaauuacccucccguggucuucaaaucucgcacacaggugguucaugagagcuuucaaggaagaucccggcuccugggcgaccuugggcugcgcaacugcacgcuccugcuuucuaaugugagcccugaacugggaggcaaguauuacuucagaggggaucucggaggcuauaaccaguacaccuuuuccgagcacagcguccuggacaucgugaauacaccgaacauuguugugcccccugaagucguggccggcaccgagguggaggucucuuguaugguucccgauaauugcccugaacugcggcccgagcucuccuggcuggggcaugaaggacuuggcgagccggcggugcuggggcgccucagagaggacgaaggaacaugggugcaggucagccugcuucacuucgugccuacccgggaggcuaacggccaucgccuggggugucaggccucuuuucccaauacaacccuccaauucgaaggauaugccuccauggauguuaaauacccucccgugaucgucgagaugaacagcucuguggaagcuauugagggcucccacguuagccugcugugcggcgccgacuccaaucccccuccgcuccugacguggaugagagaugggaccgugcuucgggaggcugucgccgaaucucugcuccuggagcuugaagaggugacacccgcggaagacggagucuacgccugucuggcugagaacgccuauggccaggauaaucgcaccguggggcucagcguuauguacgcuccuuggaagcccacagugaacggaaccauggucgccguggagggcgaaacgguuuccauccugugcagcacacagucuaauccugaccccauccugaccauuuuuaaagagaagcagauccucuccacagugauuuaugaaagcgagcugcaacuugaacugccggcggucucuccugaggaugacggggaguacugguguguggccgaaaaccaguauggacagagagcuaccgccuucaaccucagcguggaguuugcucccguucugcuucuggaaucccacugcgccgccgcucgggacaccguccagugucucugcguggugaagucuaauccugagcccagcgucgcguucgagcugccuucccgcaacgugacaguuaaugaaagcgagagagaguucguguacucugaacgguccggccugguccucacgagcauccugacccuuagaggccaagcccaggcucccccgcgcgugauuugcacagcccggaaccuguauggggccaaaucucucgaacugccuuuucagggagcucauagacugaugugggccaagaucggccccguuggggcgguggucgcuuucgccauucuuaucgccaucguguguuacauuacccaaacacgccggaaaaagaauguuaccgagucccccagcuuuuccgcuggagauaacccuccgguccucuucucuagcgacuuuagaaucuccggcgcccccgagaaauacgaaucugagcgccggcuggggagcgaaagacgccugcucggccugcggggagagccucccgaacuugaucuguccuauagccacucugaccucggcaagagaccuacgaaggauuccuacacacugaccgaggagcuggcugaauaugccgagauucgcgugaaauga

SEQ ID NO: 71785 - RNA, 4389 nt, Artificial Sequence
  derived and/or modified sequence opt5 from MAGI1__Homo_sapiens__NP_001028229
augagcaaggugauccagaaaaagaaccacuggaccuccagaguccacgagugcacaguuaaacggggcccccaaggggaacugggagugacggugcucggcggggccgagcacggagaguucccuuacgucggcgcuguggccgcgguugaagcugccgggcugccgggaggcggcgaagggccccgccuuggagagggcgagcugcuccuggaagugcagggggucagagugucuggacuuccucgguaugacguucugggcgugauugauagcuguaaggaggccgucaccuuuaaagcugugcgccaagggggaagacucaauaaggaccugcggcauuuccugaaccagcgcuuucaaaagggcucccccgaucacgaacuccagcagacaaucagagacaaucuguaccggcaugccgugccuugcaccacacgcucucccagagagggcgaggucccugggguugauuauaacuuccuuaccgugaaagaauuucuggaccucgagcagagcggaacacugcuugaagugggcaccuacgaggggaauuauuacggaacgccgaagcccccuucccaacccgucucuggcaaagugauuaccacagaugcucugcacagccuccaguccgggagcaagcagucuaccccuaaacggacaaaguccuauaacgacaugcagaaugccggaaucguucacgcggaaaacgaggaggaagaugacgugcccgagaugaauagcucuuucaccgccgauuccggcgaacaagaggaacauacgcugcaggagacagcucugccgccugucaacagcucuauuaucgccgcucccaucaccgacccuucccagaaguuuccccaauaccucccccugagcgccgaggauaaucuuggcccucugccggaaaacugggagauggcguacacagaaaauggggagguguauuucauugaccacaacaccaaaaccacauccuggcucgacccccgcugucugaauaagcagcagaaaccucuugaagagugcgaggaugacgaaggaguucauacggaggaacuggauucugagcucgagcugcccgccggcugggaaaagaucgaggacccuguguacgggauuuauuacgucgaucacaucaacagaaaaacccaguaugaaaaccccgugcuggaggcuaagcggaaaaagcaacucgaacagcagcagcaacagcagcagcaacagcagcagcaacagcagcaacagcagcagcaacagacagaggaguggaccgaagaccacagcgcccuggucccgccugugauucccaaucauccucccuccaacccugagcccgcucgcgaaguuccgcuucagggaaagcccuuuuucacaagaaaucccagcgagcugaaaggcaaguuuauccacaccaaacuccggaagucuuccagaggguucggcuuuacgguggucggaggcgaugaacccgacgaguuccugcagauuaaaagccuugugcuggaugggccugccgcccucgacggaaagauggagacaggcgauguuaucgugucugucaacgacaccugugugcuggggcauacccacgcucaagugguuaagaucuuccagagcauuccgaucggagcguccgucgaccuggaacucugccgcggcuacccccugccuuuugaucccgacgauccuaauacaucucuugugaccagcguggccauucuggacaaagagcccaucauugucaacgggcaggaaacauaugauuccccugcuagccauucuuccaagacgggcaaagugaauggaaugaaggacgcccggcccagcucuccggccgauguugcuuccaacagcucccacggcuacccuaaugacaccgugucucucgccagcuccaucgcgacacagcccgagcugaucaccguccacauugugaaagggccuaugggauucggcuuuacaaucgcugauucucccgggggaggcgggcaaagaguuaagcagauuguggacagcccgcgcugucggggccugaaggaaggagaucuuaucgucgaggugaacaaaaagaauguucaggcccucacccauaaccaaguggucgacaugcugguggagugcccuaaaggcuccgaagugacgcugcucguccagagagggggacugcccguuccuaagaaaagccccaagucucagccccuugagcgcaaggauucccagaauagcucucaacacuccgugagcucucaucggagccugcacaccgccuccccuagccacucuacacaggugcucccggaauuucccccugcugaggcccaggcucccgaccagaccgacuccagcggccagaaaaagccugaucccuucaaaauuugggcccaguccagaucuauguacgagaaccgccugccugacuaucaggaacaggauaucuuccuguggcggaaggagacaggguuuggauucagaauccuuggcgggaaugaaccgggcgagcccauuuacaucggacauauugucccucucggcgcggccgacaccgaugggcgccugcggagcggagacgaacugaucuguguggauggcacgcccguuauugggaaaucccaccaacucgugguccagcugaugcagcaggcugccaagcaaggacaugugaaccuuacaguuagacggaaaguggucuuugcugugccuaagaccgagaacgagguucccucuccggccagcucccaccauucuagcaaucagccugcgucccugacagaagagaagcgcaccccucagggcagccaaaacucucucaauaccguguccagcggcucuggguccacaagcggaaucggcucugggggaggcgggggauccggcgucgugagcacggugguccagcccuaugacguugaaauuagacggggcgagaacgaaggguucggauuugugaucguguccagcgucucuagaccugaggccggcaccacauucgggaaugcuugcguggccaugccccacaaaaucggacgcauuaucgagggcagcccugcugaucggugugggaagcugaaaguuggagaccgcauucuggccgugaacggcugcuccaucaccaauaagucucacagcgauauugucaaccuuaucaaagaagccggcaauacagugacccucagaaucauuccgggggacgaguccucuaacgcuacgcugcugacaaaugcggaaaagaucgccaccauuaccacaacccauacacccagccagcagggaacgcaagagaccagaaacacaaccaagccuaaacaggaaucccaguuugaguucaaggcuccccaggccacacaagagcaggauuucuacaccguugaacucgagcggggcgccaaaggguuuggauucucucugcgcggcgggagagaauauaauauggaccuuuacgugcugcggcucgcugaggacggaccugccgagcgcugcggcaagaugagaaucggcgaugaaauucuggagaucaacggggaaacgaccaaaaauaugaagcacagccgggcgaucgagcugauuaagaacggaggccgcagaguccggcuuuuucucaaacgcggggacggauccgugcccgaauaugauccgagcucugacagacauggcccugcuacagggccccagggagucccugaggugcgggccggccccgauagacgccagcacccuucccuggagagcucuuaucccccggaccugcauaaguccagcccucacggcgaaaaacgggcccacgcuagagaucccaaggggucccgcgaguacucucggcaacccaacgaacaucacaccuggaauggaacaagcagaaaaccugacuccggcgccugucgcccgaaggaucgggcgcccgaggggagacgcgacgcucaggccgaacgggccgcugccgcuaacggaccuaagagacggagccccgagaaacgcagagagggcacccggucugccgauaauacacucgaacgcagagagaagcaugaaaaacggagagacguuuccccugagcgccggagagaacgcagccccacccggagacgcgacgggucuccuagccggagacgcagaucccuggagcggcuucuggagcagcgcagaucuccggaacggcgcagaggaggcagccccgagcggagagcgaaguccacggaucgccggagagcccgcucuccugaacggagacgggagcgcagccucgacaaaagaaaccgggaggaucgcgcuucccacagagaacgggaggaagccaaucugaagcaagacgcuggccgcagcucuagacaucccccugagcagcggcgcagacccuacaaagaaugcuccacagaucugagcaucuga

SEQ ID NO: 71786 - RNA, 4326 nt, Artificial Sequence
  derived and/or modified sequence opt5 from MAGI2__Homo_sapiens__NP_001288057
augagcaagucccugaaaaagaaaucucacuggaccagcaaggugcaugaguccgucaucggcagaaaccccgaagggcagcucggauucgagcugaaaggcggggccgaaaauggacaauuuccuuaccuuggcgagguuaagccggggaagguggcuuaugaaucuggaagcaaacugguguccgaggagcuccugcuugaagucaacgagacacccguggccggccugacgauucgggacguucucgcggugaucaagcacugcaaagauccucugcgccugaagugugucaaacagggcgggauuguggacaaggaucucagacauuaccugaaucuucgguuccagaagggaucuguugaccacgaacugcagcaaaucauucgcgauaaccucuaucugagaaccgugcccugcacaacccggccucauaaagagggcgagguccccgggguggacuacaucuuuaucacaguggaagauuucauggagcuugaaaagagcggagcucugcucgaguccggcaccuaugaagacaauuacuaugggacaccuaaaccgcccgccgagccugcuccccugcugcucaacgucaccgaucagauucugccuggagccacgcccagcgccgagggcaagcgcaaaagaaauaagucuguuuccaacauggaaaaagcuagcaucgagccgccugaagaggaagaggaggaacggcccguggugaauggcaacggggucgugguuaccccugagucuuccgaacacgaggacaagagcgccggagcgucuggcgaaaugcccucccagcccuacccugccccgguguacagccagcccgaggagcuuaaggaacaaauggaugacacaaaaccuaccaagcccgaggauaaugaggaaccugacccccugccggacaacugggagauggcuuauacagaaaaaggggaggucuacuuuauugaucacaauaccaagacgacauccuggcucgacccucgccuggccaaaaaggcuaagcccccugaagaguguaaagaaaacgagcuucccuauggaugggagaagaucgaugacccuauuuacggcaccuauuacguggaucauaucaauagacggacacaguucgaaaaccccguucuggaggccaaacgcaagcuccagcagcacaacaugccgcauaccgaacuggggaccaaaccucugcaagcgcccggauuuagagagaagccccucuucacacgggacgccucucagcugaagggcacguuucuuagcaccacacugaaaaaguccaauaugggcuucggguuuaccauuaucggaggcgaugaaccugacgaguuccuccaggugaaaagcgucaucccggaugggcccgcugcccaagacggaaagauggagacaggcgaugugauugucuauaucaacgaagugugcguucuggggcacacccacgcugacguggucaaacuuuuucagucugugccuauuggccaguccguuaaucuggugcucugucgcggauacccccugccuuucgaccccgaggauccugccaacagcauggugcccccgcuggccaucauggaaagaccucccccugucauggugaauggccggcauaacuacgagacguaucucgaauacauuucuagaacaagccaguccguucccgacaucaccgaucgcccgccucacucucugcauagcaugcccaccgacgggcaacuugauggaacauauccuccgcccguccacgacgauaauguguccauggcuagcucuggcgcgacccaggccgagcugaugacacucacgaucgugaagggggcucagggauucggcuuuaccauugccgacuccccuacagggcagcgggucaagcaaauccuggauauucagggcugcccgggacugugugagggcgaccuuaucguggaaauuaaccagcagaauguucaaaaccucagccauaccgagguggucgauauccugaaagacugccccaucgggucugaaacaucccugauuauccacagaggaggcuucuuuagcccuuggaagacccccaaaccuauuauggaucgcugggagaaucaggggucuccccagacgucccucagcgccccugcuaucccgcagaaccugcccuucccucccgcccuucaccgguccucuuuuccugacagcaccgaggcguucgaccccagaaagccggauccuuacgaacuguaugagaaaucccgcgcuauuuacgaaagccggagacccgacuauaaggagcucgaugugcaucugcgccggauggaaucuggauuuggcuucagaauccuugggggcgacgagcccggacaaccuauucugaucggcgccguuaucgccaugggguccgcugaucgcgacggacggcuccaccccggcgaugagcugguguacgucgacgggauuccuguggccggaaaaacacauagauacguuaucgaucugaugcaccacgcugcccggaauggccaggugaaccucaccguccgcagaaaggugcugugugggggcgaaccgugccccgagaauggacggagcccuggcucuguguccacacaucacagcucucccagaagcgacuaugcgaccuacacgaacuccaaccaugccgcuccuagcucuaaugccuccccgcccgaaggguuugcuagccacucccuucagacaucugaugucguuauucaucgcaaggagaacgaaggauucggcuuugugaucauuagcucccugaaucggccugagucugggagcaccaucacagugccccacaaaaucggaagaauuaucgacggcuccccugccgaucgcugugcgaagcucaaagucggcgaccggauucuggccgugaacgggcaaucuaucauuaauaugccccacgcugacaucguuaagcugaucaaagaugccggacuuagcgugacccucagaauuaucccucaggaggaacugaacucccccaccagcgcuccgucuuccgagaagcagagcccuauggcccagcaaucuccccuggcccagcagagcccccucgcucagccuuccccggcgacacccaauucuccuauugcccaacccgcuccuccccagccucugcagcuucagggccaugaaaacuccuaucgcagcgaggucaaggccagacaagacgugaaaccggauauccggcagcccccuuucacggacuaccgccagcccccucuggauuauagacaaccucccgggggagacuaccagcagcccccgccccucgauuaucggcagccuccccugcuggacuaccgccaacacuccccugauaccagacaguacccgcuuagcgacuaucggcagccccaggauuuugacuacuucacaguugacauggaaaagggcgccaaaggguucggauuuucuauucgcggcggcagagaguauaagauggaucucuacgugcugcggcuggcugaggacgggccugccaucagaaauggacgcaugcgggucggcgaucaaaucauugaaaucaacggggagagcaccagagacaugacacaugcgcgcgcuauugaacucaucaaauccggaggccggagagugcgccugcuucugaagcgggggaccggacagguucccgaguaugaugagccugcccccuggucuagcccggccgcugccgcgccuggccuccccgaagugggcgucucccuggacgaugggcuggcuccuuucucucccagccacccugccccucccuccgaccccucucaucagauuagccccggacccacgugggauaucaagagagagcacgacgugcgcaaaccuaaggaacuuuccgccugcggccagaaaaagcaacggcugggggagcagagagaacggagcgcuucuccgcagcgcgccgcuagaccccggcucgaggaggccccuggaggccaggggcgccccgaagcgggaagaccugccuccgaggcucgggcccccggccuggcugccgccgaugcugcggacgccgcuagagccggcgggaaagaagccccucgcgcugccgcgggaagcgagcucugccggagagaaggccccggggcugccccggccuuugcuggaccuggcgggggaggcucuggcgcccuggaggcggaggggcgcgcuggagcccgggccggccccagaccugggccccgcccgccuggaggcgcucccgcccggaaggcugccguggcgcccgggccuuggaagguccccggauccgauaaacuuccuagcguucugaagccgggcgccuccgcugccucuagauga

SEQ ID NO: 71787 - RNA, 3762 nt, Artificial Sequence
  derived and/or modified sequence opt5 from MAGI3__Homo_sapiens__XP_011539510
auggagagaauggacagcucccugcccgaagaggaagaggaugaagacaaggaggccaucaacggcucugggaaugcugagaaccgggaacgccacagcgaguccucugauuggaugaaaaccgugccuagcuacaaucagacaaacuccucuauggacuucagaaauuauaugaugcgggaugaaacgcucgagccgcugcccaagaacugggagauggccuacaccgacacaggaaugauuuauuuuaucgaucauaauaccaaaacaaccacauggcuugacccucgccugugcaagaaagcgaaggcucccgaagauugugaggacggcgaacucccuuacgggugggagaagauugaagauccccaauauggaaccuacuaugucgaccaccugaaccagaaaacgcaguucgagaauccuguugaggaagccaagcgcaaaaagcagcuuggccaaguggagaucgggagcuccaaaccggauauggaaaagagccauuuuacccgggaccccucucagcugaagggagugcucguccgcgccucccugaaaaagagcacaaugggcuucggcuuuaccauuaucgggggagacagaccugaugaguuccuccaggugaaaaacguucugaaggacggccccgcugcccaggaugggaaaaucgcuccuggagacgugauugucgauaucaauggcaacugcgugcuggggcacacacaugccgacguugugcaaauguuucagcuuguccccgugaaucaguacgugaaccugacccucugucggggauacccgcugccugaugacucugaagaucccgucguugacauuguggcggccacgccugugaucaauggccagucccuuacaaagggcgagaccugcaugaacccccaagauuucaaacccggggcuaugguccuggagcagaacggaaagagcggccacacacucaccggggacggacugaauggcccuucugacgccuccgaacagcgcgugagcauggcuuccucugggagcucccaaccggagcugguuaccauuccccucaucaagggaccuaaaggcuuuggcuucgccauugcggauagccccacagggcagaaggugaaaaugauccuggacucucaguggugucagggacuucaaaagggcgauaucauuaaagaaaucuaucaccagaacguccagaaucugacgcaucuccaggugguugaggugcugaagcaauuuccugucggggccgacgugccccuucugauucucagaggaggcccgccuucccccaccaagacagcuaaaaugaagaccgauaaaaaggaaaacgccgggagccuggaggcuaucaaugagccuauuccccagccuaugcccuucccgccuucuaucauccggagcggcucccccaaacuggaccccucugaagucuaccucaagagcaagacacuguaugaggauaaaccuccgaacaccaaggaccuugauguguuucugcgcaaacaggaauccggauucggcuucagaguucucgggggagacggccccgaucagagcauuuacaucggggccauuaucccucugggagccgcugagaaggacggccggcuucgcgcggccgaugagcugaugugcauugacgggauccccgugaaaggcaagucucacaagcaaguccucgaccugaugacgacagcugccagaaauggacaugugcugcucaccguucggagaaaaaucuuuuauggcgaaaagcagccugaggaugacuccagccaggccuucauuucuacccagaacgggucccccagacugaaucgggcugaagugccugccagacccgcgccgcaagagccuuacgaugucgugcuucagcgcaaagaaaacgagggauuuggcuucgugauccugacaagcaagaauaaacccccucccgggguuauuccgcacaagaucggacgggucauugagggcuccccugcugacagaugugggaaacucaaggugggcgaucacaucucugccgugaacggacagagcauugucgaacugucccaugacaauaucgugcaacugaucaaggaugccggcguuaccgugacacuuacggucauugcugaggaagaacaccaugggcccccuucuggaaccaacagcgcccgccagucccccgcucuccagcaccggcccaugggccagagccaagccaaucauaucccuggggacagaucugcgcuggaaggagagauuggcaaagauguguccacaagcuaucgccacucuugguccgaccacaagcaucuggcccagccggauaccgcuguuaucagcguggucgggucucggcacaaccagaaccucggcugcuaccccguggagcuggaaagaggaccucgcggcuuuggguucagccuucggggaggcaaagaguacaauauggggcuguuuauucucagacuggccgaagacggacccgcuaucaaggauggccggauccauguuggcgaccagauuguggagaucaacggggaaccuacacaaggaauuacccacacgcgcgccaucgagcugauucaggcgggcgggaauaaaguccuucuccugcugagacccggaaccggccucaucccugaccacggggauugggacaucaacaauccguccagcucuaacgugauuuaugaugagcagagcccccugccucccuccucccauuucgccucuaucuuugaagagagccacgugccugucauugaagagucccuucggguucagaucugugagaaggcugaggagcugaaggacauugugcccgagaaaaagucuacacucaaugaaaaccaaccggaaaucaaacaucagagccugcugcagaagaauguguccaaaagagauccucccucuagccacggacauuccaacaagaagaaucuucucaaagucgagaacggcgugacccgccggggcagaagcguuucucccaagaaaccugccucccaacacagcgaggaacaccuggacaagauccccucuccucugaaaaauaacccgaagcgcagaccccgggaucagucccucagcccuucuaagggggagaauaaauccugccaggugagcacacgcgcuggauccggccaggaccaauguagaaagagccgggggcgcucugccagccccaaaaagcagcagaaaauugaaggauccaaggccccuucuaacgcugaggcgaaacugcuugaaggcaagagcagacggaucgccggguacaccggauccaacgcugagcagauucccgauggcaaggagaaaucugacgucauccgcaaggaugccaaacaaaaucagcuggaaaagagcagaacgcgguccccggagaaaaagauuaagcgcaugguggaaaaaucucucccuagcaagaugacaaacaaaaccacauccaaggagguuagcgaaaaugagaaaggcaagaaggugaccaccggggagacaucuuccagcaacgacaaaaucggagaaaauguccagcugucugagaagagacugaaacaggaacccgaggagaaggugguuuccaacaaaacggaagaccauaagggcaaggagcuugaagccgcugauaaaaauaaggagaccgggcgguucaaaccugaaagcuccucucccgugaagaaaacacucauuaccccuggacccuggaaggucccgagcggcaacaaggugacagggaccaucggaauggccgagaaaagacaauga

SEQ ID NO: 71788 - RNA, 1104 nt, Artificial Sequence
  derived and/or modified sequence opt5 from MAGT1__Homo_sapiens__NP_115497
augagaaagggcaaagggcccaucugccuguucagccggccuacccuccgcccguccagaucuaaggugagccugauugagggacggggcgccaacauggcugcccgcuggagauuuuggugugucuccguuacaauggugguggcgcuucugaucgucugcgacgugcccucugcuagcgcccagcggaaaaaggaaaugguucucuccgagaaagugucucaacugauggaauggacgaauaagcgcccugucauuagaaugaacggggauaaguuccggcgccuugugaaagcucccccuagaaauuacagcguuaucgugauguuuaccgcccugcagcuccaccggcagugugucgugugcaagcaggccgacgaggaguuccaaauucuggcuaacuccuggcgcuauagcucugccuuuacaaauagaaucuucuuugcgaugguggauuucgacgaaggauccgaugucuuucagaugcugaacaugaauagcgcccccaccuucaucaacuuuccugcuaaaggcaagccgaaacgcggggacacauacgagcuccagguucgcggauucucugccgaacagauugcuagauggaucgccgaucggaccgacgugaauauuagagugauccggcccccuaacuaugcgggcccccugaugcuuggccugcuccuggccgucauugggggacuuguguaccugcggagauccaauauggaguuucucuucaacaagacaggcugggcuuucgccgcucuguguuuuguucuggccaugaccagcgggcaaauguggaaucauauccgcggaccucccuaugcccacaagaacccgcauacgggccacgugaauuacauucaugggucuucccaggcucaguucgucgcggaaacccacaucgugcuccuguuuaacggaggcguuacacuuggcauggugcugcucugcgaggccgcuaccagcgauauggacaucgggaaacggaagauuaugugugucgccggaaucggccuggugguccuuuucuuuuccuggaugcugucuauuuucagaagcaaauaucacggguacccuuacuccuuucucaugagcuga

SEQ ID NO: 71789 - RNA, 903 nt, Artificial Sequence
  derived and/or modified sequence opt5 from MAK16__Homo_sapiens__NP_115898
augcagagcgacgaugugaucugggacacccugggcaacaagcaauucugcuccuuuaaaauuagaacaaagacgcagucuuucugucggaaugaguacagccucaccgggcugugcaaccgcuccucuuguccccuugccaauagccaguaugcuacaaucaaagaagagaagggacagugcuaccuguauaugaaagucauugaaagagccgcguuuccucggcgccucugggagagaguucggcuguccaagaacuacgaaaaggcucuugagcaaaucgaugagaaucugauuuauuggccgcgcuucaucagacacaaauguaagcagcgguuuaccaaaaucacacaguaccucauucgcaucagaaagcugacccugaaacggcagcgcaagcucgugccccugucuaagaaaguggaaagacgggagaagcgcagagaagagaaagcccuuauugccgcucaacuggacaacgccaucgagaaggaacuccuggagcggcuuaaacaggauacauauggcgacauuuacaauuucccuauccaugcuuuugauaaggcccuggaacagcaggaggcggaaagcgacuccagcgauaccgaggagaaagacgaugacgaugacgacgaagaggaugucgggaagagagaguucguggaagacggagaaguugaugagucugacauuuccgauuuugaggacauggauaagcucgacgccagcucugaugaagaccaagauggcaaauccagcucugaggaagaggaagagaaggcucuguccgccaaacacaaggggaaaaugccccugcgcggaccucuccagcggaagagagcuuacguggagaucgaauaugagcaggaaacggagcccgucgccaaggcgaaaaccacauga

SEQ ID NO: 71790 - RNA, 1872 nt, Artificial Sequence
  derived and/or modified sequence opt5 from MAK__Homo_sapiens__NP_005897
augaacagauacaccacaaugcggcagcugggcgacgggacguauggaagcgugcucaugggcaaguccaaugagucuggggaacuggucgccaucaaacgcaugaagagaaaauucuacagcugggaugagugcaugaaccuucgggaaguuaagucccugaaaaagcucaaucacgcuaacgugauuaagcugaaagaggugauccgcgaaaaugaccaucuuuauuuuauuuucgaguacaugaaggagaaccuguaucaacucaugaaagauagaaauaagcuguuucccgaaucugucauccggaacauuauguaccagauccugcagggacucgccuucauccacaaacauggcuuuuuccaccgcgacaugaagccugagaaucugcuuuguauggggccggaacuggugaagauugcggauuuuggacucgcuagagagcugcggagccagcccccuuauaccgacuacguuuccacacgcugguacagagcccccgaggugcuucugcggucuagcgucuauuccagcccuaucgaugugugggccguuggcucuauuauggcugaacucuacaugcugcgcccccuguucccuggcaccuccgagguggacgaaaucuuuaaaauuugccaaguccucgggacaccgaagaaaagcgauuggcccgagggauaucagcuggccucuuccaugaacuucagauuuccucagugugugcccaucaaucuuaagacccugauuccuaacgcuagcaaugaagccauccagcucaugacagagaugcugaacugggaccccaaaaagcggccgaccgcgucucaagcccuuaaacauccuuacuuccaggugggccagguccuggggcccuccagcaaucaccucgaguccaagcagucucugaacaagcaacugcagccucucgaaagcaaacccucccugguugagguggaacccaagccucuuccggauaucauugaccagguggucggacaaccccagccuaaaacgagccagcagccccugcaaccuauccagcccccgcagaaccucucugugcagcaaccucccaagcagcagucccaggagaaaccuccccaaacccuguuuccuagcauuguuaagaauaugcccacaaagccgaacggcacccuuucucacaaaagcgggcgcagacgguggggacagacaaucuucaaguccggcgauucuugggaggaacuggaggacuaugacuucggcgcuagccauuccaaaaagccuagcauggggguguuuaaagaaaagagaaagaaagauucucccuuccgccuccccgagccugucccguccggaagcaaucacucuaccggcgaaaacaagucccugcccgccgugacgagccugaaauccgacucugagcucagcacagcuccuaccuccaagcaguacuaucugaaacagucucgguaccuucccgggguuaauccuaagaaggugagccugauugccuccggaaaagaaaucaacccccauacauggagcaaucaacucuuuccuaagucucugggccccgucggggcggagcuggccuucaaaagauccaacgcuggaaaucuuggcagcuacgccaccuauaaccagucuggcuacaucccguccuuucucaagaaagaggugcagagcgcugggcaacgcauucaccuggccccucugaaugccaccgcuucugaauauacauggaacacgaagaccggacggggccaguucagcgggagaacauacaaucccaccgcgaaaaaccucaauaucgucaaccgcgcccagccuauucccuccgugcacggacggacagauuggguugcuaaguauggcgggcauagauga

SEQ ID NO: 71791 - RNA, 462 nt, Artificial Sequence
  derived and/or modified sequence opt5 from MAL__Homo_sapiens__NP_002362
auggcccccgcugccgcgaccggcgggagcacacugccuuccggauucucuguguuuacgacccucccggaccugcuuuucaucuuugaguucauuuuuggcgggcuggucuggauccucguugcuagcucccuggugcccuggccucuugugcagggaugggucauguucgugucuguguuuugcuucguugccacaaccacacugauuauccucuacauuaucggcgcccacgggggagaaaccagcugggucacacuggaugcugccuaucauuguaccgcugcccuguuuuaccucuccgcgucugugcuggaggcccuugcuacgaucaccaugcaagacggcuucacauauagacacuaccaugaaaacauugccgcuguuguguuuagcuauaucgccacccugcucuacgucgugcacgcgguguucucccugauucgguggaagucuagcuga

SEQ ID NO: 71792 - RNA, 462 nt, Artificial Sequence
  derived and/or modified sequence opt5 from MALL__Homo_sapiens__NP_005425
auggccagccccgacccuccggcuaccuccuacgcccccucugaugugccuagcggcgucgcgcuguuccucacaauccccuuugcuuucuuucugccugagcuuauuuucggguuucugguuuggacgaugguggccgccacccacaucguguauccccuccugcagggaugggucauguacgugucccuuacaucuuuccugauuagccucauguuucugcuguccuaucucuucggcuuuuacaagagauucgaaucuuggcggguucuggacagccuuuaucaugggaccacaggaauccuguacauguccgcugccgugcuccaaguccacgcuaccauugugagcgagaaacugcuugauccucgcaucuauuacaucaacucugccgcguccuuuuucgccuuuauugcuacacugcucuacauccugcaugccuucagcauuuauuaccacuga

SEQ ID NO: 71793 - RNA, 6471 nt, Artificial Sequence
  derived and/or modified sequence opt5 from MALRD1__Homo_sapiens__NP_001135780
augcuguucuuucucgacagaaugcuggccuuccccaugaacgagaccuuuugcugucuuuggaucgcuugcguguucaauagcacccuggcccagcagggcacggaauccuuucagugugauaacggggucucucucccuccggacagcauuugcgauuucaccgaccaguguggagauuccucugacgagcggcacugccugaauuacgaaagaugugauuuugaggacggccuuugccauaugacacaggaucaaagccugcagcccuccuggaccaagagaucugggaugaucggacucagcccucccuucuaugaccacaacggcgauguuuccgcgcauuuucugagccuggugucucggguggacuccauuuccucuagccuccgcagcagagucuuccugccuacaaaugaucagcacgacugucagaucaccuuuuacuauuucucuugccaaguguccgggaaacuuaugguuggacugcagacagcuuguggcggccccauucagcaucucuggcagaacaccgccgcccugccuaaucaaugggaacggaacgugaucaagauccagagcucccagcgcuuucaagucguguucgaggggcagauggcuucuacguacgagcaggacgaaguuauugccaucgaugacauuagcuucuccagcggaugccuuccggcuaaugauggcauccugcucugccaggaggcccugaacgcggaaagagagcugugucaccccgacaccgaucucugccgguuugacgccacagaugaggaacugcgccuuugucaggcuugcggguucgaguuugacaugugugaauggaccucugaggccuccgcuggacagauuagcuggaugagaacaaaagcccgggaaaucccugcguucgagucuacaccccaacaggaucaaggcggggacgaugagggauauuacgugugggucggcgccaagcacggcuuuacgcugaaucaucucgacagccgcgcuuaucugaacuccucugugugccacugucuugggaaaagcugccaucugcaguucuacuacgccauggaauccagcgugcucagaguccggcuguauaauaacaaggaggaagagaucuuuuggacauacaauauuucuacccacucccaguggguuaaggcugacgugcugaucccugaagaucucaaaacauucaagauuaucuuugagggaacccugcuuagccagcgcucuuucauugcccuggaccaccucuggguguaugccuguggccaaacccaguccagaaaacugugcagcgcugaugaguuucccuguacauccgggcagugcaucgcgaaggaaucugucugcgacagccggcaggauuguuccgacgagucugaugaagacccggccacgugcagcaaacaucuuaccugugauuucgaguccggauuuugcggcugggaaccuuuccugacagaggacagccacuggaagcucaugaaggggcugaacaacggagagcaucacuuccccgcugccgaucauaccgccaauauuaaccacggcucuuuuaucuaccuggaagcucaaagauccccuggcguggccaaacucgggagccccguucugacaaaacuucugaccgcgucuacgcccugucaggugcaguucugguaucaccucucccaacauagcaaucugucugucuuuacacgcaccagccuggacggaaaccuucagaaacagggcaagaucauucgguucuccgagagccaguggucucacgcuaaaaucgaucucauugccgaagccggggaguccacccugccuuuucaacugauccucgaggcuacagugcugagcuccaaugccaccguugcucuugacgacauuucugugagccaggaaugcgagaucuccuacaagucucugccgagaacaagcacgcaguccaaauucucuaagugugauuuugaagccaacagcugcgacugguucgaggcgaucuccggagaucauuuugacuggauucgcagcucucaguccgaacucagcgccgauuucgagcaccaagcucccccucgggaccacucucugaaugccucccagggccauuuuauguucauccugaagaaauccucuagccuuuggcaggucgcuaagcuccagagccccaccuuuucccaaacagggccuggcuguauucugagcuucugguucuauaacuacggacugucugugggcgccgcggagcuccagcugcacauggaaaauagccaugauuccaccgucaucuggagagugcuuuacaaccaggggaaacaauggcuggaggccacaauucagcucggacgccugucucagcccuuucaccugagccuugacaagguuucccucggcaucuaugauggggugucugcuauugacgauauccgguucgaaaauugcacccugccgcugccugccgagagcugugaaggacucgaccauuuuuggugcagacacacgcgcgcuugcaucgagaaacugcggcuuugugaucuggucgacgacugcggcgauagaaccgacgaggugaacugugcccccgaacuccagugcaauuucgagacagggauuuguaacugggaacaagaugccaaggacgauuuugacuggacccgcucccagggcccuacacccacccugaauacgggaccuaugaaggauaacacacugggcaccgcuaaagggcacuaccuuuauaucgagucuagcgaaccccaggcguuccaggacuccgccgcucuccugagcccgauucugaacgccacagauaccaagggaugcaccuuucgguucuacuaucauauguuuggcaaaagaaucuaccggcucgccauuuaucaacgcaucuggucugacuccagagggcagcugcuuuggcagaucuucggaaaucagggcaaccgguggauuagaaagcaccugaauaucagcucucgccaaccuuuucagauucucguugaggcuuccgugggggauggcuucacaggagacaucgccauugacgaucugagcuucauggacuguacgcuguaccccggcaaccuucccgcggaucugccuaccccgcccgagacauccgucccugugacccugcccccucauaauugcacagacaacgaauuuaucugucggucugaugggcacugcaucgagaaaaugcagaagugugacuucaaguacgauugccccgacaaaagcgaugaggcuuccugcgugauggagguuuguagcuuugagaagagaucucugugcaaaugguaucagccuauucccguccaucuccugcaagacuccaauaccuuccgcuggggacuuggcaacgggaucagcauucaccacggagaagagaaucauagaccgucuguggaucacacgcagaacacaaccgacggcugguaccuguaugccgauagcuccaaugggaaguuuggcgacaccgccgacauccucacaccuauuaucucucugaccggacccaaauguacacugguguucuggacgcauaugaacggcgcuaccgucgggagccuucaggugcugaucaagaaggauaauguuacauccaaacucugggcccaaaccggacagcagggcgcgcaguggaagcgggcugaaguguuucuggggauucgcucucacacacaaaucgucuucagagccaaacggggaauuagcuacaucggcgacguggccguugaugacauuuccuuucaggauugcagcccucuccugucucccgagcgcaaguguaccgaccacgaguucaugugcgcuaacaaacauuguaucgccaaggauaaacuuugcgacuuugugaaugauugugcugacaacuccgaugagacgaccuucauuugcagaacaagcuccggccggugugacuuugaguucgaucugugcucuuggaagcaggaaaaggacgaggacuucgauuggaaccucaaagccagcuccaucccggcggccgggaccgaaccugcugccgaccacacacugggaaauucuagcggccauuauaucuuuauuaagucccuguucccccagcaaccuaugcgcgcugccagaaucagcucucccgucauuuccaaacggagcaagaacugcaaaaucauuuuucacuaccauauguaugggaauggaaucggcgcccuuacccugaugcaagugucuguuacaaaccagaccaaggugcuccugaaucucacggucgagcaggggaacuucuggcgcagagaagaacucucccuuuuuggagaugaggacuuccaacugaaguuugaaggccgggugggcaaagggcagagaggagauaucgcucuggacgauauugugcucacagagaauugucugagccuucacgacucuguccaggaagaacuggcgguuccccucccuaccggcuucugcccgcugggguaccgcgaaugucacaacggaaagugcuaccggcucgagcaaagcuguaauuuuguggauaacugcggcgacaauaccgaugagaacgaauguggguccucuugcacauucgagaaaggaugguguggcuggcagaauagccaggccgacaacuuugacugggugcugggcgucgggucccaucagagccuuagacccccuaaggaucacacccugggaaaugaaaacggccauuucauguaucuggaggcuacggccguggggcuccgcggagacaaagcccacuuucgguccacaauguggagagagucuagcgcugccugcaccauguccuucugguacuucguuucugcgaaggcuacaggcagcauccaaauucugaucaagaccgaaaaagggcuuuccaagguguggcaggagucuaaacagaaccccggaaaucacuggcagaaggccgauauucugcucggcaaacugcgcaacuuugaagucaucuuccaaggcauccggacaagagaccucgggggaggcgccgcuauugaugacaucgaguuuaagaauuguaccacggugggggaaauuagcgagcugugcccugagaucaccgauuuccuuugccgcgacaagaaauguauugccucccaucugcugugcgauuauaagcccgacuguagcgaucggucugacgaagcgcacugcgcucauuacacauccaccacaggaagcuguaacuuugagaccucuuccggcaauuggacgacagccugcagccucacccaggauucugaagacgaccuggauugggccaucgggucccgcauuccugcuaaagcccuuaucccggacagcgaucacacacccggauccggccagcauuuccuguauguuaacagcucuggcagcaaggagggguccguggcucggaucaccaccucuaagagcuuuccugccucccucggaauguguacaguccgcuucugguuuuacaugauugaccccagaucuaugggcauccugaagguguauacgauugaagagagcgggcucaauauccugguuugguccgugauuggaaacaaacggaccggcuggacauacgggucugucccucuuagcuccaauagccccuucaagguggcguuugaggccgaucuggacggaaacgaagauaucuucaucgcucuggacgauauuucuuuuaccccggagugcgugacaggcggcccuguccccguucagcccuccccuugugaagccgaccaauucagcugcaucuacacccuccagugugugccccugucugggaagugcgauggacacgaggacuguauugacggcuccgaugaaauggacugcccucuuagcccgacgcccccucugugcuccaauauggaguuccccuguucuacagaugagugcaucccuagccuccugcugugugacggggugcccgauugccacuuuaacgaagacgagcucauuuguuccaauaaaagcugcucuaacggagcucuugucugugccuccagcaauucuugcaucccggcccaucagcgcugugauggcuucgcugacugcauggauuuucagcuggacgaaagcuccuguucugagugcccucugaacuauugcagaaaugggggaaccugugugguugagaagaacggccccaugugccgguguagacaaggcuggaaagggaaccgcugccacaucaaguucaauccucccgcgaccgauuuuacauacgcccagaacaauaccuggacacuccugggaauuggccuugcuuuccugaugacgcauaucaccguggccguccucuguuuucuggccaaccggaaagugccuauuagaaagacagaagggagcggaaauugcgcuuucguuaaccccguguauggcaauugguccaacccggagaagaccgaaucuagcgucuacuccuuuagcaauccucuguaugggacaaccucuggcucccucgagacgcuuagccaccaccugaaauga

SEQ ID NO: 71794 - RNA, 2475 nt, Artificial Sequence
  derived and/or modified sequence opt5 from MALT1__Homo_sapiens__NP_006776
augagccugcucggcgacccccugcaggcccuuccuccguccgcugcccccaccgggccucugcucgcgcccccugcuggagccacacugaacagacuucgggagccccugcuccgcagacugucugaacugcucgaucaagccccugagggccggggguggcgcagacuggcugaacuugccggaagccggggccgccugagacucuccugccuggaccuugagcaguguucucugaaggugcucgaaccggaggggagccccucccugugccugcucaaacugaugggagagaagggcuguacggucaccgaacuuucugauuuccugcaggcuauggagcacacagaaguucuccagcugcuuagcccucccggcaucaaaauuaccgugaauccugaguccaaggccgugcuggcggggcaauuugucaaacucugcugucgggccacaggacaucccuucgugcaguaccagugguuuaagaugaacaaggagaucccgaauggcaacaccagcgaacugauuuucaaugcuguucacgugaaagacgccggguuuuaugucugccgcgugaacaauaacuucacauuugaguucucucaguggucccaacuggauguuugugacaucccugagagcuuucagagaucuguggauggagucuccgaaagcaagcuccagauuugcguggaacccaccucucagaaacugaugccuggcuccacgcuugugcugcaaugugucgcuguugggagccccaucccccauuaccagugguucaagaaugagcucccucugacccacgagacaaagaaacuuuauauggugccguacguggaccuggaacaucagggaaccuauuggugccacgucuacaacgaucgggacucccaagauucuaagaaaguggagaucauuaucggccgcacagacgaagccguugaguguaccgaagaugagcucaauaaccugggccaccccgacaauaaggagcagacgacagaccagccucuggcgaaagauaagguggcccuccugauugggaacaugaauuauagagaacaucccaaacuuaaggcuccucuggucgacguguacgagcucaccaaccugcugcggcagcuugauuuuaaaguugugagccuccuggaccugacagaauacgagaugcgcaacgccgucgaugaguuccuccugcuucuggacaagggaguguauggccuccuguacuaugcugggcacggauacgaaaauuuuggcaacuccuucaugguccccguggaugccccgaauccuuauagaagcgagaacugccugugcguucaaaauauccuuaagcucaugcaggaaaaagagaccgggcugaacguguuccugcucgacaugugucggaagagaaaugauuacgacgauaccauucccauccuggacgcccuuaaagucacagcuaacauuguguuuggauaugcgacgugccagggcgccgaggcuuucgaaauccagcauucuggccuggccaaugggaucuuuaugaaguuccucaaagaccgccugcuggaggauaagaagauuaccguucuucucgacgaaguggccgaggauaugggaaaaugucaccugacaaagggcaaacaagcucuggaaauccgguccagccucucugagaagagagcccugaccgacccuauucaggggacagaauacagcgcggagucccuuguccgcaaccugcagugggcuaaagcccacgagcuccccgaaucuaugugccugaaguuugauuguggagugcagauccaacugggcuucgccgcugaguuuagcaaugugaugauuaucuacaccuccaucguuuauaagccucccgaaauuaucaugugcgacgccuacgucacggauuucccgcuugaccucgauauugacccuaaagaugcuaacaaggggacacccgaggaaaccggcagcuaucuggugucuaaagaccugcccaagcauugucucuacacccggcuguccagccuucagaaacugaaggagcaccucguguuuacagucugccugucuuaucaguacuccggacuggaggauaccguggaagacaagcaggagguuaaugugggcaaaccucuuaucgccaagcuggacaugcauagagggcucggacgcaaaacauguuuccaaacgugccugaugagcaacggcccguaucaguccucugcggccaccagcgggggagcuggccacuaccauucccuccaggaucccuuucacggggucuaccacucucauccuggcaaucccagcaacgugaccccugccgacuccugucacugcagccggacacccgaugcuuucauuucuuccuuugcccaucacgcgagcugccacuucucuagauccaacguuccuguggaaacaaccgacgagauccccuucagcuuuucugaucgccugcggaucagcgaaaaguga

SEQ ID NO: 71795 - RNA, 3051 nt, Artificial Sequence
  derived and/or modified sequence opt5 from MAML1__Homo_sapiens__NP_055572
auggugcugccuaccugccccauggccgaguucgcucucccgagacacagcgccgucauggaacggcugcgcagacggaucgagcuuugucgcagacaucacuccacaugcgaagcgcgguacgaggcuguuucucccgaacgccuggagcucgagagacagcauacguuugcccugcaccaacgguguauucaggccaaggcuaaacgcgccggcaagcauagacagccucccgcugccaccgcgccugcccccgcugccccugcuccgcggcuugacgccgcggaugggcccgaacacggacgcccugccacacaucugcacgacaccgugaaaagaaaccucgauagcgcuacaucuccccagaauggcgaccaacagaacggguauggagaucuguucccuggccacaagaaaacccggcgcgaggcuccccuggggguggcuaucuccagcaauggacucccgccugccucuccccugggccaguccgacaagccuagcggcgccgaugcccuucaguccagcgggaagcauucucugggacucgacucccugaacaaaaagagacuugcggauagcucucugcaccucaauggcggguccaaccccagcgaaucuuuuccccugucccugaauaaagagcucaagcaagagccugucgaagaccugccgugcaugauuacaggaaccgugggcagcaucucccagucuaaccuuaugcccgaucugaaucucaacgagcaggaauggaaagagcugauugaggaacuuaaucggagcguuccugacgaggauaugaaggaccuguucaacgaagacuuugaggaaaagaaagaucccgaguccagcgggucugccacgcagaccccucucgcucaagacaucaauaucaagacagaguucucccccgccgccuuugaacaggagcagcugggaagcccgcaagugagagcuggcucugccggccagaccuuccuggggccuagcuccgcgcccgucucuacagauagcccuucccucggaggcagccagacccuguuucacacgucugggcagccccgcgcugacaacccuucccccaaucuuaugccggccagcgcccaagcucagaacgcccagcgggcucuggccggagugguucucccuucucagggccccgggggagcguccgaacugagcuccgcccaucaacuucagcagauugcugccaaacagaagagagagcaaaugcugcagaacccccagcaggcuaccccugccccggcgcccggccaaaugucuacauggcagcagacaggcccuagccacuccucucucgaugugcccuacccuauggaaaaacccgccagcccuuccagcuauaagcaagacuucaccaauucuaaacugcugaugaugcccuccgucaacaagagcucuccgcgcccugggggacccuaccuccagccuucccaugugaaucugcuuagccaccagcccccgucuaaccugaaucagaacagcgcuaauaaccaaggcuccgugcucgauuaugggaauaccaagccucugagccauuacaaagccgacuguggacagggcucucccggguccggccagagcaagccugcucugauggccuaucuuccccagcaacucucccacaucucucacgagcagaacagccuguuucugaugaaacccaagccuggaaauaugccguuccggucccucguucccccuggccaggaacagaaccccucuagcgucccugugcaagcccaggcuacauccguggggacgcagcccccugcggucucuguggccagcucccauaauagcucuccguaccuguccagccaacagcaggcugccguuaugaaacagcaccaacuucugcucgaucagcagaagcagagagagcaacagcagaagcaucugcagcaacagcaguuucugcagcgccaacagcaccuucucgccgagcaggaaaaacaacaguuccagcggcaccugaccagacccccuccccaguaccaagacccuacacagggaucuuucccccaacaggugggccaauuuaccggguccagcgcugccgucccgggaaugaacacacugggcccuucuaauuccagcugcccccgcguguucccccaggcggggaaccucaugccuaugggccccggacaugcuuccguuagcucucugccuaccaacagcggccagcaggauagagggguggcccaauuuccgggaucccagaauaugccccagucuagccuuuauggcauggccuccgggauuacgcaaaucgucgcucagccucccccucaggccacaaacggacacgcgcauauuccccggcagaccaaugugggccaaaacaccucugucagcgcugccuacgggcaaaauucccugggcucuagcggacucucccagcagcacaacaagggcacacugaauccggggcugaccaaaccucccgugccucgcguuagccccgccaugggaggccagaacucuuccuggcagcaucaggggaugccuaaucuuagcggacagacacccggcaacucuaauguguccccguucacggcugccagcuccuuucacaugcaacagcaggcucaccucaagaugucuagcccucaguucucccaagccguccccaaccggcccauggcgccuaugagcucugccgcugccguggggucccugcugccgcccguuagcgcucagcagagaaccucugccccugcccccgcuccucccccuacagcgccgcaacagggccuccccggacugagcccugccggccccgagcuuggggcuuuuucccagucuccugccagccagaugggaggccgggccgggcugcauuguacccaggcuuaucccgugcgcacagccggacaggaacucccguucgcguacuccggccagccuggcgggucuggacugagcuccgucgcuggccacaccgaccugaucgacagccuucucaaaaauagaacgucugaggaguggauguccgaucuggacgaucugcucgggagccaguga

SEQ ID NO: 71796 - RNA, 3471 nt, Artificial Sequence
  derived and/or modified sequence opt5 from MAML2__Homo_sapiens__NP_115803
augggcgacaccgcucccccucaggccccggccgggggacugggcggggcgagcggagcuggccuccuugggggaggcuccgugacacccagaguccacucugccaucguugagcggcugcgcgccagaauugcugugugccggcaacaucaccugagcugugaaggccgcuacgagagagggcgggccgaauccucugaucgcgagagagaaagcacgcuccagcugcuuucccuggugcagcauggacagggcgcucggaaggccgggaaacacaccaaggcgacagccaccgcugccacaaccacagcuccucccccucccccugccgcgccgcccgccgcuucucaagccgcugccaccgccgcuccucccccucccccggacuaucaucaccaccaucagcagcaccuccugaacagcuccaauaacggaggcagcgggggaaucaauggcgagcagcaaccucccgcgucuacgccuggcgaucagcgcaacuccgcccugauugcucuccaggggagccugaaaagaaagcaggucgugaaucuuucucccgccaacuccaaacggcccaauggauucguugacaacagcuuucuggauaucaagcgcauuagagugggcgagaaucucucugccgggcaaggaggccugcagaucaacaaugggcagucccaaaucaugagcggaacccuuccuaugucccaggcuccgcugcggaagacaaacacccuccccucucauacacacagcccuggcaauggccuguucaacauggggcugaaagaagucaagaaagagcccggagaaacccucuccugcagcaagcacauggacggccagaugacgcaggagaauauuuuuccuaaccgcuacggggaugaccccggagagcaacugauggauccggaacuucaggagcuguucaacgaacucacaaauaucucugugccucccauguccgaccuggagcuugaaaacaugauuaaugccaccaucaaacaggaugacccuuuuaacauugaucugggccagcaaagccagagaucuacaccccggccuagccuccccauggagaagaucguuauuaaguccgaguauucuccggggcugacccagggcccuagcggaagcccccagcugagacccccuuccgcgggcccggcuuucucuauggccaauuccgcccucagcaccucuucccccaucccuagcgugccccaaucccaggcucagccucagacagggucuggagccagccgcgcucugcccuccuggcaagaagucucucaugcccagcagcuuaaacaaaucgcggccaaccggcagcagcacgcuagaaugcagcaacaucagcagcagcaccaaccuacgaauuggagcgcccugcccuccagcgcuggcccgucuccugggcccuuuggacaggagaagauuccuucccccagcuucggccagcagaccuuuucuccgcaauccagcccuaugcccgggguggccggcggaucuggccagagcaaagugauggcgaacuacauguauaaggccgggccuuccgcucagggaggccaucucgacguccugaugcaacagaaaccccaggaccuuagccgcucuuucaucaauaacccccacccugccauggaaccgcggcaggggaauacaaagccccuguuucacuucaacuccgaucaagcuaaucagcagaugccuagcguucuccccucccagaacaaaccuucucugcugcauuacacccaacagcagcagcaacagcagcagcaacagcagcaacagcagcagcaacagcagcagcaacagcagcagcaacagcagcaacagcagcagcaacagcagcagagcuccauuucugcccaacagcagcagcaacagcagagcuccaucucugcccagcaacagcagcaacagcagcagcaacagcagcagcaacagcagcagcaacagcagcaacagcagcagcaacagcagcagcccagcucccaaccugcucagagccucccgucucagccccugcuuagauccccucugccccuccagcaaaagcugcugcuucagcagaugcaaaaucagccuauugcgggaaugggcuaucaggugagccagcaacagcgccaggaccagcacucuguggucgggcaaaacacaggccccuccccgagcccuaaccccuguucuaaucccaacaccggauccggcuacaugaauagccagcagucccuccugaaccagcaacugauggggaagaaacagacgcuccagcggcagaucauggagcaaaagcagcagcugcuucugcaacagcagaugcucgccgaugcugagaaaaucgccccucaggaccaaauuaauagacaucugagccggcccccuccggauuacaaggaccagcgcagaaacgugggaaauaugcagcccacagcccaguauucuggcgggagcuccaccaucucucugaacagcaaucaagcucuugccaacccuguuuccacccacacaauucucacccccaauucuagccugcuguccacaucucacggaacgcgcaugccuagccucuccaccgcggugcagaacaugggcauguacgggaaucugcccugcaaccagccgaauacauauagcgucaccucuggcaugaaccagcuuacacaacagcggaacccuaaacagcugcucgcuaaucaaaacaaucccaugaugccuagacccccuacccugggacccuccaacaauaacaauguggccacguuuggcgccgggagcguuggaaacucucagcagcugcggccgaaucuuacccauuccauggcuagcaugccuccccagcgcacauccaacgugaugaucaccucuaauacaaccgcccccaacugggcgagccaagaaggcacguccaagcagcaggaggcucucacaagcgccggggucagauucccuaccggaacaccggccgcuuacacccccaaucagucucugcaacaggccgugggcucccagcaguucagccaacgggcugucgccccucccaaccagcugaccccugcggugcagaugagacccaugaaucagaugucucaaacacucaacggccagacgauggggccucugcgcggacuuaaccugcggccgaaucagcucagcacccaaauucugcccaaccugaaucaguccggcacagggcuuaaccagucuagaaccggaaucaaucagccucccagccucacaccuuccaacuuucccucuccgaaucaaagcucccgcgccuuccagggcaccgaucacagcucugaccuggcuuuugauuuccugucccagcagaacgacaauauggggccugcccucaacagcgaugcugacuuuaucgacucccugcuuaagacggaacccggaaaugaugacuggaugaaagauauuaaccuggacgagauccucggcaauaacucuuga

SEQ ID NO: 71797 - RNA, 3402 nt, Artificial Sequence
  derived and/or modified sequence opt5 from MAML3__Homo_sapiens__NP_061187
augggcgacuucgccgcucccgccgcggcugccaacgggagcuccaucugcauuaauucuagccugaacuccucucucggaggcgccgggaucggagugaauaacaccccuaauagcacaccggcugcccccuccucuaaccacccugcugccggcggguguggaggcagcggcgggcccggaggcggguccgcggccgucccuaagcauagcacgguuguggagagacugcggcagcgcauugaaggaugcagacggcaccaugugaauugugagaaccgcuaccaacaggcucaggucgaacagcuugagcuggaaagacgggauaccgugucucucuaucaacgcacacuggagcagagagccaaaaaguccggcgcugggaccggaaaacagcagcaccccagcaagccucaacaggacgccgaggcggccucugcugaacagcggaaucauacacuuaucaugcugcaggagaccguuaaacgcaagcucgaaggcgccagauccccgcugaacggcgaucaacagaauggggcuugcgacggaaacuuuagccccacaucuaagcggauucgcaaagauaucuccgccggcauggaggccaucaauaaccugccuagcaauaugccccucccuuccgcuucuccccugcaccagcuugaccugaagccgagccucccucugcaaaacuccgggacccacacgcccggacuucuggaggaucucagcaaaaacggcagacugccugaaauuaagcugcccgugaauggguguucugaccucgaggauuccuucaccauccugcagagcaaagaccuuaagcaggaaccccuggaugacccuacaugcauugauaccucugagacaagccucuccaaccagaauaagcuguuuucugacaucaaccuuaaugaccaagaauggcaggagcugauugaugagcucgcgaacaccgucccggaagacgauauccaggaccuguucaaugaggauuuugaagagaaaaaggaacccgaguucagccagccugccacggagacaccccugucccaagaaagcgcuucugugaaauccgacccuagccauucucccuuugcccacguuuccaugggaagcccgcaggcccggccuuccucuagcgggcccccuuucuccaccgugucuacagcuaccagccuccccuccgucgccagcaccccugcggcucccaacccggccucuuccccugccaauugugcugugcagagcccccagacacccaaccaagcccauacgccuggccaggcuccgccccgcccuggcaauggauaccugcuuaaccccgccgcggugaccgucgccggcucugcuuccgggccuguugccgugcccagcucugauaugagcccugcugagcagcugaagcagauggccgcgcaacagcagcaaagagccaaacucaugcagcagaagcagcaacagcagcagcaacagcagcagcaacagcagcaacagcagcagcaacagcagcagcaacacuccaaucagacaagcaacuggucuccccugggaccgccuuccagccccuauggcgcugccuuuaccgcugaaaaaccuaauucccccaugauguacccgcaggccuucaacaaccagaauccuauugugcccccuauggccaacaaucuucaaaagacaaccaugaacaauuaucugccccagaaccacaugaauaugaucaaccagcagcccaauaaccucgggacaaauucucugaacaagcaacauaauauccugacguacggcaacaccaaaccucucacccacuuuaaugcugaccugagccagcggaugacaccgcccgucgcgaacccuaacaagaauccccuuaugccuuauauucagcaacagcagcagcaacagcagcagcaacagcagcagcaacagcagcaacagcccccuccgccccagcugcaggccccuagagcucaucucuccgaggaucaaaaacgccugcugcuuaugaagcagaaaggagugaugaaccagcccauggccuacgccgcucucccuucucacggccaggaacaacaucccguugggcugccgcggaccacaggaccuaugcagagcuccgugccucccggcucugggggaauggucagcggcgccucccccgcggggcccggcuuccugggaagccagccucaggcugccaucaugaagcaaaugcucauugaccagagagcccagcugaucgagcagcaaaagcagcaguuucuucgcgagcaacggcagcagcagcaacagcagcagcaaauucuggcugaacagcagcuccagcaaucucaccucccgagacagcaucugcagccccaacgcaauccuuaccccgugcagcagguuaaccaguuccaaggcuccccucaggauaucgccgcggugcggagccaggcugcccuucagucuaugagaacgucccgccucauggcccaaaaugcugggaugaugggaaucggccccagccagaacccggggaccauggccacagcugccgcgcagucugagaugggacuggccccuuauuccaccacacccaccagccagccuggcauguacaauauguccacggggaugacccaaaugcugcagcaccccaaccagagcggcaugucuauuacacacaaucaagcucagggaccucggcagcccgccagcggccagggggucggaaugguguccggcuucgggcaaucuaugcucgucaacagcgcuaucacccagcagcauccgcagaugaaaggaccugugggccaagcccugcccagaccccaggccccuccgcgccuucagucccugauggggacaguucagcaaggcgcucagucuuggcagcagcggagccuccaaggaaugcccggcagaaccuccggggaacugggaccuuuuaauaacggcgcgucuuauccccugcaggccgggcagccucggcuuacgaagcaacacuucccccagggacucagccaguccguggucgacgcuaauacaggcaccgugcgcacacugaacccugccgccaugggcagacagaugaugccgagccugcccgggcaacagggaaccucucaggcucggccuaugguuauguccggccucagccagggggugcccggaaugccugccuuuucucaacccccggcgcagcagcagauuccuuccggcagcuucgcucccuccucucaaagccaggccuacgagagaaaugcuccccaggacgucuccuauaacuacagcggggauggagccggcggcucuuuuccugggcugcccgacggagccgaucuuguggacuccaucauuaaaggcgggccuggagaugaguggaugcaagaacuggacgagcuguucggcaacccguga

SEQ ID NO: 71798 - RNA, 2997 nt, Artificial Sequence
  derived and/or modified sequence opt5 from MAMLD1__Homo_sapiens__NP_001170936
auggacgauuggaaguccagacuggugaucaaauccaugcucccccacuucgccauggucggcaaccggcaggagccucgcaagcugcaagaaucugggaccguuaaaagacggcaggaggaagaccauuuucaguucccggauauggcugacggaggcuaccccaauaagauuaaacgcccuugccuugaggaugugacacuggccauggggcccggagcgcacccuagcacggcuugugccgaacuccaggugcccccucugaccaucaacccgucccccgccgcuaugggcgucgccgggcaaucucuucugcucgagaauaacccuaugaauggaaacauuaugggcagccccuuugugguuccucagacaaccgaggugggccugaaggggcccacagucccguauuacgaaaagaucaauuccgugccugcuguugaccaggagcugcaggaacuccuggaggagcuuaccaaaauucaagaucccucuccuaacgaacuggaccucgagaagauccugggaacaaaacccgaggaaccccuugugcuggaucauccucaggccacccucagcacgaccccgaagcccuccguccagaugagccaccuggaaucucuggcguccagcaaagaguucgccucuuccugcagccaggugacaggcaugucucuccaaaucccuuccagcuccaccgggauuucuuauagcauccccuccacaagcaagcagauugugucuccuuccagcucuauggcucagagcaagucccaaguccaggccaugcugcccguugcgcuuccgccucugcccgugccucaguggcaucacgcccaccagcucaaagcgcuggccgcuucuaagcaaggaagcgccaccaaacagcagggccccacgccuuccuggagcgggcuucccccgccuggacugucuccucccuacagacccgugccgagcccccauccucccccucucccccugccucccccgccucccccuuuuagcccccagucucugauggucuccuguaugagcuccaauacacucucuggcagcacccugcggggcuccccgaacgcccuucugucuagcaugacauccagcucuaaugcugcccucgggccugcuaugcccuaugcgccugagaagcugcccucccccgcccuuacccaacagccucaguucggaccgcagagcucuauccuggcuaaccucauguccagcaccauuaaaacaccccaaggccaccugaugucugcccugccugccagcaaucccgggccuuccccucccuaccgcccggaaaagcucagcucucccggacugccucagcaguccuuuacgccccagugcagccuuaucagaucccugaccccuacaucuaaccuccugagccaacagcagcaacagcagcagcaacagcagcaggcuaaugugauuuucaaacccaucuccucuaacagcuccaagacccugucuaugaucaugcaacagggcauggccagcuccagcccgggggcgacagagccuuuuaccuucggaaacacgaagccccuuucucauuuuguuuccgaacccggcccucagaaaaugcccagcaugccuacaaccucucggcagccgucccuccugcacuaucugcaacagcccaccccuacacaggcuagcucugccaccgccuccagcacagcuacggccacccuccaacugcagcagcagcaacagcagcagcaacagcagcccgaccacuccagcuuccuucugcagcaaaugaugcagcagccucagcgcuuucaaagaucuguggcuagcgauuccaugcccgcccucccgcggcagcaggaggaacaacgcucuggccugauggcgaugacaccugagagacagaaugccuacauuagccagcagaugucccccuucgaggcuguccaagaacaggugaccucuaaguguagccggaucaaagccuccccucccucuagcaagcaucugaugccuccccgcacagggcuucuccagaacaaucuguccccgggaaugauuccucugaccagacaccagagcugcgagggcauggggguuaucucucccacgcucggaaaacggcaaggcauuuucaccuccagcccccaguguccuauccugucucauuccgggcagacaccgcuuggcagacuggacagcgugugccagcacaugcaaucccccaaggcuaccccucccgaagucccucuccccggauuuuguccuucuagccugggcacacagucccugagcccgcaucagcuucgccggcccucugugccuagaaugcccaccgccuucaacaaugcggccugggucacggcugccgcugccgugacaaccgccguuuccgggaagacaccucucagccaaguggauaacucuguccagcagcacagccccuccggacaggcuugccugcaacgcccgucugacugggaggcucaggugccugccgcuaugggcacccagguuccccuggccaauaaccccagcuuuucccuccuggggucucagagccuucggcaauccccugugcagggacccgucccuguggccaauaccacaaaauuccugcagcagggcauggcuagcuuuucuccgcucucccccauccaagggauugaaccucccagcuacguggccgcggcugccacggccgcugccgcguccgcuguugccgccucucaguucccuggccccuuugacagaaccgauaucccgccugagcugcccccugcugacuuccugcgccagccccagccuccccuuaacgaucucauuagcuccccggacuguaaugaggucgauuuuaucgaagcccugcugaagggaucuugcgugagcccugacgaggauugggugugcaaccuccggcugauugacgauauccuugaacaacacgcugccgcgcagaaugccacagcucagaacuccggccaagucacccaggacgccggggcucuguga

SEQ ID NO: 71799 - RNA, 1962 nt, Artificial Sequence
  derived and/or modified sequence opt5 from MAN1A1__Homo_sapiens__NP_005898
augcccgugggcgggcugcucccucuguucagcuccccggccggaggcguccuugggggaggccugggaggaggcggcgggagaaagggaucuggccccgcugcccuccggcugaccgagaaauuuguucuucugcucguguucagcgcguuuaucacacugugcuucggggcuauuuucuuccugccugacuccucuaagcuccugagcggagugcuuuuucacuccucucccgcccugcagccugccgcugaucauaaacccggcccuggggcccgcgcugaagacgccgcggaggggagagcccggcgcagagaagagggcgcuccgggcgaucccgaagccgcucucgaggacaaccuggcccggauccgcgagaaucacgaaagagcgcuucgggaggccaaggaaacgcugcaaaaacucccugaggagauucagcgcgauauccugcuggaaaagaagaaagucgcucaggaccagcucagagauaaggcccccuuccgggggcugccucccguggacuuuguuccgccuauuggaguggagagccgcgaacccgcugaugccgccaucagagagaaacgggcuaagaucaaagaaaugaugaagcaugcguggaacaauuacaagggcuaugccugggggcuuaacgagcugaaaccuauuuccaagggaggccacucuucuucccucuucgggaauaucaaaggagcuaccauugucgacgcccuggauacacuuuuuaucauggagaugaagcaugaauuugaggaagccaaaagcuggguggaggaaaaccuggacuuuaauguuaacgcugagauuucuguguucgaggucaauauccgcuucgugggcggccuccuguccgccuacuaucugagcggggaagagauuuuuagaaagaaagcgguggaacucggagucaagcugcuucccgcuuuccacacccccucuggcaucccuugggcccugcucaacaugaaguccgggaucggacggaauuggccgugggccagcggcggguccucuauucuggcugaguuuggcacacuucaccuggaguucaugcaucucagccaccuguccggaaaccccaucuuugccgaaaaaguuaugaauauuagaaccgugcugaacaagcucgagaaaccucaaggccuguaccccaauuaucuuaacccuagcucugggcaguggggacagcaucacguguccgucggcgggcugggagauagcuucuacgaauaucuccugaaggcuuggcugaugucugacaaaacagaccuugaggccaagaagauguacuuugaugcggugcaggccaucgaaacccaccucauucgcaaaagcuccucuggccugacguacaucgcugaguggaaagggggccugcucgagcauaagaugggacaccugaccuguuucgccggcgggauguuugcucuuggagccgacgcggcccccgaaggcauggcucaacauuaucuggagcucggggccgaaaucgcucggacaugccacgagagcuacaacagaaccuucaugaagcugggaccggaagccuuucgcuucgauggcgggguugaggccauugcuacacggcagaaugagaaauauuacauccugagaccugaagugauggagaccuauauguacauguggcgccuuacgcaugaccccaaguaucggaagugggcgugggaagccgucgaggcucucgaaaaccacuguagagugaauggcggauacuccggccugcgcgauguuuaccugcuccacgagagcuaugacgaugugcagcagagcuuuuuccuggccgagacacuuaaauaccuguaucucauuuucuccgacgaugaccugcugccucuugaacauuggaucuuuaacagcgaggcccaccuccugcccauucugccuaaggauaaaaaggaagucgagauccgggaagaguga

SEQ ID NO: 71800 - RNA, 2100 nt, Artificial Sequence
  derived and/or modified sequence opt5 from MAN1B1__Homo_sapiens__NP_057303
auggccgcuugcgagggcagacggagcggggcccugggauccucucagagcgacuuccucacacccccugugggcggggcgccgugggcugucgccaccacgguugugauguaucccccucccccucccccuccgcaccgcgauuuuaucuccgugacccugucuuucggagaaaacuacgacaauagcaaguccuggagacggcgcucuuguuggagaaaauggaagcaacuuagccggcugcagcgcaacaugauucucuuucugcuugccuuccugcucuuuugcggccugcuguucuacaucaaucucgcugaucauuggaaagcccuggcuuuuagacuugaggaggaacagaagaugcggcccgaaauugccgggcugaaaccugcgaaucccccuguccuccccgccccgcagaaggcugacacagauccugagaaccugcccgagaucuccagccaaaagacccagcgccacauucagagaggaccuccccaucuucagauccggcccccuucucaagaccugaaagauggcacacaggaagaggccaccaagcgccaggaagcuccgguggaccccagaccugagggcgauccccagcggacaguuaucuccuggcgcggggccgugauugagccugaacaaggaaccgagcuccccagcagacgggcggaagucccgacgaaaccuccccugccucccgccagaacccagggcacaccugugcaccugaacuaucgccagaaggggguuaucgacguguuccuccaugcuuggaaaggauaccggaaguuugccuggggccacgaugagcugaagcccgucucuagauccuucagcgaaugguuugggcuuggacugacccucauugacgcucuggauacaauguggauccuuggccugcgcaaagaguucgaggaagcccggaagugggugucuaaaaagcuccacuuugagaaagacguggacgucaaucuguucgaauccaccauuagaauccugggcgggcuccugagcgccuaucaucuuuccggagauucucuguuccuccgcaaggcugaggacuuuggcaaccggcugaugccggcguucagaacgccuagcaaaauucccuacuccgauguuaauaucgggacaggaguggcccaucccccucgcuggaccagcgacucuacaguggcugaagucaccuccauccaacuugaguuucgggagcugagcagacucaccggcgauaagaaguuccaggaagccguggagaaaguuacacagcacauucacgggcugucuggaaagaaagacggccuggugccgauguuuaucaacacgcacagcggccucuucacccaucugggggucuuuacacuuggagcccgcgcugauuccuauuacgaauaccugcucaagcaguggauucaaggcgggaaacaggagacccagcugcuggaagacuauguggaggccaucgagggaguucggacacaccuucucagacauucugaacccagcaagcugaccuucgugggcgagcuggcgcacgggcgguuuuccgcuaagauggaucaucucgucuguuuccugccuggcacgcuugcccugggaguguaccacggccuccccgccagccacauggaacuggcucaggagcugauggagacaugcuaucaaaugaaucgccagauggaaaccgggcuuucuccugagauuguccauuuuaaccucuacccccagccuggaagacgggacguggaaguuaaacccgccgauagacacaaucugcugcgcccggagaccguggaaucccucuucuaucuguaccgggucacaggcgacagaaaguaucaggacugggggugggagauccuucagagcuuuucucgcuucaccagagugccuuccggaggcuacagcuccaucaacaauguucaagauccccagaaaccugagccccgggacaagauggaaucuuucuuucugggggagacacucaaauaccuguuccugcuuuuuagcgaugacccgaaccuccugucccuggaugcuuauguguucaacacggaagcccauccucuccccauuuggaccccugcguga

SEQ ID NO: 71801 - RNA, 3435 nt, Artificial Sequence
  derived and/or modified sequence opt5 from MAN2A1__Homo_sapiens__NP_002363
augaagcugagcagacaguucaccguguuuggcuccgccaucuucugcgucguuaucuuuucucucuaccugaugcuugaccgggggcaccuggauuauccccgcaacccuagacgggagggcagcuucccgcaaggacagcucuccaugcugcaggagaaaaucgaccaucuugaacgccugcucgcugaaaauaacgagauuaucucuaauauuagagauagcgugaucaaccuguccgaaucuguggaggacgggcccaagagcucccagagcaauuuuucucaaggagccggcucccaucugcucccuagccagcugucucuuuccgucgauacagcggacugucuguucgcuagccagucugggucccacaacagcgaugugcagaugcucgacguuuacucccugaucucuuuugauaaucccgacggaggcguguggaaacaaggcuucgauauuacguaugagagcaacgaaugggacaccgagccucuucaggucuuugugguuccccacucccauaaugauccuggguggcugaagacauucaacgacuacuuucgggacaaaacccaguauaucuucaauaacauggugcucaagcugaaggaagauagccgcagaaaauuuauuuggucugagaucuccuaccugagcaaguggugggacauuaucgauauucagaaaaaggacgccgucaaaucucucaucgagaauggacaacuggaaaucgugacaggcgggugggugaugccggaugaggccacaccccacuauuucgcucuuauugaccagcugaucgaaggacaccaguggcucgagaacaauauuggcgucaagccucggagcgggugggccaucgaucccuucggacauuccccuaccauggcuuaccugcuuaaccgcgccggccugucucacaugcucauucaaagaguucauuacgcggugaagaaacacuuugcccugcacaagacccuggaguucuuuuggcggcagaacugggaccucggcagcgugacggauauccugugccauaugaugcccuucuauuccuacgacaucccgcacaccugugggccugaucccaaaauuugcugucaguuugacuucaagcgccuuccuggaggcagauuugggugccccuggggagugcccccugaaacaauccauccgggcaauguccagagccgggcucgcaugcugcucgaccaauaucggaaaaagucuaaacuguucagaaccaagguucuucuggcuccccucggggaugacuuuagauacugugaguauacagaaugggaucugcaguucaagaacuaccagcagcuguuugacuauaugaacucccaaagcaaauucaaggugaaaauucaguuuggaacccucucugauuucuucgacgcccuggauaaggccgacgagacgcagcgcgauaaaggccaguccauguuuccuguccuuagcggcgacuucuuuacauacgcggaucgggacgaucacuacugguccggguauuucaccucuagacccuuuuacaagcgcauggaccggaucauggaaagccaucugagagccgcugagauucucuauuacuucgcccugcgccaagcucacaaguauaaaaucaauaaguuucuguccucuagccuuuacacagcccucaccgaagcccggagaaaucugggacuguuccagcaccaugacgcuaucaccggcacagcgaaagauugggugguuguggacuaugggacgcgccucuuucacucccugaugguccuugagaagauuaucggaaacagcgccuuccugcucauucugaaagauaagcugaccuacgacucuuacuccccugauacauuucuugagauggaccucaagcagaaaagccaggauucucugccccaaaagaauaucauucggcuguccgcugaaccgagauaucucguggucuacaacccucuggagcaggaccgcaucagccuugugucuguuuaugugagcucccccaccguccagguguucagcgccucuggcaaaccuguugaagugcaagucuccgccgugugggauacagcuaauaccauuagcgagacggccuacgaaaucuccuuucgggcgcauauucccccucuggggcucaagguguauaaaauucuggagucugcuagcuccaacucucaccuggccgacuacguucuuuauaagaauaaggucgaggauagcggcaucuucacaauuaaaaacaugaucaauaccgaagagggaauuacccucgaaaacuccuucgugcugcugagauuugaccagacaggccucaugaagcagaugaugaccaaagaggaugggaagcaccaugaggugaauguccaguucucuugguacggaacaacgaucaaacgggacaagagcggcgccuaccuguuucuucccgacgggaacgcuaaaccguauguguacaccacaccucccuucguucgcgugacccacggaagaaucuauuccgaagucacaugcuuuuucgaucaugugacccaccggguuagacuguaccauauucaaggcaucgaggggcagagcguggaagucucuaacauuguggacauccgcaagguuuauaaucgggagauugccaugaagaucuccagcgauaucaaaucucagaacagauuuuacacggaccucaauggcuaucagauucaaccccgcaugacccuguccaagcugccucuucaggcuaacguguacccgaugacaaccauggccuacauccaggaugcgaaacacagacucacacugcugagcgcccagucucucggagucuccagccuuaauuccggccaaauugaagugaucauggaccggcgccugaugcaggaugacaacagagggcuggagcagggcauucaagauaauaagaucaccgcuaaccucuuccggauccugcuggagaaacgcagcgccgugaauacggaagaggaaaagaagucugucagcuaucccucccuucugucucacauuacaagcucccucaugaaccauccuguuauccccauggcuaauaaauuuucuagcccuacccuggagcuccagggagaguucucuccccugcaguccagccuuccuugugacauucaccuggugaaccucagaacaauccaguccaagguggggaauggacauagcaacgaagccgcgcugauucugcaccggaaaggcuuugauugccgcuucucuuccaaggggaccggccuuuucuguagcaccacacaaggaaaaauccugguccagaagcuccugaauaaguuuauuguggagucucucacgcccuccagccugucccuuaugcauucuccgccuggcacccagaacaucagcgaaaucaaccugucccccauggagauuagcacauucagaauccagcuccgguga

SEQ ID NO: 71802 - RNA, 3453 nt, Artificial Sequence
  derived and/or modified sequence opt5 from MAN2A2__Homo_sapiens__NP_006113
augaagcugaaaaagcaggucaccgucugcggcgccgcuaucuucuguguugccguguuuagccucuaccugaugcuugacagagugcaacacgaucccacacggcaucagaacgggggaaauuucccucgcucccagauuucuguccugcagaacagaaucgagcaacucgaacagcugcuugaggaaaaucacgagauuaucagccauauuaaagacuccgugcuggaacucacggcgaacgcugagggcccgcccgccaugcugccuuauuacaccguuaaugggucuuggguggugcccccugagccccggccuagcuuuuucuccaucucuccgcaggauugccaguuugcccugggaggccgcgggcaaaagcccgaacuccagaugcugacagugagcgaggaacuuccuuucgacaacguugauggaggcguguggagacagggcuuugacaucuccuaugauccccacgacugggaugcugaggaccugcaggucuucguggugccucauagccacaaugaucccggguggauuaaaaccuuugacaaguacuauacagagcaaacccagcacauccucaacucuauggucuccaagcugcaggaagauccgcggcgcagauuccuuugggccgagguuagcuuuuucgcuaaauggugggacaauauuaacgugcaaaagcgggccgcggugcgcagacuggucggaaauggccagcucgaaaucgccacagggggaugggugaugccugacgaggcuaacucucauuacuuugcccugauugaucagcugaucgaaggccaccaguggcucgagcggaaucugggggcuacccccagauccggaugggccguugacccuuucggcuauagcucuacgaugcccuaccuucugagacgggcgaaccucaccuccaugcugauucaacgcgugcauuacgccaucaaaaagcacuucgcugccacacacagccuugaguuuauguggagacagaccugggauuccgacucuagcacagauaucuucugucauaugaugcccuuuuauuccuacgacgucccucauaccugcggcccggaucccaaaauuuguugccaguucgacuuuaagcggcugccugggggaagaaucaauugucccuggaaggugccuccccgcgcuauuacggaagccaacguugccgagcgggcugcgcuccugcuggaucaguaucgcaaaaagagccaacucuuccgcucuaacgugcugcuugucccgcugggcgacgauuuucgguacgacaaaccucaggaaugggacgcccaguucuuuaauuaucagagacucuucgacuuuuucaacucccgccccaaucugcacgugcaagcucaguuugggacacuuagcgauuacuucgaugcccuguauaagcggaccggagucgagccuggcgccagacccccuggguuccccgugcucucuggagacuuuuucagcuacgcugaucgcgaagaccacuacuggacaggcuauuacaccucccggccguuuuauaaaucucuggauagaguucuggaggcccaucuccgcggcgcggaggugcuguacagccuugcugccgcccacgcucggagauccgggcuggccggacgguauccucucagcgacuucacccugcugacagaagcucgcagaacgcuuggccucuuucagcaccaugaugccaucaccgggacagcgaaggaggccgucgugguugacuacggagugcggcugcugagaucucucgucaaccugaaacaggugauuauccacgcugcccauuaucuugugcugggcgauaaggaaaccuaccacuucgaccccgaggcucccuuucuccaaguugaugacacacgccugucccacgacgcccugccugaacggaccgucauccagcuugauagcucuccgagauucguggugcucuuuaauccccuggagcaggagcgcuucuccauggucagccugcucgugaacuccccuagaguucgggugcugucugaagaggggcaaccccuugcgguccagauuagcgcccauugguccucugcuacggaagccgugccugacguuuaccaggugagcguccccgugcgccugccugcucucggccugggaguucugcagcuucaacucggccuggaugggcacagaacacugcccuccagcgugcggaucuaucuccauggacgccagcugucugucuccagacacgaggccuuuccgcuucgggugauugacagcggcaccucugauuucgcccuguccaaucgcuacaugcaagugugguuuagcgggcucaccggacugcugaagucuaucagacgggucgacgaggaacaugagcagcagguugauaugcaagugcuuguguauggcacacgcaccagcaaagacaaguccggggcuuaccucuuccugccugauggcgaagcgaaacccuaugucccuaaggagcccccggugcugagaguuacagaaggaccuuucuuuagcgagguggucgccuacuaugagcacauucaccaggcugugcggcucuacaaccugcccggcguugaagggcuuucucuggacaucuccagccucguggauaucagagacuacgucaauaaagagcuggcccugcauauucacacggauaucgacucccagggaauuuucuuuaccgaccuuaacggcuuccaggugcagccucgccgguaucugaagaagcucccccugcaggccaauuuuuaccccaugccuguuauggcuuauauccaagaugcccagaaaagacucacacugcauaccgcgcaggcucuuggggugucuagccugaaggacggacagcucgaagucauucuggaucgccggcugaugcaagacgauaacagaggccuugggcagggccugaaagacaauaagcgcacaugcaaccgguucagacuccugcucgagcgccggaccgugggauccgaagugcaggauucucacagcacguccuacccgucucugcuuagccaucugaccuccauguaucucaaugcccccgcccuggcucugccugucgccagaaugcagcuucccggcccugggcugcggagcuuucacccccucgcgucuucccugccuugugacuuccaccuccugaaccuucgcacacugcaagcugaggaggauacccugccgagcgccgaaacagcccucauccugcauagaaaaggauuugacugcggccuugaggcuaagaaccugggguucaauuguaccacgucucagggaaagguugcccucggcucccuguuucacgggcucgaugugguguuccugcagcccacaagccuuacccugcuguacccucucgcuucucccuccaacagcacagacgucuaucuggaaccuauggagauugccaccuuccggcuucgccugggcuga

SEQ ID NO: 71803 - RNA, 3036 nt, Artificial Sequence
  derived and/or modified sequence opt5 from MAN2B1__Homo_sapiens__NP_000519
augggcgccuacgcuagagccagcggggugugcgcgcggggaugucuggacuccgcuggccccuggaccaugucucgcgcccucagaccuccgcugcccccucuuugcuucuuucugcuccugcuugccgcugccggggcucgggccggaggcuaugagacaugucccacgguccagccuaacaugcugaauguucaccuccugccccauacccacgaugacgugggguggcugaagacaguggaucaauacuucuauggaaucaaaaacgacauucagcaugcgggcguccaguacauccucgauagcgugauuuccgcccugcuugcugacccuacccgcagauuuaucuauguugaaauugccuucuuuucucggugguggcaccagcaaacaaaugcuacccaggaggugguccgcgaucuggugagacagggccggcucgaguucgccaacgggggauggguuaugaaugacgaagcggccacacauuacggcgcuaucguggaucagaugacccuggggcuucgcuuucuggaagacacguucggaaacgauggcagaccgcgggucgccuggcacaucgaccccuuugggcacagccgcgagcaggcuucccucuucgcccagaugggauuugauggcuucuuuuucggcagacuggacuaucaggacaagugggugcggaugcagaaacuggagauggaacaaguguggcgcgccucuaccagccucaagccucccacagcugaucuguucaccgggguccuuccuaauggauacaaucccccgagaaaccugugcugggacguucucuguguggaucagccucugguggaggacccccgguccccugaauacaacgcgaaagagcuugucgauuauuuucugaauguggccacagcucagggcagauacuaucgcaccaaccauacgguuaugacaauggggagcgacuuccaauacgagaaugccaacaugugguuuaagaaucucgauaagcugauucggcuggugaacgcccagcaggcuaaaggaucuuccguccacgugcucuauagcacccccgccugcuaccugugggaacuuaacaaggcgaaucugacauggucuguuaaacaugacgauuucuuucccuaugcugacggcccucaccaguucuggaccggguacuuuuccagcagaccggcccucaagcgcuacgagcggcugucuuauaacuuccuucaaguguguaaucagcuggaagcccucgucggacuggcugccaacgugggccccuacggcuccggggauagcgcuccucugaaugaggccauggcgguccuccagcaccaugacgccguguccggaaccucuagacagcacguugcuaacgacuaugcccgccaacuggcugccggcugggggcccugcgaagugcuucugagcaaugcgcucgcccggcugagaggauuuaaagaucauuucacauuuugucagcagcugaacaucuccauuugcccucuuagccagacggcugcccgcuuccaagucaucguguacaauccccucggccggaagguuaacuggauggugagacugccggucucugaggggguguuugugguuaaggacccuaauggccgcaccguccccuccgauguggugauuuucccuagcucugacagccaggcucaucccccugagcuccuguucuccgccucucugcccgcccuuggauuuagcacauauuccgucgcucaggugccgcgguggaaaccucaggcgagagcuccccaacccaucccucggcgcagcuggucuccggcccugaccauugaaaacgagcacaucagagccacauucgaucccgacaccggccuccugauggaaaucaugaauaugaaccagcagcugcuucucccuguucggcaaacguuuuucugguacaaugccuccauuggggauaacgagagcgaccaggcuucuggagccuauaucuuuagacccaaccagcagaagccucugcccgugucccgcugggcgcaaauucaccuggucaaaacaccucucgugcaggaaguucaccagaauuucagcgcuugguguucccaggugguccggcuguaccccggccaaagacaucuugagcuggaguggucuguggggccgaucccuguuggagauaccuggggcaaggaagugauuagccgcuuugacacaccccucgagaccaaagggagauucuacaccgauuccaacggccgggaaauccuggagcgcagacgggacuaucgcccuacauggaagcugaaucagacggaacccgucgccggaaacuacuauccggugaauaccagaaucuacauuacagauggcaacaugcagcuuaccgugcucacagaccggucucaagggggaagcucccugcgcgacggcagccuggagcucaugguccacagacggcugcuuaaagaugacgggcgcggaguuucugagccucugauggaaaauggcuccggggccugggugagaggccggcaucucgugcugcuggauaccgcucaagccgcggcugccggacacagacuucucgccgagcaggaaguccuggcuccccaggugguucuggccccuggcgggggagcugccuauaaccucggcgcgccuccccgcacgcaauuuagcgggcugcggagagaccuucccccgucugugcaucugcucacccuggccuccuggggacccgagaugguccugcuucgccuggagcaccaguucgcugugggcgaagauagcgggcggaaucucucugccccuguuacacugaaccucagagaccuguuuagcaccuucacaaucacccgccuucaggagacgacacugguggcuaaucagcuccgggaagccgccuccagacugaaguggaccacaaacaccggccccaccccucaccaaacacccuaccagcuggauccugcuaauauuacgcuugagccgauggaaauccgcaccuuucuggcgagcguccaguggaaggagguggacggauga

SEQ ID NO: 71804 - RNA, 3174 nt, Artificial Sequence
  derived and/or modified sequence opt5 from MAN2C1__Homo_sapiens__NP_001243423
auggccgcugcccccgcgcugaagcacuggagaaccacacucgagcggguggaaaaauucgucagcccucuguacuuuacggacugcaaccuucgcggcagacuguucggggcuuccuguccgguugccgugcucucuagcuuucugacccccgagcggcuuccuuaucaggaagccgugcaacgcgauuucagacccgcucaggucggagacuccuuuggcccuacaugguggaccugcugguuccggguggagcugacaauccccgaagccuggguugggcaggaggugcaucucuguugggagucugauggagaaggccuggucuggcgcgacggggagccugugcagggacugaccaaggaaggcgagaaaacaagcuacguucucaccgauagacugggcgagcgggacccgcgcucccuuacgcuguauguggaagucgcuugcaaugggcuccugggagccggcaaggggucuaugauugcggcccccgauccugagaaaauguuucaacuuagcagagcugaacuggccguguuccaccgggacgugcauaugcuccuggucgaucuggagcuccugcuuggaaucgcuaagggccuggggaaggacaaccagcgcuccuuucaggcccucuacaccgcgaaucagaugguuaacgugugugaucccgcccaaccugaaacauuccccguggcucaggcccuggcuagcagauuuuucggacagcacggcggcgagucucagcauaccauucacgccacagggcacugccauaucgacaccgccuggcuuuggccguuuaaagagacgguccggaagugugcucgcuccugggugacagcgcugcaacucauggaaagaaauccugaguucauuuucgccugcagccaggcucagcaacuggaauggguuaaaucucgguaucccggacuguacuccagaauccaggaguuugccugucgcggccaguucgugccugucgggggaaccuggguggaaauggauggcaaccuccccagcggggaggccaugguucggcaguuucugcaaggacagaauuucuuucuucaggaguucggcaagaugugcucugaauuuuggcugcccgacacauucggcuauuccgcucagcucccucaaaucaugcacggguguggaauuagacgcuuucugacccagaaacuuagcuggaaccuggucaauuccuucccgcaucacaccuuuuucugggagggccucgacgggucucgggugcuggugcacuuucccccuggagauagcuacggcaugcagggguccgucgaagaggugcugaagacaguugccaacaauagagacaagggccgcgcgaaccauagcgcuuuccucuucggauuuggcgaugggggaggcgggcccacgcagaccaugcuggaccggcuuaaaagacugucuaauacagauggacucccucgcgugcaacuguccagcccccggcagcuguucucugcccuugaaagcgacuccgagcagcucugcaccugggucggcgagcuguuucuggaacuccacaacgggacauacaccacgcaugcccagaucaagaaaggcaauagagagugcgaacgcauucugcacgauguggagcuucugucuagccucgcucuggcccgguccgcucaauuccuguauccggccgcgcagcuucagcaucucuggagacugcugcuccugaaccaauuucacgacguugugacaggaagcuguauccagauggucgccgaggaagcuaugugccacuacgaggauauucggucucauggcaacacccuucuguccgccgcugccgcggcccucugugcuggggaaccuggacccgagggccugcugaucgugaauacccuuccuuggaagcgcauugaagugauggcccuccccaaaccugggggagcucacagccugggccugacacccucuccgggggacuccgcccagcauggccucugcagcuguuccucuccucaccugaccgccgcucccgcggcccccgcugccugcguuagaagcgcccgggcuccuacagauuccgccucuagaccgcccccuacgaagaccgacggaagcgucacacuugacaacggcaucauccgcgugaaacuggaucccaccgggcggcucacaucccuggugcuggucgcgagcggaagagaggcuauugccgagggcgccguggggaaucaguucguucuuuuugacgaugugccucucuauugggacgcuugggaugucauggacuaccaccuggaaacccgcaagcccgugcugggacaagccggcacgcucgcgguugggaccgagggcggacugagaggcucugcuugguuccuucugcagaucuccccuaacagccggcucucucaggaagugguccuggauguggggugucccuauguucgcuuucauacagaggugcacuggcaugaagcccacaaguuccugaaagucgaguuuccggccagagugcgguccagccaggcuaccuacgagauucaauucggacaucuucagcgcccuacacacuauaauaccucuugggacugggccagauuugaagugugggcucaccgguggauggaucugagcgagcauggcuucgggcucgcccugcucaacgacugcaaguacggagcguccguccgcggcagcauccugucucuuucccugcucagagcccccaaagcuccugaugccacggcugacacaggccggcacgaguucaccuacgcccugaugccccauaaggggagcuuucaggaugccggaguuauucaggcugcguauucccugaauuucccgcuucuggcccucccugcucccucuccugcccccgccacaagcugguccgcuuuuucugugagcucccccgccgugguccuggaaaccgugaaacaagcggaaucuagcccucagcgcagaucccucguucugcggcuuuacgaggcucacggcagccauguggacuguuggcugcaccucucucugccgguccaggaggccauccugugcgaccuucuggaaagacccgauccugccgggcaccucacccugcgcgacaaccggcucaagcugacauucucccccuuucaagugcuuagccugcugcucguucugcagccucccccucauuga

SEQ ID NO: 71805 - RNA, 2640 nt, Artificial Sequence
  derived and/or modified sequence opt5 from MANBA__Homo_sapiens__NP_005899
augagacugcaccuccugcuucugcucgcccugugcggcgcugggaccacagccgcggagcuuagcuacucccugcggggaaacuggucuaucuguaauggcaacgggagccucgaacugcccggagcugugccuggcugcguccauuccgcccuguuccagcaagggcucauucaggacucuuauuaccgcuuuaaugaucugaacuauagauggguuagccuugacaauuggacguacuccaaggaguucaaaaucccguuugaaauuucuaaguggcagaaagugaaccugauccucgagggaguggauaccgucagcaagauucuguucaaugaagugacaaucggcgagaccgacaacauguuuaaucgguauuccuucgauaucacaaacguugugcgcgacgucaauagcauugagcuuagauuucagucugccgugcuguacgcugcccaacaguccaaagcucacacccgguaucagguucccccugauugucccccucucgugcagaagggcgaaugccaugucaacuucgugcgcaaggagcaauguagcuuuucuugggacugggggcccuccuucccuacacagggaaucuggaaagaugugagaauugaagccuacaauaucugccaccugaacuacuuuaccuucagcccgauuuaugacaagucugcgcaggaguggaaucuggagaucgaauccacguuugaugucguuagcuccaaacccgugggcggacaggugauugucgccaucccuaagcuccaaacccagcagacauacucuaucgagcugcaacccgggaaacggauuguggaacuuuucguuaacaucagcaagaacauuaccguggagacaugguggccucauggccacgggaaucagaccggauauaacaugacgguccuguucgaacucgacggcggccugaauaucgagaaguccgcuaaaguguacuuucgcacaguugagcuuauugaggaacccaucaaggggagcccgggacugucuuucuauuuuaaaaucaacggcuucccuauuuuucucaagggguccaauuggauccccgccgauagcuuccaggacagagugaccucugaacugcugcggcuccugcuucagagcgucguggacgcuaacaugaauacacugcgcgucuggggaggcgggauuuacgagcaagaugaauuuuaugagcucugugacgagcugggaaucaugguguggcaggauuucauguuugccugcgcgcuuuacccuaccgaccagggcuuccuggauuccguuaccgccgaaguggcuuaccagauuaaaagacucaagucucaccccagcaucaucauuugguccggcaacaaugagaacgaagaggcccugaugaugaauugguaucauaucagcuuuacagaccggcccauuuacaucaaagauuaugucacgcuguacgugaagaacauucgcgaacucguucuggcuggggacaagucuagaccuuucaucaccuccagcccgacaaauggagccgagaccguggccgaggcuugggucucucaaaaccccaauuccaacuauuuuggcgaugugcacuucuacgacuauauuagcgauuguuggaacuggaaaguguucccuaaggcgcgguuugccuccgaauacggguaccagucuuggcccagcuucuccacacuugagaaaguuucuagcaccgaagacugguccuuuaauagcaaguucucucugcauagacagcaccacgagggaggcaacaaacagaugcucuaucaagcugggcugcauuuuaagcugccucaguccacggacccccuucgcacauucaaggauaccaucuaccucacccaggucaugcaggcccaaugcgugaaaacagagaccgaauuuuaucggagaagccgcucugagaucguggaccagcagggccacacaaugggagcccuguacuggcaacugaaugauauuuggcaggcuccguccugggccagccucgaauauggcgggaaguggaaaaugcugcauuacuucgcgcagaacuuuuucgcuccucuucugcccgucggauuugagaaugaaaacacguucuauaucuacggcgugucugaccuccacagcgauuacuccaugacccugagcguucgggugcauacauggucuucccuggagccugucuguagcagagugaccgagcgcuuuguuaugaaagggggagaagccgugugccuuuaugaggaacccgucuccgagcuccugcggagaugcggcaauuguacacgcgaaucuugcgugguuagcuucuaccuguccgccgaccacgagcuccugucuccuaccaacuaucacuuccuuagcucccccaaggaggcuguggggcuguguaaggcccagauuacggcuaucauuucucaacagggcgauaucuuugucuucgaccucgaaaccagcgccguggcgccguuuguguggcuggaugucggauccaucccuggccgguucagcgacaauggguuucugaugacagagaagaccagaacaauucuuuucuaccccugggaacccaccucuaaaaacgagcucgaacaguccuuucauguuacgagccugacagauaucuauuga

SEQ ID NO: 71806 - RNA, 1389 nt, Artificial Sequence
  derived and/or modified sequence opt5 from MANEA__Homo_sapiens__NP_078917
auggccaaguucagacggagaaccugcaucauucuggcucucuuuauccuguucauuuuuagccuuaugaugggccugaaaaugcuccgccccaacacagccacguucggggcgccuuuuggacuggaccuucugccggagcuccaccagcggaccauccaucugggcaagaauuucgauuuucaaaaauccgaccgcauuaacucugaaacaaauaccaagaaccugaaaagcguggagaucacaaugaagcccuccaaggcuucugaacucaaucuggaugagcuuccuccccugaacaauuaccuccacgucuucuauuacagcugguaugggaacccucaguuugacggaaaauacauccauuggaaucaccccguucuggaacauugggauccuagaauugccaagaacuauccgcagggccggcacaaucccccugacgauaucggguccucuuucuaccccgagcuuggaagcuauuccagccgcgacccuucugugauugagacccacaugagacagaugcgguccgccagcaucggcgugcuggcucucucuugguaucccccggaugucaacgacgaaaauggcgagccuacagauaaccuggugcccaccauucuggacaaagcccauaaguacaaucucaaaguuacguuucacaucgaaccuuacuccaaccgcgaugaccaaaacauguacaagaaugugaaguauauuaucgacaaauacgggaaccaucccgcuuucuauagauacaagaccaaaacaggaaaugcccugcccauguuuuaugucuacgauagcuacaucaccaagccugagaaaugggcgaaccuucugacaaccucuggcucccggagcauucgcaauuccccguaugacggacucuucaucgcccugcuuguggaggaaaagcacaaauacgauauucugcagucuggguucgacggcaucuauacguacuuugcuacaaacggguucaccuauggaagcucccaccagaauugggccagccucaagcuguuuugugauaaguacaaccugauuuucauccccucuguuggcccuggcuauaucgacacauccauuagacccuggaauacccagaacacccggaaucgcaucaacgggaaauacuacgagauuggacucagcgcugcccugcaaacaagaccuucucuuaucagcauuacguccuuuaaugaauggcaugagggcacccagaucgaaaaggcggugcccaaacggacaucuaacaccgucuaucuggauuacagaccgcacaagccugggcucuaucuggagcuuacacgcaaauggagcgagaaguacuccaaggaacgggccaccuaugcucuggacagacagcuccccgugagcuga

SEQ ID NO: 71807 - RNA, 558 nt, Artificial Sequence
  derived and/or modified sequence opt5 from MANF__Homo_sapiens__NP_006001
augagacggaugcgcagaaugugggccacccagggccuggcuguggcccucgcgcugagcguccuucccgggucccgggcucugcgcccuggagacugcgagguuuguaucucuuaccucggcagauucuaucaagaucugaaggaccgggaugugacauuuagcccggccacgauugaaaacgagcuuaucaaauucugccgcgaagccagagggaaggagaaucggcuguguuacuauauuggagcuaccgacgaugccgcuacaaaaaucauuaacgaaguguccaagccccucgcccaccauaucccugucgagaaaaucugcgagaagcugaagaaaaaggacucucagauuugugaacugaaauacgauaagcagaucgaccucagcaccguggaucugaaaaagcugcgcguuaaggagcuuaaaaagauucucgacgauuggggcgaaacaugcaaagggugugcggagaaguccgacuauaucagaaaaauuaaugagcugaugcccaaguacgccccuaaagcugccucugcucggaccgaucuuuga

SEQ ID NO: 71808 - RNA, 1296 nt, Artificial Sequence
  derived and/or modified sequence opt5 from MANSC1__Homo_sapiens__NP_060520
auguucuuuggcggggagggaagccugaccuacacacucgugaucauuugcuuccugacgcuuagacuguccgccucucagaacugucucaagaaaagccuggaagacgucguuaucgauauucaauccucucuuagcaagggcauccgggggaaugagcccguguauaccuccacacaggaagacugcauuaacucuuguugcagcaccaaaaauaucuccggagauaaggcuuguaaccugaugaucuuugacacacgcaaaaccgccagacagccuaauugcuaccucuucuuuuguccgaacgaggaagcgugcccccugaagccugcuaagggccugaugagcuaucggauuaucacagauuuccccucucucacccgcaaucugccuucccaggagcuuccccaagaggacagccugcuccacgggcaguuuucucaggccgugacgccucuggcccaucaccauaccgauuacuccaaaccgacagacauuagcuggagagauacccuuucucagaaguucggauccagcgaccaccuggaaaaacucuuuaagauggaugaggcuuccgcccaacugcuggcuuauaaagaaaagggccauucucagagcucccaguucagcucugaccaggagaucgcccaccuccugcccgagaacgucuccgcgcuuccugccacaguggcuguugccagcccccacaccacgucugcuacaccuaagcccgccacccugcucccgacaaaugcgagcgugaccccuuccggcaccucucaaccccagcuggccacaacggcuccucccgucaccacagugaccagccagcccccuacaacccuuauuuccacgguuuuuacacgggccgcugccacccugcaagccauggcuaccacagcggugcucaccacaacguuccaggccccgaccgauagcaaagggucucuggaaacaauccccuuuaccgagauuuccaaccugacacucaauaccggaaacgucuacaauccuacggcucugagcaugucuaacguggaauccagcaccaugaauaagacagccuccugggagggccgcgaagccucucccgggagcuccucucagggaagcgugccugagaaccaguauggccuucccuucgagaaauggcugcucaucgggucccugcuuuucggaguccuguuucucguuaucggccuggugcugcucggccggauucugagcgaaucucuuagacgcaagagauacucccggcuggacuaccucaucaacgggauuuauguggacaucuga

SEQ ID NO: 71809 - RNA, 1584 nt, Artificial Sequence
  derived and/or modified sequence opt5 from MAOA__Homo_sapiens__NP_000231
auggagaaccaggaaaaggccagcaucgcuggccacauguucgacguggucguuauugggggaggcaucuccgggcugucugccgcgaaacuccugaccgaguacggagugagcgugcuuguccuggaagcuagagaucgggugggcgggcgcacauauacgauuagaaaugagcauguugacuacguggaugucggaggcgccuaugugggccccacccaaaaccggauccuccgccuguccaaggaacuugggauugagacauacaaaguuaaugugucugagagacugguccaguaugugaagggaaaaaccuacccuuuucggggcgccuucccgcccguguggaacccuaucgcuuaucucgacuacaauaaccuguggcgcacaaucgauaauauggggaaggaaauucccaccgacgccccuugggaggcucagcacgccgauaagugggacaaaaugacaaugaaggaacugaucgauaaaauuugcuggaccaagacggcgagacgguuugccuaccucuucgucaacaucaauguuaccagcgagccccaugagguguccgcucugugguuucuuugguaugugaaacaguguggaggcacaacccgcauuuucucugucacaaacgggggacaagaaagaaaguuugugggcggcagcgggcagguuuccgagcggaucauggaccugcucggagaucaggugaagcugaaucacccugucacccauguggaccagagcucugauaacauuaucaucgaaacgcuuaaucacgagcacuacgaaugcaaauauguuauuaacgccaucccgcccacacugaccgcuaagauucauuuccgcccugagcuccccgccgagagaaaucaacugauccagcggcugccuaugggcgcggugauuaaauguaugauguacuauaaggaagccuuuuggaaaaagaaagacuacugcggguguaugaucaucgaggacgaagaugcucccauuuccaucacacucgacgauaccaagccggacggaagccugccugccauuaugggcuucauccuugcucgcaaggccgauagacuggccaaacuccacaaggagauucggaaaaagaaaaucugcgaacuguaugcuaagguccuugggucucaggaggcgcugcaucccgugcacuacgaggaaaagaacuggugugaggaacaguacuccggaggcugcuauaccgccuacuuuccucccggcaucaugacacaauaugggagagucauucgccagcccgugggacggaucuucuuugcuggcacggagaccgccacaaaauggagcggguacauggaaggagccguugaggcuggcgagagagccgcgcgcgaagugcucaacgggcugggcaaggucaccgagaaagacauuugggugcaggaaccugagucuaaggauguuccggcuguggagaucacacacaccuucugggaacggaaucugcccuccgucagcggacuccugaaaauuaucggcuucuccacgucugugacagcccuuggguuugugcuguauaaguacaagcuccugccuagaagcuga

SEQ ID NO: 71810 - RNA, 1563 nt, Artificial Sequence
  derived and/or modified sequence opt5 from MAOB__Homo_sapiens__NP_000889
augagcaacaagugcgacguggucguugugggcgggggaaucuccggcauggccgcugccaaacugcuccacgauucugggcugaauguggucgugcuugaggcgagagaccggguuggaggccgcaccuacacacugagaaaccagaaggugaaauaugucgaucucgggggaagcuacgugggccccacgcaaaaucggauucugcgccuugcuaaggaacugggccucgagaccuauaaaguuaacgaaguggagagacugauccaccacgucaaggggaaguccuacccuuuccggggaccguuucccccuguguggaaucccauuacauaucuggaccauaacaauuucuggcgcaccauggaugacaugggcagagaaaucccuucugaugcccccuggaaagccccucucgcugaggagugggacaacaugacaaugaaggaacugcuugauaaacuguguuggaccgagagcgccaagcagcucgcuacacuguuugugaaucuuugcgucaccgccgaaacgcacgagguuuccgcgcugugguuccucugguacgugaaacagugugggggaaccacacggauuaucucuaccacaaacggcgggcaggagcgcaaguuugugggaggcagcggccaagucuccgaaagaaucauggaccugcugggggaucgggugaagcucgagcgcccgguuauuuauaucgaccagaccagagaaaaugugcuggucgagacgcuuaaccaugaaauguacgaggccaaauacgugauuagcgcuauucccccuacacugggaaugaagauccacuucaaucccccucuccccaugaugcggaaccagaugaucacccgcguuccgcugggcucugugauuaaaugcaucgucuauuacaaggagccuuuuuggcggaaaaaggauuauugugggacaaugaucauugacggagaagaggcccccguggcuuacacccuugacgauaccaaaccugaaggcaauuaugccgcgaucaugggguucauucuggcccacaaggcuagaaagcucgccagacugacaaaagaggaacgccugaagaaacucugcgagcuguacgcuaagguccuuggaucccuggaggcccucgaacccgugcauuaugaggagaaaaacuggugugaagaacaguacagcggcggcugcuacacgaccuauuuucccccugggauccugacacaauacggacggguucuuagacagccgguggaccgcauuuauuucgccggcaccgagacagcuacccacuggucuggguacauggagggagcggucgaagccggcgagcgggcugccagagaaauccugcaugccauggggaagauccccgaggaugagauuuggcaguccgaaccugagagcguggacguucccgcucagccuaucacgacaaccuuucucgaacgccaucugcccucugugccgggccugcuccggcugauuggacuuaccacaaucuucuccgccaccgcgcugggcuuucucgcucacaagagagggcugcugguccgcguguga

SEQ ID NO: 71811 - RNA, 3144 nt, Artificial Sequence
  derived and/or modified sequence opt5 from MAP10__Homo_sapiens__NP_061963
auggcccacugcggccagcugaccaacuggcucugucuggcuugggagagaaaggaaagccccgacuuccuuuccaucuuucugcgguacauugaucucacaccuaaacugcauaagaucugcucugacaaaacgauuacccaaaagacacacugucuucugccgcucaucagcuccgcccugucuagcauugugcugauccaggggugguggcagaaaaccgcgcauaaguaugcuuacaagggagccaaacacaucgagcagcaaaauccccagucccgccauagaccucggcccgccggcgcucucccucagauuucucgcgauagcagacagcggugccugcuucugcgcuuccucgucagaccccggggguuuuccuucagcuuugccgaaccugcugccgcguucccgggagccacagcuauggccgcuucucuguccgagcgccuuuuuagccuggaacuccugguugacugggugagacuggaggcccggcuccugcccucuccugcggccgcuguggagcaagaagaggaagaggaggaaaaggagcagggcgaagccuccagcccccgcgggcuuuguccugcugucgccuucagacugcucgauuuucccacccugcuuguguauccgccugacggacccggcgccccugcugcggagcccuggcccggcguuauccgguucgggcgcggaaaaucuugccuguuuagacuccagccugccacacugcacugucggcugcucagaaccccgcuggcuacgcuucugcuccagcugcccccuggccgccccaccccuacaccccaacuucugggggccugcgauauuucccucgccaccgcugcccaccggguggucggaccggcggcuagcggcuguucccauagacaccgcgggcgguucccucugcauaacagagugggagaacgcacaggcgacaucgcccuggccuaccggcucaccgaucugggcucuagacuucugagccagcucgagcgcccccugacguuuacacggaccgggggaggcgcugagguuuccccucagacacaacaggaaagacagcagcugcaacagcccgccagccagccuucucccaaggaggcugacaaaccgcuuggggaacucgagauuccugaagcccagaaggaucugaaggagauggugaaauccaaggcggagugcgacaaugucggaagcguggaaaacggcaaaaccaauucuguggucaccuguagcggggccggaaacggccgcaauguuuccucucugaacgaggaagugacagagcucgauauggaaacgaauaucuucugcccucccccucuguauuacaccaaccuuacacaagagaagccgcccccugcucaggccaaaauuaccaucgagccccagaugaaugcuccugaagagauggacgacgccagccccgaaaagaaacgggugaacccucccgcgcacagauccugccugaagcacccgagcucugccgcucaugagcacccucccaugcucgucaauccuccccauauccagaacauuggcgccacaaaucaaaccugucagacggagcagaaccggaucaacacaauucgccagcugccgcugcuuaaugcucuccugguggaacugucccuccuguaugaucaaccuguuaccagccccgcccacauccauccucaccuugccuggcuguacagaaccgaggacaagaaaucucccgaauccagcgcuaaguccacaugccggucugaggcgaaaaaggauaaaagaagcgucgggggaugugaaaaguccgugucucuccaguacaagaaaaaccagauugagaauuauaaggaggacaaauacagcgaaaaguccagcggcgcccugcacaaacgcgugcccaaggggcggcugcuuuauggacucaccaacacacugagacugcgccucaagcugacgaauccugauaugcuuguugugcaugagaaaagagaacuguaccggaagcgccaaucucagaugcucggcaccaaauucagaaucccguccagcaaggucaaacugcugucuuccgcugagcagagccagaagccccaacuuccugaagacaaguaucucgauucugacgccagcuuuacagagaacuccgauaccagccggcagaucucugggguguucgacgagcccuccacaagcaaagaaaccaagcugaaauacgccacggagaagaaaaccgucgauugcuccaagaaucgcauuaacaaugugucucuggaagagguugugagcccugcuaacuccaucauucccgaaagacucacaccuaccaauauccugggcggaaacgucgagaugaaaauucagucuccguguguguuucagcaagacgccguuguggaccggaucgucgauaaggagaucgacauucgccaggugaagacaaccgauaaugacauccuuauggcggauauuagcgacaaaagaacgggcaagaacuccugcuaugaaaauaucucugagcugaaauacagcgaugaccucuccagccccuguuacucugaagauuucugcacauccgaggacaccagccggucuuuuaaggcucacgauuccagcucucgcacagagaacccuaaacauucccaguauaccagcaaguccagcgacaccggggugucuaagaaaaagaacagcuccgauagaucuagcauucuguccccgcccuucucugccggaagccccguucacuccuaccggaaauuucacaucucuaagacacaggacaaaagccuggaagaggccuccagcauuucugcuuccgaccuuagcucuacgcauuggaccgaacaaaaggagaaucagaucgaucagaacuccaugcacaauagcgaaaucacaaagagagcccaagacauuuccgucaaaacccgcucuagcuggaagucccuggagaaaagccagucuccccagacaucccaggugagcucuuaucucccuagcaacguguccgagcugaauguccucgauucuagcaccuccgaccauuucgaagagggcaacgaugacguggggucucugaauaucagcaagcaauguaaagauauuugcgaacuuguuaucaacaagcugcccggauacacgauguga

SEQ ID NO: 71812 - RNA, 8412 nt, Artificial Sequence
  derived and/or modified sequence opt5 from MAP1A__Homo_sapiens__NP_002364
auggacggcguggccgaguucuccgaauacgucuccgagaccguugaugugcccucuccuuuugaccugcucgaaccgcccaccagcggcggguuccugaaacuuuccaaaccuugcuguuauaucuuucccggcgggagaggagauucugcucuguucgccgugaacggcuuuaauauucucguugacgggggaagcgaucggaaguccugcuucuggaaacuggugcgccaccuugacagaaucgauucuguucugcucacgcauauuggcgcggacaaccugccuggcaucaaugggcugcuccagcggaagguggcugagcuggaagaggagcaaagccagggauccagcucuuacuccgauugggucaaaaaccuuauuagccccgaacugggcguggucuuuuucaaugugccugagaagcuccgccugccggacgccucuagaaaggccaaacgguccaucgaagaggcuugucuuacccugcagcaccucaaccgccuggggauccaggccgagccccuguauagagucgugagcaauacaauugaaccucucacccuguuucauaagaugggagugggccggcuugauauguacguccugaaccccguuaaagacucuaaggagaugcaauuccucaugcagaaaugggcugggaacuccaaggccaagaccggaaucgugcugccuaacggcaaagaagccgagauuagcgugcccuaucuuaccuccaucaccgcccuggucguguggcucccggcuaauccuaccgaaaagauuguucgcgugcuguuucccggcaacgccccucagaauaaaauccuggaggggcucgagaagcugagacaccuugauuuccugcgguaccccgucgcuacgcagaaagaccucgccucuggagccgugcccaccaaccugaagccuagcaaaauuaagcaacgcgccgacuccaaggaaagccuuaaagcuacaaccaagacagccguuucuaaacuggcuaagagagaggaaguggucgaggaaggcgccaaagaggcccgguccgagcucgcuaaggaacuggcgaagaccgagaaaaaggccaaagaaagcucugagaagccgcccgaaaaaccugcuaagcccgagcgcgugaagacggagagcuccgaagcccugaaagccgagaagagaaaacucaucaaggauaaagucgggaagaagcaucugaaagaaaagaucucuaaacuugaggagaagaaagacaaggagaagaaggagauuaagaaagaacggaaggagcugaaaaaggaugaaggaagaaaagaggagaagaaggacgcuaaaaaggaagagaaacgcaaggauacaaaaccugaacucaagaagaucagcaaacccgaccugaagccguuuaccccugaggugcggaaaacacuguauaaggccaaaguucccggcagagugaagauugaucgcucccgggcgaucagaggggaaaaggagcuuagcucugagccucagacacccccugcucagaaaggaaccgucccccucccgacaauuuccggccaccgcgaacuggugcugagcucuccugaggaccucacgcaggauuucgaagagaugaagcgggaagagagagcccugcuugccgagcaacgcgacaccggccugggggauaaacccuucccccucgacacagcugaagagggaccuccguccaccgccauccagggcacacccccuagcguucccgggcugggacaggaagaacacgugaugaaggagaaagaacuggucccugaggugcccgaagaacaaggcuccaaggaccgggggcuugauucuggcgcugaaaccgaggaggaaaaagacacgugggaggaaaagaagcagagagaggccgaacgccucccugaucggacagaggcgagagaggaaagcgagcccgaagugaaagaggacguuaucgaaaaggccgagcuggaggaaauggaggaaguccauccguccgaugaggaggaagaggacgcuaccaaagccgaaggauuuuaccagaagcacaugcaggagccucugaaagugacaccccggucucgcgaggcuuucggcgggagagagcucggacugcaaggcaaggccccugagaaggaaacaagccuuuuucuguccagccucaccacacccgcgggggccacggagcaugugucuuacauucaggaugaaaccaucccgggauauuccgagacagaacagaccauuagcgacgaggagauccacgaugaaccugaggaacggcccgcuccucccagauuccacacaucuaccuacgaccugcccggcccugagggggccggcccguuugaggcuucccagcccgccgauagcgccgucccugcuacgucuggaaaaguguauggcacccccgagacagagcugaccuacccuacaaauauuguugcggcgccccuugcugaagaggaacaugugagcuccgccaccagcaucacggagugcgacaagcucucuuccuucgccacaagcgucgcugaggaucaauccguggccucucugaccgcgccucagacagaagagaccgggaaaagcucccugcuccuggacaccguuacaucuaucccgagcucccgcacggaagcuacccagggacuugacuaugugcccucugccggcacaauuagcccuaccuccagccuggaggaagauaagggguuuaaaucucccccuugugaggacuucuccgucacaggagagagcgaaaagcggggcgagaucauugggaagggccucucuggagaaagagccguggaggaagaggaggaagagaccgcuaacguugaaauguccgagaaacugugcagccaguacgggacgcccguguuuucugcccccgggcacgcgcugcauccuggagaacccgcucuuggcgaggccgaggaacgcugucucucccccgaugacagcacagucaagauggccuccccucccccuagcgggccgcccucugcuacccacaccccuuuccaucaaagccccguggaggaaaaauccgagccucaggauuuucaggaggccgacucuuggggagauacaaagagaacccccggcguggggaaagaagacgcugccgaggaaacagucaagccgggcccugaggaaggaacgcuggagaaggaggaaaaaguucccccuccccggagcccucaggcgcaagaggcccccgugaacaucgaugaaggccugaccgggugcacaauucagcuccugccggcucaggacaaggccaucguguucgagauuauggaagcuggagagccuaccggccccauccuuggggccgaggcccugcccggaggccuccgcacacugccucaagaaccgggcaaaccccagaaggaugagguccugagauauccugaccggucccuuucucccgaagaugcugagagccuguccgugcucucuguuccuagccccgacaccgcgaaucaggaaccuacgccgaaaucccccugugggcugaccgagcaguaccuccacaaggaccgcuggccugaggugagccccgaagauacacaaucucugucccuuagcgaggaaucuccuuccaaggagaccagccuggacgucuccucuaaacagcucagccccgagucccugggaacacugcaguuuggcgaacuuaaccuggggaaggaggaaaugggacaccucaugcaggccgaggauaccagccaucacacagcuccgaugucugugccugaaccccaugccgccaccgcuucucccccuacggacggcacaaccagauacagcgcccaaaccgauaucacagacgauagccuggaccggaaaagccccgcguccucuuucagccacuccaccccuucugggaauggaaaguaucucccgggcgcuauuacgagccccgaugagcacauccugacaccugacuccagcuucucuaaaucccccgagagccuuccuggccccgcccuggaagauauugccaucaagugggaggacaaaguuccggggcucaaggaccgcaccuccgaacagaagaaagagccugaacccaaggaugaggugcugcagcagaaagacaagacacuggagcauaaagaagucguggagccuaaggauaccgcuauuuaccaaaaggacgaagcccuucacguuaaaaacgaggcggugaagcagcaggauaaagcucuggaacaaaagggaagagaccucgagcagaaagauacagcccuggagcagaaggacaaggcccucgaacccaaagauaaggaccuggaggaaaaagauaaggcucuugagcagaaagacaagaucccugaggaaaaggauaaagcccuggagcaaaaggacaccgcucuggaacagaaagacaaggcccucgagcccaaagauaaggaccuggaacagaaagaucggguccuugagcagaaggagaagaucccggaagagaaagacaaggcgcuggaucaaaaagugcgcucuguggaacauaaggccccugaggacacggucgcugaaaugaaagauagagaccucgagcagaccgauaaggcccccgagcagaagcaccaggcucaagaacagaaagacaagguuagcgagaaaaaggaucaggcccuggaacagaaauauugggcccucggccaaaaggacgaggcucuggaacagaauauucaggcgcuugaggagaaccaucaaacacaggaacaggagucccuggugcaggaagauaagacccggaaacccaagaugcuggaggagaaaucuccugaaaaggugaaagccauggaggaaaagcucgaggcucugcuugaaaagacaaaagcccuggggcucgaggagagccugguccaagaaggcagagcccgcgagcaggaagagaaguacuggcggggccaggacgugguucaggaauggcaagagaccuccccgacgagagaggaacccgcuggggagcagaaagaacucgccccugcgugggaggacacaagccccgaacaggauaaucgcuauuggcggggaagagaggacguggcucuggagcaggauaccuacuggcgcgaacuuucuugcgagcggaaggucugguuuccucacgaacuggacggccaaggcgccagaccccacuauacagaggagcgcgaauccaccuuccuggaugaggggccugacgaugaacaggaggugccccuccgggaacaugccaccagaagcccgugggcuucugacuuuaaagauuuccaggaguccagcccucaaaagggacuggagguugaacgguggcuugccgagucucccgugggccugccucccgaagaggaagacaaacucacacgcagcccguuugagaucauuuccccucccgcgucucccccugagauggucgggcagagagugcccagcgccccuggacaggaauccccgauccccgauccuaagcugaugccccacaugaagaacgagccuacgacccccagcuggcucgcugacauuccuccguggguccccaaagaccggccucugcccccugcgccccuuuccccggcuccuggaccgcccaccccugcccccgaaucucauaccccugcuccguucagcugggggacagccgaguacgauuccgugguugcggccgugcaggaaggagcugccgagcuggagggcggccccuacucuccucuggggaaggacuaucgcaaagcugaaggagagagagaagaggagggccgggccgaagcccccgauaagagcucccacucuagcaaagucccugaggcuuccaagagccaugcgaccacggaacccgagcaaacagaaccggagcagagagagccuacccccuacccugacgaacgcucuuuucaguaugccgauaucuacgagcagaugaugcucaccgggcugggacccgcuuguccgacacgggaaccuccccuuggcgccgccggggacuggcccccuugccuguccaccaaggaggcugccgcgggaagaaauacaagcgccgaaaaagagcucucuucccccaucagcccuaagucucugcaauccgauacgccgaccuucagcuaugcugcccuggcuggccccacagugccuccccgcccugagcccggcccuuccauggaaccgagccucacacccccugccguucccccucgggcgcccauucuuucuaaagggccgagcccuccccugaacggaaauauccuguccugcucucccgacagacgcagcccuucccccaaggagucuggccggagccacugggaugacuccacaucugauagcgaacucgagaaaggggccagagaacagccugagaaggaggcucaguccccgucucccccucaccccauuccuaugggaagccccacccuguggccggaaacggaggcccauguguccccuccccuugacagccaccugggcccugcucgccccucucucgauuuuccugccuccgcuuucggguuuagcucccugcagcccgccccgccccaacugccuucucccgcggaaccuagaagcgccccguguggaucccucgcuuucagcggcgaccgggcccuugcucuggcccccggcccucccacccgcacaagacaugacgaguaccuggaggucaccaaggccccuucucucgauuccagccugccccagcuuccuucucccagcuccccgggggcgccucugcucucuaaccugccccggccugcuagccccgcccuguccgaaggaucuagcuccgaggcuacaaccccggugaucagcucuguggccgaacgcuuuuccccuagccucgaggccgcugaacaggaguccggcgagcuugaccccgggauggaacccgccgcgcacucucugugggaucugacaccucucagccccgccccuccggcuucccuggaccuugcccuggcucccgccccuucucuccccggagauaugggcgacgggauucugccuugccaccuggaguguagcgaagcggccacggagaaacccuccccguuccagguuccuagcgaagauugcgcugccaauggacccaccgagacaucuccuaaucccccuggccccgcuccggccaaggcugagaaugaagaggccgcggccugucccgcuugggaaagaggcgccuggccugagggggcugaacgguccagcagacccgacacccuccuuucuccugagcaacccgucugcccugccggaggcuccgggggaccgcccagcucugccuccccugagguggaagcgggcccccaggggugugcuaccgagccucgcccccaucggggcgaacugagcccgucuuuccugaacccuccccucccucccagcaucgaugacagagaucuguccacagaggaggugcgccuugucggacggggcgggagacggcgcgugggaggcccggggacgaccggaggcccuugccccguuacagacgaaacacccccuacaagcgccuccgacucugggagcucccagucugauagcgacgugcccccugagaccgaagaguguccguccaucacggccgaagcugcccuggauucugacgaggauggcgacuuucuccccgucgauaaagcuggaggcgugagcgggacacaccauccuagacccggacacgacccucccccucugccgcaacccgauccucggcccuccccuccccgcccggacguuugcauggccgaucccgagggccugagcucugaauccgggagaguggagcggcuccgcgaaaaggagaaaguccagggaagagugggccggcgcgcgccugggaaggccaagcccgcuagcccugccagacggcuugaccugagaggcaaacgcucucccaccccuggaaagggcccggcugaucgggccuccagagcgcccccucgcccccggagcaccacaucucagguuaccccugccgaagagaaagacgggcauucccccaugagcaagggacuggugaacggccucaaagcugggccgauggcccugucuuccaagggaagcagcggcgcuccugucuauguggaccuugccuacauucccaaucacuguuccggcaagacagcugaucuggacuucuuuagacgcgugcgggccucuuacuaugucguuagcgggaacgauccugcgaauggagagcccuccagagccgugcucgacgcucugcuggaaggcaaagcccaguggggagaaaaccuccaagugacccuuaucccuacgcacgauacagaagucacccgcgagugguaccagcagacacaugaacagcaacagcagcugaaugugcugguucucgccucuagcuccaccguggucaugcaggacgagucuuuccccgcuugcaagauugaguuuuga

SEQ ID NO: 71813 - RNA, 7407 nt, Artificial Sequence
  derived and/or modified sequence opt5 from MAP1B__Homo_sapiens__NP_005900
auggccaccguggucguugaagcuacagaacccgaaccuagcggcuccaucgccaacccggcggcuucuacgagccccucccugucucacagauuccucgacagcaaguuuuaccugcuugugguggucggggaaauugugaccgaagaacaucugcggcgcgccaucggaaauauugaacucggcaucagauccugggacacaaaccugauugaaugcaaucuugaccaggaacugaaacucuucguuucucggcacagcgcccgcuuuuccccugaggugcccgggcagaagauccugcaucacagaagcgauguccuggaaaccgugguucucaucaacccuucugacgaggcuguguccacagagguccggcugaugauuaccgaugccgcucgccauaaacuucuggugcucacaggacaguguuucgaaaauaccggcgagcugauccuucagagcgggucuuuuuccuuccagaacuuuauugaaaucuucacggaccaagagauuggagaacugcucagcaccacacaccccgccaauaaggccucucugacccuguuuugcccugaggagggcgauuggaaaaacuccaaucucgacagacacaaccugcaggauuucaucaauauuaaacuuaacagcgccuccauccugccggaaauggagggccucucugaauuuacagaguaucugagcgaauccguggagguccccagcccuuucgacauccuugagcccccuaccucugggggauuucugaagcucuccaaacccuguugcuacauuuucccgggcgggcggggagauagcgcucuguucgccguuaauggcuuuaacaugcugaucaaugggggaucugaacgcaagagcuguuucuggaaacucauuagacaucuggaccggguggauuccauccuucugacgcacauuggcgacgacaaccucccuggcaucaacucuaugcugcagcgcaagaucgcugagcuugaagaggaacagagccaaggguccacaaccaauagcgauuggaugaaaaaccugauuucucccgaccucggaguggucuuucugaaugugccugagaaccugaagaaucccgagcccaacaucaagaugaaaagauccauugaagaggccugcuucacacuccaguaucugaauaaacuuagcaugaaaccugaaccgcuguuucggucuguuggcaacaccaucgaucccgugauucucuuccagaagaugggggucggaaaacuggagauguacgugcugaauccuguuaaguccagcaaagagaugcaguauuuuaugcaacaguggaccggcacaaacaaggacaaggcggaguucauccuucccaaugggcaggagguggaucucccuaucuccuaccugacgucugucagcucccugauuguguggcaucccgccaacccggcugagaagaucauucgcguccucuuuccuggaaauucuacccaauauaacauccuggagggccuugaaaagcugaaacaccucgacuuccugaagcagccccuggccacacagaaagaucuuaccggccaggugccuacacccguugugaagcaaaccaagcucaaacagagagcugacagccgggagucccugaagccugccgccaaaccccugccgagcaagucugucagaaaagaguccaaggaagagacgccugaagugacaaagguuaaucacguggagaaaccgccgaaggucgaaagcaaagagaaggugauggugaaaaaggauaagccuauuaaaaccgagaccaagccgucuguuacagaaaaagagguccccuccaaggaagaaccuagccccgugaaagcugaaguggcggagaagcaggccaccgacgucaaaccuaaggcugccaaggagaaaacagugaagaaagaaacgaagguuaaacccgaggauaagaaggaagagaaagagaagccuaaaaaggaaguggccaaaaaggaggacaagacccccaucaaaaaggaagagaaaccgaagaaagaagaggucaagaaggaggugaaaaaggaaauuaaaaaggaggagaagaaggagccuaaaaaggaaguuaagaaagagacacccccuaaggaggugaaaaaggaagucaaaaaggaggaaaagaaagaggugaagaaagaagagaaggagcccaaaaaggaaaucaagaaacucccgaaggacgcuaaaaagucuagcaccccucuguccgaggccaaaaagcccgcggcucuuaagccuaaaguucccaagaaagaagagagcgugaagaaagauucugucgccgccgggaagcccaaggagaaaggaaagaucaaagugauuaagaaagaaggcaaggcugccgaggcuguggccgcggccgucgggacaggagcuaccacggccgcuguuauggccgcggccggcaucgcugccauugggccugcuaaagaacuggaggccgaacgcucccucaugagcuccccggaggaccugaccaaggauuuugaggaacugaaggccgaggaaguggacgugacaaaagauaucaagccccagcuugagcucauugaagacgaggagaaacugaaggaaaccgagccugucgaggcuuacgugauccaaaaagagcgggaaguuacaaagggccccgcggagucuccugaugagggaaucaccacgacagaaggcgagggggaaugugagcagacccccgaggaacuggagccuguggaaaagcagggagucgacgauauugagaaauucgaagacgagggcgccggguuugaggaaagcuccgagacaggagauuacgaagagaaggcugaaaccgaggaggccgaagaacccgaagaggacggcgaagaacaugugugcguuucugccagcaaacacucccccaccgaggaugaagagucugcuaaggccgaagcggacgcuuauaucagagagaaacgcgagagcguggccuccggggacgaucgggccgaagaggacauggaugaagcuauugagaagggcgaagccgagcagagcgaggaagaggcggacgaagaggauaaggcugaagacgccagagaggaggaauacgagccugagaaaauggaggccgaagauuaugucauggcugugguugacaaggccgcugaggccggaggcgcggaggaacaauacggguuccucacaacgcccaccaaacagcugggagcccagucuccuggccgcgagcccgcuuccagcauccaugaugaaacacuucccgggggaucugaguccgaggccaccgcuagcgacgaagagaaccgggaagaucagccugaggaguucacagccaccucuggcuauacgcaauccacaauugagaucagcuccgagcccacccccauggacgaaaugagcaccccuagagaugugaugucugacgagacaaacaaugaagagaccgaaagccccucccaggaguuugucaacaucacaaaguacgagucuagccuguauucccaggaauacucuaaaccugccgacgugacgccgcucaauggguucagcgagggcuccaagaccgaugcuacagacggaaaggauuacaacgcgucugccagcaccauuagcccucccagcucuauggaagaggacaaauuuucccgcagcgcucugcgggaugccuauuguucugaagugaaggccuccacaacccuggacaucaaagauagcauuuccgcugucucuagcgagaagguuucccccagcaaaucuccuucccuuagccccucuccgccuagcccccucgagaagacgccucugggcgaaagauccgugaauuucucucugacccccaacgagaucaaagugagcgccgaagcggaggucgcuccugugucccccgagguuacacaagaaguggucgaggaacacugcgccucuccggaggacaagacccucgaagugguuagcccuucccagagcgugacagggucugccggacauacccccuacuaucagucccccacagaugaaaagagcucccaucugccuaccgaggucauugagaaaccgcccgcugugccugucucuuuugaguucagcgacgccaaggaugaaaaugagcgcgcguccgugucucccauggacgaaccuguucccgacagcgaguccccuaucgagaaagugcuuagcccgcugcggucucccccucucaucggcuccgaaagcgcuuacgagucuuuucuguccgccgaugacaaggccagcgggagaggagcugaaucucccuucgaggagaaauccggcaagcagggguccccugaucaagucucucccgugagcgagaugacguccacaagccuguaucaggacaagcaggagggcaaauccaccgauuuugccccgauuaaggaagacuucggacaggagaaaaagaccgaugacguugaagcuaugucuagccaaccugcccuugcgcuggaugagcggaaacucggcgacgugucccccacacagaucgaugucucucaguuugggagcuucaaggaggacaccaagauguccauuucugaaggaacggugagcgauaaauccgccacacccguggacgagggcguugcugaagacaccuacagccacauggagggggucgccucuguguccacagcuagcguggccaccucuuccuuuccugaacccacaaccgaugacgucagcccuucucugcacgccgaggugggauccccgcacagcacggagguugaugacucccucagcgugucugucgugcagacccccacaaccuuccaagaaacagagaugagcccuuccaaggaagaguguccccgcccuaugucuaucucucccccggauuucuccccuaaaaccgcuaaguccagaacgcccguucaggaccaucggagcgaacaguccucuaugagcauugaguuuggccaagaguccccugaacagagccuggcgauggauuucucuagacagucccccgaccacccuacagugggcgccgggguccuucacaucaccgagaacggacccacagaaguggauuauagcccgucugacaugcaggauuccagccugucccauaaaauuccucccauggaggaacccucuuacacccaagacaaugaucucagcgagcugaucuccguuagccagguggaggcuucuccuuccaccagcucugcccacacaccgagccagaucgccagcccccugcaggaagacacgcuuucugacgucgcuccuccccgcgauaugagccuguacgccucccucaccucugagaaggugcaaagccuggaaggcgagaagcucuccccuaaaagcgacauuucuccccugacaccucgggaguccagcccccuuuauuccccgaccuuuucugauagcacauccgcggugaaggagaaaacagcuacgugccauucuagcuccagcccucccaucgacgccgccucugcugagccuuacggguucagagccuccguccuguuugauacaaugcagcaccaucucgcgcugaaccgcgaccugagcacccccggacuugaaaaggauucuggcgggaaaaccccgggagacuucuccuaugccuaccagaagccugaggaaacaaccagaagccccgaugaggaggacuaugauuacgaaucuuaugagaaaacaacgcggaccuccgacguuggcggcuacuacuaugaaaagauugagcgcacaaccaagagccccucugacagcggguacuccuaugaaacaaucggaaaaaccacgaagaccccugaggauggcgacuacagcuaugagauuaucgagaaaacaaccagaacacccgaggaagggggauacuccuaugauaucucugagaagaccacaagcccuccggaaguguccggcuacucuuacgagaaaacggagcggagccgcagacugcucgacgauauuuccaauggguaugacgauucugaagacggaggccacacccugggcgaucccagcuacuccuaugagacaaccgaaaagaucaccagcuuuccugagucugagggguacuccuaugaaacaagcacgaagaccacacggacccccgacacaucuaccuacugcuaugagacggcugagaaaauuacacgcaccccucaggccuccaccuacagcuacgagacaucugaucucuguuauaccgcugaaaagaaaucccccagcgaggccagacaagacguggaucugugccuugucucuuccugugaguacaagcacccuaaaacagaacugagcccgagcuucaucaaccccaauccucuggagugguuugcuuccgaagaacccaccgaagagucugagaagccucucacgcagagcggaggcgcgcccccgccucccgggggaaagcagcagggccggcaaugcgacgaaacacccccuaccuccgugucugagagcgcgcccucccagacagacucugauguuccuccggaaaccgaggaaugucccagcauuacggccgacgcuaacaucgauuccgaggacgagagcgaaaccaucccuacagauaaaaccgugacauauaagcauauggaucccccucccgccccgguccaggaucgcucuccuucccccagacacccugacgugagcaugguugaucccgaggcucuggccauugaacaaaaucuugggaaagcccugaagaaagaccucaaggagaagaccaaaacaaagaaaccgggaaccaagacgaaaucuuccagcccugugaagaaguccgauggcaaaucuaagccccuggcugcgagccccaaaccugccggccucaaggaguccucugacaaagucagccggguggcuucccccaagaaaaaggaaagcgucgagaaggccgccaaaccuacaaccaccccggaagugaaggcugccagaggggaggaaaaagacaaggagaccaaaaacgcggccaacgcuucugccuccaagagcgcuaagaccgccacagcgggacccggcacgaccaaaacaaccaagucuagcgccguuccucccgggcugccuguguaccuugaucugugcuauauccccaaucauuccaacucuaaaaauguggacgucgaguucuuuaagcgcguucggagcuccuacuauguggugagcggaaacgauccugcugccgaagaaccgucuagagcuguccuggacgcccuccuggaaggcaaagcucaguggggguccaauaugcaagugacacuuauucccacccacgauagcgagguuaugcgcgaaugguaccaggagacgcaugagaagcaacaggaccugaacaucauggugcucgccuccucuagcaccgucgugaugcaggaugaauccuucccugcguguaagauugagcuguga

SEQ ID NO: 71814 - RNA, 366 nt, Artificial Sequence
  derived and/or modified sequence opt5 from MAP1LC3A__Homo_sapiens__NP_115903
augcccagcgacagaccuuucaagcagcggcgcuccuuugccgauagaugcaaagaggugcaacagauccgggaccagcacccgucuaagauucccgucaucauugaacgcuacaaaggcgagaagcagcugccuguucucgauaaaaccaaguuccuggugcccgaccaugugaacaugagcgaacuugucaagaucauuagacggcgccugcaacucaauccuacacaggccuuuuuccugcuugugaaccagcacuccaugguuucugugagcacgcccaucgcugauaucuaugagcaggaaaaagacgaggauggguuucuguacauggucuaugcgucccaagagaccuucggauuuuga

SEQ ID NO: 71815 - RNA, 378 nt, Artificial Sequence
  derived and/or modified sequence opt5 from MAP1LC3B2__Homo_sapiens__NP_001078950
augcccagcgagaagaccuucaaacagagacggacauuugaacaacgcguggaggacgucagacugauccgggaacagcacccuacgaagauuccgguuaucauugagcgcuacaaaggcgaaaagcagcuccccgugcuggauaaaaccaaguuccuugugccugaccaugucaacauguccgagcugaucaagauuaucagacggcgccuccagcugaaugccaaccaagccuuuuuccuucuggugaaugggcacucuaugguuagcguguccacacccaucucugaggucuaugaaagcgagaaagaugaagacggauuucucuacauggugugcgcuucccaggagaccuucggcaugaagcugucuguuuga

SEQ ID NO: 71816 - RNA, 378 nt, Artificial Sequence
  derived and/or modified sequence opt5 from MAP1LC3B__Homo_sapiens__NP_073729
augcccagcgagaagaccuucaaacagagacggacauuugaacaacgcguggaggacgucagacugauccgggaacagcacccuacgaagauuccgguuaucauugagcgcuacaaaggcgaaaagcagcuccccgugcuggauaaaaccaaguuccuugugccugaccaugucaacauguccgagcugaucaagauuaucagacggcgccuccagcugaaugccaaccaagccuuuuuccuucuggugaaugggcacucuaugguuagcguguccacacccaucucugaggucuaugaaagcgagaaagaugaagacggauuucucuacaugguguaugcuucccaggagaccuucggcaugaagcugucuguuuga

SEQ ID NO: 71817 - RNA, 3180 nt, Artificial Sequence
  derived and/or modified sequence opt5 from MAP1S__Homo_sapiens__NP_060644
auggccgcuguggccggcagcggggcggcugccgcccccuccucucugcuccuggucguuggaagcgaguucggcuccccugggcuucugaccuacgugcucgaggaacuggaaagaggaauccggucuugggacguggauccgggcgucugcaaccuugacgagcagcugaagguguuuguuagccgccacuccgcuacauucucuagcauugugaaagggcaaagaucccuccaucaccggggagauaaucuggaaacgcugguccuccugaaccccagcgacaagucucuuuaugaugagcugcgcaaucuccugcuugacccugccucccauaaacugcucgugcuggcuggccccugucuggaggaaaccggcgagcuccugcuucagacagggggauuuagcccucaccauuuccugcagguucucaaggauagagaaauccgggacauucuggccaccacacccccuccggugcagcccccuauccuuaccauuacaugccccaccuuuggcgauugggcgcaacuggccccugcuguccccgggcuccagggagcccugcgccugcagcucagacugaacccgccugcucagcuucccaauucugagggccugugugaguuccucgaauacguggccgagucccuggaaccucccagccccuuugagcuucuggaaccuccgacgucugggggauuccuccggcugggccgccccugcuguuauaucuuuccuggcgggcugggagacgcggccuucuuugcugugaacggcuucaccguccucguuaaugggggauccaaccccaaaagcuccuuuuggaagcuggugagacaccuugaucggguggacgccguccuggugacacacccuggcgcugauucucuccccgggcugaauagccugcuucgcagaaagcucgccgagcgguccgagguugccgcuggaggcggcagcugggacgaccgccugagacggcugaucucuccgaaccucgggguggucuucuucaaugcgugcgaagccgcuuccagacuggcccgcggagaggaugaagccgagcuugcucugagccuccuggcccaacugggcauuaccccucuuccccucucucgggggccugugcccgcgaaaccuacaguucuguuugaaaagaugggagugggcagacuggacauguacguccuccaucccccgagcgcuggggccgagcgcacccuggccuccgugugugcccuucuggucuggcacccugccggccccggagagaaagugguucggguccucuuccccggcugcacgccuccggcuugucugcuggaugggcuugugagacuccagcaucugcgcuuucugcgggaacccgugguuacaccucaggaccucgagggacccggcagagccgaaucuaaggagagcguggggucccgcgauagcucuaaacgggaaggacugcuugcgacccacccuagacccggccaggagcgcccuggggucgcccggaaggagcccgcuagagccgaagcuccgcggaagacagagaaagaagccaagaccccucgcgagcugaaaaaggaccccaaaccuuccgugagcagaacccaaccccgggaggugagacgcgcggccucuuccguuccgaaccucaagaaaacaaaugcucaggccgcuccuaagccccggaaggccccuagcacgucccacucuggcuucccucccgucgccaacggacccagaagcccgcccucccugcgcugcggcgaggcuucuccucccagcgcggccuguggguccccugcuagccagcugguggccacccccucucuugaacucggaccuaucccggccggcgaagagaaagcucuggaacugccccucgccgcguccagcauuccuagaccccggacaccuucucccgagucccaucgcagcccggcugaggggucugaaagacugagccuuuccccucugcggggaggcgaggccgggcccgaugccagccccaccgugacaaccccuacggucacaacccccucucucccugcugaagugggcuccccgcacagcaccgagguugacgaaucccugucugugagcuuugagcaaguccugcccccuuccgcccccacaucugaggcgggacuuagccugccucuccgcggccccagagcucggcgcuccgccucuccgcaugauguggaccugugccucguuagcccuugcgaguucgaacacagaaaggccgugcccauggcuccugcccccgcuuccccugggagcucuaaugauuccagcgcccggucucaggaacgcgcgggaggccugggggccgaggaaacacccccgaccuccgucagcgagucucuuccuacgcuguccgacagcgaccccgugccccucgcuccuggagccgcugauuccgacgaggauaccgaaggcuuugggguuccgagacaugacccccugccugauccccugaaagugccucccccucuuccggaccccagcucuaucuguauggucgauccugagaugcugcccccuaagacagcccggcagaccgaaaacgugagcagaacacgcaaaccccucgcccggccgaacuccagagcugcggccccuaaggcuacccccguggccgccgcuaagacgaaaggccuggccggaggcgaccgcgcgucucggccccucagcgcuagauccgagccuucugagaaagggggacgcgcuccccugagccggaaguccucuaccccuaagacagccaccagaggcccgagcggguccgcuagcucucgccccggagucuccgccacaccucccaaaagcccuguuuaucuugaucuggcguaccuccccucuggcuccagcgcucaccugguggacgaagaguucuuucagcgggugagagcccugugcuaugucauuuccggccaagaucagcggaaggaagaggggaugcgcgccgugcuugacgcucugcucgccucuaagcagcacugggauagagaccugcagguuacccucaucccgacguucgacagcguggcuaugcauacaugguacgccgaaacccacgcgcggcaucaagcccugggaauuacaguccuuggcuccaauagcauggugucuaugcaggaugacgcuuuuccugccuguaaaguugaguucuga

SEQ ID NO: 71818 - RNA, 1680 nt, Artificial Sequence
  derived and/or modified sequence opt5 from MAP2__Homo_sapiens__NP_001034627
auggccgacgagagaaaggaugaagcuaaagcgccccacuggaccagcgccccucugacagaggcuuccgcccauucucacccgcccgaaaucaaggaccagggcggggccggagagggccucgugcggagcgcuaacggguucccuuaccgcgaagaugaggagggagccuuuggcgaacaugggucccaaggaacguauucuaauaccaaagagaacggcauuaauggcgaacugacaagcgcugacagagagaccgccgaggaagucuccgcgcggaucguucagguggugacagccgaggcugucgccgugcuuaagggggaacaggagaaagaagcucagcacaaggaucaaaccgccgcgcugccccucgccgcugaggagacagccaaccugccucccucuccuccgcccagcccugcuuccgaacagaccguuacgguggaggaagccgccggaggcgagagcgcucuugcgcccucugucuucaagcaggccaaagacaagguguccaauagcacccugucuaaaauuccugcucuccagggguccacaaagagcccccgcuacucuuccgccugcccgagcaccacaaaaagagccaccuuuuccgauucucugcugauccaaccuacgagcgcuggauccacagaccggcuccccuauagcaagucuggcaacaaggaugggguuaccaaauccccugaaaagcgcagcucucugcccagacccagcuccauucuuccuccgcggcgcggagugucuggcgacagagaugagaauagcuucucccugaacagcucuaucuccagcucugcccggcgcacaaccagauccgagcccauccggcgcgcgggcaaaagcgggaccuccacaccuacgacccccggaucuacagcuauuaccccuggcacacccccgagcuacuccucuagaaccccugggacgcccggaacaccuagcuauccccggaccccucauacccccggcacaccgaaguccgccauccucgucccuagcgagaaaaagguggccauuaucagaaccccucccaaaucucccgcuacaccgaagcagcugcgccuuauuaaucagccccugccugaccucaagaacgugaaauccaagaucgggagcacggauaauauuaaauaccagcccaagggaggccaaguccggauccugaacaaaaagaucgacuuuucuaagguucaguccagauguggcagcaaagacaauauuaagcacucugccgggggaggcaacgugcagaucgugaccaaaaagauugaucugagccacgucacauccaaaugcgggagccucaagaauauccgccaucggccuggaggcgggagagugaagauugaaucuguuaaacuggacuucaaggaaaaagcucaagccaaggugggcucccuugauaacgcgcaccauguccccggaggcgggaacgugaaaaucgacagccagaagcugaauuuucgcgagcacgccaaggcucggguugaucacggagccgaaaucauuacccaguccccuggcagaucuagcguggcuucuccccgccggcucuccaacgucagcuccucugggagcaucaaucugcuugaguccccgcagcuggccacacucgcggaggacgugaccgccgcucuggccaaacaaggacuguga

SEQ ID NO: 71819 - RNA, 1182 nt, Artificial Sequence
  derived and/or modified sequence opt5 from MAP2K1__Homo_sapiens__NP_002746
augcccaagaaaaagccuaccccgauccagcugaaccccgccccugacggcagcgcugugaaugggacauccucugccgagacgaaccucgaagcgcugcaaaagaaacuugaggaacuggagcucgaugaacagcagagaaaacggcuggaggcuuuccuuacccagaagcaaaaggucggagagcugaaagacgaugacuuugaaaagauuagcgagcucggcgccgggaauggaggcguuguguucaaagugucccacaagcccucugggcuggucauggcccgcaaacugauccaucucgaaauuaagccugcuaucagaaaccagauuauccgggagcuucaggugcugcacgagugcaauagccccuacaucguuggauuuuauggcgccuucuacuccgauggcgaaauuucuaucuguauggagcauauggacgggggaagccuggaucaggugcucaagaaagcuggccgcauuccugaacaaauccuggggaaggucuccauugccgugaucaaaggacuuacauaucugagagagaagcacaaaauuaugcaucgggacguuaagccgagcaacauccucgucaauucucgcggcgaaaucaaacugugcgauuuugggguguccggacagcugauugacagcauggcgaacucuuucgugggcaccagauccuacaugagccccgagcggcuccagggcacacacuauucugugcaguccgauaucuggagcauggggcugucccuugucgagauggccguuggacgcuacccuauucccccucccgacgcuaaggaacuggagcucauguuuggcugucaaguggaaggggaugccgcugagaccccgccuagaccccggacaccuggacgcccccugucuagcuauggcauggacuccagacccccuauggccaucuucgaacuucuggacuacauugugaaugagccgcccccuaagcuccccagcggggucuuuucucuggaguuccaggauuuugugaacaaaugccugaucaagaauccugcggaacgggccgaccucaaacagcugaugguucacgcuuucaucaagcgcuccgaugccgaggaaguggacuuugcuggauggcuuuguagcaccauuggccugaaccaacccucuacgccgacccaugccgccggcgucuga

SEQ ID NO: 71820 - RNA, 1203 nt, Artificial Sequence
  derived and/or modified sequence opt5 from MAP2K2__Homo_sapiens__NP_109587
augcuggccagacggaagcccgugcucccugcucugaccaucaacccgacaauugccgagggccccagcccuacguccgaaggggcgucugaggcuaaucuugucgaccugcagaaaaagcucgaggaacuggaacuugaugagcaacagaaaaagcgccuggaggccuuccucacccagaaagccaagguuggagaacugaaggacgaugacuuugagagaaucagcgaacugggcgcugggaacggaggcguggugacaaaaguccagcaccggcccuccgggcucauuauggcccgcaagcugauccaucuugagauuaaaccugcuaucagaaaucaaaucauucgggagcuccaggugcugcacgaaugcaacucucccuacaucguuggauucuauggcgccuuuuacagcgauggcgagauuuccaucuguauggaacauauggacgggggaucucuggaucaggugcuuaaggaggcgaaacgcauuccugaagagauccugggcaaggucagcauugccgugcucagagggcuggcuuaucugcgggagaagcaccagaucaugcaucgcgacguuaaaccguccaauauccucgugaacagcagaggagaaauuaagcugugcgauuucggcgucucugggcaacuuaucgacuccauggccaauagcuuugugggaacccggucuuacauggcucccgagcgccugcagggcacacacuauuccgugcagagcgauauuuggucuaugggccucucccuggucgaacuugccguugggagauacccuauucccccucccgacgcgaaagagcuggaagccaucuucggacggccggugguggauggcgaggagggggaaccucacagcaucucuccccgcccuagaccucccggacggcccgucuccggccaugggauggacagcagaccggcuauggccaucuuugagcuccuggacuauauugugaacgaacccccucccaagcugccuaauggaguuuucacccccgauuuucaggaguucgugaacaaaugucucaucaagaauccggcugaacgcgccgaccugaaaaugcuuacaaaccacaccuuuauuaagcgguccgaggucgaggaaguggauuucgccggcuggcugugcaagacgcucagacugaaucaaccuggcacccccacacgcaccgcuguuuga

SEQ ID NO: 71821 - RNA, 957 nt, Artificial Sequence
  derived and/or modified sequence opt5 from MAP2K3__Homo_sapiens__NP_002747
augagcaagcccccugccccgaaccccaccccucccagaaaucuggacucccggacauucaucacgauuggcgaucgcaacuuugagguggaagcugacgaucucgucaccaucucugagcuggggagaggagccuacggcguuguggaaaaagugcggcacgcgcagagcgggacaauuauggcugucaagcgcaucagagccaccguuaauucccaagagcagaaacggcuucugauggaccucgauauuaacaugcgcacaguggacugcuucuauaccgugacauuuuacggagcccuguucagagaaggcgaugucuggaucuguauggagcuuauggacaccucucuggauaaguuuuaucggaaagugcucgacaagaauaugacgaucccugaggauauucugggggaaaucgcuguuagcauugugcgcgcccuggagcaucuccacuccaagcugucugucauccauagagacgugaaacccagcaacgugcuuauuaauaaggaaggacacgucaaaaugugcgauuucggcaucuccggcuaccugguugacagcguggcuaagaccauggacgccggguguaaaccuuauauggcgccggagcggauuaaccccgagcucaaucagaagggauacaacgugaagucugaugucuggucccugggcaucacaaugaucgaaauggccauucuucgcuuuccuuaugagagcugggggacccccuuccagcaacugaaacaggugguugaagaaccuucuccccagcucccggcugacagauuuuccccugaguucguggauuuuacagcccagugccugcggaagaaucccgcugagcgcaugagcuaccuggagcucauggaacauccuuucuuuacccugcacaaaacgaagaaaacagacaucgccgcguucgucaaggagauucuuggagaagauucuuga

SEQ ID NO: 71822 - RNA, 1233 nt, Artificial Sequence
  derived and/or modified sequence opt5 from MAP2K4__Homo_sapiens__NP_001268364
auggccgcucccagcccuuccggcgggggaggcucugggggaggcagcggguccggaaccccgggccccgugggcucuccugcccccgggcacccugcggucagcuccaugcagggauuccaaaucaacuuuugcgagaaggcucagucuaaaagaaaggcccugaaacucaauuucgccaaucccccuuuuaagagcacagcucgguucacgcugaacccgaaccccaccggcguucagaauccucauauugaacgccuuagaacacacuccaucgagagcucugggaaacugaagauuucccccgaacagcauugggacuuuaccgccgaggaucucaaggaccugggagaaaucggccgcggggcuuacggaagcgugaacaaaauggugcacaagccuucuggccaaauuauggccgucaaacggaucagauccacaguggaugagaaggagcagaaacagcuucugauggaccucgauguugugaugcggagcucugacugucccuauaucguccaguucuacggcgcgcuguuucgcgaaggggauugcuggauuuguauggagcugauguccaccagcuucgacaaguuuuauaaguacguguauuccguucucgaugacgugaucccggaagagauucugggaaaaaucacacuugccaccgucaaggcucugaaucaucucaaagagaaccugaagauuauccacagagauauuaaaccuucuaauauccuucuggaccggagcggcaacaucaagcucugcgauuucgggauuuccggacaacugguggacagcaucgccaaaacgcgcgacgcuggcuguagacccuacauggccccugaacggauugaucccucugcgucccgccagggguaugacgugagaagcgaugucuggucucugggaaucacccucuacgagcuggccacaggccgguuucccuacccuaaguggaauagcguuuucgaccagcuuacccagguggugaagggcgauccgccccaacuguccaacucugaagaacgcgaauuuagcccuuccuucauuaauuucgucaaccucugccugacaaaagacgagagcaagagacccaaauauaaggagcuucugaaacacccuuuuauccucauguacgaggagcgggcuguggaaguugccuguuaugugugcaagauccuggaucagaugcccgcuaccccgucuuccccuauguacgucgacuga

SEQ ID NO: 71823 - RNA, 1239 nt, Artificial Sequence
  derived and/or modified sequence opt5 from MAP2K5__Homo_sapiens__NP_001193733
augauggagggccacuucccccagagcgacgugaucggccaaguccugccugaagccaccacaacggcuuuugaguacgaagaugaggacggagauagaauuaccguucgguccgacgaagagaugaaggccaugcucucuuauuacuauagcacagugauggagcaacaggugaacggccagcugaucgaaccgcuucagauuuucccccgcgcgugcaaaccucccggggagagaaauauccauggacugaaggucaacacccgggcuggcccuucccagcacucuagccccgccguguccgauucucucccuagcaauucccugaaaaagagcucugccgaacuuaaaaagauucuggcuaacgggcagaugaaugagcaggacauccgcuacagagauacacucggacauggcaacggcgggaccguuuauaaggccuaccacgugccguccggaaaaauccuggcugucaaggugauucugcucgacaucacacuggagcuucaaaaacagauuaugagcgaacuggagauccucuauaagugugauucuuccuacauuaucggcuuuuacggggccuucuuuguugaaaaucggauuagcaucugcaccgaguucauggacggaggcucucuggauguguaucgcaaaaugcccgaacauguccuugggagaaucgcgguggccguggucaagggacugacguaccucuggucccugaagauucugcaccgggacguuaaaccuagcaacaugcucgugaauacccgcggccaggugaagcugugugauuuuggcgucuccacacagcuugugaacucuaucgcuaaaaccuauguugggacaaaugccuacauggcucccgagagaauuagcggagagcaauauggcauccacuccgacguguggagccuggggauuucuuucauggaacucgcccugggacgguuuccuuacccccagauccagaagaaccaaggcucccuuaugccgcugcagcuccugcagugcaucgucgacgaggauagcccugugcugcccguuggggaguucucugagccuuuugugcauuucauuacccaguguaugcgcaaacaacccaaggaaagacccgcgccugaggagcucaugggacacccguuuaucguccaguucaaugacggcaacgccgcuguggucagcaugugggugugccgggcccuggaagaacgcagaucccagcaggggcccccuuga

SEQ ID NO: 71824 - RNA, 1005 nt, Artificial Sequence
  derived and/or modified sequence opt5 from MAP2K6__Homo_sapiens__NP_002749
augagccaguccaagggcaaaaagagaaaccccgggcugaaaaucccuaaggaggccuucgaacaaccgcagaccucuagcacacccccucgggaccucgauuccaaggcuugcauuucuaucggaaaucagaacuuugaggugaaagccgacgaucuggaacccauuauggagcuuggccgcggggcguacggagucguugaaaagaugagacacgugccuagcggccagaucauggcugugaaacggauucgcgccacggucaauucccaagagcagaagagacugcucauggaccuggauaucucuaugcggaccguggacugucccuucacaguuaccuuuuauggggcccuuuuccgcgagggagauguguggaucugcauggaacugauggacacaagccucgauaaauuuuacaagcaggucauugacaaaggccagaccaucccugaggauauucugggcaagaucgcuguguccauuguuaaggcccuggaacaucuccacagcaaacugucugugauccauagagacgucaagccguccaacgugcuuauuaaugcucuggggcaagugaaaaugugugauuucggaaucagcggcuaucucgucgacucuguugccaagacaaucgacgcggggugcaaacccuacauggccccugagcggauuaaccccgagcugaaucagaagggauauuccgugaaaagcgauaucuggucucuuggcauuaccaugaucgaacuggcuauucuccgcuuuccuuacgacuccugggggacgcccuuccagcagcugaagcaaguggucgaggaaccgagcccucagcugcccgccgauaaguuuuccgcugaguucguggacuuuaccucucagugucucaaaaagaacagcaaagaaagaccuacauaucccgagcugaugcaacaccccuucuuuacccuucaugaguccaagggaacagauguugccagcuucgugaaacugauccucggcgacuga

SEQ ID NO: 71825 - RNA, 1308 nt, Artificial Sequence
  derived and/or modified sequence opt5 from MAP2K7__Homo_sapiens__NP_001284484
auggccgcuagcucccuggagcagaagcucucuagacuggaagccaaacuuaagcaagagaaccgggaagcgcgcagacggaucgaccugaaucucgauauuagcccccagcgcccuagaccgaucauugugaucacccugucccccgcuccugcccccucucagcgggccgcucuccagcugccucucgccaacgacggcgggagccgcucccccucuagcgaguccagcccucaacacccgacacccccugcuagaccccggcacaugcugggacugccuucuacgcuuuucaccccucgcuccauggaaagcauugagaucgaucagaaacugcaggagaucaugaagcagacaggcuaccuuaccauugggggacaaagauaucaggccgaaaucaaugaccuggagaaccucggcgaaauggggucuggaacaugcggccaggucuggaaaaugcgguuucgcaagaccggccacguuauugcggugaagcagaugagacgguccgggaauaaagaggagaacaagcgcauccugauggaucuugacgugguccugaaaagccaugauuguccguacauugugcaaugcuucggaacauuuaucaccaauacggacguuuucauugccauggaacucaugggcaccugugcugagaagcugaaaaagagaaugcaggggccuauccccgaacggauccugggaaagaugacaguggccauugucaaagcucucuauuaccugaaggagaaacacggcgugauccauagagauguuaagccuucuaacauucuucuggacgaacgcgggcagaucaaacucugcgauuuuggaauuuccggccggcugguggacagcaaggccaaaaccagauccgcgggcugugccgcuuauauggcccccgagcgcaucgaucccccugacccgacaaagcccgacuacgauauccgggcugacgucuggucucuugggauuagccugguggagcucgccaccggacaauucccuuauaagaauugcaaaacggauuuugaagugcugacaaagguccugcaggaggaacccccucuccugcccggccacaugggguucuccggagacuuucagagcuucguuaaagauugucuuaccaaggaccacagaaaacgcccgaaguacaacaagcugcucgagcauucuuuuaucaaacgguacgaaacacuggagguggauguggccuccugguucaaggacgucauggcuaaaaccgagagcccuagaaccucuggcgugcuuagccagccccaucugcccuuuuuccgcuga

SEQ ID NO: 71826 - RNA, 2865 nt, Artificial Sequence
  derived and/or modified sequence opt5 from MAP3K10__Homo_sapiens__NP_002437
auggaggaagaggaaggcgccguggcuaaggagugggggaccacacccgccggaccugucuggacggcgguuuucgacuacgaagcugccggcgaugaggagcugacccucagacgcggggaccggguccaggugcugagccaagauugcgccguguccggagacgaaggcugguggacagggcagcuuccgucuggaagagugggcguuuuucccagcaacuauguggcuccuggcgcccccgcugccccugcggggcugcagcucccccaggagaucccuuuccacgaacugcaacuugaggagauuaucggagucggcggguuuggaaaaguguaccgggcccuguggcgcggcgaagagguugcugugaaggccgcuagacucgauccggaaaaagaccccgccgucaccgcggaacaggugugucaggaagcccggcuguucggggcucugcagcauccuaauauuaucgcccuccgcggagcuugccugaaucccccucaccuuugucuggugauggaguaugccagaggcggcgcccucucccggguccuggcugggcgcagaguucccccgcaugugcuugugaacugggcgguccaaguggcccggggaaugaacuaccugcacaaugaugcuccuguucccauuauccaucgcgaccucaagucuaucaacauucugauccuggaggccauugaaaaucacaaccucgccgauacagugcugaaaaucaccgacuuuggccuugcuagagaguggcacaagacaaccaagaugagcgccgcggggacguaugcuuggauggccccugaagucauucggcugucccucuucucuaaaagcuccgauguguggagcuuuggaguucugcuuugggagcugcucaccggcgaagugcccuaccgcgagaucgacgcccuggcugucgccuaugggguggcuaugaauaagcugacacuccccauuccuucuaccugcccggagcccuucgccagacugcuugaagaguguugggauccugacccccauggacggccugacuuuggcuccauccugaaaagacucgaagucaucgagcagagcgcgcuguuccagaugccccuugaaucuuuucacucccugcaggaggauuggaagcucgagauucaacauauguucgacgaucugcgcacaaaagaaaaggagcugcggagcagagaagaggagcuccugcgcgccgcucaggaacagcgguuucaagaggaacagcuuagacgccgggagcaggaacuggccgagagagagauggacaucguggaacgcgagcuccaucugcugaugugccagcuuucucaagaaaagccgcggguuagaaaacgcaagggcaacuucaaacgguccagacuccugaagcugcgggaagggggaagccacauuucccucccuucuggcuucgagcacaaaaucaccgugcaggcuagccccacgcuggauaagcgcaaaggguccgacggagccagcccucccgcgucuccuuccauuauccccagacuucgggccaucagacugacaccggucgauuguggcgggagcucuagcggcuccucuagcggaggcuccgggaccuggagccgcggaggcccucccaagaaggaggagcucgugggagggaaaaagaaaggccggacaugggggcccucuuccacccugcagaaggaaagaguuggcggagaggaacgccugaaaggccuuggggagggaagcaagcaguggucuuccagcgcuccuaaucucggcaaguccccgaaacacacccccauugccccuggguuugcuucucugaacgaaauggaggaguucgccgaagccgaggacggaggcagcuccgugcccccuucucccuacagcacaccuuccuaccugagcgucccccucccggcugaaccuucucccggggcgagagccccuugggagcccacgccguccgcuccucccgcccgguggggccauggagcccgcagacggugcgaucuggcccuucugggcugugcuacccuccugggggcggugggacugggcgcugacguggccgaggcccgcgcugccgauggggaggagcaaagacgguggcuugacggacucuuuuucccucgcgcgggcagauuuccccgggggcugagcccucccgcucgcccgcacggcagacgggaagacguuggacccggccuggggcucgccccuucugccacacuggucucccuuagcucugugagcgauugcaauuccaccagaagccugcuccgcucugacuccgaugaggcugcccccgcugccccuagcccucccccgucucccccugcgcccacaccuacccccuccccgagcacgaacccucugguggaccuggaacuugaguccuucaagaaagauccccggcagucucucacacccacccaugucaccgccgcuugugccgugagcagaggacaccgccggacaccuuccgacggcgcucuggggcagagaggacccccugagccggccggccacggccccgggccucgcgaucugcucgacuuuccccggcugccugauccccaggcccuuuucccggcuagacgccggccucccgaauuuccuggaagacccaccacacugacguucgcgccucggccccgcccggccgcuucuagaccucggcucgaccccuggaagcugguuagcuuuggccgcacccugacaaucuccccucccagcagaccggauacccccgagucuccugggcccccuuccgugcaacccacacuucuggacauggauauggaaggacagaaucaggacagcaccgucccucucugcggcgcccaugggucucacuga

SEQ ID NO: 71827 - RNA, 2544 nt, Artificial Sequence
  derived and/or modified sequence opt5 from MAP3K11__Homo_sapiens__NP_002410
auggagccccuuaagagccucuuccugaaauccccucuuggcucuuggaacgggagcggauccggcgggggaggcgggggaggcggcgggagaccggaaggaucucccaaggccgcuggcuacgccaauccuguguggaccgcgcuguuugacuaugagcccagcgggcaggaugaacucgcucugcggaaaggagaccgcgucgagguucuuuccagagaugccgccaucucuggcgacgaaggguggugggcuggacaagugggcggccagguggggauuuucccuagcaacuacgucucccggggaggcgggcccccuccgugcgagguggccagcuuucaggagcugcgccucgaagagguuaucggaauuggcggguucggaaagguguauagaggcucuuggcggggcgaacuggucgcugugaaagccgcgcgccaggaucccgacgaggauaucuccguuacagccgagagcgugagacaagaagcucggcuguuugccaugcucgcucacccuaauauuaucgcccugaaggcggucugucuugaggaacccaaccugugccucgugauggaguacgccgcugggggaccucugucucgcgcccuugcuggcagacgggugcccccgcauguccugguuaauugggccgugcagaucgcccgcgggaugcacuaucuccauugugaagcucuggugccugucauucacagagaccugaaguccaacaauauccuccugcuucagcccauugagagcgaugacauggagcauaaaacgcugaagaucaccgauuucggacucgcgcgggaauggcacaaaacaacccagaugucugccgcuggcacauacgccuggauggccccugaggugauuaaggcuuccaccuuuagcaaaggguccgacguuuggucuuucggcgugcugcuuugggaacugcucacaggagagguccccuaucgcggcaucgauugccuggccguggcguacgggguugcugugaacaagcugacccuccccauuccuagcacguguccggaacccuuugcccaacugauggccgacugcugggcucaggacccucacagacggcccgauuucgccuccauccuucagcagcuggaggcucucgaggcccaaguccugagagaaaugccucgcgacagcuuucauucuaugcaggagggauggaagcgggaaauccagggccuuuucgaugagcugagagcgaaagaaaaggagcuccugucccgcgaggaagaacugacccgggccgcuagagaacaacgcagccaggccgagcagcuccggagacgcgagcaucugcuugcucagugggaacuggagguguuugaacgggagcucacacugcugcuucaacaggucgacagagaacgcccccacgugcggagacggcgcgggaccuucaaaagaucuaagcuccgggccagagauggaggcgagcgcauuagcaugccgcuggacuucaaacaccggaucacaguucaggcguccccugggcuggauagacgcagaaauguguuugaggucggccccggagacucuccuaccuucccccgguuucgcgccauucagcucgaaccugcugagcccggccaagccugggggagacagagcccgcggcgccuggaagauuccagcaacggagagagacgggcuuguugggccuggggcccuucuucccccaagcccggggaagcccagaauggacgcagacggagccgcauggacgaggcuacgugguaccuugauucugacgacuccagcccucugggcuccccgucuacacccccugcgcucaacgggaaucccccuagacccagccuggagccugaggagcccaaacggccggugccugccgaaagaggcuccucuagcggaacccccaagcugauccagcgcgcucugcuccggggcacagcccugcuggccucccucgggcugggaagagaucuucaaccucccggcgggccgggacgcgagcggggcgaaagcccuaccacacccccuacccccacgcccgcuccuugcccgaccgagcccccucccucuccucugauuuguuucucccucaagacacccgacagcccuccgacccccgccccucugcugcuugaucucgggauccccguuggccagagaucugcgaaauccccucgccgggaggaggaacccagaggaggcacagugagcccgccucccgggaccucucgcagcgcucccggaacgccuggcacaccccgguccccuccgcuggggcugaucagcagaccccggccuucuccccuccgcuccagaauugacccuuggagcuuugucuccgccggaccccggccgucuccucugcccagcccucagcccgccccucgcagagcucccuggacccuuuucccggauuccgacccuuuuugggauucuccucccgccaaccccuuccagggcggcccgcaagacugccgggcgcagaccaaggauaugggggcucaggcccccugggugccugaagccggacccuga

SEQ ID NO: 71828 - RNA, 2580 nt, Artificial Sequence
  derived and/or modified sequence opt5 from MAP3K12__Homo_sapiens__NP_006292
auggccugccugcacgagaccagaacacccagcccuuccuucggcggguuugugucuacgcucagcgaggcuuccaugcggaagcuggacccggauaccucugacuguacacccgaaaaagaucuuaccccuacacauguccugcagcuccacgaacaagacgccggaggccccgggggagcggcuggcagcccugagucccgcgccucuagaguucgggccgaugaagugcgccugcagugccagagcggguccggauuccuugagggccuguuuggcugucucagacccguguggaccaugaucgggaaggcuuacagcacagagcauaaacagcaacaggaagaccugugggaggucccuuucgaagagauucuggaucuccagugggugggaucuggcgcccagggggcuguuuuucugggacgguuccacggcgaggaaguggccgucaagaaagugcgcgaccuuaaggagaccgauaucaagcaucugagaaaacucaagcacccgaacauuaucacguuuaaagggguuugcacccaagcgcccuguuauugcauucugauggaguucugugcccagggacagcuuuacgaagugcugcgggcuggccgcccugucacacccucccuccugguggacuggagcaugggcaucgccgggggaaugaauuaucugcaccuccauaagaucauucacagagaucugaaaucuccuaacaugcuuaucaccuacgacgauguggucaagauuuccgacuuuggcacaagcaaggaacugucugacaaauccaccaagaugagcuucgcugggacgguugccuggauggcgcccgaggugauccggaaugagccgguguccgaaaaagucgauauuuggucuuuuggagugguucucugggagcugcuuacaggcgaaaucccuuauaaggacguggauagcuccgccauuaucuggggcgucggaagcaacucucugcaucuccccgugccuuccagcugccccgacggcuucaaaauccugcugcgccaguguuggaacucuaagcccagaaaucggccuagcuuucgccaaauucuccugcaccuugauaucgcuuccgccgacguucugucuaccccgcaggagacauacuucaaaagccaggcugaauggagagaggaggugaagcuccacuucgaaaagauuaaauccgaggggaccugccugcaucggcuugaagaggaacuggucaugagacgccgggaggagcucagacacgcccuggauauccgcgaacauuaugagcggaagcuggaaagagccaauaaccucuacauggagcugaaugcucuuaugcugcaacucgagcugaaagaacgcgagcugcuucggagagaacaggcgcucgagcgccggugucccgggcugcugaagccucaccccagcagaggacuccugcauggcaacaccauggaaaaacuuauuaagaagcgcaaugugccucagaaacugucuccccacuccaagcggccggacauccucaaaacagagagccugcugccuaaacuugaugccgcucucucuggggucggacugcccggcugcccuaaggggcccccuucccccggcagaagccggcgcggaaagacgagacaccggaaggccuccgccaaaggcucuugcggggaccugccgggacucagaaccgcugugccuccccaugagcccggcgggccuggaagcccgggcgggcugggcggaggccccuccgccugggaagcguguccucccgcccuucgcgggcugcaccaugaucuccugcugcggaagaugucuagcuccagcccugaccuucucucugcugcccugggauccagaggccgcggggcuacaggaggcgccggggaccccggcagcccucccccggcuagaggagauaccccucccucugagggcuccgccccugggagcacaucucccgacagcccgggaggcgcgaaaggggaaccucccccucccguuggacccggcgagggggugggccugcucggaaccggccgggaagggacguccggacgcggcgggagcagagccggaucucagcaccugacacccgcugcccuucuguaccgggcugccgucacccgcucccaaaagagaggcaucagcuccgaggaggaagagggcgaaguggauucugagguugaacucaccagcucccagcgguggccgcagucucugaacaugcgccagagccuguccacauuuucuagcgagaaucccuccgacggggaggaaggaaccgcgagcgagccuucucccuccggcacaccugaaguggggagcacgaacaccgaugagagacccgacgagcggucugaugacaugugcucccaaggaagcgaaauuccucuugauccgcccccuucugaggucauccccggcccugaacccuccagccucccgauuccucaccaggagcugcugcgcgaaagagggccucccaauuccgaggacagcgauugugacucuacagagcucgauaacagcaacuccguggacgcccugcggccucccgcuucucuuccuccguga

SEQ ID NO: 71829 - RNA, 2280 nt, Artificial Sequence
  derived and/or modified sequence opt5 from MAP3K13__Homo_sapiens__NP_001229246
auguacugcggcauccagauucuggcccucugggagagagggguguguacccaagcucccugcuauuguaucauuauggaauacugcgcccacggacagcuguaugagguccuucgggcgggccgcaagaucacaccuagacugcucguugacuggagcacggggauugcuuccggaaugaacuaccugcaucuucacaaaaucauccaucgggaucugaagucuccgaaugugcucgugacccacacagacgccgucaaaauuagcgauuucggcaccuccaaggaacugucugacaaaagcacaaagauguccuuugccgggaccguggcuuggauggcccccgagguuauccgcaacgaaccugugucugagaaggucgauauuuggagcuucggagugguucugugggagcuccugacaggcgaaauccccuauaaagacguggauuccagcgcuauuaucuggggcgucgggucuaauucccuucaucugccugugcccagcaccuguccugacggauuuaagauucucaugaaacagacguggcagucuaagccgagaaaccggcccuccuuccgccaaacccugaugcaccuugauaucgccagcgcggacgugcuggccacaccucaggagaccuacuuuaaaucucaggcugaauggagagaggaggucaagaagcacuucgagaaaaucaaguccgagggcacaugcauucaucggcucgaugaagaacugauccgcagacggcgcgaggaacugagacacgcccucgacauucgggagcauuaugaacgcaaacuggagagagcuaauaaccuuuacauggaacugagcgccaucaugcuccagcuggagaugcgggaaaaggagcuuauuaaaagagagcaagcgguugaaaagaaauaccccgggaccuauaagcgccacccugugcggcccaucauccacccgaaugccauggagaagcugaugaaaagaaagggagugccucauaaauccggcaugcagacgaagcgccccgaucuccugcggucugaagggauuccuacaaccgaggucgcucccacagccagcccccuguccggaagcccuaaaaugucuaccuccagcucuaagagcagauaccgcuccaagccgcggcacagacgcggcaacucucggggcagccauuccgacuuugcugccauccucaaaaaucagcccgcccaggaaaacagcccucaccccaccuaucugcaucaagcucagucucaguacccuucccuucaccaccauaauagccugcaacagcaguaucagcaacccccgccugcgaugucucagucccaccaucccagacucaacaugcacgggcaggacauugccacaugugcuaauaaccugcgcuacuucggaccugccgccgcccuucggagcccccuguccaaucacgcucagagacaacucccuggcucuagccccgaucugaucuccacggcgauggcugccgacugcuggcggucuagcgagccggauaaggggcaggccggaccuuggggcuguugccaggcugacgccuaugaucccugucugcagugccgccccgagcaauacgggucccucgacauuccuagcgcugaaccggugggaagaucucccgaucuguccaaaagcccugcccauaacccccuucuggagaacgcgcagucuuccgaaaagaccgaggagaaugaauuuagcggcugccggucugagagcucccucggcacaagccaccuggggaccccucccgcccugccuagaaaaacacgcccccuucagaagucuggagacgauuccagcgaagaggaagagggcgagguugacuccgaaguggaguucccgcggagacagcgcccucauagauguaucucuagcugccaauccuacucuaccuuuagcuccgaaaacuucucugucagcgauggggaggaaggaaauacguccgaccacagcaacucucccgacgagcucgcugauaagcuggaggaccggcuggccgaaaaacucgaugaccugcuuucccagacaccugagauccccauugauaucagcucucauuccgacggccugagcgauaaggaaugugcugugcgcagaguuaaaacccagaugucucucgggaagcugugcguggaggaacggggcuaugagaauccgaugcaauuugaggaauccgacugugauagcuccgacggagagugcagcgaugccaccguccgcacaaacaaacacuacucuagcgcgaccugguga

SEQ ID NO: 71830 - RNA, 2844 nt, Artificial Sequence
  derived and/or modified sequence opt5 from MAP3K14__Homo_sapiens__XP_011523743
auggccgugauggagauggcuugccccggcgccccugggagcgcggucggacagcaaaaggaacugccgaaagcuaaggagaaaacacccccucucggcaagaaacaguccucuguuuacaagcuggaagccguggaaaagagccccguguucugugggaaaugggaaauccuuaacgacgucauuaccaagggaacggccaaagagggcuccgaggcugggccugccgcuaucucuauuaucgcccaggcggaaugcgagaauagccaggaauuuucccccaccuucucugagagaauuuuuaucgccggaagcaagcaauauucccagagcgagucucuggaucagaucccuaacaauguggcucacgccacagaaggcaaaauggcucggguuuguuggaagggcaagcgcagauccaaagcccggaagaaacgcaagaaaaagagcucuaaaucccucgcgcaugccgggguggcucuggccaagccgcuucccagaaccccugagcaggaaagcugcacaauucccguccaagaggacgaaucuccucugggagcucccuacgugcggaacaccccgcaguucacaaagccucucaaagagcccggccuggggcagcuguguuuuaagcagcucggagagggccugcgcccugcccuucccagauccgaacugcacaaacucaucagcccccugcaaugccuuaaucauguuuggaagcugcaccauccucaggaugggggaccgcucccccugccuacccaccccuucccuuauucccggcugccccacccguuuccuuuccauccccuccagccuuggaaaccccacccucuggagucuuuucuuggcaagcuggccuguguggacagccaaaagccccucccggauccucaucuguccaaacuugcuugcgucgacagccccaagccccugccuggcccgcaccucgaacccucuugucugucccgcggggcgcacgagaaauucagcguggaagaguaccuggugcaugcccuccagggaucugucagcuccggccaggcucacucucugacgagccuugccaagaccugggccgcuagagggucccggagccgcgagccuucucccaaaacagaagauaacgagggaguucugcucaccgaaaagcugaagccuguggacuaugaguacagagaagaggugcauugggccacacaccagcuucggcugggccgcggguccuuuggagagguccauagaauggaagauaaacaaaccggcuuccagugcgcggugaagaaaguucggcucgagguguuuagagcugaggagcugauggccugugccggccugacgagcccccgcauugucccucucuauggggcugugcgggagggacccuggguuaauaucuucauggaacugcuugagggcgggucucugggacagcucgugaaggaacagggcugccugccggaggacagagcccuguacuaccuugggcaagcucucgaaggccuggaguaucugcacucccgccggauucuccacggagaugucaaagccgacaacgugcugcuuagcuccgauggcucucaugcggcccugugcgacuucgggcacgcugucugucuccagccugacggacugggcaagagccugcuuacaggggauuacauccccggaaccgagacacauauggccccugaagugguucucggcagauccugcgacgcuaagguggaugucuggucuagcuguugcaugaugcugcacaugcugaaugggugucaccccuggacccaguuuuuccgcggcccgcucugccugaaaauugccuccgagccucccccugugcgggaaaucccucccagcugugcgccccuuaccgcccaggcuauccaagagggacugagaaaggaaccgauucaucgcguuucugccgcugagcucggcgggaaagugaaccgggcccugcagcaggucggaggccugaagucccccuggagaggggaguauaaagaaccucgccaucccccucccaaucaggccaacuaccaccaaacacuucacgcucagccucgggagcucagcccgagagcgcccggaccucggcccgccgaagagacgaccggccgcgcuccuaagcugcagcccccgcugccucccgaacccccugagcccaauaaaucuccuccgcucacacuguccaaggaggaaagcgggaugugggagccccuuccucugucuagccucgaacccgccccugccagaaaccccuccagcccggagcggaaggcuaccgugccugagcaagaacugcagcagcuggagaucgaacuuuuucucaauucucugucccagcccuucagccuggaggaacaagagcagauucucuccugccugucuaucgacagccuuucccugucugaugacagcgagaaaaacccuuccaaggccucucagagcuccagagauacacucagcucuggcgugcauuccuggagcucucaggcggaagcucgcuccagcucuuggaacaugguucuggcccggggaagacccaccgacacgccuuccuauuuuaauggcgucaaagugcaaauucagagccugaacggggagcaccuucacauccgcgaguuccauagagugaaggucggagauaucgccacaggcauuuccagccagauccccgcugccgcguuuucucuggugaccaaagacgggcagccgguucgguacgauauggaagugccugacagcggaauugaccuccaauguacccuggcucccgauggcuccuucgccuggucuuggcgcgucaagcacgggcagcucgaaaauagacccuga

SEQ ID NO: 71831 - RNA, 3648 nt, Artificial Sequence
  derived and/or modified sequence opt5 from MAP3K19__Homo_sapiens__NP_001018054
augagcuccaugcccaagccugagagacacgccgaaucucugcucgacaucugccaugauaccaacagcuccccgacagaccugaugacggugaccaaaaaucagaacauuauccuucaaucuauuagccgguccgaggaauuugaucaggacggcgauuguucucacagcacacuggucaaugaggaagaggaccccuccgggggacgccaggauuggcagccuagaaccgaggaauuuagcacaucucauaugaaguacuccggccggagcaucaaauuccuccugcccccucuuucucugcuccccacccgcuccgggguucugacaauuccucaaaaccacaaguuuccgaaagagaaggaaagaaauauccccagccugaccucuuucgugccuaagcucuccgugagcguccggcaguccgacgagcugucucccagcaacgagccucccggagcucuugugaaaucccugauggauccgacgcuccgcagcucugacggcuuuaucugguccagaaauaugugcagcuucccuaagaccaaccaucaccggcagugucuggaaaaagaggaaaauuggaagucuaaagagauugaagagugcaacaagaucgagauuacacacuuugaaaaggggcagagccuuguuuccuucgagaaucugaaagaaggaaacauccccgccgugcgcgaggaagauauugacugucauggcucuaagaccagaaaaccugaggaggaaaauagccaauaucucuccagccggaagaacgagucuuccgucgcgaaaaauuacgaacaggaucccgagaucgugugcacaauucccagcaaguuucaggaaacccagcacucugagaucacgccuucccaagacgaggaaaugcgcaacaacaaagcugccagcaagagaguuucccugcauaagaaugaggccauggaaccgaacaauauccuggaggaguguacagugcucaaaucucugagcuccgucguguucgacgaucccauugacaagcugccugaaggcugcucuagcauggagaccaacaucaaaauuuccaucgcugaacgggccaagcccgagaugagccgcauggugccucugauucacaucacauuucccgucgaugggucuccgaaagaaccuguuaucgcuaagcccucccuccagaccagaaagggaaccauucacaauaaccauagcgugaauaucccugugcaccaggagaacgacaaacauaagaugaacucucaccgguccaaacuggauagcaagacaaaaacgucuaagaagacaccccaaaauuucgucauuagcaccgagggcccuaucaaacccaccaugcauaagacauccauuaaaacccagaucuuuccggcccuugggcugguggacccuagacccuggcagcucccccgcuuccagaagaaaaugccucaaaucgcgaagaagcagagcacgcaccggacacagaaaccgaagaaacagucuuuccccuguauuugcaagaauccuggaacccaaaaauccuguguuccccugagcgugcagccuaccgaacccagacugaacuaucucgaucugaaguacuccgacauguuuaaagagaucaauucuacagccaacggcccugggauuuaugaaauguucggaacccccgucuacugccacgugcgcgagacagaacgggaugagaauacguauuacagagagaucugcagcgcuccguccggccgccggauuaccaacaaguguagaucuagccauuccgaacgcaagucuaacauccggacaagacuuagccagaaaaagacccacaugaaaugcccuaagacauccuuuggcauuaaacaggagcauaagguucugaucagcaaggaaaaaucuuccaaggccgugcacagcaaucuccacgacaucgagaacggggauggaauuucugaacccgacuggcaaaucaaauccagcggcaaugaguuccugucuuccaaggacgagauucauccuaugaaccuugcucagacccccgaacagagcaugaaacagaaugaguuuccgccugucuccgaucugagcaucguggaagaggucucuauggaggaaagcacgggggaccgcgauauuuccaacaaucaaauccucaccacaucucugcgggaccugcaggagcucgaggagcugcaccaucagauccccuucauuccuagcgaagauuccugggccgugcccucugagaagaacagcaauaaguacguucaacaggagaaacagaacaccgcgucccuuucuaaggugaaugccagcagaauccugacaaacgaccucgaauuugauuccgucagcgaccacucuaaaacccugacgaauuucuccuuucaggcuaagcaagagagcgccucuucccagacauaucaguacugggugcauuaucuggaucacgacagccuugcuaacaaauccauuaccuaccagauguucggaaagacacucucuggcaccaauagcaucucccaagaaauuauggauagcguuaacaacgaggaacugaccgacgagcugcucgggugucuggccgccgagcuucuggcucucgaugaaaaggacaauaacucuugccagaaaauggcgaaugagacagaccccgaaaaccugaaucuggugcuucgguggcgcggauccacgccuaaggagaugggcagagaaaccacaaaagucaagauccagcggcacagcucuggccucagaaucuaugaucgcgaggagaaauuucugauuagcaacgaaaagaaaaucuucuccgaaaauucucuuaagagcgaggaaccgauucucuggaccaagggggagauccugggaaaaggcgccuacgggacaguguauuguggacuuaccucccagggccaacugauugcugugaagcagguugcccucgacacgucuaacaaacuggccgcugaaaaggaguaccggaaacugcaggaagaggucgaucuucucaaggcccugaagcaugugaauaucguggcguaccuggggacaugccuccaagaaaacaccgucagcaucuuuauggaguucgugcccggcggauccauuagcucuaucauuaauagauucggcccucugcccgagaugguuuucuguaaauauaccaagcagauccuucaggggguggcuuaccugcacgaaaacugcgucgugcaucgcgacauuaaaggaaauaacguuaugcucaugccuacaggcaucauuaagcugaucgauuucgggugugccagacggcuggccugggcuggacuuaauggcacccacuccgacaugcucaaaagcaugcaugggacacccuauuggauggccccugaggugaucaacgaauccggcuacggacgcaagucugauauuuggagcaucggcugcacggucuuugagauggcuaccgggaagccgccccuggccuccauggacagaauggcggccauguucuauauuggagcucaccggggccugaugccuccccucccugaucacuuuucugaaaacgccgcugacuucgugcgcaugugucugacaagagaucagcaugagcggcccagcgcccuucaacugcucaaacacuccuuucuggagcgcagccauuga

SEQ ID NO: 71832 - RNA, 4539 nt, Artificial Sequence
  derived and/or modified sequence opt5 from MAP3K1__Homo_sapiens__NP_005912
auggccgcugccgcgggcaacagagcuagcuccucuggguuccccggagcccgggccaccagcccugaggcuggcgggggaggcggggcccugaaggcuuccucugccccggcggccgcugccggacuccugcgcgaagcuggcagcggcgggagagagcgggccgacuggcgcagacggcagcuucgcaaagugagauccgucgaacuggaucaacuccccgagcagccucuguuucuugcggccucucccccugcuagcuccacaagccccucuccugaaccggccgacgcugccggauccggcacgggguuccagcccguugccgugccucccccucacggagcugcgagccggggcggggcccaucugaccgagucuguggcugcccccgauuccggagccagcucuccggcugccgcggagccuggcgaaaagcgcgcucccgccgccgagccuucccccgcugccgcucccgccggcagagaaauggagaauaaagagacacucaaggggcugcacaaaauggacgaucggccugaggaacgcaugaucagagaaaagcugaaggcgaccugcaugccggccuggaaacaugaguggcucgaacggcgcaacagacggggacccgucgugguuaagccuauucccgugaaaggcgacgggagcgagaugaaucaccuggcugccgaguccccuggagaaguccaggcuucugccgcgagccccgccuccaagggcagacgcagcccgucuccugggaacucccccagcggacggacagugaaaucugagagcccuggcguuagacgcaagcgggugucccccgucccuuuucaaucuggcagaaucaccccgccgcgccgggcuccuagccccgauggguucucccccuacagcccugaagagacaaauagacgcgugaacaaggugaugcgggccagacuuuaucugcuccagcagauuggacccaauucuuuucugaucggcggggacucccccgauaacaaauaccgcgucuucauuggaccucagaauuguagcugcgcucggggcaccuuuuguauccaucuucuguucguuaugcucagaguguuucaacuggaacccucugacccuaugcuguggcggaagacgcucaaaaacuucgagguggagucccuguuucagaaguaucacagccgcagauccucucggaucaaagcccccagcagaaauaccauucagaaguucgucucccgcaugucuaacagccacacacuuuccucuagcuccaccagcacaucuuccagcgaaaauucuaucaaagaugaggaggaacagaugugcccuauuugucugcucgggaugcuggacgaagagagccuuaccgugugcgaggauggcugucggaacaagcugcaucaccauugcauguccaucugggccgaagaguguagacgcaauagagaaccccucauuugcccgcugugucggagcaaguggcgcucucacgacuuuuacucccacgagcugagcuccccuguugacucucccagcucccucagagcugcgcaacagcagacggugcaacagcagccucuggccggaucucggcgcaaccaggagagcaacuucaaucuuacacauuauggcacccaacagauucccccggcuuacaaagaucuggccgaaccuuggauccaggucuucgggauggagcucgugggaugccuguuuuccagaaacuggaauguucgggaaauggcccuucgcagacugucucacgacgugagcggcgcucuccugcuggccaacggggaguccacaggaaauagcggcgggucuuccggcagcucucccuccggaggcgcgaccagcgggucuucccagaccagcaucuccggagaugucguggaggcuugcuguagcguccucucuauggugugcgccgacccuguuuauaagguguacgucgccgcucugaaaacacuucgggccaugcugguguacacgcccugucauagccucgcggaacgcaucaagcugcaaagacugcuucagcccguuguggauaccauucucgucaaaugcgcugacgccaacucccggacaucucagcugagcaucuccacccugcucgagcuguguaagggccaggccggggaacuugcugugggaagagagauucugaaggccggcucuaucgggauuggcggaguggauuauguucucaauugcauccugggcaaccaaacagaaagcaauaacuggcaggagcugcuugggcgccucugucugaucgaccggcugcuccuggaguucccugcugaauuuuacccgcacauugucuccaccgaugugucucaggccgagcccguggaaaucagauauaaaaagcugcuuagccuccugacguucgcgcugcaguccauugacaauagccauucuauggucggaaaacuuucccgccggaucuaccucagcucugccagaauggugacaaccguuccucacguguuuuccaagcugcuggagaugcucagcgucuccucuagcacccacuucacacgcaugcggagacgccugauggcuauugccgaugaaguggagaucgcugaagccauccaacuuggcguugaggacacccuggacgggcagcaggauuccuuucuccaagccagcgugcccaacaauuaucuggagacaacggaaaacucuuccccugagugcaccguccaucuggaaaagacaggaaagggccuuugugcuaccaagcucagcgcgucuagcgaggacauuuccgagcggcuggccucuaucagcguggggcccuccucuagcacaaccacgaccacaaccacaaccgaacagccuaaaccgaugguucagacgaagggcagaccccacucccagugccugaauagcucuccucucucccaucacagccaacugauguuccccgcucuuuccacaccuucuagcuccacccccucugugccggccggaacagccaccgaugucagcaaacaccggcugcagggcuuuauuccuugucgcauccccuccgcuagcccccagacccagagaaaguucucucuccaauuucaucggaacugcccugagaacaaagacuccgauaagcugagccccguguucacacagucucgcccucugccguccagcaauauucacagacccaagccuucucggcccacgccugggaacaccagcaaacagggagaccccuccaaaaauucuaugacacuugaucugaacagcuccagcaaaugcgacgauuccuuuggcuguucuagcaauuccucuaacgccgugaucccgagcgacgaaaccgucuucacaccuguugaggaaaagugcagacucgaugugaauaccgagcugaacuccucuauugaggaccuccuggaagcgagcaugcccuccagcgauacgacagugaccuucaaaucugaggucgcugugcuuuccccugaaaaggccgagaaugacgacaccuacaaagaugacguuaaccauaaucagaaguguaaggagaaaauggaagccgaggaagaggaagcucuggccaucgcgauggcuaugagcgccucucaagaugcccuccccaucgugccucagcugcaggucgagaacggggaagacauuaucauuauccaacaggauacacccgagacccugccgggacacacaaaggcuaaacagccuuaucgcgaggacacggaauggcuuaagggccagcaaauuggccugggggccuuuuccagcugcuaccaggcucaggaugugggaaccggcacacucauggccguuaaacaggugaccuacguccggaauacaucuuccgagcaagaagaggugguugaggcgcugagagaagagauccgcaugaugagccaucucaaccaccccaauaucauucggaugcugggggccaccugugaaaaguccaacuauaaccuuuucaucgaguggauggcuggaggcagcguggcccaucugcucucuaaguacggggcuuuuaaagaaagcgucgugauuaauuauacggagcagcugcugagaggacuuuccuaccugcacgagaaccagaucauucaccgcgacgugaagggcgccaaucuccugaucgauucuaccggccagcggcucagaaucgccgacuucggggcugcggcccgccuggcuagcaaaggaacaggcgccggggaauuucaaggacagcuucugggcaccauugccuucauggcucccgagguccugagagggcagcaguauggacgguccugcgauguuuggucugugggcugugccaucauugaaauggcgugcgcuaagccuccguggaacgccgagaaacauagcaaucaccucgcccugaucuuuaagauugcuuccgccacaaccgcgcccucuaucccuagccaucuuucccccggccugcgcgacguggcccucagaugucuggaacuccaaccucaggaucggcccccuagccgcgagcugcuuaagcacccggucuucagaacaaccugguga

SEQ ID NO: 71833 - RNA, 1860 nt, Artificial Sequence
  derived and/or modified sequence opt5 from MAP3K2__Homo_sapiens__NP_006600
auggacgaucagcaagcccugaacagcaucaugcaggaccucgcugugcugcacaaggccuccagacccgcgcuuucucugcaggagacccggaaagcuaagagcuccucuccuaaaaagcagaaugauguccgcguuaaauucgaacauagaggcgagaagcggauucuccaauuuccgcgccccgugaagcuggaagaccuuagaagcaaagccaagaucgccuucgggcaguccauggaucugcacuacacaaacaaugagcucgugauuccucugacgacccaggacgaucuggacaaagcugucgaacuccuggaucggucuauccauaugaaaagccuuaagauucugcucgugaucaacggauccacacaggccaccaaucuggagccccuuccuagccuggaggaccucgauaacacaguuuuuggcgcugaacgcaagaagagacugucuaucauugggcccaccucccgggaccgcagcucuccuccgcccggauauaucccugaugagcugcaccaaguggccagaaauggcuccuucacaagcauuaacucugaaggggaguuuauccccgaguccauggaccagaugcucgacccucugagccuuuccucucccgaaaauagcggauccggcagcugcccgucucuggauuccccucucgacggcgagagcuaccccaaaucucggaugccucgcgcgcagagcuaucccgauaaccaucaggaguucuccgacuacgauaaucccauuuuugaaaaguucgggaaaggaggcaccuauccuagacgguaccacgucucuuaucaccaucaagaauacaacgacgggcgcaagacguuuccgagagcccggagaacccagggaacaagccugcgcucccccgugagcuucucuccuaccgaucacucccuuagcacaucuuccggcagcuccaucuuuacccccgaguacgacgauucucggauuagacgccgggggagcgacaucgauaauccuacgcugacaguuauggacaucucucccccguccagaagcccucgcgcucccaccaacuggcggcucggaaaacugcugggccagggcgccuucgggagaguguaucucuguuacgacgucgauacaggacgcgagcuggcugugaagcaagugcaguuugacccugauucccccgaaaccagcaaagaggucaaugcccuugaaugcgagauucagcugcucaagaaccugcuucaugaacggaucguucaguauuacggcugucugagagacccucaagagaagacccucucuauuuucauggaguauaugcccgggggauccaucaaagaucagcugaaggcguacggcgcccugacagaaaacgugacgcgcaaauauacccggcagauucucgagggggugcacuaccugcacagcaauaugaucguccauagagacaucaagggagcuaacauucuucgggauucuacaggcaaugugaaacugggcgacuucggggccuccaagcgccuccagaccaucugccugagcggaacaggcaugaagucuguuaccgggacgccguacuggaugagcccugaagugauuuccggagagggcuaugggagaaaagcugauaucuggagcgucgccuguacagugguugaaaugcugaccgagaagccucccugggccgaguuugaagcuauggcggccauuuucaaaaucgcuacccaacccacaaacccgaaacuucccccucacgugucugacuacacccgggauuuucucaagagaaucuucgucgaggccaagcugcgccccuccgccgacgaacugcuccggcauauguuugugcacuaucauuga

SEQ ID NO: 71834 - RNA, 1881 nt, Artificial Sequence
  derived and/or modified sequence opt5 from MAP3K3__Homo_sapiens__NP_002392
auggacgagcaggaagcccugaacagcaucaugaaugaucucguggcucugcaaaugaacagacggcaccgcaugcccggcuacgagaccaugaagaauaaagacacagggcauuccaacagacagucugauguccggauuaaguucgaacacaauggagagcgcagaaucauugccuuuagccggccuguuaaauaugaagacguggagcauaaggugacgaccgucuucggccagccgcuugaucugcacuacaugaacaaugagcucuccauccugcuuaaaaaccaggacgaucuggacaaggcgauugauauccucgaccgcucuagcuccaugaagucucugagaauccugcuccugagccaagaucggaaucauaacuccagcucuccccacuccggggugagccgccagguuagaauuaaggcuucucaguccgccggagacaucaauacaauuuaucagccucccgaaccucggagccgccaccuuucuguguccagccaaaaccccggcagauccucuccuccgcccggguacgucccugagcggcagcagcauaucgcccgccagggaagcuauaccuccauuaauagcgaaggcgaguuuauccccgagacaucugaacaaugcaugcuggauccucucuccagcgcugagaacucucugagcggcuccugucagucucuugacagaagcgccgacucccccagcuuccggaaaucuagaaugucccgcgcucagagcuuuccggauaaucggcaagaauacucugacagagagacccagcuguaugauaaaggggugaagggaggcacauacccucgccgguaccacguuuccgugcaucacaaagacuauagcgaugggagacgcaccuucccccggauuagacgccaccagggaaaccucuuuacgcuggucccuuccucucggagccuguccaccaacggcgaaaauauggggcucgccgugcaguaccuggaccccagaggacgccuucggucugcggauagcgagaacgcccuguccgugcaagagagaaauguccccacaaagagcccuucugcuccgaucaacuggcggcgcggcaagcuccugggccagggggccuucggaagaguuuaucuuugcuacgacguggauaccggccgggaacuggcuuccaaacaggugcaguuugaccccgauagcccugagacaucuaaggaagucuccgcccucgagugugaaauccaacugcugaaaaaucuccagcaugagagaauugugcaguauuacgggugccugcgcgaccgggcggagaagacccuuacgaucuucauggaauauaugcccggaggcagcguuaaagaccagcugaaggccuacggggcucucacagagucugugaccagaaaauacacacgccaaauucuggaaggaaugagcuaucuucacuccaacaugaucguccauagagauauuaagggcgccaauauccugcgggacagcgcuggcaacgugaagcucggggauuuuggagccucuaaacgccugcagaccaucuguauguccggcaccgggaugagaagcguuacaggaacgccuuacuggaugucccccgaggugauuucuggcgaaggguauggccggaaggccgacgucuggagccugggaugcaccguggucgagaugcucacagagaaaccgccuugggcugaauacgaggcgauggccgcuaucuucaagauugccacccagcccacaaauccucagcugcccucccacaucucugaacauggccgcgauuuucuuagacggauuuucguggaggcccgccaaagaccuagcgcugaggaacugcucacccaccacuucgcccagcugauguauuga

SEQ ID NO: 71835 - RNA, 4827 nt, Artificial Sequence
  derived and/or modified sequence opt5 from MAP3K4__Homo_sapiens__NP_005913
augagagaggccgcugccgcgcuggugcccccuccggcuuucgccgucacccccgccgcugccauggaagaaccucccccucccccuccgcccccucccccucccccggaaccugagacagaaagcgagcccgagugcugucucgcugcccggcaggaaggcacgcugggggacuccgcgugcaagucuccugagagcgaucuugaagacuuuuccgaugagaccaacacagagaaucuguacggaaccucuccucccagcacaccccgccaaaugaaaagaauguccaccaagcaccagcggaacaauguuggccgcccggccucuagaagcaaccucaaagaaaagaugaaugcucccaaccagccuccccauaaagacacagggaagaccguggagaauguggaagaguauuccuacaagcaggagaaaaagauccgggccgcucugcgcacgaccgagagagaucacaaaaagaacguccaauguagcuucaugcuugacucugugggaggcucccugccuaaaaagagcauucccgauguugaccucaauaagccguaucugucucuggggugcuccaacgccaaacucccugugagcguccccaugccuaucgcgcggcccgcccgccagacaucuagaaccgauuguccugcugaccggcugaaguuuuucgagacacuucgccugcuccugaaacuuaccuccgugagcaagaaaaaggauagagaacagcggggacaggagaauacguccggcuuuuggcugaaccgcucuaaugaacucauuuggcuggagcugcaagccuggcaugcuggcagaacaaucaacgaccaggauuucuuucucuacaccgcccggcaggccauucccgacaucaucaaugaaauucugacauucaaaguugacuaugggagcuuugcuuucgugagagaucgcgcgggauuuaacggcaccuccgucgaggggcagugcaaggccaccccgggaacaaagaucgugggcuacagcacgcaccaugagcaccuucaacggcagagagugucuuucgaacaggucaaacgcauuauggagcugcucgaauauaucgaggcucuguacccuucccuucaagcccugcagaaggacuacgaaaaauaugccgcuaaggauuuucaggaccggguucaggcccucugucuguggcugaacauuaccaaagaucucaaucaaaagcugagaaucauggggacagugcuuggaauuaagaaccugagcgacaucggcuggcccguguucgagauccccucuccucgcccgagcaaaggcaaugagcccgaauacgagggggaugacaccgaaggagagcucaaggagcuggaauccucuacagaugagagcgaagaggaacagauuuccgacccucggguccccgagaucagacagccuauugauaacagcuucgacauccagucucgcgacugcauuuccaaaaagcuggagcggcuugaaagcgaggaugacucucucggcuggggagcgcccgauugguccaccgaagcuggauuuagcagacacugucugacguccaucuaucgcccuuucguggacaaagcccugaagcaaaugggccuccggaagcugauccuuagacugcauaaacucauggaugggucucugcagcgggcccgcauugcucugguuaagaaugacagacccguggaguuuagcgaguucccggauccuauguggggauccgacuacguccagcuuucucggacacccccuagcuccgaggagaaaugcagcgccgugucuugggaagaacucaaggcuauggaucugcccuccuuugaaccggccuuccugguucucuguagagugcugcuuaacgucauccacgagugccugaaacuccgccuggaacagcggccugcgggcgagcccagccugcuuucuauuaagcaacucgugagagagugcaaggaaguccugaaaggcgggcugcucaugaagcaguauuaccaguuuaugcugcaggaggugcuugaagaccuggagaaaccugauuguaauaucgacgccuucgaggaagaucuccauaagaugcugaugguuuauuuugacuacaugcgcuccuggauucaaaugcugcagcagcuuccccaagcuagccacucucucaaaaaccugcuggaggaagaguggaauuucaccaaggaaaucacccacuacaucagaggaggcgaggcccaggcugggaaacucuuuugcgacauugccggaaugcugcuuaagagcacaggcuccuuccuggaguuugggcuccaggaaagcugugcggaguucuggaccucugccgaugacuccagcgcuuccgaugaaauccggcgcucugugauugagaucagcagagcccugaaggaacuguuccaugaggcucgggagcgcgccuccaaagcccuuggcuuugcuaagaugcucagaaaagaccuggaaauugcggccgaguuccggcugucugcucccguccgcgaucuccuggacgugcuuaagagcaaacaguauguuaaggugcaaaucccuggacuggaaaaccuccagauguuugucccggauacacuggccgaggaaaaguccauuauccugcagcuucugaaugccgcugccggcaaagacugcucuaaggauagcgacgaugugcucaucgacgcguaccugcuccugacgaaacacggggauagagcucgggacuccgaggacagcuggggaaccugggaggcccagcccgugaagguugucccucaaguggaaacaguggauacccuucgcucuaugcaggucgacaaccugcuccuggugguuaugcaguccgcccaucugacaauucagagaaaggcuuuccaacagagcaucgagggccuuaugacccugugucaggaacaaacgucuucccagcccgugauugccaaagcgcuccagcagcugaagaaugaugcucucgagcugugcaaccggaucagcaaugccauugacagagucgaucacauguuuaccucugaguucgacgccgaaguggaugaguccgaaagcguuacacuucaacaguauuaccgcgaggcuaugauccagggguauaacuuuggauucgaauaccauaaagaggugguccggcugauguccggcgaguuuagacagaagaucggggacaaauauauuagcuucgcccgcaaguggaugaacuacgugcucaccaaaugugaaucuggccggggaacaagaccucgcugggcuacccaaggcuuugauuuccugcaggccaucgagcccgcguuuauuagcgcccugccugaagacgauuuccuuucccugcaggcucucaugaaugagugcaucgggcacguuauuggaaagccgcacucucccgugacgggccuguaccucgccauccaucggaacagcccuagacccaugaaggucccucgcugucacuccgaucccccgaauccucaucugaucauucccacacccgaaggguucucuacccggagcaugccuuccgacgcuagaucucacggaagccccgccgccgcugcggccgcugccgccgcugccguggcggcuucccggccuagcccgucuggcggggacuccgugcuucccaaaagcaucucuuccgcccacgacacacgcggcagcuccgucccugagaacgauagacuggccucuauugcugccgagcugcaguuucggagccucucccgccauagcucucccaccgaagagagagacgaaccugcguauccccggggagauuccagcggcucuaccagacgcagcugggagcugcggacacuuaucucccaaucuaaggacacggcuagcaaacuggggccgauugaagccauccagaaguccguuagacucuucgaggagaaacgcuaccgggaaaugagacgcaagaauaucauuggacaggugugcgauaccccuaaaucuuaugacaacgugaugcacgucggccugcggaaggugacauuuaaguggcagagagggaauaaaaucggagagggccaauacgggaagguuuauaccuguauuagcguggauacaggcgaacucauggccaugaaagagauccgcuuccagcccaacgaccauaagaccauuaaagagacggcugaugaacugaagaucuuugagggaauuaagcacccuaaucuugucagauacuucggcguggaacugcaucgggaggaaauguauaucuuuauggaguacugcgacgaggggacacuggaagagguuucccgccucggacugcaggaacacgugaucagacuuuacagcaaacaaauuaccaucgccauuaacguccugcacgagcauggcaucgugcaccgggauauuaagggggcuaauaucuuccucaccucuuccggacugaucaaacucggcgacuuuggcugcagcguuaagcugaaaaacaaugcccagacaaugcccggggaagugaacuccacccuuggaacagcggccuauauggcuccugaggucauuacgcgcgccaagggcgaggggcaugggagagcugccgacaucuggucucugggcuguguggugauugaaauggucaccgggaagcggcccuggcacgaguacgaacauaauuuccagaucauguauaaaguuggaaugggccacaagccgccuauucccgagagacugagccccgaaggcaaagauuuucucucccacugccuggagucugacccuaagaugcgcuggacagccagccagcuucuggaucauuccuucgugaaaguguguaccgacgaggaauga

SEQ ID NO: 71836 - RNA, 4125 nt, Artificial Sequence
  derived and/or modified sequence opt5 from MAP3K5__Homo_sapiens__NP_005914
augagcaccgaggccgacgaaggcaucacauucuccgugcccccuuuugcuccgucuggguucugcacgauucccgagggaggcaucuguagacggggaggagccgcggcugucggcgaaggggaggaacaccagcugccucccccucccccugggagcuuuuggaacguugaguccgccgccgcuccgggcauuggcugccccgccgcuaccucuagcuccucugccacacgcgggagaggaagcuccgugggcgggggaagccggcgcaccacaguggcguacgucaucaaugaggccucucaaggccagcucgugguugcugaauccgaggcccugcagagccuuagagaggcuugugaaaccgugggggccacacuggagacccuccauuucggaaagcuggauuuuggcgaaacgaccguccuugaccgguucuauaacgcggauauugccgugguugagaugucugacgcuuuucgccagccuucccuguucuaccaccucggcgugagagagagcuuuucuauggccaauaacaucauccuguauugcgauacaaauuccgacagccugcaaucccucaaagaaauuaucugucagaagaacaccaugugcacagggaauuacaccuucguccccuauaugauuacgccucauaacaaaguguacuguugcgauucuagcuuuaugaagggacugacagaacuuaugcagcccaauuucgagcugcuccugggcccgaucugucuuccucugguggaccgguuuauucagcuccugaaagucgcucaagccuccagcucucaguauuuccgcgaguccauccugaacgauauuagaaaggcccggaaucucuacaccgggaaggaacuggcugcggagcuugcccgcaucagacagcggguugacaacaucgaagugcugacagcugauauugugaucaaucuccugcuuagcuaccgcgacauucaggauuaugacucuaucgucaaacugguggagacccucgaaaagcugcccaccuucgaccuggccagccaccaucacguuaaauuucacuacgccuucgcucucaacagacggaaucugccuggagauagagccaaggcgcuugacauuaugauccccauggugcaauccgagggccaggucgcuucugauauguauugccugguggggcgcaucuacaaagacauguuucucgauagcaacuucacagacacggagucccgggaucauggagccagcugguuuaagaaggccuucgaaucugagcccacccugcaguccggcauuaacuaugcuguucuucugcucgccgcuggccaccaauuugaaagcucuuucgagcugagaaaagugggggucaagcuguccagccuccugggcaaaaagggaaaucuugaaaaacugcaguccuacugggaggugggguuuuuccucggagccucuguccuggcgaacgaccauaugcgcgugauccaggccagcgagaagcuguuuaaacuuaagaccccugcuugguaucucaaguccauuguugaaacaauccugauuuacaaacacuucgugaagcugacaaccgagcagccggucgccaaacaagaacucguggauuuuuggauggacuuccugguugaggcuacgaagacagaugugaccgucgugcgguuccccgugcuuauccuggagccuaccaaaaucuaccagcccucuuaucucagcauuaauaacgaaguugaggaaaagacaaucuccauuuggcacguccugccugacgacaagaaaggcauccaugaguggaauuuuagcgccucuuccgugagaggggugagcauuucuaaguucgaggaacgcuguugcuuucuguacguccuucacaacuccgaugacuuccagaucuauuuuugcaccgagcuccauuguaaaaaguucuuugaaauggugaauacaauuacggaggaaaaaggccggagcaccgaggaaggagauugcgagucugaccugcuggaguacgauuaugaauacgacgagaacggcgauagaguugugcucgggaagggaacauauggcaucgucuacgcggggcgcgaccugagcaaucaggugcggaucgccauuaaggaaauccccgagagagauucccgcuacagccaaccgcuucacgaagagauugcucugcauaaacaccucaagcacaaaaacaucguucaguaucugggaucuuucuccgagaauggcuuuauuaagaucuucauggaacaggugccugggggcagccuguccgcccuucuccggucuaaauggggaccccugaaggacaacgagcagaccaucggcuuuuacacaaagcaaauucuggaagggcucaaauaucugcaugauaaucagaucguccacagagacauuaagggagauaacgugcuuaucaauaccuacagcggcguucugaaaauuuccgacuucgggacgucuaagcggcucgcuggaaucaacccuuguaccgagacauuuaccggcacacugcaguauauggcccccgagaucauugacaaagggccucgcggcuacggaaaggccgcugauaucuggagccugggcugcaccauuaucgaaauggcgacggggaaacccccguucuaugagcuuggagaaccucaggccgcuauguucaaggugggcauguuuaagguccaucccgagauucccgaauccaugucugccgaggccaaggcuuucauccucaaguguuuugagccugacccggauaaaagagccugcgcgaacgaccugcugguggaugaguuccucaaggugagcuccaaaaagaagaaaacacaacccaagcugagcgcucuuucugccggguccaaugaauaccugcggagcaucucucucccuguccccguucugguggaagacaccuccucuagcuccgaguacggaagcguguccccugauacagaacugaaagucgaccccuuuagcuucaagaccagagccaaaucuuguggcgagcgcgaugugaaggggauucggacccuuuuucugggcaucccugacgagaacuucgaagaucacagcgcucccccguccccugaggaaaaggacucuggauuuuucaugcucagaaaagauagcgagcgcagagccacacugcaccggauucucacggaagaccaggacaagaucguucgcaaucugauggagucccuugcgcagggcgcugaggaacccaaacugaagugggagcauauuaccacacucaucgccucucugagagaauuugugcggagcaccgaucgcaaaauuaucgccacaacccuguccaaacuuaagcuggagcucgacuucgauucucacgggaucagccaaguccaggugguucuguucggauuucaggacgcugugaacaaaguccucagaaaucauaacauuaagccucacuggauguucgcccuggauuccaucauucggaaagcugugcagacggccaucacaauucuuguucccgagcugcgcccgcauuuuagccucgcgucugaauccgacaccgccgaucaagaggaccuggauguggaagacgaucacgaggaacagccuagcaaucagaccgucagacggccccaggcugugaucgaggacgccguggcuacaucuggcgucuccacccugagcuccacaguuucucacgacagccaauccgcccaucgcagccuuaacgugcagcuggggagaaugaagaucgagacgaaucggcuccuggaggaacucgugagaaaagaaaaggagcugcaggcccuucugcaccgcgcuauugaagagaaagaucaggagaucaagcaucugaagcucaaaucucaaccuauugaaauccccgagcugcccgucuuccaccuuaacuccagcggaaccaauacagaagacucugagcugaccgauuggcuccgggugaacggcgcggacgaagauacaauuagcagauuucuggccgaggacuauacccuccuggauguucuuuacuaugugacgcgcgacgaucugaagugccugcggcucagaggcgggaugcuguguacccuuuggaaagcuaucaucgacuuccgcaauaagcagacauga

SEQ ID NO: 71837 - RNA, 3843 nt, Artificial Sequence
  derived and/or modified sequence opt5 from MAP3K6__Homo_sapiens__NP_001284538
auggccggccccugcccuagaagcggggcugagcgggccggauccuguuggcaggacccgcuggcgguggcucucucucgcggcagacaacuggccgcuccucccgggcggggaugcgcucgcagcagaccccuuuccgucguuuacgugcugacccgggaaccccagcccggccucgagccucgcgaagggacagaggccgaaccgcugccccuuagaugucugcgggaggcuugcgcccaggugccucgccccagaccucccccgcagcuccggucucugccuuucggaacgcuggagcucggcgauaccgcggcccuggacgcuuuuuauaacgccgaugucgugguucuugaagugagcuccucucugguccaacccagccucuucuaccaccugggcgugcgcgaguccuuuagcaugacaaauaacguucuucuguguucucaggcugaccucccugaucugcaggcccugagagacugcgugggguccuauacccucauccccuacgucgugacagcgaccggacgggugcuguguggcgaugccgggcuucugcgcggacucgcugacggccugguccaggccgggguuggaacagaagcccuucugacgccccucgugggcagacuggcccggcugcucgaggccacgccuaccgauagcugcggcuauuucagagagacaauucgccgggacaucagacaagcucgcgaacgguuuucugggccgcagcugagacaggagcuugcgcgccugcagcggagacucgauuccguggaacugcuuagccccgacauuaucaugaaucugcuccugucuuaccgcgauguccaagacuauuccgccauuaucgagcugguggaaacccuccaggcucugccuacaugugacguugccgagcagcauaacgugugcuuccacuacaccuuugcccuuaaucggagaaaccgccccggagaucgggcuaaggcccugagcguccuccugccucuggugcaacuugagggcuccguugcgcccgaccucuacuguaugugcgggagaaucuauaaagauauguucuuuucuagcggauuccaggacgcuggccaucgggaacaggccuaccacugguaucgcaaggccuuugauguggagccgucccugcauagcgggauuaaugcugccguccugcucaucgcugccggacagcacuucgaagacucuaaagagcugagacuuauuggcaugaagcugggcugccuccuggcgcggaaaggguguguggaaaagaugcaauacuauugggaugucggauuuuaccugggcgcccagauccuugcuaacgacccuacccaggugguucucgccgcugagcagcuguauaagcugaaugcccccauuugguaccucguguccgucauggagacauuccugcuuuaccaacacuucagaccuacccccgaaccucccgggggaccgccucgccgggcgcauuuuuggcugcacuuccuccugcagagcugccagcccuuuaaaacagccugugcucagggcgaucaaugccuggugcuuguucucgagaugaacaaggugcugcugcccgccaaacucgaagucagagggaccgacccugugucuaccgugacacugagccuucuggagccggaaacgcaggauauccccuccucuuggaccuucccuguugcuagcauuuguggcgucuccgccagcaagcgcgacgagagaugcuguuuucucuaugcccugcccccugcucaggacgugcagcugugcuuccccucugugggacauugucaaugguuuugcggccuuauccaggcgugggucacaaauccugauuccaccgcccccgcugaggaagccgagggggccggagaaaugcucgaguucgacuacgaguauacagaaaccggcgagcggcuggugcuggggaaaggaacguacggcguuguguaugcugggcgcgauagacacacacggguccgcaucgccauuaaggaaaucccggagagagacagccgguuuucucagccucuccacgaagagauugcgcugcaucgcagacuucggcacaagaacaucgugcgcuaccugggcuccgcuagccaaggaggcuaucucaaaauuuucauggaggaaguucccgggggaucccugucuagccugcuuagauccguguggggcccucugaaggauaaugagucuaccaucagcuuuuacacccggcagauccuccaggggcugggauaccuccaugacaaccacauuguccauagagauaucaaaggcgacaaugugcugauuaacacauucuccgggcuucugaagaucagcgauuuuggcaccucuaaacgccucgccggaauuacacccuguacggaaaccuucacaggcacccugcaguauauggccccggagaucaucgaccaagggccucggggauacggcaaggcugccgauauuuggucccuggggugcacaguuaucgaaauggcgaccggaagacccccuuuccacgagcuuggcagcccccaggcugccauguuucagguggggauguauaaaguccaucccccuaugccgucuucccugagcgccgaggcucaggccuuccuccugcgcacguuugaacccgacccucggcucagagcuucugcccaaacccugcuuggcgaucccuuccugcagccuggaaagcgcagccggucccccagcucuccuagacacgcgccgcgccccuccgacgccccuagcgcuucccccacaccuucugccaacagcaccacacagucccagaccuuucccugcccgcaagcuccuucucagcacccucccagcccucccaagcggugucucuccuacggcgggacgucucagcugagagugccugaggaaccggccgccgaggaacccgcuagcccugaggaguccagcggacugucucuucugcaucaagaauccaaacggcgcgcgaugcucgccgcugugcuggagcaggaacuccccgcccuggccgagaaucuucaccaggagcagaagcaagaacagggcgcuagacuggggcggaaccacgucgaggaacugcuccgcugccugggagcccauauucacacaccuaauagacggcagcuugcgcaggagcugagagcucuccaaggccgccugcgggcccagggccucgggcccgcccugcuucauagaccgcuguucgcuuuuccugacgccguuaaacagauccugcgcaagcggcagauuagaccccacuggauguucgugcucgauagccugcuuucucgcgcggugcgggcugcccugggaguccucggcccugaaguggagaaagaggccguuucccccagaagcgaggaacugucuaacgaaggggacucccaacagagcccuggacagcagagcccccucccgguggagccugaacaaggccccgcuccccugaugguccagcuuucccugcugcgcgccgagaccgauagacuccgggagauccuggcugggaaggaacgcgaguaucaggcccuugugcaaagagcgcugcagcggcucaaugaagaggcccgcacauacguucuggcuccugaaccgcccaccgcccucucuaccgaccagggacuggugcaguggcuucaagagcugaacgucgauagcggcacaauucagaugcugcucaaucauuccuuuacgcugcacacccuucugacauaugcuaccagagacgaucucaucuacacacggaucagaggcgggauggugugucgcauuuggcgggccauccuggcccagagagcuggaucuaccccuguuacgagcggccccuga

SEQ ID NO: 71838 - RNA, 429 nt, Artificial Sequence
  derived and/or modified sequence opt5 from MAP3K7CL__Homo_sapiens__NP_001273546
augaucagcaccgccagagugcccgcugacaagccuguccggauugccuucucccugaacgaugcgucugacgauacaccgcccgaggacagcaucccucucguuuuucccgaacuggaucagcaacuucagccucugcccccuugccacgacuccgaggaaucuauggagguguucaaacagcauugucagauugcugaagaguaccacgaggugaagaaagaaaucacgcuccuggagcaacgcaagaaagaacuuauugccaagcuggaucaggccgagaaggagaaagucgacgcugccgaacucgugagagaguuugaagcucugaccgaggaaaaucggacacugcgccucgcccagagccagugcguugagcaacuggagaaacuuagaauccaguaucagaagcggcagggcuccucuuga

SEQ ID NO: 71839 - RNA, 1740 nt, Artificial Sequence
  derived and/or modified sequence opt5 from MAP3K7__Homo_sapiens__NP_003179
augagcaccgccuccgcugccucuagcuccucuagcuccucugcgggcgagaugaucgaagcucccagccaggugcugaacuucgaggaaauugacuacaaggagaucgaagucgaggagguuguggggagaggagccuuuggcguggucugcaaagccaaguggcgggcuaaagauguggccauuaagcaaaucgaauccgagagcgaacgcaaggcuuucauuguugagcucagacagcugucucgggugaaucacccuaacaucgucaaacuuuauggggccugucugaauccggugugccucguuauggaguacgcggaaggaggcucccuguauaacgugcuucauggggccgagccccugccuuacuauacagcugcccacgcuaugagcuggugucuccagugcucucagggagucgccuaccugcauuccaugcaacccaaggcgcugauccaccgcgaccucaaaccucccaaucugcuucugguggccggcggcacggugcucaagauuugugauuuugggaccgcuugcgacauccagacacauaugaccaacaauaaaggaagcgccgcuuggauggccccugaagucuucgagggcucuaacuauuccgaaaagugugauguuuuuagcugggggauuauccugugggaggugauuacaagacggaaaccguucgacgagaucggaggccccgccuuucgcauuaugugggcugugcacaaugggaccagaccuccccuuaucaagaaccugccuaagcccaucgaaucccucaugacacggugcuggucuaaagauccgagccagcgcccuuccauggaggaaauugucaagaucaugacccaccugaugagauacuuccccggagcggacgagccucugcaguaccccugucaauauagcgaugaaggccagucuaauuccgccacgagcaccggcucuuuuauggacauugcuagcacaaacaccuccaauaaaucugauacaaacauggaacaggugcccgccaccaaugacacgaucaagcggcucgagagcaaacugcuuaagaaccaggccaaacaacaguccgagagcgggcgccugucucucggagcuuccagaggcagcucuguugagucccugccuccgacaagcgaagggaagcggauguccgccgauaugucugagauugaagcgcgcaucgcugccaccacaggaaacggccagcccagacggagaagcauccaagaccuuaccgugaccgggacagagccuggacaggucuccucucgcagcuccagccccucugugcggaugauuacgaccuccggcccuacaagcgagaagcccaccagaucucauccguggacaccugacgauuccaccgacacgaauggcagcgauaacucuauccccauggccuaccugacacucgaccaccagcugcagccucuggcucccugcccuaauagcaaagaauccauggccguuuucgagcaacauuguaagauggcucaggaauauaugaaagugcagaccgagauugcccuccugcuucagcgcaagcaagagcuggucgcggaacucgaucaggacgagaaagaucagcagaacaccagccggcuggugcaagaacacaagaaacuucuggacgagaauaagucucucuccacauacuaucagcagugcaagaaacagcuggaagucaucagaagccaacagcagaagcgccaagggaccuccuga

SEQ ID NO: 71840 - RNA, 1404 nt, Artificial Sequence
  derived and/or modified sequence opt5 from MAP3K8__Homo_sapiens__XP_005252421
auggaguacaugagcaccggcuccgacaacaaggaagagaucgaucugcucauuaaacaccugaaugugucugacgucaucgauauuauggaaaaccuuuaugccagcgaggaacccgcuguuuacgagccuucccugaugacaaugugccaggacucuaaucaaaacgaugagagaagcaagucccuccugcuuucugggcaggaagugccguggcugagcuccgugcgguauggaacggucgaggaccuccuggccuucgcgaaucauaucagcaacaccgcuaaacacuuuuacggccagcgcccccaggaaucugggauucugcucaauauggugaucacaccucaaaacggaagauaucagaucgauuccgacguucugcuuauucccuggaagcugaccuaccggaauaucggcagcgauuucauuccucgcggggccuuuggaaaaguguaucucgcccaggacaucaagacaaagaaaagaauggcuuguaagcugauucccgucgaucaguucaaaccuucugacguggagauccaagccugcuuucggcaugagaacauugcugaacuuuacggcgccguucuguggggcgagaccgugcaccucuucauggaagcgggggagggaggcuccguccuggaaaagcuggagagcugugggccgaugcgcgaguuugaaaucaucugggugacaaaacaugugcucaagggacuggauuuccuucacucuaagaaagucauucaccaugacaucaagcccuccaauauuguuuuuaugagcaccaaagccgugcugguggacuucggccucuccguccagaugacggaggauguguacuuuccuaaggaccugagagggaccgaaaucuauaugucucccgagguuauucuuugccggggacacagcacaaaagcugauaucuacucccugggcgccacccucauccauaugcagacaggcaccccucccugggugaagcgcuauccgagaagcgcuuacccuucuuaucuguacauuauccacaaacaggcgcccccucuggaagacauugccgaugacuguucccccgggaugcgggagcucaucgaggccagccuggaacgcaaccccaaucacagaccucgggcugccgaucuucugaagcaugaggcucucaacccgccccgcgaagaccaaccuagaugccagucucuggauagcgcccuucuggagcggaagagacuccugucccgcaaagaacuggagcuccccgagaauauugccgacucuagcuguacgggauccacagaagagagcgaaaugcugaagcggcagagaucucuuuauaucgaucugggcgcucucgcgggguacuucaaccugguccgcggaccucccacccuggaguacggcuga

SEQ ID NO: 71841 - RNA, 3315 nt, Artificial Sequence
  derived and/or modified sequence opt5 from MAP3K9__Homo_sapiens__NP_001271159
auggagcccagcagagcccugcucggcugccuggcuuccgccgcggcugccgccccuccgggggaagacggagcuggcgccggggcugaggaagaggaagaggaggaagaggaagccgcggccgcugugggacccggcgagcuugggugugaugccccucugcccuacuggaccgcugucuucgaguaugaagccgcgggagaggacgaacucacacugcggcuuggcgauguuguggaggugcugucuaaggacagccaggucuccggcgaugaagggugguggacgggacaacucaaccagcgcgugggcaucuuuccuucuaauuacguuacccccagaagcgccuucuccucucggugccagccugggggagaggacccgagcuguuaucccccuauucagcugcuggagaucgauuuugcugaacucacacuggaggaaauuaucggcauugggggauucggcaaaguguaccgcgccuuuuggaucggcgacgaggucgcugugaaggccgccagacacgaucccgacgaagauaucucccaaaccauugagaacguucggcaggaggcuaaacuuuucgcgaugcugaagcauccuaauaucauugcccuccgcggggugugccugaaagaacccaaccuuugucuggucauggaguuugcuagaggaggcccgcucaaucgggugcugagcgggaagcgcaucccucccgacauucuggugaacugggccguccagaucgccagaggaaugaauuaucuccacgaugaagcuauuguuccuaucauccaucgggaccugaagucuuccaacauucuuauccugcagaaaguggagaauggcgaccucagcaacaagauucugaaaaucacagauuucgggcuugcccgcgaauggcacagaaccacaaagaugucugcggcuggaaccuacgccuggauggcccccgaggugauucgggcuuccauguuuagcaaaggcucugacgucugguccuauggcgugcugcucugggagcugcugacgggggaaguucccuuccgcggaaucgauggccucgccguggcuuacggggucgccaugaauaagcuggcgcuuccuaucccgucuaccugccccgagccuuuugccaagcugauggaagacuguuggaaccccgauccucauuccagacccucuuucacaaauauucucgaccaacugaccacaaucgaggagagcggauuuuucgaaaugccgaaagauuccuuccacugccuucaggacaacuggaagcacgagauucaggaaauguuugaucagcugcgggcuaaagagaaggaacucagaaccugggaggaggaacugacgcgcgccgcucugcaacagaaaaaucaggaggaacuccugcggagacgcgagcaagaacuugccgagcgggagaucgacauucuggaaagagagcucaacaucaucauucaucagcugugucaggaaaagccucgcgugaaaaagcggaagggcaaauucagaaagagccgccugaaacuuaaggaugggaaccggaucucucuccccuccgacuuucagcacaaauucacaguucaagcgagcccuaccauggacaagagaaagucucugauuaauagccgcuccucucccccugccagccccacaaucauuccgcggcugagagcuauccagcucaccccuggcgaguccagcaaaaccuggggacggucuuccgugguccccaaggaagagggcgaggaagaggaaaaacgcgcccccaagaaaaaggggagaacauggggaccuggcacgcuggggcagaaggagcuugcuagcggagaugagggcucuccgcagcggagagaaaaagccaacgggcuguccacccccagcgaguccccucauuuucaccucggccugaagucucugguggacggauacaaacaauggagcuccucugcccccaaucuugucaagggcccucgcagcucccccgcucucccuggguucacaagccugauggaaauggaggaugaagacucugagggacccggcuccggggagagccggcugcagcacucuccgucccagagcuaucucugcauuccuuuucccagaggagaagauggcgacgggccuucuagcgauggcauccaugaggaacccaccccggugaacuccgcgacaagcaccccucagcugacgcccacaaauucucuuaaacgcggaggcgcccaccauagacggugugagguugcucugcucgggugcggagccgugcuggccgcuaccggccugggguucgaccuucucgaagccggaaagugccaacugcugccucucgaggagcccgaacccccugcgcgcgaggaaaagaaaagacgggagggccuguuucagcgcuccagcagaccgcggcgcuccaccucucccccuagcagaaaacuuuucaagaaggaagaacccaugcugcuccugggggauccuuccgcuucucugacacuucucagccuguccucuaucagcgaguguaacuccacccggagccugcuccgcucugacuccgaugaaauugucguguacgagaugcccguuagcccuguggaagccccgccccugucuccuugcacacacaauccccuugucaacgugagaguggagcgguuuaaaagagacccuaaucagucccugacgcccacccauguuacacucaccacaccgagccagccuucuucccaccgccggacccccagcgauggcgcccugaagcccgagacgcugcuugcuuccagaagcccuucuagcaacggacugucccccucuccuggcgccgggaugcucaaaaccccgagccccucccgcgacccuggagaguucccccggcugccugaccccaaugucguguuuccgccuacacccagacgcuggaacacccaacaggauucuacacucgagcggccuaagacccuggaguuccuucccagaccucgccccagcgcgaaucggcagagacuggacccguggugguucguguccccuucucacgcucggagcacgucccccgccaacagcagcuccacagagacccccagcaaucucgauucuuguuuugccuccagcuccucuacagucgaagaacgcccuggccugccggcucugcuucccuuccaagccgggccucugcccccuaccgagagaacccuccuggaccucgaugcugaaggacagagccaggacuccacagugccccugugccgggccgagcuuaacacgcaucgcccugcgccguaugaaauccagcaagaguuuuggagcuga

SEQ ID NO: 71842 - RNA, 3408 nt, Artificial Sequence
  derived and/or modified sequence opt5 from MAP4__Homo_sapiens__NP_001127836
auggccgaccugagccucgcugaugcccugaccgagcccuccccugacaucgaaggcgagauuaagagagauuucaucgcgacacuugaagcugaggccuuugacgauguggucggggaaacgguuggaaaaaccgacuacauuccgcugcucgauguggacgagaagacaggcaacucugagagcaaaaagaaacccugcuccgaaaccucucagaucgaggauacaccuagcuccaagcccacccugcuugccaaugggggacacggcguggaagggucugacacaaccggaagcccuacggaguuccuggaggaaaagauggcuuaucaagaguaccccaacucccagaauuggccugaagauaccaacuuuuguuuccagccggagcaggucguggaccccauucaaacagauccuuuuaaaauguaucaugacgacgaucucgccgaccugguuuuccccagcucugcuaccgccgauacauccaucuuugcgggccagaaugacccucugaaggauagcuacggcaugucucccugcaacaccgccguggucccgcaggggugguccguggaagcucucaauagcccucacucugaguccuucguuagccccgaggccguggcugaaccuccccagcccacggccgucccucuggagcuugcgaaagaaaucgagauggccuccgaggaacggccgcccgcucaagcccuggagauuaugaugggacucaagacaaccgacauggcuccuucuaaagaaacagagauggcccuggccaaggauauggcucuugcgaccaagaccgaaguggcccuggcuaaagacauggagagccccacaaagcucgaugugacgcuggccaaagacaugcagccuuccauggaaagcgauauggcccuggucaaggacauggagcuccccaccgagaaagaaguugcucuggugaaggacgugcgcuggccgacagagaccgaugucucuuccgccaaaaacgugguucuuccuacagaaaccgagguggcgcccgcuaaggacgucacgcugcucaaggagacagaaagagccagcccuaucaaaauggaucuggcccccucuaaggacaugggcccucccaaagagaauaagaaagaaaccgagcgggcuagcccgauuaagauggaucuugccccuuccaaggacauggggccucccaaagaaaacaagaucgugcccgcuaaagaucugguucuccugucugagauugagguggcccaggcgaaugacaucauuagcuccaccgaaaucagcucugccgagaaggucgcucuguccagcgaaacagagguggcccucgcucgcgauaugacccugccgcccgaaacaaacgucauccuuacgaaagacaaggcccugccucucgaggcggagguggcccccguuaaggauauggcucagcugccugaaaccgagauugcccccgcuaaagacguggccccuucuacagucaaggaagugggacuucugaaagauaugagcccccucuccgagaccgaaauggcccugggcaaggacguuacaccgccucccgagaccgaggugguccugaucaaaaaugugugucucccucccgaaauggagguggcucugacggaagaccaaguuccggcgcuuaagaccgaggccccucuggcuaaggaugggguccucacacuggccaacaaugugacccccgccaaagacgugccuccccuguccgagacagaagcuacccccgucccuauuaaggauauggagaucgcccagacgcagaaaggaauuucugaagacagccaucuugagucccuccaagaugugggccagucugcggcuccgacauuuaugaucagccccgaaaccguuacaggcaccgggaagaaaugcucccugccugccgaggaggacagcgugcuggaaaagcucggagagagaaaacccuguaacucucagccuuccgaacugagcucugagaccuccggcaucgcccggcccgaagaggggcgcccugucgugagcggaacaggcaacgauauuacgaccccgcccaauaaggagcuuccucccucuccugaaaagaaaacaaagccccuggcuaccacacagccggccaaaaccagcacguccaaggcgaaaacacaaccuaccagccuccccaagcagcccgcuccuaccacaaucgggggacugaacaagaaacccaugucucuggccuccggccuuguuccugccgcuccgcccaagagaccugccguggcuagcgcccggcccuccauucucccuucuaaagacgucaagcccaaaccgaucgcggaugccaaggcuccugagaagcgcgccagccccuccaaaccugcuucugcccccgccagcagauccggcucuaagagcacccagacaguggcuaaaacgaccacagcggccgcuguugccuccaccgggccuagcucucggucccccagcacacugcugccgaagaaaccuaccgccauuaagacggaaggaaagcccgcugaggugaaaaagaugaccgccaaaucuguccccgcggaccucucccgcccuaagagcacaucuaccuccagcaugaaaaagacaaccacacuguccggcaccgcuccggccgccgggguggugcccagcagagucaaagcuacgccuaugcccucucggccuagcacaacccccuucaucgauaagaagccuaccuccgccaaaccgucuagcacaacgccccgccuuuccagacuggcgaccaauacaucugcuccugaccucaagaacguucggagcaaagugggauccaccgaaaauaucaagcaccagcccggcgggggcagagccaaaguggagaagaagacagaggccgcugccaccacacgcaaaccugaaucuaacgcugucaccaagacggccggacccauugcgagcgcccaaaaacagccggcuggcaaggugcagaucguuuccaaaaaggugagcuauucucauauucaguccaagugcgggagcaaagauaauaucaagcacgucccuggaggcgggaacgugcaaauucagaauaaaaagguugacaucucuaaaguguccagcaaguguggauccaaggccaacauuaaacacaagcccggcgggggcgacgucaaaaucgagucucagaagcugaauuuuaaagaaaaggcucaggccaaggugggaagccuggauaacguuggccaucuucccgccgggggagcugugaaaaucgagaccuaccggcucacauucagagcgaaugcccgcgcucggaccgaccacggcgccgauauugucuccagaccuccccauuuuccugggggaccgaacagcggcucucgcgugcuggggccccugucccgggccgugcacuga

SEQ ID NO: 71843 - RNA, 2466 nt, Artificial Sequence
  derived and/or modified sequence opt5 from MAP4K1__Homo_sapiens__NP_001036065
auggacguggucgaucccgacaucuucaacagagauccucgggaccacuacgaucugcuccagcgccugggcgggggaaccuauggcgagguuuuuaaggccagagacaaagugagcggggaucuuguggcucugaagauggucaaaauggaaccggacgaugacguguccacacuccaaaaggagauucugauccuuaaaacgugccggcaugccaauauuguugcguaccacggaucuuaucuguggcuccagaagcuguggaucuguauggaguucugcggcgcugggagccugcaggauauuuaccaggugaccggaucccucucugagcugcaaaucagcuaugucugucgcgaagugcuucagggccuggccuaccuccauucccagaagaaaauccacagagacauuaagggcgccaacauccugauuaaugaugcuggggagguucggcuugccgacuuuggaaucucugcucagauuggcgccacacuggcgcgcagacucagcuucaucgggacccccuauuggauggccccugagguggcugccgucgcucugaaaggaggcuacaacgaacugugcgacauuuggucccucgggaucacagccaucgagcuggcggaacuucaacccccucuguuugaugugcauccccuccgggugcuguuccuuaugaccaagagcggauaccagccuccgcgccugaaagagaagggcaaguggucugccgcuuuucacaauuucauuaaagucacacucaccaagucccccaaaaagagaccuagcgccacgaaaaugcugucucaccagcugguuucccagcccggccucaaccgggggcugauccuugaccugcucgauaagcugaaaaauccuggaaagggccccagcauuggggacaucgaggaugaagaaccggaacuuccucccgcuauuccucgcagaauccggucuacccaucgcuccagcucccugggaauccccgacgccgauuguugcagacggcacauggaguuuagaaagcuccgcggcauggaaacacggcccccugccaacaccgcuagacugcaaccgccccgcgaccugcggucuagcuccccuagaaaacagcucagcgagucuuccgaugacgauuaugacgacguggauauucccaccccugcggaggacacacccccgccucugcccccuaagcccaaauuccgcagcccuucugaugaagggcccggaagcaugggcgacgauggccagcuuuccccgggggugcugguccggugugccucuggaccuccucccaauagccccagaccggggcccccucccuccacgagcucuccucaucucacagcucacuccgagcccagccuguggaacccucccucucgcgaacuggacaagccgccucuucugcccccuaaaaaggagaagaugaaacggaagggcugcgcccuccuggugaaacucuuuaauggauguccccugagaauccacuccaccgccgcuuggacacauccgagcaccaaggaucaacaccuucugcucggcgccgaagaggggauuuucauccugaaccgcaaugaccaggaggcgacccuggaaaugcuuuuuccuucccggacaacguggguuuacucuauuaacaaugugcucaugagccuguccggcaaaacaccccaucuguauucucacagcauccucggacugcuugagagaaaggaaacccgggcuggcaacccuaucgcccauauuagcccccaccgccugcucgccagaaagaacauggucuccaccaaaauccaggauacaaaggggugccgggcuuguugcguggccgagggagcuucuuccggcgggcccuuccugugcggagcccuggaaaccagcguugugcuucuccagugguaccaaccuaugaauaaauuccugcuggucagacaggugcucuuuccgcugcccacgccucuuucugucuucgcgcugcucacaggccccggguccgagcugccugccguguguauuggcguuagccccggacgcccuggcaagucugugcuguuucacaccguccgguucggggcucuuagcugcuggcucggagagauguccaccgaacauagaggcccggugcagguuacacagguggaggaagacauggucauggugcugauggaugggagcgugaaacugguuacccccgagggaucuccuguccgcggccucagaacacccgagaucccuaugacggaagccguggaggcuguggccauggucgggggccaacugcaggcguuuuggaagcacggagugcagguuugggcccuuggcuccgaccagcugcuccaagaacugcgggaucccacccugacauuccgccuucuggggagcccgagaccuguggucguggagacccggcccguugacgaccccacagcuccuuccaaccucuauauucaggaauga

SEQ ID NO: 71844 - RNA, 2463 nt, Artificial Sequence
  derived and/or modified sequence opt5 from MAP4K2__Homo_sapiens__NP_004570
auggcccugcucagagacgugagccugcaggauccccgggaccgcuucgagcuucugcaaagagucggcgcugggaccuacggagauguuuauaaggcccgggacacagugacguccgaacucgcggcugugaaaaucgucaagcuggauccuggcgacgauauuucuagccuucagcaggagaucaccauucugcgcgaaugcagacacccgaacgugguugccuacaucggguccuaucuccggaaugaccgccuguggauuuguauggaguuuugcggaggcgggucucugcaggaaaucuaccaugccacaggaccccucgaggagagacaaaucgcuuaugugugucgggaagcccugaaaggccuucaccaucugcacagccagggcaagauucaucgcgauaucaaaggggcuaaccuccugcuuacccugcagggagacgucaagcucgccgauuucggcguguccggggagcugacagcgucuguugccaagagacggagcuuuauuggaaccccuuacuggauggcucccgaaguggccgcugucgagcgcaaaggcggguauaaugagcugugcgacgugugggcccucggaaucacagcgauugaacugggcgagcuucagccuccccuguuccaccuccacccuaugagagcccugaugcuuauguccaagagcucuuuucaaccgcccaaacugcgggauaagacccgcuggacgcagaacuuccaucacuuucucaaacuggcucugaccaagaauccuaagaaaagacccacagccgaaaagcuccugcagcauccuuucaccacacagcaacuuccccgggcucugcucacccagcugcuugacaaagccuccgacccgcaccugggcacgccuagccccgaggauugugaacucgagacauacgacauguuuccugauaccauccacucuagagggcagcauggacccgccgagcgcacacccuccgaaauucaauuccaccaggugaaguuuggcgcuccucggagaaaagagaccgacccgcugaacgaacccugggaggaagaguggacccugcucgggaaggaggaacugagcggaucucuucugcaguccguccaggaggcgcucgaagaacgcagccugacaauccgguccgccucugaguuccaagagcuggauagcccugacgauacgaugggcaccaucaaaagagcucccuuucuugggccucuccccacagacccgccugccgaggaaccccuguccagcccucccggaacccugccucccccgccuucuggccccaauuccagcccccuccugccuacagccugggcuaccaugaagcagcgcgaggauccggaacggucuagcugccauggccuucccccuacgcccaagguucacaugggggccuguuucuccaaaguguucaacggaugcccucugagaauccaugcggcugugacauggauccaccccgucacccgcgaccaguuucucgugguuggcgccgaggaggggauuuacacccugaaucugcacgaacuucaugaggauacacucgaaaagcugaucucucaccgguguagcuggcuguauugcgugaacaauguccuccugucccuuagcggaaaaucuacccauauuugggcccacgaccugccuggccucuucgagcagagacgccugcaacaacaggugccccuguccaucccgacaaaccggcuuacgcagagaaucauuccucggcgcuuugcucucagcaccaagauccccgacacaaaagggugucugcagugcagaguugugcggaauccuuacaccggcgccacauuccugcucgcugcccugcccaccucucuucugcuccugcagugguaugaaccgcugcagaaguuucuucuccugaagaacuucuccagcccucugcccuccccugcgggaaugcucgagccccugguccuugauggcaaagagcugccccaggugugcgucggggccgaaggaccugagggcccgggguguagagugcucuuucacguucugccccuggaagcuggacuuacgccugacauucugauucccccugagggcauucccgggucugcccaacaggugauccaggucgaucgcgacaccauccucgugagcuucgaacggugcguuagaauugugaauaugcaaggcgagccuacagcuacccuggccccggagcucacauuugauuuccccaucgaaaccgucgugugucugcaggacuccgugcuugcguuuuggucucauggaaugcagggccgcagccuggauacgaacgagguuacacaggaaauuaccgacgagacaagaaucuuccggguccucggggcccaccgcgauauuauccuggaauccauuccuaccgacaaccccgaggcucauagcaaucuguacauccuuaccggacaccaaucuacauauuga

SEQ ID NO: 71845 - RNA, 2622 nt, Artificial Sequence
  derived and/or modified sequence opt5 from MAP4K3__Homo_sapiens__NP_001257354
augaaccccggcuucgaccugagcagacggaauccucaggaggauuuugaacucauccaacgcauuggguccggaaccuacggcgacguguauaaggccagaaacgucaauacaggggagcuggcugccaucaaaguuauuaaacuugaaccgggagaggauuucgcgguggugcagcaggaaaucauuaugaugaaagacugcaagcaccccaacaucgucgcuuacuuuggcucuuaucugcggcgcgauaaacucuggaucuguauggaguucugcgggggaggcagccugcaggacauuuaccaugugacgggcccucuuuccgagcugcaaaucgccuauguuucuagagaaacccuccaggggcuguacuaucugcacagcaagggaaagaugcaucgggauauuaaaggcgccaauauccuccugacagacaacgggcacgugaaacuugcugauuuuggagucuccgcccagauuaccgcuacaaucgccaaacgcaagucuuucauuggcacccccuacuggauggcgccugagguggccgcuguugaaagaaaagggggauacaaucagcugugugaccucugggccgugggcaucacagcuaucgagcuggccgagcuucaacccccuauguuugaucugcauccgaugcgggcccucuuccugaugaccaagagcaacuuucagcccccuaagcugaaagacaagaugaaaugguccaauagcuuccaccacuuugucaagauggcgcucacgaaaaaccccaagaaacgcccuaccgcugaaaagcugcuucagcaucccuucgugacacagcaccugaccagaucucucgccauugagcugcuugauaaggugaauaacccggaccauuccacauaucacgacuuugaugacgaugacccugaaccccuggucgcuguuccucaccggauccauagcaccucucgcaaugugagagaggaaaagacgcgguccgagauuacauucggccaagugaaguucgauccuccccuccgcaaagagaccgaaccccaccaugagcuggaccugcagcucgaauacgggcagggacaccaaggcggguauuuucugggagccaacaagagccuucugaaaucugucgaggaggaacuccaucagagaggccacguggcccaccuggaggaugacgaaggggaugacgaugaguccaagcauagcacacuuaaggcuaaaaucccgcccccucugcccccuaagcccaaauccauuuucaucccgcaggaaaugcacucuaccgaggacgaaaaucagggaaccaucaagcggugcccuaugagcggcucccccgcgaaaccuagccaaguucccccuagacccccgccuccccgccugcccccucauaagccgguggcccucggcaacgggaugucuuccuuucagcugaacggagagcgggacggcagccucugucagcagcaaaaugagcacagagggacaaaccugucucgcaaggaaaagaaggauguccccaaaccuauuagcaauggacuucccccuacgcccaaggugcacaugggcgcuugcuucuccaaaguuuuuaacggguguccucugaagauccauugcgccucuagcuggauuaaucccgacacccgggaucaguaccucaucuucggcgccgaggaaggaauuuauacacugaaccugaaugagcuucacgagaccuccauggaacagcucuuuccgagacgcuguacauggcuguacgugaugaacaauugccugcucagcaucucuggcaaggcuucccagcuguauagccauaaccuuccugggcuguucgacuacgcccggcaaaugcagaaacuccccgucgcgaucccugcucacaagcugcccgaucgcauucugccgagaaaauuuucuguguccgccaagaucccugagaccaaauggugucagaagugcugcgucgugcggaaucccuacacgggacauaaauaucuuuguggcgcccuccagacaagcauuguucugcuggaauggguggagccuaugcaaaaguucaugcucaucaagcacauugacuuucccauccccugcccucugagaauguucgaaaugcuugucgugccggagcaggaguacccccugguuugugugggggucucccgcggacgggauuuuaaccagguggugagauucgaaaccguuaauccuaacucuaccagcuccugguucacagagucugacacaccccaaaccaaugucacgcacgugacccagcucgaacgggauacaauucuggugugccuggacuguugcaucaaaaucgucaaccuucagggccgccucaagagcuccagaaaacugagcucugagcugaccuuugauuuccagauugaauccaucgugugucuccaagacagcguucuggcuuuuuggaagcaugggaugcagggccggucuuucagauccaacgaggugacacaggagauuagcgauucuacccgcaucuuucggcuucugggaagcgacagagucgugguucucgaaucccgcccuacggacaaucccaccgccaacagcaaucuguauauucuggcuggccacgagaacucuuacuga

SEQ ID NO: 71846 - RNA, 3720 nt, Artificial Sequence
  derived and/or modified sequence opt5 from MAP4K4__Homo_sapiens__NP_001229488
auggccaacgacagccccgcuaagucccugguggauaucgaccucucuagccugagagauccugccggcauuuucgagcuugucgaaguuguggggaauggaaccuacggccagguguauaaagggcggcacgucaagacaggacaacuggcggcuaucaaagugauggacguuacggaggaugaagaggaagagauuaagcucgagaucaacaugcugaaaaaguacucccaucaccgcaauauugccaccuauuacggcgccuuuaucaagaaaucuccgcccgggcaugacgaucagcuuuggcuggugauggaauuuugcggagcuggcagcaucacagaccucgucaagaacaccaaaggcaauacacugaaggaggauuggauugccuauaucuccagagaaauucugcgggggcucgcucaucugcacauccaccacgugauucaucgcgacaucaaaggacagaacguucuucugaccgagaaugccgaggugaagcucgucgauuuuggcgugucugcgcagcuggacagaacaguggggcggcgcaacaccuucauuggaacgccuuacuggauggcccccgaagucaucgcuugugaugagaauccugacgccaccuaugacuacagaagcgaucuuugguccugcggcaucacagcuauugaaauggccgagggggcgcccccucugugugacaugcacccgaugcgggcccucuuucugaucccccgcaacccucccccuagacucaagagcaaaaaguggucuaaaaaguucuuuuccuucauugaaggaugccugguuaaaaauuacaugcaacggcccagcaccgagcagcugcuuaagcauccguuuauccgcgaucagccuaacgagagacaggugcggauucaacugaaagaccacaucgaucgcacaagaaagaagcggggcgaaaaagacgagaccgaauaugaguacucuggcuccgaagaggaggaagaggaagugcccgagcaggaaggggagccuagcucuaucgucaaugugcccggagaguccacgcucagacgcgauuuccugcggcuucagcaggaaaacaaggagagaagcgaagcucugcgccggcaacagcuccugcaggagcaacagcugagagagcaggaagaguauaaacgccagcuccuggccgaacggcaaaagagaauugagcagcagaaagaacagcgccggagacuugaggagcaacagcgccgggaaagagaggcucggcgccagcaggaaagagagcaacggagacgcgaacaggaggagaagcggagacuggaggaacucgaacgcagacggaaggaggaagaggagcgcagacgggccgaagaggaaaaacgcagaguugagcgggagcaggaauacauccgcagacagcuggaggaggaacaacggcaccuugaagugcugcagcagcaacuccugcaggagcaggccaugcugcucgagugucgcuggagagaaauggaggaacaucggcaggcugagagacugcaacgccagcuucagcaggaacaagcguaucugcucucccugcagcacgaccaucggagaccccacccucagcauucucagcaaccgcccccuccccagcaggagcgcagcaagccuuccuuucacgcccccgagccgaaagcucacuacgaaccugccgaucgggccagagaggucgaagaccgcuuccggaagacaaaucauagcucucccgaggcucaauccaaacagaccggcagagugcuggaaccucccguuccuagccgcucugagagcuuuuccaacgggaacucugagagcgugcaccccgcccuucagcggccggcggaaccucagguccccgugagaacaaccucccggagccccguccucucucgcagagauuccccucugcaaggaagcggccagcagaauagccaggcugggcaacggaacuccaccagcauugagccgcgccugcucugggaaagaguggagaagcugguuccccggccuggauccggcucuagcuccggcucuagcaauuccgggagccagcccggaucucauccuggcucccagagcgggucuggagagagauuccgcgugcgguccagcucuaagagcgaaggcucccccagccagagacuugagaacgccgucaaaaagccugaagacaaaaaggagguguuccgcccccugaaaccggccgaccucacagcucuggccaaggaacugcgggcuguugaggaugugagaccuccccacaaggucacggacuauucuuccagcuccgaggaaucugggaccacagaugaggaagacgaugacguggagcaagaaggcgccgaugagagcaccuccggaccugaggacacacgcgcggccucuagccuuaaucucuccaacggcgaaaccgagucugugaaaacgaugaucguucacgaugacgucgaaagcgagcccgcuaugacaccguccaaggaagggacccugauugugcggcagacccagagcgccucuuccacacugcagaaacauaagucuucuuccagcuuuaccccuuucaucgaucccagacuccugcaaaucucuccuuccagcggaacaacggugaccuccgucgugggcuuuagcugcgacgggaugcgccccgaggcuauuagacaggaucccacacggaaaggaucuguugugaaugucaacccuaccaauacacgcccgcagagcgacacccccgagaucagaaaguacaaaaagcgguucaacuccgaaauucuuugugccgcgcuguggggcgugaaucuccugguugggacggagucuggccugaugcuucucgaccgcagcggacaaggcaagguguacccucugaucaacagacggagauuucagcagauggauguccuggaagggcucaaugugcugguuaccauuuccgggaaaaaggacaaacuucgcguguauuaccugucuuggcuccggaacaagauccugcacaaugaucccgaggucgagaaaaagcagggcuggacaaccgugggggaccuggaaggaugcgugcauuauaaggucguuaaauacgagagaauuaaguuccuugugaucgcccucaaaagcuccguggaagucuaugcuugggccccuaagcccuaccacaaauuuauggcuuucaagucuuuuggcgagcuggugcauaagccucugcucguugaucugacaguggaagaggggcaacgccuuaaagucaucuauggcagcugugccggauuccacgccguggacguugauuccggcagcguguacgacauuuaccugccgacccacauccagugcucuauuaagccccaugcuaucauuauccucccuaacacggaugggauggagcugcuggucuguuaugaagacgagggaguguacguuaacacauauggccggaucaccaaagaugugguccuucaguggggagaaaugcccacauccguggcguacauuagaagcaaucagaccaugggauggggcgagaaggccaucgaaauucggucuguggagaccgggcaccuggacggcgucuuuaugcauaaacgcgcucaaagacucaaguuccugugcgagcggaacgauaagguuuucuucgccuccgugcgcagcggaggcuccucucagguguauuucaugacacucgggagaacgagccugcuuuccugguga

SEQ ID NO: 71847 - RNA, 2541 nt, Artificial Sequence
  derived and/or modified sequence opt5 from MAP4K5__Homo_sapiens__XP_006720076
auggaggcuccccugagaccugccgccgacauccuccggcgcaacccgcagcaagauuacgaacuggugcagagagucggcagcgggaccuauggagacguuuacaaggcgcggaaugugcacacaggcgagcuugcugccgugaaaauuaucaagcuggaacccggggaugacuucucccucauucagcaggagaucuuuauggucaaagaaugcaagcauuguaacauuguggccuauuucggaucuuaccugagccgcgagaaacuuuggaucugcauggaguauuguggcgggggaucccugcaagauaucuaccacguuacgggcccucucucugaacugcagauugcuuaugugugcagagagacccugcagggccucgccuaccugcauacaaaggggaagaugcaccgggacaucaaaggagcuaauauucuucugaccgaucauggcgacgucaagcucgccgauuuugggguggcggccaaaaucacagcuaccauugccaagcgcaagagcuucaucggaacacccuacuggauggcuccugaaguugccgcgguggagaaaaacggcggguauaaucagcugugugacauuugggccgucggaaucaccgcuaucgagcuuggcgaacugcaacccccuauguuugaucuccacccgaugagagcccuguuccugauguccaagucuaacuuucagcccccuaaacucaaggacaaaacgaaguggagcuccaccuuccacaauuuugugaaaauugcucugacaaagaaccccaaaaagcggccuaccgccgagcgccuucugacacauaccuucguggcccagcccggccucagcagagcucuggcggucgaacuucuggauaagguuaauaacccggacaaucacgcccauuacacggaggcugacgaugacgauuuugaaccucacgccaucauucggcacacaauccgcucuaccaacagaaaugcccgggcugagcgcacagccuccgagauuaacuucgacaaacuccaguuugaacccccucugagaaaggagaccgaagcgcgggaugagauggggcugagcucugaccccaauuucaugcuccaauggaaccccuucguggauggagcuaacaccggcaaauccacaagcaagagagccaucccuccgccccugccucccaaaccucgcaucucuuccuaucccgaagacaauuuuccggaugaggagaaggccagcacgauuaagcauugcccugacuccgaaucucgggcuccccagauccuuagacgccagagcuccccuagcugugggcccguggccgagaccucuuccauuggaaacggcgaugggaucagcaaacugaugucugaaaauacagagggaagcgcucaagccccucagcucccccggaagaaagacaagagagacuucccgaaaccugcgauuaacggccugccucccacccccaagguccuuaugggcgccugcuuuuccaagguguucgauggguguccgcugaaaaucaauugcgcuacaucuuggauccaccccgacaccaaggaucaguacauuaucuuuggaacggaagacggcauuuauacacucaaccugaaugagcugcaugaggccaccauggaacaacucuucccucgcaaauguaccuggcuguacguuaucaacaauacacuuaugagccuguccgaggggaagaccuuucagcucuauagccacaaccugauugcucuguucgaacaugccaaaaagcccggacuugcggcccacauccagacacaccgguuuccugaucgcauucuccccagaaaguucgcucugacgaccaaaaucccugacacaaagggcugccauaaaugcuguaucgugcggaaucccuacaccgggcacaaguaccugugcggcgcccuccagucuggaauuguccugcuucagugguaugagccgaugcaaaaauuuaugcugaucaagcauuucgauuuuccucuccccuccccucugaacguguucgagaugcugguuauucccgaacaggaguacccgauggugugugucgcuaucagcaaaggcacagaaucuaaucaggugguccaguucgagaccauuaaccuuaauuccgccagcuccugguuuacggaaaucggggccggaucucaacagcucgacagcauccacgugacccagcuggagagagauacaguucuggugugccucgacaaguucgucaagauugugaaccugcagggcaaacuuaaguccucuaaaaagcuggcuagcgagcucuccuuugauuuccgcaucgaaagcguugugugucugcaagacucuguccuggcguuuuggaaacacgggaugcagggaaaguccuucaagagcgaugaggugacccaggaaauuucugacgagacacggguguuuagacuucucggcuccgaccggguugucgugcuggaaagccgcccuaccgagaaccccacggcccauucuaaucuguauauccucgcugggcacgagaacagcuacuga

SEQ ID NO: 71848 - RNA, 2442 nt, Artificial Sequence
  derived and/or modified sequence opt5 from MAP6__Homo_sapiens__NP_149052
auggccuggcccugcaucaccagagccuguugcauugcccgguucuggaaccagcuggacaaggcggauaucgcugugccucucgucuuuacaaaauacagcgaggccacggaacacccgggcgcucccccucaacccccucccccucagcagcaggcccaaccggcccuggcucccccuuccgcccgcgcgguugccauugagacccagcccgcucagggggaacuugacgccguggcuagagccacaggaccugcgcccggcccgaccggggagcgggaaccugccgcuggacccggccgcucugggccuggacccggccugggcagcggguccacaucuggacccgccgauagcgugaugagacaggacuaucgggcuuggaagguccaacgcccugagccguccuguagaccccggucugaguaccagccuagcgaugcccccuucgaacgcgagacccaguaucagaaagacuuuagagccuggccucucccccggcgcggcgaucauccguggaucccuaagcccgugcaaauuuccgcugcgagccaggccucugcuccuauccugggggcccccaaaagacggccucagucccaagaacgcuggcccguucaggccgcugccgaggcgagagagcaggaagcugccccgggaggcgccgggggacuugcugccggcaaggcuagcggcgccgacgagcgggauacaagacgcaaggcggggccugccuggaucgugcggagagcugaaggacugggccacgagcagacgccccuccccgccgcucaagcccagguccaggcgaccgggccugaagccggacgcggccgggcugccgcugacgcccugaauagacagauucgcgaggagguggccucugcuguuuccagcucuuaccggaacgaguucagagcguggaccgauaucaaaccggugaagcccauuaaagccaagccucaauauaaacccccugacgauaagaugguccaugaaacauccuacagcgcucaguuuaagggggaagccuccaaacccaccacagccgacaauaaggugaucgaccgccggcgcauuagaucucuguauagcgagccuuucaaagaacccccgaagguggagaaaccuuccguccagagcucuaagcccaaaaagaccuccgcuagccacaagccuacgcggaaagccaaggauaaacaggcgguuucuggacaagcugccaagaaaaagagcgccgagggccccuccacaaccaagccggacgauaaagaacagucuaaggagaugaacaauaaacucgcugaagccaaggagagccuggcgcagccuguguccgacagcucuaaaacacagggccccguggcuaccgaaccugauaaggaccaaggguccgucgugcccggacuucugaagggccaggggcccaugguucaggagccucucaaaaagcaaggaagcguggucccggggcccccuaaagaucugggccccaugaucccucuucccgugaaggaccaggaucauaccguuccugagccgcugaaaaacgaaucucccgugauuuccgccccugucaaggaccagggccccagcgugccugugcccccgaagaaucaguccccuaugguccccgccaaaguuaaggaucaaggaucugugguccccgagagccucaaagaccagggcccuagaauccccgaaccugugaagaaccaggcuccgaugguucccgccccugugaaagacgaggggcccauggucuccgcuucugugaaggaucagggaccuauggugagcgcccccguuaaagaccaaggcccgaucgucccugcgcccgugaagggggagggaccuauugugcccgccccugucaaggaugaaggccccaugguguccgcuccgaucaaagaccaggauccuaugguucccgagcaccccaaggacgaaagcgccauggcuacagccccuauuaaaaaucaggggucuaugguguccgagccggucaagaaccagggccuggugguuagcggacccgugaaagaucaagacgucgugguuccugaacacgccaaggugcaugauucugcugucguggcgcccgugaagaaucagggcccugucguucccgaguccgugaaaaaccaggacccuauccugccggugcucgucaaggaucaagggcccacggugcugcagccucccaaaaaucagggacggauuguuccugagccccuuaagaaccaggugccgaucgucccugugccccugaaagaccaagauccccucguuccugugcccgccaaggaccagggcccugcugucccggaaccccugaagacccaggggccucgcgacccccagcuuccuacagugagcccccugccgagaguuaugaucccuaccgcuccccacacagaguacauugaaucuagcccuuga

SEQ ID NO: 71849 - RNA, 2205 nt, Artificial Sequence
  derived and/or modified sequence opt5 from MAP7__Homo_sapiens__NP_001185540
augcccggcagcgccaccgcucugagacacgagcggcucaagaaaacaaacgcccgcccuaucccgcuggggcuuuucacgauuaaugaagaggacgaacagcaaaagaacggaaauuccagacggcccaaagcgccugauucuuacaaggugcaggacaaaaagaacgcuagcucccgccccgccucugccaucagcggccagaauaacaaucauuccgggaacaagccugaucccccuccgguccugagaguugacgaucggcagcgccucgcuagagagcggcgcgaagagagagagaaacaacuggccgcucgggaaauuguguggcuugagcgcgaagagagagcccggcagcacuaugagaagcaucuggaggaacgcaaaaagagacucgaggaacagcggcagaaagaagagagacgccgggcggccguggaggaaaagagacgccaacggcuggaggaagacaaggagagacacgaagcugucgugcgccggaccauggagagaucucagaaacccaagcagaaacauaaucgcuggagcuggggaggcucccugcacgggagcccuucuauccacuccgccgcucggagacuccagcugagccccugggagucuuccguugugaaccgccuucugacaccuacccauagcuuucucgcccggucuaaguccacagcggcccugagcggagaagcugccuccugcucucccauuaucaugccguacaaagcugcccacagcagaaauuccauggaucggccuaaacuuuucgucacacccccugagggcagcucucgcagacggaucauucauggcacagccuccuauaaaaaggaaagagagcgcgaaaacgugcuguuucucaccagcgggacgcggagagcuguuucucccagcaaucccaaggcgcgccaaccugccagaucccggcuguggcugccgucuaaaagccucccccaucugccuggaacccccagaccuacauccagccuucccccgggcucugugaaggcugccccugcccaggucagacccccuucccccgggaacauccggccugugaaacgcgaggugaaggucgagcccgaaaagaaggacccggagaaggaaccucagaaaguugcuaaugagcccagccugaagggcagagcgccccucgugaaaguggaggaagccaccgucgaggaacggaccccugcugagccggaagugggacccgccgccccugcuauggcccccgcuccugccucugcgcccgccccugcuuccgcccccgcuccggccccuguucccaccccugcgauggugagcgcccccuccucuacggucaacgcuagcgccuccgugaagacaucugcugggaccacagauccggaggaggccacccgccugcuugccgaaaaacgccggcuggcucgcgagcaaagagaaaaggaggaacgggagagacgcgagcaggaggaacucgaacggcagaagagagaggaacuggcgcagcgcguugccgaggagcggaccacaagacgcgaagaggaaagccggagacuggaggcugagcaagcccgcgaaaaagaggaacagcuccagcggcaggccgaggaaagagcucugcgggagcgcgaggaagccgagagagcgcaacggcagaaggaagaggaagcucgcgugagagaggaggccgaacgggucagacaggagcgcgaaaaacacuuccagcgggaggaacaagagagacuugagcgcaagaaacggcuggaagagauuaugaagagaacgcgccggaccgaagccacagacaagaaaaccuccgaucagagaaacggagacaucgcuaagggcgcccucacaggcgggaccgaggugagcgcgcugccuuguacgacaaaugcucccggaaacggcaaaccugucgggucuccccacgugguuaccucccaccagagcaaggugaccgucgagucuacacccgaucuugaaaaacagccuaaugagaacggaguguccguucaaaaugaaaacuuugaggaaauuaucaaucugccgauuggcagcaagcccucucgccucgacgugaccaacagcgaguccccugagaucccccugaauccuauccuggccuucgacgaugaagggacacucggaccccugccucaggucgacggcgugcagacgcaacagaccgccgaggugauuuga

SEQ ID NO: 71850 - RNA, 1944 nt, Artificial Sequence
  derived and/or modified sequence opt5 from MAP9__Homo_sapiens__NP_001034669
augagcgacgagguguucuccaccacacuggccuacacgaagucucccaaagucaccaagagaacaaccuuucaggaugaacucauccgggcuauuacagcccgcagcgcgagacaacgguccucugaguauagcgacgauuucgacuccgaugaaaucguuucucugggcgacuuuagcgauaccuccgcugacgagaacagcgugaauaaaaagaugaacgauuuccacauuucugacgaugaagagaaaaauccuuccaaacuucuguuucucaagacaaacaaaagcaaugggaacaucaccaaggacgagccggugugcgccauuaaaaaugaagaggaaauggcccccgauggaugugaggacaucgucgugaagucuuucuccgagagccagaacaaagacgaagaguuugaaaaggauaagaucaaaaugaagccuaaaccccgcauucugucuaucaaguccacgagcuccgcugagaauaacucucuugacaccgaugaccauuucaaaccuagccccagaccucgguccaugcugaagaaaaagagccacauggaagagaaggauggccucgaggacaaagaaacagcccugucugaggaacuggagcuccauuccgcuccgagcucucugcccaccccuaaugggauucagcuugaagccgagaagaaagcguuuagcgagaaccuggaucccgaagacuccugccucacaucucuggccagcuccagccuuaagcagauccugggagauucuuucuccccuggcagcgaggggaaugcuucuggaaaagaccccaacgaagagauuaccgaaaaucacaacucccucaagagcgaugagaacaaggaaaauuccuuuucugccgaccauguuacgacagcuguggaaaagagcaaggagucccaagucaccgccgacgaucuggaagaggagaaagcgaaggccgaacugaucauggacgaugaccgcacaguggauccgcuccugucuaaaagccaguccauucuuaucagcaccucugcuaccgccuccagcaagaagacaaucgaggacagaaacauuaaaaauaagaaaucuacgaacaaucgggcuuccagcgccucugcccgccugaugaccagcgaguuccucaagaaauccagcucuaagagacggacaccuuccaccacaaccagcucccacuaccugggcacgcuuaagguucuggaucagaaacccucucagaagcaaagcaucgagccugaccgcgcugauaacauuagagcggccguguaucaggaauggcucgagaaaaagaaugucuaccugcacgagaugcaucggaucaaacgcauugaauccgagaaccugagaauccagaaugaacagaagaaagcugccaagcgggaggaagcccucgcuucuuuugaggccuggaaggcgaugaaagagaaggaagcuaaaaagaucgccgccaaaaagagacuggaggaaaagaacaaaaagaaaacagaggaagagaaugcugcccgcaagggcgaggcucugcaagccuucgaaaaauggaaggagaagaaaauggaauaucuuaaggagaaaaaccggaaggagagagaauacgagcgcgcgaaaaagcagaaggaagaggaaaccguggccgagaaaaagaaagacaaucucaccgcuguggagaaguggaacgagaaaaaggaagccuucuuuaaacagaaggaaaaggagaaaauuaaugaaaagcggaaagaggagcugaagagagcugagaaaaaggauaaggacaaacaagccaucaacgaauaugaaaaguggcuugagaacaaagaaaagcaggagcgcauugagcggaaacagaagaagagacacagcuuccuggaauccgaggcgcucccucccuggucucccccgagccgcacagucuuugccaaaguuuucuga

SEQ ID NO: 71851 - RNA, 1269 nt, Artificial Sequence
  derived and/or modified sequence opt5 from MAPK10__Homo_sapiens__NP_002744
augagccugcacuuccucuacuauugcuccgagcccacccuggacgugaagaucgccuuuugucagggcuucgauaaacaagucgacguuucuuacauugcuaagcauuauaacaugagcaaauccaagguggauaaucaguuuuacucuguggaagucggggacagcacauucacggugcuuaaaagauaucagaaccugaagccuaucggauccggcgcccaggggauuguuugcgcggcuuacgaugccgugcucgaccggaaugucgccaucaagaaacugucucgcccguuucaaaaccagacccacgcuaagagagccuaucgggagcuugugcugaugaaauguguuaaucauaagaacauuaucagccuccugaauguguucacaccccagaaaacccuggaagaguuucaggaugucuaccucgugauggaacugauggacgcuaaccuuugccaagugauccagauggagcuggaucacgagcgcauguccuaccuccuguaucagaugcuuuguggaauuaagcaucugcacagcgccggcaucauucacagagaccucaagccuucuaauaucgucguuaaauccgauugcacacugaagauucuggacuucgggcucgcgcggaccgccggaaccagcuuuaugaugacacccuacguggugacgcgcuauuacagagcuccugaagucauccugggcaugggcuauaaagagaacguggauauuuggucuguuggguguaucaugggagaaauggugcggcauaagauccuuuuccccggccgcgacuacauugaccaguggaauaaagucaucgagcaacuggggaccccuugcccggaguuuaugaagaaacuccagcccacagugagaaacuauguugaaaaucggccuaaguacgccggacugaccuuccccaaacuuuuuccugauucccuguuccccgcugacagcgagcacaacaaacucaaggccucucaggcgcgcgaucugcuguccaaaaugcucgugauugacccggccaagagaaucagcgucgaugacgcucugcaacauccuuacauuaaugugugguaugaucccgccgaagucgaggcuccuccuccccagaucuacgacaaacagcuugaugaacgggagcacacaaucgaggaauggaaggagcugauuuauaaggaagugaugaacuccgaggaaaagaccaagaacggcguugugaaagggcagcccucuccgagcgcccaaguccagcaguga

SEQ ID NO: 71852 - RNA, 1095 nt, Artificial Sequence
  derived and/or modified sequence opt5 from MAPK11__Homo_sapiens__NP_002742
augagcggccccagagccggguucuaccggcaggagcugaacaagaccgugugggaagucccucaacgccuccagggacugagaccgguuggcuccggggcuuauggaucugugugcagcgccuacgacgcgcggcuucgccagaaaguggcugucaagaaacuguccagacccuuucagucucucauccacgcccggcgcacauauagagagcugcggcuucugaagcaucucaaacacgaaaaugugauuggccugcuggauguuuucacgccugccaccagcaucgaggacuuuuccgaaguguaccucgucacaacccugaugggggcugaucuuaacaauauugugaagugucaagcccugucugacgagcauguucaguuccucguguaucagcugcuucgcggacugaaguacauccacagcgcuggcauuauccauagagaucucaaacccuccaacgucgccgugaaugaggacugcgaacugcggauccuggauuuuggccucgcgcgccaggccgacgaggaaaugacaggguauguggcuaccagaugguaccgggccccugagauuaugcugaacuggaugcacuacaaucaaacagucgauaucuggagcguuggauguauuauggcugagcuucugcagggcaaggcccucuuccccgggucugacuauaucgaucagcugaaacgcauuauggaaguggugggaaccccuuccccggagguccuugcgaagaucagcucugaacacgccagaacguacauucagucccugcccccuaugccccaaaaagaccucagcucuaucuuucggggcgcuaacccucuggccaucgaucugcucgggagaaugcuggugcuugacuccgaccagcgcguuagcgcugccgaggcccuggcucaugcguauuucucccaguaccacgaucccgaagacgagccggaggccgaaccuuaugaugagucuguggaagcuaaggagcggacccucgaagaguggaaggagcugacauaccaagaaguccuuagcuuuaaacccccugagccucccaagcccccgggaucccuggaaauugagcaguga

SEQ ID NO: 71853 - RNA, 1074 nt, Artificial Sequence
  derived and/or modified sequence opt5 from MAPK12__Homo_sapiens__NP_001290181
augagcucucccccuccggccagauccggcuucuaccggcaggaggugaccaagaccgcuugggaaguccgcgccguuuauagagaccugcaacccguggggagcggagcguacggcgcugugugcuccgccgucgaugggcggacgggagccaaaguggcuaucaagaaacucuaucgcccuuuucagucugagcuguucgccaagagagcuuaccgggaacuucgccugcucaaacacaugagacaugagaacguuauuggccugcuugacguguuuacccccgaugaaacacuggacgauuucaccgacuuuuaucucgucaugccuuucauggggacagaucugggaaagcugaugaagcacgagaaacucggcgaggaccggauccaguuucugguguaccagaugcuuaagggccugcgcgaucucaaacccgggaaucuggccguuaacgaagacugugagcuuaagauucuggauuucggacucgcgagacaagccgacagcgaaaugaccggcuauguggucacacggugguaccgcgcuccugaggugauccugaauuggaugagauacacccagacgguggauauuugguccgucgggugcaucauggccgagaugaucaccggaaaaacacuguuuaagggcucugaccaucucgaccagcugaaggaaauuaugaaaguuaccgggacaccgcccgcugaguucgugcagcggcuucaaagcgaugaagccaagaacuauaugaaaggacugccugagcucgaaaagaaagacuuugcguccauccugaccaaugccagcccccuugcugugaaccugcucgagaagaugcugguccuggaugccgagcagcgcgugacggcuggcgaagcccucgcccacccuuacuucgagucucugcaugacacagaagaugagccccagguucagaaauaugacgauuccuuugacgauguggacagaacccuugaugaauggaagcgggucacauacaaggaggugcugagcuucaaaccgccuagacaacucggcgcucgcguuucuaaggagacaccccuguga

SEQ ID NO: 71854 - RNA, 1098 nt, Artificial Sequence
  derived and/or modified sequence opt5 from MAPK13__Homo_sapiens__NP_002745
augagccugaucagaaagaaaggcuucuacaagcaggacgugaacaaaaccgccugggagcuccccaagacauaugucuccccuacgcacguugggucuggagcuuacggcagcgugugcuccgccauugauaaacggucuggggaaaagguggcgaucaagaaacugagccgcccguuucaauccgagauuuucgcuaagagagccuaucgggaacuucugcuccugaaacauaugcagcacgagaaugucaucggacuucuggacguguuuacccccgccucuagccuccgcaacuucuacgauuuuuaucugguuaugccuuucaugcagacagaccugcagaagauuaugggcauggaauuuuccgaggagaaaauccaauaccucguguaucagaugcugaaggggcuuaaguacauccauagcgcuggagucgugcacagagaucugaaacccggcaaucucgccguuaacgaagacugugagcugaagauucuugauuucggccuggcucggcaugccgacgcggaaaugaccggguacguggucacacgcugguauagagccccugaggugauccucucuuggaugcacuacaaucagaccguggauauuugguccgucggaugcaucauggcugagaugcugacaggcaaaacccuguuuaaggggaaagacuaucucgaucagcugacgcaaauucuuaagguuaccggagugcccggcacagaguucgugcagaaacugaacgacaaggccgcuaagagcuacauccagucucucccucagaccccgcggaaagauuuuacacaacuguucccccgcgccuccccucaggcggccgaccuucuggaaaagaugcucgaacuggacgucgauaaaagacugaccgcugcccaggcucucacgcaccccuuuuucgagccuuuccgggaccccgaagaggagacagaagcccaacagccguuugaugacagccuggagcaugaaaaacuuaccguggaugaguggaagcagcacauuuauaaggaaaucguuaauuucucuccuaucgcccgcaaggacuccagacggcgcagcgggaugaaacuguga

SEQ ID NO: 71855 - RNA, 1083 nt, Artificial Sequence
  derived and/or modified sequence opt5 from MAPK14__Homo_sapiens__NP_001306
augagccaggagagacccaccuucuaccggcaagaacugaacaagacaaucugggaggugccugaacgcuaucagaaucucuccccggucggcucuggggccuacggaagcguuugcgcugccuuugacacgaaaaccggccugagaguggcggugaagaaacuuucccggcccuuccagucuauuauccacgcuaagcgcacauauagagagcugcggcuccugaaacauaugaagcacgaaaacgucauugggcuucuggauguguuuaccccugcccgcagccucgaggaguucaaugacguuuaccuggugacacaucugaugggagccgaucucaacaauaucgucaagugucagaaacugaccgacgaucacgugcaauuucuuauuuaucagauccugagaggccucaaguacauccauuccgcugacauuauccaccgggaucugaaacccucuaaccuugccguuaaugaagacugcgagcugaagauucucgauuucgggcuggcucgccacacagacgaugaaaugaccggauauguggccacgagaugguaccgggcgccugagaucaugcugaacuggaugcauuacaaucagaccgucgacauuuggagcgugggcuguaucauggccgagcuccugacaggccgcacccuuuuucccgggacagaucacauuaaccagcugcaacagaucaugagacucaccggaacgccuccggcuuaucugaucaaucggaugcccucccaugaagcccgcaacuacauucagagccuuacacagaugccuaaaaugaauuucgcuaacguguuuaucggcgccaauccccuggcggucgaccuccuggagaagaugcugguucucgacucugauaagagaauuaccgccgcucaagcccuggcucacgccuauuucgcccaguaccacgacccugaugacgaacccguggcugauccguaugaccaguccuuugagagccgggaucuucugaucgacgaauggaaaucucucacauacgaugaggugauuuccuucgucccucccccucuggaccaagaggaaauggagagcuga

SEQ ID NO: 71856 - RNA, 1635 nt, Artificial Sequence
  derived and/or modified sequence opt5 from MAPK15__Homo_sapiens__NP_620590
augugcaccguggucgaccccagaaucguucggcgcuaccugcucagacggcagcugggccaaggggccuauggaauuguguggaaggcuguggaucgcagaacaggcgaggucguggccaucaaaaagauuuucgacgcguuucgggauaaaacggacgcucagcgcaccuucagagaaaucacacuucugcaggaguuuggggaucacccuaacauuaucagccuccuggacguuauccgggccgaaaaugaucgcgacauuuaccuuguguucgaguuuauggauaccgaccugaacgccgucaucagaaagggaggccuccugcaggaugugcauguucgguccauuuucuaucaacugcuccgcgcuacaagauuucugcacucugggcaugugguccaccgggaccagaaaccgagcaaugugcuucuggaugccaacuguaccgugaagcucugcgacuucggacuggcucgcucccuuggcgaccugcccgaaggcccugaggaucaggccgucacagaguacguugcgaccagaugguaucgggcccccgaagugcuccugucuagccauagauacacgcuggggguggacauguggucccucggauguauccugggcgagaugcuucgcgggcggccucuguuucccggaaccucuacacuccaccagcuggaacuuauucuggagaccaucccuccgcccagcgaggaagaucuccuggcucugggcuccgggugcagagccagcguccuccaccaacugggaucucgcccucggcagacacuugacgcucugcugcccccugauaccucccccgaggcccuggaccuucugagacgccuccugguguucgcgccggauaagcggcugagcgccacgcaggcucuccagcauccuuauguucaaagauuucacugucccucugacgaaugggcccgcgaggcugaugugcggccuagagcccaugaaggcguccagcuguccgugcccgaguaccgcagccggguuuaccagaugauucuugagugcggcgggucuuccggaacaagcagagaaaaaggccccgaggggguguccccuucucaagcccaccuccacaagccgcgggcugacccccagcucccuagccgcacccccguccagggaccuagaccccggccgcaguccagcccuggccaugaucccgcggaacacgagucuccuagagccgcuaaaaaugugccccgccaaaacuccgccccucugcugcagacagcccuucucgggaauggagaacggcccccgggcgcuaaggaggccccuccccugacccugagccucgucaaacccucuggcagaggggcggcuccuagccugaccucccaggccgccgcucagguggccaaccaagcucuuauccgcggagacuggaauagaggcgggggaguucggguggccucuguccaacaggugccgccccgccugccucccgaggcgagaccuggccggcgcauguucagcacauccgcccuccagggggcucagggcggagccagagcucugcugggcggguauagccaggccuacggaacgguuugucauucugcgcuuggccaccucccccugcuggaagggcaucacguguga

SEQ ID NO: 71857 - RNA, 1083 nt, Artificial Sequence
  derived and/or modified sequence opt5 from MAPK1__Homo_sapiens__NP_620407
auggccgcugccgcggcugccggcgccgggcccgagauggugagaggacaggucuucgacguuggcccucgguacaccaaccugagcuauaucggggaaggagcuuacggcauggugugcuccgccuaugauaaugugaacaagguccgcguggcuauuaaaaagaucucuccguuugagcaccaaacauacugucagagaacgcuccgggaaauuaaaauccugcuucgcuucagacaugagaauauuaucgggaucaacgacauuauccgggcccccaccauugaacagaugaaggauguuuauaucgugcaggaccugauggagacagaucucuacaaacugcuuaagacccaacaccugagcaaugaccauauuugcuauuuucucuaccagauccugcgcggacugaaguacauucacuccgcgaacguccuccauagagaucugaaaccuucuaaucuucugcucaacacaaccugugaccugaagaucugcgauuucggccuugcccggguggcugaccccgaucacgaccacacaggcuuucugaccgaguauguugccacgcgcugguacagagcuccugaaaucaugcucaauagcaaaggguauaccaaguccauugauaucuggucugugggauguauucuggccgagaugcugagcaaccggcccaucuucccuggcaaacauuaccucgaccagcugaaucacauucuugggauccugggauccccgagccaggaagaccucaacugcaucauuaaucugaaggcgcgcaacuaucuucugucucucccccauaagaauaaagucccuuggaacagacuguuucccaacgccgauuccaaggcucuggaccuccuggauaaaaugcuuacauucaauccucacaagcggaucgagguggagcaagcccuggcucaccccuaccucgaacaguauuacgacccgagcgaugagccuauugccgaagcccccuuuaaauucgacauggagcuggaugaccuuccuaaggaaaaacugaaggagcucaucuuugaggaaaccgcucgcuuccagcccggcuacagaucuuga

SEQ ID NO: 71858 - RNA, 1074 nt, Artificial Sequence
  derived and/or modified sequence opt5 from MAPK3__Homo_sapiens__NP_001035145
auggccgcugccgcggcucagggcgggggaggcggggagcccagacggaccgaaggagugggcccuggggucccgggagagguugaaauggugaagggccaacccuucgacgugggcccucgcuacacacagcugcaguauaucggggagggagccuacggcauggucagcuccgccuaugaucacgugagaaaaacgcggguugcuauuaagaaaaucucucccuuugaacaucagaccuacugccaacgcacacucagagagauucagauccugcuucgguuccgccacgagaacgugauugggaucagagacauccugcgggccagcacccucgaagcuaugcgcgaugucuauauugugcaggaccugauggagacagaucuuuacaagcugcucaaaucccagcaacugucuaaugaccauaucuguuauuuucuguaccagauucucagaggacugaaguacauccacagcgccaacguucuucaucgggaucugaagccuuccaaucuccugauuaacaccacaugcgaccuuaaaaucugugauuucggccuggcgcgcauugccgaccccgaacacgaucacaccggguuucucacggaguauguggcuaccagaugguaccgggccccugagaucaugcucaauucuaagggauauacaaaaagcaucgacauuugguccgucggcugcauccuggcugaaaugcugagcaaccgcccgauuuuccccggcaagcauuaccuggaucagcuuaaucacauccuggggauucucggaucuccuucccaggaggaccugaacuguaucaucaauaugaaagccagaaacuaucuucaaagccugcccucuaagaccaagguggcgugggccaaacucuuuccuaaguccgacagcaaagcucuggaucugcucgaccggaugcugacauucaaucccaacaagagaauuaccguggaagaggcccuugcucauccguaccuggaacaguauuacgauccuacggacgaggucggccagucucccgccgccguugggcucggagcuggcgagcaagggggaacauga

SEQ ID NO: 71859 - RNA, 2166 nt, Artificial Sequence
  derived and/or modified sequence opt5 from MAPK6__Homo_sapiens__XP_005254596
auggccgagaaguucgaaagccugaugaacauccacggcuuugaccucggguccagauacauggaucugaaaccccuuggaugcggcgggaauggacugguguucucugcugucgacaacgauugugacaagcggguugccauuaaaaagaucgugcucaccgauccucagagcgugaaacaugcgcugcgcgagauuaagaucauuagacggcuugaccacgauaauaucgucaagguguuugaaauccugggcccguccgggucucaacucacagacgauguuggaagccugacggagcugaacuccguguauauuguccaggaauacauggagaccgaccucgcuaaugugcuggagcagggcccccuucuggaggaacaugcccgccucuucauguaucagcugcuuagaggccugaaauacauccacucugccaacguucuccaucgggaucugaagccugcuaaucuguuuauuaacacagaagaccucgugcugaaaaucggggauuucggacuugcccgcauuauggacccccacuauagccacaagggccaucuguccgaggggcucgucaccaaaugguacagaagcccucggcugcuucugucucccaauaacuauacaaaggcuaucgacaugugggccgcgggaugcauuuuugccgagaugcucaccggcaagacacuguucgcuggggcccacgaacuggagcaaaugcagcucauccuggaauccaucccuguggugcaugaggaagaucgccaggagcuucugagcgucauuccgguuuacaucagaaaugacaugaccgagccccacaaaccucucacgcagcugcuucccggaauuucucgggaagcucuggauuuucucgagcaaauccugaccuucuccccuauggaccgccugacagccgaagaggcgcucagccaccccuacaugucuauuuauuccuuuccgauggaugaaccuaucagcucccaucccuuccacaucgaggacgagguggaugacauucugcuuauggaugaaacccauucucacaucuacaacugggagagauaucaugacugucaguuuagcgaacacgauuggccugugcacaauaacuucgacauugacgagguccagcuggauccccgggcccucuccgacgugacagaugaagaggagguucagguggacccccgcaaguaccuggauggcgacagagaaaaauaucuggaggauccugcuuucgacaccaauuacagcacggaaccgugcuggcaauauucugaucaucacgagaacaaguacugugaccuugagugcucccauacauguaacuacaaaacccggagcucuagcuaucucgauaaucuggucuggagagaauccgaggugaaccacuacuaugaacccaagcugaucauugaccucucuaauuggaaagagcagagcaaggaaaaguccgauaaaaagggcaaaagcaagugcgagcgcaacgggcugguuaaagcccagaucgcucuugaggaagccucucaacagcuggccggaaaggagcgggaaaagaaucagggcuuugacuucgacuccuuuaucgcugggacaauucagcucagcucucaacacgagccuaccgauguggucgacaaacugaacgaucugaauagcagcgugucccagcuugaacucaagucucugaucagcaaauccgucucucaggagaagcaggagaaaggaauggcgaaccuggcccaacucgaagcucuguaccagagcuccugggacagccaguucgugucuggcggggaggauugcuuuuucauuaaucaguuuugugaaguuagaaaggacgagcaaguggaaaaggagaacaccuauacauccuaccuugauaaauucuuuagccgcaaggaggacacggaaaugcuggagaccgaacccgucgaggauggaaaacucggcgagcggggccaugaagagggguuccugaauaacucuggagaauuucuguucaauaagcagcuugaguccaucggcauuccucaguuucacagccccguggggucuccgcucaaaagcauccaggccacacugaccccuuccgccaugaaguccucuccccaaauuccucaucagacauauuccagcauccugaagcaccucaacuga

SEQ ID NO: 71860 - RNA, 2451 nt, Artificial Sequence
  derived and/or modified sequence opt5 from MAPK7__Homo_sapiens__NP_002740
auggccgagccccugaaggaagaggacggcgaagaugggagcgcugagccuccgggacccgugaaagccgaaccugcgcacaccgcugccuccgucgccgcuaagaaccucgcccugcuuaaagcuagaucuuucgacguuacauuugaugugggcgacgaguacgagaucauugaaacgaucgggaauggagccuauggcguggucagcuccgcgcggcgcagacugaccgggcagcaaguggccauuaagaaaauccccaacgcuuucgauguugugacaaaugccaagcggacccuccgcgagcugaagauucuuaaacauuuuaagcacgacaacaucaucgcuauuaaagauauccugagaccuacaguccccuacggagaguucaagucuguguauguugugcucgaccugauggaaagcgaucugcaucagauuauccacuccucucagccucucacccuggagcauguccgguacuuucuuuaucagcugcuccgcggccugaaauacaugcacagcgcccaagugauucacagagaccuuaagccguccaaucugcucgugaacgaaaauugcgagcugaagaucggcgauuucgggauggcgcggggacuguguacaagccccgccgaacaucaguauuuuaugaccgaguacgucgcuacgcgcugguacagagccccugaacucaugcugucucuucacgaguauacccaggcuauugaccugugguccguuggcugcaucuucggggagaugcucgcccggcgccagcuguuucccggcaaaaacuacgugcaucaacuucagcugaucaugauggugcucggaacaccuagccccgccgucauucaggcugugggggcggaaagaguucgggccuauauccagucucugccgccucgccaacccgugccuugggagaccgucuaccccggagcugauagacaggcccugucccuccugggccggaugcuuagauucgaacccagcgcccgcauuucugcugccgcggcucugcggcacccuuuucucgccaaguaucacgacccggacgaugagcccgacugugccccucccuucgauuuugcuuucgacagagaagcccugacacgcgagcggaucaaagaggcuauuguggccgaaaucgaggauuuccaugcgagacgcgaaggcauccggcagcaaauuagauuucagccuucccuucagcccguugccagcgagccggggugcccugacguggaaaugcccuccccuugggcucccucuggagauugugccauggagagcccucccccggcuccuccucccugccccggcccggcccccgacaccaucgaucugacgcuccagccucccccucccgucuccgagccugcgcccccgaagaaagacggggccauuagcgauaauacaaaggcugcccugaaagcugcccugcucaagucucugcgcucccggcuuagagacggaccuagcgcuccccuggaagccccugagccccgcaagccggugaccgcgcaagaacggcagagagagcgggaggaaaaacgcagacggagacaggagcgcgccaaggaacgggagaaaagacgccaggaaagagagcggaaggagcgcggcgcuggggccucuggaggcccuagcacagacccccucgccggccugguccuguccgauaacgacagaucucuucucgaacgguggacccgcauggcuagaccugccgcgcccgcucugaccagcgugcccgccccugccccggcucccacaccuacgcccaccccuguucaacccacauccccuccgcccgggccuguggcccagcccaccggaccucagccccagagcgcgggcucuacauccgggccggucccucaacccgcuugucccccucccggaccugccccgcaccccaccggcccucccgggccuauccccgugccggccccuccccagauugcuacgagcacaucucugcucgccgcucagucccugguuccucccccuggccuucccggaagcuccaccccgggcgugcugccuuacuucccucccgggcugcccccgcccgaugccggaggcgcgccucagucuagcauguccgagucucccgacgucaaucucgugacccaacagcugagcaaaucccagguggaagauccucuucccccuguuuuuagcgggacaccgaagggaucuggcgccggguauggcgucggauucgaccucgaggaauuucugaaccaauccuucgauaugggcguggcugacgggccccaggauggacaggccgacagcgcuucucuguccgccagccuccuggccgauuggcuugagggccaugggaugaauccugcugacaucgagucucugcagcgggaaauccaaauggauagccccaugcuccuggcggaccugccugaccuucaggaucccuga

SEQ ID NO: 71861 - RNA, 927 nt, Artificial Sequence
  derived and/or modified sequence opt5 from MAPK8__Homo_sapiens__NP_001265477
augagcagauccaagcgggacaacaauuucuacucuguggagaucggcgauagcaccuuuacaguccugaaacgcuaucagaaccucaagcccauuggguccggagcccaaggcaucguuugcgcugccuacgacgcgauucuggaaagaaauguggcuaucaaaaagcugucucggccuuuccagaaccagacgcacgccaaacgcgccuauagagagcuugugcucaugaagugugucaaucauaagaacauuaucgggcugcuuaauguguuuaccccgcagaaaagccuggaagaguuccaagauguuuacaucgugauggaacucauggacgcuaaccugugccaggucauucagauggagcuggaucacgagcggauguccuaucuccuguaccagaugcuuuguggaaucaagcaucugcacucugccggcauuauccaucgcgaccucaaacccagcaauauugugguuaaguccgauugcacacugaaaauccuugacuuugggcuggcuagaaccgccggaacauccuucaugaugaccccuuauguggucacacgguacuaccgcgcgcccgaagugauucucggcaugggcuauaaggagaacgccgauucugaacacaauaagcugaaagcuagccaagccagagaccugcucagcaagaugcuggugaucgaugcuucuaaacggaucuccgucgacgaggcccuucagcacccuuacauuaacguuugguaugaucccagcgaggcggaagccccuccgcccaagaucccugacaaacagcuggacgagcgcgaacauaccauugaggaauggaaggagcucaucuacaaagaggugauggaucuggaagagagaacgaagaauggggugauucggggacagcccucuccucuugcucaaguccagcaguga

SEQ ID NO: 71862 - RNA, 2136 nt, Artificial Sequence
  derived and/or modified sequence opt5 from MAPK8IP1__Homo_sapiens__NP_005447
auggccgagagagaaagcggcgggcugggaggcggggcugccucucccccugcggcuuccccguuccucggacugcacaucgccagcccucccaacuuucggcuuacccaugacauuucccuggaggaguucgaagaugaagaccucucugagaucacagaugagugcggcauuagccugcaguguaaggacacgcuuucccugagacccccucgcgccgggcuccugucugcuggaggcggcggggccggaagccggcugcaagcugaaaugcuccagauggaucugaucgacgccaccggcgauacacccggggcggaggacgaugaagaggacgaugacgaggaacgcgccgcuagacggccuggagccggcccgcccaaagcugaguccgggcaggaaccugccagccgcggacagggccaaucucagggccagucccaggggcccggaagcggcgauaccuacagaccuaagcggcccacaacccuuaaucuguuuccgcaagugccucgcucucaggacacacucaacaauaacucccuggggaaaaagcacagcuggcaggacagagucucucgguccagcucuccccuuaaaaccggagagcagacgccuccccaugaacacauuugccuguccgaugagcugcccccucaaagcggcccggcgcccaccacagaccgcgggaccuccacagauagcccuuguagacggucuaccgccacgcagauggcucccccuggagggcccccggccgcuccucccggcggccgcggacauucccacagagaccggauccacuaucaggccgauguuagacucgaggccacagaagagaucuaccugaccccugugcaacggcccccugacgcugcggaacccacaagcgccuuccucccgccuaccgagucucgcaugagcguguccucugaucccgaccccgcugccuauccuagcaccgccggcagaccgcaucccuccauuagcgaagaggaggaaggguuugauugccugucuuccccugagcgcgcugaacccccuggaggcggguggcggggcagccuuggagagcccccucccccgccuagagccucucuguccagcgacacauccgcgcucucuuacgauagcgucaaguauacgcuggugguugacgaacacgcucagcuugagcuggugucccuccgccccuguuucggcgacuacucugaugagagcgacuccgccaccgucuaugauaauugcgccagcgugucuuccccuuacgaaagcgcuaucggggaggaauacgaggaggcuccccggccgcagccucccgccugucugucugaagacuccacaccugaugagcccgacguucauuuuagcaagaaauuccugaacguguuuaugucuggaagaagccgcuccagcucugccgaauccuucggccucuuuagcugcauuaucaauggggaggaacaggagcaaacccaccgggcgauuuucagauuugucccccgccacgaggaugaacuggagcuugaaguggacgauccucugcucguggagcugcaggccgaagacuauugguacgaggcuuauaacaugcggacaggagccagaggcgucuucccggcuuacuaugccaucgagguuaccaaggaacccgagcauauggcggcccuugcuaaaaauuccgauuggguggaccaguuccgggugaaguuucuggggucuguccaggugccuuaccacaaaggcaacgauguucucugugccgcuaugcaaaagauugccacgacacgcagacugaccgugcauuucaaucccccuagcuccugcguccuggaaaucucugugcggggaguuaagaucggcgugaaagccgacgacagccaggaggcuaaggggaacaaauguucccacuuuuuccagcucaagaauauuucuuuuugcggauaucaucccaaaaacaauaaguacuucggcuuuaucaccaaacacccugcggaucacagauucgccugccaugucuuugugagcgaagacuccacaaaggcucuggccgagagcgucgggcgcgccuuccagcaauuuuacaagcaguucguggaguauaccuguccgacagaagauauuuaccuugaguga

SEQ ID NO: 71863 - RNA, 2475 nt, Artificial Sequence
  derived and/or modified sequence opt5 from MAPK8IP2__Homo_sapiens__NP_036456
auggccgacagagcugagauguucagccuguccaccuuucacucucucucucccccuggcugccggccgccccaggauaucucccuggaagaguucgacgaugaagaccuuucugagauuacagaugacugugggcugggacucagcuacgauuccgaccauugcgaaaaggauucucugagccuuggccgcuccgagcaaccucaccccaucuguagcuuucaggacgauuuccaggaguuugaaaugauugacgauaacgaggaagaggacgacgaggaugaagaggaagaggaagaggaggaagagggggacggagaaggccaggaagggggagauccuggcucugaagcccccgcgccuggcccgcugauccccuccccuagcguggaggagccccauaaacacagaccuacgacccuccggcugacaacccugggggcucaagacucucucaauaacaauggaggcuucgaucugguccgccccgccuccuggcaggaaacagcccuuugcagcccggcuccugaggcccugagagaacuccccgggccucugcccgcuaccgacacaggacccggcggggcccagucuccuguucggccgggaugugauugcgagggcaaccgccccgcggaaccucccgccccuggcgggaccucccccagcuccgacccgggaauugaggcugaucuuagaucucggagcuccggcgggcgcggaggcagacggagcucucaggagcuguccagcccugggucugacagcgaagaugccggaggcgcucgccucggcagaaugaucuccucuaucagcgagacggaacuggagcuguccagcgacgggggaucuuccagcucuggccgguccagccaucucaccaauuccauugaggaagccucuagccccgcguccgagccugaacccccucgcgagcccccgagacggccugccuuucugcccguggggcccgacgauacaaacucugaauaugagagcggauccgagagcgaaccugaccuuucugaggaugcugacuccccguggcugcucagcaaucuggugucuagaaugaucuccgaaggcagcucucccauucgcuguccugggcaaugccuuagccccgccccucggcccccuggcgagcccgucuccccggcuggaggcgccgcccaggauagccaggacccugaagcugcggccgggcccggaggcguggagcugguugauauggagacccucugugcuccucccccgccugcccccgccgcuccuagacccgggcccgcccagccuggaccgugccuguuccugucuaaccccacacgcgacaccaucacgccucucugggcggcucccggccgggccgccagaccugggcgcgcuuguuccgccgcuugcagcgaagaggaagaugaggaagacgaugaggaggaagaggacgccgaagauuccgcgggcucucccggaggccgggggacaggaccuagcgccccgagagacgcuucccugguguacgacgccgucaaguauacccuugugguugaugagcacacacaacuggagcucgugucucugcgccggugcgcuggccuugggcacgacagcgaagaggauuccggaggcgaagccucugaggaagaggcgggggccgcucugcucggcggaggccaggucagcggggacaccucccccgauagcccugaccugaccuuuucuaaaaaguuccugaauguguuugugaacuccacaagcagaucuuccagcacggagucuuucggacucuuuuccugucuggucaauggcgaggagcgcgaacagacccaucgggccguuuucagauucauuccccggcacccugaugagcuugaacuggacguggaugaccccgugcucgucgaggcugaggaagaugacuuuugguuccgcggguuuaacaugagaacaggagagcggggcguguucccggccuuuuacgcccaugcuguuccugggcccgcgaaagaucugcugggcagcaagagaucccccugcuggguggaacgcuucgacguccaauuucuuggaagcguggagguuccuugucaccagggcaaugggauccucugcgccgcuaugcagaagauugccaccgcccggaaacugacagugcaccugagacccccugcuucuugugaccucgaaaucagccugcgcggagucaaacuuucccugucuggcgggggaccggaguuccagagaugcagccacuuuuuccaaaugaagaacaucuccuuuuguggcugccauccccggaauagcuguuauuucggcuuuauuaccaagcauccucuccugagccgcuucgccugccacguguucgucucccaggagucuaugagacccguggcgcagagcguugggcgggcuuuucuggaauacuaucaggagcaucuugccuacgccuguccuacggaagauaucuaccucgaguga

SEQ ID NO: 71864 - RNA, 3993 nt, Artificial Sequence
  derived and/or modified sequence opt5 from MAPK8IP3__Homo_sapiens__NP_001035529
augauggagauccagauggacgaaggcgggggaguggucguuuaccaagaugacuauugcagcggcuccgugaugucugagagagugagcgggcuggccggauccauuuaccgggaguucgaacgccucauccacuguuaugaugaagaggucgugaaggagcugaugccccuuguugugaacguccuggaaaaucucgacucugugcugagcgagaaccaggaacaugagguugagcuugaacugcucagagaggauaaugaacagcugcugacccaguacgagcgggaaaaagcucuccgcagacaagccgaggagaaguuuauugaguucgaagacgcgcuggaacaggagaaaaaggaacuucagauccagguggagcacuaugaguuucaaacacggcagcuggaacucaaagcuaagaacuacgccgaucagauuucccgccuggaggaaagagagucugaaaugaagaaagaguauaaugcccuucaucagcggcacacggagaugauccaaaccuacgucgaacauaucgagcgcagcaagaugcaacaggugggcgggaacucccagacagaaagcucucugccuggaagacggaaagagcgcccgaccucccucaauguguucccccuggcugacggcacagucagagcccagauuggcgggaagcugguuccugcuggagaucacuggcaccucagcgaccugggccagcuucagucuuccagcucuuaccaaugcccccaggaugagauguccgaaagcgggcaguccucugccgcggccaccccuagcacaaccggaacgaaauccaacacccccacaagcucugugccuuccgcugccgugaccccgcugaaugagagccuccagccccugggcgacuauggggucggaucuaagaacagcaagcgggcucgcgagaaaagagauucccggaauauggaagugcaaguuacacaggaaaugagaaacgugucuaucggcaugggcagcuccgacgaguggagcgacguccaggauauuaucgacucuaccccugagcuugauaugugucccgaaacgcgccuggaccggacaggguccagcccuacccagggaauugugaauaaggccuuuggcaucaacacagauucucucuaccaugagcuguccaccgcggggagcgaaguuauuggagacguggaugagggcgccgaccugcucggggaguucuccggaaugggcaaagaagucggcaaucugcuucuggagaacucucaacuccuggaaaccaagaacgcucuuaauguggucaaaaacgaucugaucgccaagguggaccagcucagcggggagcaggaaguucugagaggagagcuggaagcugccaaacaggccaaggugaagcucgagaaucgcaucaaagagcuggaagaggaacuuaagcgggucaaauccgaggcuauuaucgcgagacgcgagcccaaggaagaggccgaagaugugucuagcuaucugugcacagaguccgacaaaauuccgauggcucaacggagacgcuuuacgcggguugaaauggccagagugcucauggagcgcaaccaguacaaggagcggcugauggaacugcaggaggccgucagauggaccgaaaugauccgggcuagccgcgagcacccuucugugcaagaaaagaaaaaguccacaauuuggcaguucuuuagcagacuuuucucuuccagcucuagcccuccucccgccaaacggcccuaucccuccgugaauauccauuacaagagcccgaccacagcgggcuuuucucagagacgcaaccacgcuaugugucccaucuccgccgggagccggccucucgaguucuuucccgacgaugacugcaccuccucugccagacgcgagcagaaaagagaacaauaucggcagguucgcgagcacgucagaaaugaugacggacggcugcaggcuuguggcuggagccugccugccaaguacaagcagcucucccccaacgggggccaagaagauacgcgcaugaaaaaugugccggugccugucuacugcagaccccugguggagaaggacccuacaaugaaacuuuggugugcugccggaguuaaccugucuggcuggcggcccaaugaagaugacgcggggaacggagugaagccugcccccggccgcgauccgcugaccugcgacagagagggggauggagagccuaaaagcgcucauaccucccccgaaaagaagaaagccaaggagcuccccgaaauggacgcuacaucuagccgggucuggauucugaccuccacacuuacgaccagcaaagugguuaucauugaugccaaucagccuggcacaguggucgaccaguucaccguguguaacgcgcacguucucugcaucucuuccauuccggccgcuagcgacucugauuaucccccuggggagauguuccuggacuccgaugugaaucccgaggacccuggcgccgauggaguccuggcuggcaucacacucguggggugcgccacccgcuguaacgugcccagaagcaacuguucuucccggggagacacgccuguccuggauaagggccagggggaaguugccaccaucgcuaauggaaaagugaaccccagccaauccacagaggaagcgaccgaggccacagaagugccggacccuggccccagcgagccugagaccgcuacgcuuagacccgggccgcugacagaacaugucuuuaccgauccugcccccacaccuucuagcggcccccagcccggauccgagaauggcccugaaccggacucuagcuccacccgccccgagccugaacccucuggggauccuaccggagccggcagcuccgcugcccccacaauguggcucggggcgcagaacggauggcuguacgugcacucugcuguugccaauuggaagaaaugccugcauagcauuaaacuuaaggacuccgugcucagccugguccacgugaagggccggguucugguggcccucgcugaugggacgcuggccaucuuccacagaggcgaggacggacaaugggaccuuucuaacuaucaucugauggaucucggccacccucaucacuccauucgcugcauggcggucguguacgaccggguuugguguggguauaagaauaaagugcacgucauccagccgaagaccaugcagauugagaaaucuuuugaugcucaucccagacgcgaaagccaggugcggcaacuggccuggaucggagacggcgugugggucuccauuagacuggauagcacacuucgccucuaccacgcccauacccaccagcaucugcaggacguugauaucgagccuuauguguccaagaugcuggggacaggaaagcucggcuucucuuuugugcggaucaccgcucugcuugucgccggcagcagacuguggguggggacgggaaacggcguugugauuuccaucccccucacagaaaccgucgugcugcaccgggggcagcugcuuggacugcgcgcuaauaaaaccagcccuacaucuggcgagggggccagacccggaggcauuauccacguuuacggcgacgauuccagcgaccgggcggccucuagcuucauuccguacugcuccauggcucaagcccagcucuguuuucaugggcaccgcgaugcugugaaguucuuugucucugugccuggaaacguccuggccacccucaauggcagcgugcuggacucccccgccgaagggcccggaccugcugcgcccgccucugagguugagggccagaaacuuagaaacgugcugguccucagcgggggagaaggcuauaucgacuuccggaucggcgauggggaggacgaugaaacagaggagggagcuggcgacaugucccaggugaagccuguucugagcaaagccgaaagaucucauauuaucguguggcaagucuccuacacgccggaguga

SEQ ID NO: 71865 - RNA, 729 nt, Artificial Sequence
  derived and/or modified sequence opt5 from MAPK9__Homo_sapiens__NP_001128516
augagcgacuccaagugcgauucucaguucuacagcgugcaagucgccgacuccaccuuuacaguucugaaaagauaucagcagcucaagcccaucggcucuggggcucagggaauugugugugccgcguucgauacggugcugggcaucaacgucgcugugaaaaagcugagccggccuuuucaaaaucagacccacgccaaacgcgccuacagagagcugguucuccugaagugcgugaaccauaagaauauuaucucccuucugaacgucuucacaccgcagaaaacccucgaagaguuucaggacguguaucugguuauggaacugauggaugcuaaucucugucaagugauucacauggagcuggaccaugaacggaugucuuaccuucuguaucagaugcucugcgggaucaagcaccuucauagcgccggaaucauucaccgcgaucuuaaacccuccaacaucgucgucaagagcgacuguacacugaaaauucucgauuucggccuggcuagaaccgccugcacaaauuuuaugaugaccccuuacguggugacgcgguauuaccgcgcgcccgagguuauccuggggaugggauacaaggagaacguggacauuuggucugugggcuguaucaugggcgaacucgucaaggggugcgugauuuuccagggaaccgauagaauccugccucgggaccuuggccccgccaugcuguccuga

SEQ ID NO: 71866 - RNA, 1569 nt, Artificial Sequence
  derived and/or modified sequence opt5 from MAPKAP1__Homo_sapiens__NP_001006618
auggccuuccuggacaaccccaccaucauucucgcucacaucagacagagccaugugacauccgaugacacgggcaugugcgagaugguccugauugaucacgacguugaucuugaaaagauccauccuccgucuaugcccggggacagcggauccgagauucaaggcucuaauggggaaacccagggauacguguaugcccagagcguggauaucacauccucuugggacuuuggcauccggcgcagaagcaacaccgcgcagcggcuggagcgccucagaaaagaacggcaaaaucagauuaaguguaaaaacauccaguggaaggagcgcaauuccaaacagagcgcucaagagcugaagucucuuuucgaaaagaaaucccugaaggagaaaccucccauuagcgggaagcagucuauccucuccgucagacuggaacagugcccucugcagcucaacaaucccuuuaacgaguacagcaaauucgauggaaagggccacgugggcacaaccgccacaaagaaaauugacguuuaucugccucuucauucuucccaagaucggcugcucccgaugaccguggucacgauggccagcgcucgcgugcaggaccugaucgggcuuauuuguuggcaguacaccuccgagggaagagaacccaagcugaaugauaacguuucugccuauugccuccacaucgcugaggacgacggcgaaguggauacagacuuuccuccccuggauagcaaugagccuauccacaaauucggguuuuccacccuggcccucgucgaaaaguacagcucucccggacugacauccaaagagagccuuuucgugcggauuaacgcggcccauggcuuuucucugauccaaguggacaauaccaaggucacgaugaaagagauucuccugaaggcuguuaagcgcagaaaagggagccagaagguguccggaccgcaguaucggcuugaaaaacagucugagccuaacguggccgucgaucuggacagcacacucgaaucccaaagcgcuugggaguucugucuggugcgcgaaaauucuuccagagccgauggcguuuuugaggaggacagccagaucgauauugcgaccgugcaggacaugcugucuucccaccauuacaagagcuucaaagucuccaugauccaccggcucagauuuacaaccgaugugcagcugggcaucucuggggacaagguugaaauugaccccgugaccaaccaaaaggccagcacaaaauucuggaucaagcagaaaccuauuuccaucgauucugaccuucugugcgcuugugaucucgccgaggaaaagagccccucccacgcuauuuucaaacugacguaccuuagcaaccaugacuauaagcaccuguacuuugagucugaugccgccaccgucaaugaaaucgugcucaaggucaacuauauccuggagucccgcgcuagcacagcgcgggccgacuacuucgcucagaaacagagaaagcugaaucgccggaccucuuuuuccuuccaaaaagagaagaaaagcggacagcaguga

SEQ ID NO: 71867 - RNA, 1113 nt, Artificial Sequence
  derived and/or modified sequence opt5 from MAPKAPK2__Homo_sapiens__NP_004750
augcugagcaacucccagggccaaucucccccugugccguuccccgccccugcucccccuccccagccuccgacccccgcccucccucaucccccugcgcagcccccgccucccccuccccagcaauuuccccaguuccacgucaagagcgggcugcagaucaaaaagaaugcuauuaucgacgauuacaaaguuacaucccaggugcuuggacugggcauuaacgggaaggugcuccaaaucuuuaauaaaagaacgcaggagaaguucgcccugaagaugcuucaggacugcccuaaagcccggcgcgaagucgagcugcacuggagagcuucucaguguccgcauauugugcggaucguugauguguaugaaaaccucuacgccggacgcaagugccugcugaucgucauggagugucucgacggcggggaacuguuuagccggauucaagauagaggagaccaggcuuucaccgagcgcgaggccuccgaaaucaugaaaucuauuggcgaggcgauccaguaucuucacagcauuaauaucgcccauagagaugugaagcccgaaaaccugcucuacacauccaaacggccuaaugcuauucugaaacuuaccgacuuuggcuucgccaaggagacaaccagccacaacucucugacaacccccugcuauacgccuuacuauguugcucccgaggugcucgggccggaaaaguacgauaaguccugugacauguggagccugggagucaucauguacauccugcucugcggcuauccucccuuuuacucuaaucacgggcuggccauuuccccuggaaugaaaacccgcaucagaaugggccaauaugaguuccccaacccugaauggagcgaggugucugaagaggugaagaugcuuauucggaaucugcucaaaacagagcccacccagcgcaugacaaucaccgaauuuaugaaccauccguggauuaugcaguccacgaaggucccucagacaccccugcacaccagcagaguucuuaaagaggauaaggaacggugggaggacgugaaggggugucugcaugauaaaaauuccgaccaagcgacauggcucacccgccuguga

SEQ ID NO: 71868 - RNA, 1149 nt, Artificial Sequence
  derived and/or modified sequence opt5 from MAPKAPK3__Homo_sapiens__NP_001230855
auggacggcgagaccgccgaggaacagggcggacccgugccuccgcccgucgcuccuggcgggcccggacugggcggggccccuggaggcagacgggaacccaagaaauacgcgguuacagaugacuaucaacucagcaaacaggugcugggccuuggggugaacggaaaaguccuggagugcuuccaccgcagaacgggccagaagugugcucucaaacugcuuuacgauuccccuaaggcccggcaggaaguggaccaucacuggcaagccucugggggaccgcauaucguuugcauucuggauguguaugagaauaugcaccauggcaagcgcugucuccugaucauuauggagugcauggaagggggagagcuguuuagcagaauccaggaacggggcgaccaggcuuucaccgagcgcgaggccgcugaaauuaugagagauaucggcacagccauccaguuucuccacucccacaacauugcgcaucgggacgucaaacccgagaaucugcuuuacaccucuaaggaaaaagaugccgugcugaagcucacagacuucggguuugcuaaagagaccacacaaaacgcccugcagaccccuuguuauacgcccuacuauguugcuccugaagugcuuggacccgagaaguacgauaagagcugcgacauguggucccugggcgucaucauguacauucuccuguguggguucccgccuuuuuauucuaauaccggacaggccaucagccccggcaugaaacgccggauuagacuggggcaguacggauucccuaaccccgagugguccgaagugagcgaggaugcgaagcaacucauccgccugcuucugaaaacagaccccaccgaaagacucacaauuacccaguuuaugaaucacccuuggaucaaccagucuaugguggucccgcaaacgccccugcauacagcccggguucuucaggaggacaaggaucacugggacgaagugaaagaggagaugaccuccgcucuggccacaaugcgcguggauuaugaccaggucaagaucaaagaucucaagaccagcaauaacagacugcugaauaagcggagaaagaagcaggcugggucuuccagcgccucucaaggcugcaacaaucaguga

SEQ ID NO: 71869 - RNA, 4545 nt, Artificial Sequence
  derived and/or modified sequence opt5 from MAPKBP1__Homo_sapiens__NP_001122080
auggccguggagggcagcaccaucacauccagaauuaagaaccugcuccggucucccagcaucaaacugcgcagauccaaggcugggaaucggcgcgaagaccuuucuagcaaagucacgcuggagaagguucucggaauuaccguguccggcgggagaggacuggccugcgauccucggucuggccuuguggcguacccggcugggugugucgugguucuguucaacccccgcaaacacaagcagcaucacauccucaauagcuccagaaagacaauuaccgcccuggccuuuagcccugacggaaaauaucuggugacaggcgaaucuggccauaugcccgcuguccgggugugggauguugccgagcacucccaaguggcugaacuccaggagcauaaguacggggucgccugcguggcguucagcccuucugccaaauauaucguguccgucggauaccagcacgacaugaucguuaacgugugggcuuggaagaaaaauauuguggucgccagcaacaaggugucuucccgcguuaccgcugugagcuuuuccgaggauuguucuuauuucgucacagccggcaauagacacaucaaguuuugguaccuggacgauagcaaaaccuccaaggugaacgcgacgguuccccuucuggggcggagcggacuccugggcgaacuucgcaauaaccuguucaccgacguggccugcgggagaggcaaaaaggcugauucuacauuuuguauuaccuccagcggacuccugugcgaguucucugaccggcgccugcucgauaaaugggucgaacugagaaauaucgacagcuuuacaaccacgguggcccauuguauuuccgucucucaggauuauaucuucugcggcugugcugacgggacagugcggcuuuuuaacccuagcaaucugcacuuccucuccacccugccgagaccccaugcccuuggaacagacauugccagcguuaccgaggcuucucgccuguuuuccggcguggcgaacgcccgguacccugauaccaucgcucucacauucgaccccacgaaucaauggcugagcugcgucuacaacgaucacucuaucuaugugugggacguuagagauccuaagaaaguggggaaggucuacuccgcccuguaucacagcuccuguguguggucuguggagguuuaccccgaagucaaggacagcaaccaggccugccucccgccuuccucuuucauuaccugcagcuccgauaauacaauccgccuguggaacaccgagagcucuggagugcauggcuccacacuucaccggaauauucugagcucugaccucaucaaaauuaucuauguggaugggaacacccaggcucugcuugacacggaacugcccggaggcgauaaggccgacgcgucccuccuggacccuagagucggcauccgcagcguguguguuucucccaaugggcagcaucuggcuagcggagaucggaugggcacacucagagugcacgagcugcaaucccuuagcgaaaugcugaaagucgaggcccaugacucugagauucucugccuggaauacuccaagcccgauaccgggcugaaacuucucgccagcgcuucccgcgaccggcugauccacgugcuggaugccggaagagaguauucucuccagcagacccuggacgaacacagcuccucuauuacagcuguuaaguuugccgcgagcgauggccaggugcgcaugaucuccuguggggccgacaagucuauuuacuuccggaccgcucaaaaauccggcgauggaguccaguuuacaagaacgcaucacgugguucggaagaccacacuuuacgacauggauguggagccuuccuggaaauauaccgccaucggcugccaggaccgcaacaucagaauuuucaauaucagcucugggaagcagaaaaagcuguuuaagggaucccaaggcgaagaugggacacucauuaaaguccagaccgacccgagcggaaucuacauugcuacgucuuguuccgacaagaaccugagcaucuucgauuuuucuuccggcgagugcguggccaccauguucgggcauagcgagauugugacaggcaugaaauuuuccaaugacuguaagcaccugaucagcgucucuggagauagcugcaucuucguuuggcggcuuuccucugaaaugaccauuagcaugagacagcgccucgcggagcugcggcaaagacagcgcggcgggaaacagcagggacccuccucuccucaaagagccagcggccccaaccggcaccaggcuccuuccaugcugucucccgggccggcccucagcuccgacagcgauaaggaaggagaggacgaaggcacagaggaggaacugccugcccuucccgugcuggcuaagucuaccaaaaaggcccucgcuuccgugccuagccccgcgcugccucgcucucugucccauugggagaugagcagagcccaggaauccgucggguuucuugaucccgcuccggccgccaauccuggcccccggcgcagaggacggugggugcagcccggcguugagcucucugugcgcagcaugcuggaccugagacaacucgagacgcuggcuccuucccuucaggauccgagccaggacucucuggccaucauucccuccgggccucggaaacacggacaggaagcgcucgagacaagccugaccucucaaaacgaaaagcccccucgcccccaggcuagccagccuuguuccuauccccauaucauuagacugcuuucucaagaggaaggcgucuucgcccaggaucucgagccggccccuaucgaggacgggaucguguaccccgaaccuagcgauaaucccacaauggacaccuccgaguuucagguucaggcuccggcccggggaacccugggcagaguguauccugggucucgcagcuccgaaaaacacagccccgacucugcgugcuccgucgauuacagcuccucuugucugagcuccccugagcaucccacagaagacucugagagcacggagccccucuccguggauggcauuagcucugaccuggaggaaccugcugaaggagaugaggaagaggaggaagaggaaggcgggaugggaccguauggccuucaagaggggagcccccagaccccugaccaggagcaguuccugaagcaacacuucgaaacacucgccagcggagccgcucccggcgccccuguucaggugcccgagcggucugaauccagaagcaucucuagccgcuuucugcugcagguccagacccggccucuuagagagccgucccccucuagcuccagccuggcucucaugucccgcccugcccaagugccccaggcgucuggcgaacagccucgggggaacggagccaaucccccgggcgcuccucccgagguggagcccagcuccgggaacccuucuccccaacaggccgcuagcguccugcucccuagaugccgccugaacccggauuccucuugggcccccaaacggguugccacagcuagcccuuucuccggacuucagaaggcgcagagcgugcacucucuggugccccaagaaagacaugaggccucccuccaggcuccuagccccggcgcccugcugucucgggaaauugaggcccaggacgggcuuggaucccugccgccugcugauggccgccccagcagaccucacucuuaccagaaucccaccacguccagcauggccaagaucucccggagcauuucugucggcgaaaaccucgggcugguggcggagccucaagcucaugcccccauccgcguuagcccgcucuccaaacuggcccuuccuucuagagcucaccuggugcucgacauccccaagccccugccugaucggccgacacuggccgcguuuagccccgucaccaaaggcagagcuccuggagaggccgaaaagcccggguucccugugggacuuggcaaagcccauuccaccacagagcgcugggcuugccugggggaaggaaccacacccaagccucggacggagugucaggcccacccgggccccucuagcccuugcgcucagcagcuccccguuuccucucuguuucaaggcccugaaaaucuccagcccccgccucccgagaagacccccaacccuauggaguguacaaaacccggggccgcgcugagccaggacuccgaaccugccgugagccuugagcagugcgaacaacuggucgcugagcugagaggaucugugcgccaggccguccggcucuaccacuccguggcuggcuguaagaugccgagcgccgagcagucuagaauugcccaacugcuucgcgacaccuucuccagcguucggcaggaacuggaggcuguggcgggggccguccucuccucucccggaagcuccccuggcgcugugggggccgaacagacacaggcccugcucgagcaauauagcgaacugcuucugagagcuguugagcgcagaauggagcggaaacuguga

SEQ ID NO: 71870 - RNA, 807 nt, Artificial Sequence
  derived and/or modified sequence opt5 from MAPRE1__Homo_sapiens__NP_036457
auggccgugaacgucuacagcaccuccguuacaucugacaaucugagcagacacgauaugcucgcuuggaucaacgagucccugcagcuuaaucugacgaagauugaacaacucugcucuggcgccgcguauugucaguucauggacaugcuguuucccgggagcaucgcucuuaaaaaggugaaauuccaggccaagcuggagcaugaauacauucagaacuuuaaaauccuccaagccggauucaagcggaugggcguggauaagauuaucccugucgacaaacuggugaaggggaaauuucaggauaauuucgaguuuguucagugguucaagaaauuuuucgacgcuaacuaugauggaaaggacuacgauccgguggccgcucgccagggccaagaaaccgccgucgcgcccucccugguggccccugcucucaauaagcccaaaaagccucugacaucuagcuccgccgcuccccagagaccuaucagcacccagcggacagccgcggccccgaaagcugggcccggaguugugcgcaagaacccuggcgucggcaauggggacgaugaggccgcugagcuuaugcagcaagugaacgugcugaaacucaccgucgaagaccuggagaaggaaagagauuuuuauuucggaaaacuucggaauauugagcugaucugccaggagaacgaaggcgagaaugaccccguucuccagcgcauuguggacauccuguacgccacagaugaaggguuugugauuccugacgagggaggcccccaagaggaacaggaggaauauuga

SEQ ID NO: 71871 - RNA, 855 nt, Artificial Sequence
  derived and/or modified sequence opt5 from MAPRE2__Homo_sapiens__NP_001137298
auggccgugaacgucuacagcaccuccaucacacaggagacgaugucuagacacgacauuaucgcuuggguuaaugauauugugagccugaacuauaccaagguggaacaacucugcuccggcgccgcguacugucaguucauggacaugcuguuucccgggugcaucucucuuaaaaaggucaaauuccaggcuaagcuggagcaugaauauauucacaauuuuaaacuccugcaggccagcuucaagcggaugaacguggauaagguuaucccuguggagaaacuugucaagggacgcuuucaagacaaucuggauuucauccagugguuuaaaaaguucuacgacgccaacuaugauggcaaagaauacgacccgguggaggcuagacaggggcaggaugccauucccccucccgacccuggagagcaaaucuuuaaucuccccaagaagucccaucacgcuaacucuccuacagccggcgcggccaaaagcuccccggcugccaagcccgggagcaccccuucucggcccuccagcgcuaaacgcgccucuuccagcggaucugcguccaagagcgauaaagaccuggaaacacagguuauucagcugaaugaacaggugcauucccucaagcuggcccuugaaggcgucgagaaagagagagauuucuauuuuggcaagcugcgggaaaucgagcuccugugucaagaacacgggcaggagaacgacgaccuugugcagcgccugauggauauucucuacgcuucugaggagcacgagggacauaccgaggaaccugaagccgaggaacaagcucacgagcagcagcccccgcagcaagaggaauacuga

SEQ ID NO: 71872 - RNA, 846 nt, Artificial Sequence
  derived and/or modified sequence opt5 from MAPRE3__Homo_sapiens__NP_001289979
auggccgugaacgucuacagcaccuccguuacaucugagaaucugagcagacacgacaugcucgcuugggugaacgauucccugcaucuuaauuauacgaagaucgaacagcugugcucuggcgccgcguacugucaauucauggacaugcucuuucccgggugcgugcaucugcggaaagucaaguuccaggcuaaacuugagcacgaauauauucacaacuuuaaggugcugcaggccgccuucaaaaagaugggaguugauaagaucauuccuguggagaaacucgucaagggcaaauuucaggacaauuucgaauuuauccaaugguucaagaaauuuuucgaugcuaacuacgacgggaaggauuauaauccgcugcuggcccgccagggacaggacguggcucccccucccaacccuggcgaucagauuuuuaauaagagcaaaaagcucaucgggaccgccguuccccaaagaacauccccuaccggaccgaaaaacaugcagacaucuggccggcugagcaauguggcgcccccuuguauccuucgcaagaaucccccuuccgccagaaacggcgggcaugagaccgacgcucagauucuggagcucaaccagcaacuggucgaucuuaaacugacaguggacggacucgaaaaggagcgggauuucuacuuuagcaaacugcgcgacaucgaacugauuugccaggagcacgagucugaaaauucccccgugaucagcggcauuaucgggauucucuaugccaccgaggaaggauucgcuccgccugaggacgaugaaaucgaggagcaccagcaagaagaccaggaugaguacuga

SEQ ID NO: 71873 - RNA, 2331 nt, Artificial Sequence
  derived and/or modified sequence opt5 from MAPT__Homo_sapiens__NP_001116538
auggccgagcccagacaggaguucgaggugauggaagaccacgcuggcaccuacgggcugggagaucggaaggaccaaggcggguauacaaugcaucaggaucaggagggagacacggaugccggccucaaagaaagcccucugcagaccccgacagaggacggguccgaggaacccggaucugagaccagcgaugcgaaguccacaccuaccgcugaagacgucacagcuccccuuguugaugagggcgccccuggcaaacaagccgccgcucagccccacaccgagaucccugaagggacgaccgccgaggaagcgggaauuggcgacacaccgucucuggaggaugaagccgcugggcaugugacccaggagcccgagagcggaaaggugguccaggaaggcuuucuccgcgagccugggcccccuggacugucccaccaacuuaugucuggcaugcccggcgccccgcugcucccugaagggcccagagaggcuacacggcagccuagcggaaccggccccgaagacacggaagggggacgccaugcccccgagcugcugaaacaccagcuccugggcgaucuucaccaggaagggccuccgcugaagggagcgggcggcaaggagagacccggguccaaagaagagguggacgaagaccgggauguugacgagagcucuccucaagauuccccucccagcaaggccucucccgcucaggacggacgcccgccucagacagccgcuagagaggccaccuccauccccggcuucccugccgaaggggcuauuccccucccuguggauuuucugagcaaagucucuacagagauccccgcguccgaaccggacggaccuagcgugggccgggccaaggggcaagaugcuccccuugaguucaccuuucauguugagauuacccccaacgugcagaaagaacaggcccacuccgaggaacaucugggccgcgccgcuuucccuggagccccgggcgaggggcccgaagcgagaggaccuucucucggcgaggacacaaaggaggcugaucugcccgaaccuagcgagaagcagcccgccgccgcuccucgggggaaacccgucucccgcgugccgcaacugaaggccagaauggugagcaaaucuaaggacggaacgggcuccgaugacaaaaaggcuaaaaccagcacacggucuagcgccaagacccucaagaaucgcccuugccugucccccaaacacccuacacccgggucuagcgacccgcuuauccagccuuccagccccgcggucuguccugaaccucccucuucccccaaguacguuagcucugugaccuccagaacgggcagcuccggagccaaagagaugaagcugaaaggcgcugaugggaagacaaagaucgccaccccgcggggagcugcgcccccuggccagaaagggcaggccaacgccacccgcauucccgcuaagacaccucccgccccuaaaaccccgcccucuagcgcuacaaagcaagugcagcgccggccucccccugccggacccagauccgaacgcggcgagccgccuaaaucuggggaccggagcggcuauuccagccccggaucucccggcacgccuggguccagaagccgcacccccucucucccuacaccgcccacccgggagccuaagaaggucgccgugguuagaacacccccuaaaucccccagcucugcuaagagccgccugcagaccgcgccggugccuaugcccgaucuuaaaaaugucaaguccaaaaucggaagcacggaaaaccugaagcaccagccuggcgggggaaaggugcaaauuaucaauaaaaagcucgaccugucuaacguucaguccaaaugcggcagcaaggauaauauuaaacaugugcccgggggcggauccguccagaucguguacaagccugucgaccugucuaaagugaccagcaaguguggcucccucgggaacauucaccauaagcccggaggcgggcagguugaggugaaaucugaaaagcuggauuuuaaagaccggguccaaagcaagaucggaucccuugauaauaucacacacgugccgggcggcgggaacaaaaagauugagacccauaagcugacauucagagaaaaugccaaagcuaagaccgaccacggagccgagaucguuuauaaaucuccuguggucagcggcgauacgucccccagacaccucagcaacgugucuuccacagggagcauugacaugguggauucuccccagcuggccacccuugcugacgagguuuccgccagccuggcgaagcagggacucuga

SEQ ID NO: 71874 - RNA, 1014 nt, Artificial Sequence
  derived and/or modified sequence opt5 from MARC1__Homo_sapiens__NP_073583
augggcgccgcugggagcuccgcccuggcgagauucgugcuccuggcucagucucggcccggauggcuuggcgucgccgcccuggggcucaccgcuguugcccugggagcuguggccuggcgcagagcguggccuacacggcgcagacggcuucugcaacaggugggcacggucgcccagcucuggaucuacccggugaaguccugcaaagggguucccguguccgaggcugaauguaccgccaugggacugcgcucuggcaaccugagagaccgguuuuggcucgucauuaaucaggagggcaacauggugacagcucgccaagaaccuagacugguucuuaucagccugaccugcgauggggacacacucacccuguccgccgcguauacaaaggaucuucugcuccccauuaaaaccccuacgaccaaugccgugcacaagugucggguccauggacuggagaucgaaggccgcgacugcggggaggcuacagcccaguggauuaccucuuuccugaaaagccagcccuacagacucgugcacuuugagccucauaugcggccgcgcagaccccaccagaucgcugaucuguuccggccuaaggaccaaaucgccuauuccgauacaagccccuuucuuauucugucugaagccucccucgcugaccugaacagcagacuugagaagaaagugaaggcgaccaauuuccgcccuaacaucgucauuucuggaugugauguuuacgccgaagacuccugggaugagcugcucaucggcgacguggagcugaaacgggugauggcuugcagcagauguauucugacgacagucgaucccgacaccggggugaugucucgcaaggaaccgcucgagacacugaaauccuaucggcagugcgacccuagcgaaagaaaacuuuacggaaagagcccccuguuuggccaguauuucguucucgagaauccuggcaccaucaaggugggggaucccgucuaccugcuuggacaguga

SEQ ID NO: 71875 - RNA, 738 nt, Artificial Sequence
  derived and/or modified sequence opt5 from MARC2__Homo_sapiens__XP_011507986
auguucuggcuggugaucaaggaggacggccacauggucaccgccagacaggaaccccggcucguucugauuagcaucauuuacgagaacaauugccuuaucuuucgcgcuccugauauggaccaacuggugcucccguccaaacagcccucuagcaacaagcugcauaauuguagaauuuucgggcuugauaucaaaggacgggacugcggcaacgaagccgcgaagugguuuacaaauuuccugaaaacggaggcuuaucgccucgugcaguuugaaaccaacaugaaggggagaacaucccggaagcugcugccuacccucgaucagaauuuccaagucgccuaccccgacuauuguccucugcuuaucaugacagaugccucucugguggaccucaacacccgcauggagaaaaagaugaaaauggagaauuuuagacccaacauuguugugacaggaugcgaugcuuucgaagaggacaccugggaugaacugcuuaucggcagcgucgaggugaagaaaguuauggccuguccucggugcauucugacgaccguggacccggauacaggggucaucgaccgcaagcagccccucgacacccugaaguccuacagacugugugauccuucugagcgggaacucuauaaacugagcccccuuuuuggaauuuacuauuccguggagaagaucggcagccugcgcgugggcgacccugucuacagaaugguuuga

SEQ ID NO: 71876 - RNA, 870 nt, Artificial Sequence
  derived and/or modified sequence opt5 from MARCH1__Homo_sapiens__NP_001159845
augcugggcuggugcgaggccaucgcuagaaacccccaccggauuccuaauaacacccgcacaccggaaaucagcggggaccucgccgaugcgucccagacgucuacccugaaugaaaagagccccggaagauccgcuucucggagcuccaacauuucuaaagccagcuccccuacaaccggcacagcuccccgcagccaaucuagacuuuccguguguccuagcacccaggacaucugccggauuugucauugcgaaggggaugaggaaucuccccugaucacaccuugucgcugcaccggaacgcucagauucguccaccaguccugucugcaucaguggaucaagagcucugacacccggugcugugagcuuugcaaauacgauuuuauuauggagacaaagcugaaaccgcuccgcaagugggaaaagcugcaaaugaccacauccgagagacggaaaaucuucuguagcguuaccuuucacgugauugccaucacgugcguggucuggucccuguaugugcucauugaccgcacagccgaagagaucaagcagggcaaugauaacgggguucuggaguggcccuucuggaccaaacuuguggucguggcuauuggauuuacaggcggccugguuuucauguacgugcagugcaaggucuaugugcagcucuggagacggcugaaagccuacaaucgcgugaucuuuguccaaaacuguccugacaccgcgaagaaacuugagaagaauuucucuugcaacguuaauaccgauaucaaggacgccguggugguccccgugccucagacaggggcuaacagccugcccuccgccgagggaggcccgccugaaguugugagcgucuga

SEQ ID NO: 71877 - RNA, 741 nt, Artificial Sequence
  derived and/or modified sequence opt5 from MARCH2__Homo_sapiens__NP_001005415
augaccacaggcgacugcugucaucugcccgggagccucugcgauuguuccggaucuccugccuucagcaagguggucgaggcuacgggccuggggccgccccaguacguugcccaagugaccuccagagacggacggcuucugucuacagugauccgcgcgcucgauaccccuagcgacggccccuuuugcagaauuugucacgaaggggcuaacggagagugccugcuuuccccuuguggcugcacaggcacccugggggccguccacaaaucuugucucgaaaaguggcugagcuccagcaauacaucuuauugcgagcugugucauaccgaguucgccguggaaaaacggccccgcccucucacggaguggcugaaggauccgggacccagaaccgaaaaacggacacuuugcugcgacaugguuuguuuucuguucaucaccccucucgcugccauuuccggcuggcugugccuucgcggggcucaggaucaccugagacuccauagccagcuggaggccgugggacugaucgcgcucacaauugcccuguuuaccaucuacguccuuuggacgcuggugucuuuccgguaucacugucagcucuacuccgaauggcgcaagacaaaccaaaagguuagacugaaaauccgggaggcugacagccccgagggcccucagcacucuccccuugccgcugggcugcucaagaaaguggccgaagagaccccggucuga

SEQ ID NO: 71878 - RNA, 837 nt, Artificial Sequence
  derived and/or modified sequence opt5 from MARCH5__Homo_sapiens__NP_060294
augcccgaccaggcccugcaacagaugcucgauagaagcugcuggguguguuucgcuaccgacgaggaugaccggacagccgaauggguccgcccuugcagaugucggggcuccacgaaguggguucaccaggcgugccugcagcgcuggguggaugagaaacaaagagggaacucuaccgcucggguggccuguccgcagugcaaugccgaauaccuuaucgucuuucccaagcugggaccugugguuuaugugcucgaccuggcugaucgccuuauuagcaaagccugucccuucgcugccgcgggcaucauggucggguccauuuacuggacagccgugaccuauggagcuguuacagugaugcaggucgugggccauaaggaggggcuggacgugauggaaagagccgauccucucuuucugcugaucggacuccccaccauuccugucaugcugauccuuggcaaaaugauccggugggaggacuacguucugcgccucuggagaaaguauucuaacaagcugcagauucuuaauagcaucuucccgggcauugggugccccgugccucggauccccgcugaggccaacccucuggcggaucacguguccgccacacgcauucucuguggagcucuggucuuucccaccaucgccacgauugugggcaaacugauguucucuagcguuaauuccaaccuccaaagaaccauccuugggggaaucgcuuuuguggccauuaagggcgccuucaaagucuacuuuaagcagcagcaguaucugcggcaagcucaucgcaaaauccugaauuacccggaacaggaggaagcguga

SEQ ID NO: 71879 - RNA, 2733 nt, Artificial Sequence
  derived and/or modified sequence opt5 from MARCH6__Homo_sapiens__NP_005876
auggacaccgccgaggaagauaucugcagagugugucggagcgagggcacacccgaaaagccucuguaccacccgugcgucuguacgggguccauuaaauucauccaucaggagugccucguucaauggcugaagcacucucgcaaagaauauugugagcuuugcaagcauagauuugcuuucacccccauuuacagcccugacaugcccucccggcugccuauccaggauauuuuugccggacucgugacaucuaucggcaccgcgauccgcuauugguuccacuacacacugguggcuuuugccuggcuuggggucgugccccugaccgccuguagaauuuauaaaugccucuucacaggaagcguuuccucucugcugacccucccucuggacaugcuuagcacggagaaccugcucgcugauugucugcagggcugcuuuguggucaccuguacacuuugcgccuucaucucccugguguggcuccgggaacagauuguucaugggggagcuccgaucuggcuggagcacgccgcgcccccuuuuaaugccgcuggccaccaucaaaacgaagcccccgcuggcgggaauggagccgagaacguggcggccgaccagccugcuaaucccccggccgagaacgcugucgugggcgaaaauccugaugcccaggacgaucaggccgaggaagaggaagaggacaacgaggaagaggaugacgcugggguggaagaugcggccgacgcuaauaacggagcccaagacgauaugaauuggaacgcccuggagugggaccgcgcugccgaggaacucaccugggagagaaugcugggccuugaugggagccuggucuuccucgaacacguguuuuggguugugucucugaauacacuuuucauucuggucuuugcguucugccccuaccauaucggacacuucucccucgugggccugggcuuugaggaacacguucaggcuagccauuucgaggggcugauuaccacgaucgugggauauauccuccuggccauuacacuuaucauuugucacggccuggccacccucgucaaguuucaucggucucgcagacugcuuggggugugcuacaucguugugaaggucucccugcucguggucguggaaauuggaguuuucccucugaucuguggcugguggcuggacaucugcagccucgagauguuugaugcuacacugaaagaccgggagcuuucuuuccaguccgcccccgggaccaccauguuucugcacuggcucgugggaauggucuacguguucuauuuugcuagcuucauucugcugcuucgcgaaguucucagacccggcgugcugugguuucugcggaaccucaaugauccugacuucaacccgguccaggagaugauccaucugcccauuuaccgccaccuuagacgguuuauccuguccgugauuguguucggcucuaucguucuccugaugcuguggcuuccuaucagaauuaucaagagcguccuccccaacuuccugccuuauaaugugaugcuguacuccgaugcccccgugagcgaacucucucuggagcuucugcuccugcaagucgugcugccggcgcuucucgagcaggggcacacacgccaguggcugaaaggacugguucgggccuggacggugaccgcuggcuaucuccuggaccuucauuccuaccugcucggggaucaagaagagaacgaaaauagcgccaaccagcaggucaauaacaaucagcacgcuagaaacaauaacgccauuccugugguuggagagggccugcaugcggcccaccaagcuauccugcagcaagggggccccgugggauuucagccuuaucgccggccccuuaauuucccucucagaauuuuucugcugaucgucuucauguguauuacacuccugaucgccucucuuaucugccugacccuccccguguuugcuggccgcuggcugaugagcuucuggacagggaccgccaagauucacgaacuguacacggccgcuuguggacuuuacguuugcuggcugacaauccgggcggugaccgucaugguggccuggaugccgcagggcagacgcgugauuuuucagaaagucaaggaguggucccucaugaucaugaagacccugauuguugcugugcuccuggccgggguggucccucuucugcucggacugcuguucgagcuugugaucguugcuccccugcgggugccccucgaccagacaccucuguuuuauccguggcaggacugggcccucggcguccugcaugccaaaaucauugcggcuaucacccuuauggggccccaaugguggcugaagacagugauugaacagguuuacgccaacggcaucagaaauauugaucuccacuauaucgugcgcaaacuggccgcuccugucaucucugugcugcuucugagccucuguguucccuacgugauugccuccggagucgugccucugcucggcgugacggcggagaugcagaaccugguccaucggagaaucuaucccuuccuucugaugguuguggugcugauggcuauucucagcuuucagguccggcaauucaagcgccuguacgaacacaucaaaaaugacaaguaucuuguggggcagagacugguuaacuacgagcggaaaucuggaaagcagggcuccagcccucccccgccucaaucuucccaggaauga

SEQ ID NO: 71880 - RNA, 1908 nt, Artificial Sequence
  derived and/or modified sequence opt5 from MARCH7__Homo_sapiens__NP_001269735
auggagagcaagcccuccagaaucccucggcgcauuucugugcagccgagcuccucucugagcgccagaaugauguccggcucucgggggagcucccucaacgacaccuaccacagccgcgauucuuccuucagacuggacagcgaauaucaaucuacauccgcuagcgccucugcgucccccuuucagagcgcuugguacuccgagucugaaaucacgcagggagcccggagccgcucccagaaucaacagagagaucaugacagcaaacggccuaaacuuucuugcaccaacuguacaaccuccgccggccgcaaugucgggaacggacugaauacacucagcgauguucaggacagagugcccucuuauagccagggcgcucggccuaaggagaacuccaugucuacccugcaacuuaauacaagcuccaccaaccaccagcugcccagcgaacaucagacgauucucucuucccgcgauagcagaaauucucugcgguccaacuucagcucccgcgagucugagagcuccagaucuaauacccagccuggguuuagcuacuccagcucucgggacgaagccccgaucauuuccaacagcgagagaguggucucuucccaacgccccuuccaggaaagcucugauaaugagggacggagaacaacccgccggcugcucagcagaaucgcuuccagcaugucuuccacauuuuucagccgccgguccucucaggacagccugaacaccagaucccuuaauucugagaacagcuauguguccccucgcauccugacggccucucaaagccgguccaacguucccagcgcgucugaagugccugauaauagagccuccgaggcuagccagggcuuucgcuuccuccggagacgguggggccugucuucccuuagccacaaccauucuuccgaaagcgacuccgagaauuuuaaccaggaaagcgaggggcgcaauacaggacccuggcugucuagcucccucagaaaccggugcaccccgcuguucucuagacgccggagagagggccgcgaugaaagcucccggauuccuacaucugacaccagcuccagaucucacaucuuucgcagagagagcaaugaagucgugcaccuggaggcccagaacgacccccucggggcugccgcgaaucggccucaagccuccgcugccuccucuuccgcuaccacaggaggcagcacgucugauuccgcccaagggggacgcaacaccggcauuagcggcauccugcccgggucccuuuucagauuugccguucccccugcucugggaucuaaucucacagacaacgugaugauuaccgucgauaucauuccgagcggcuggaauagcgcggacggaaagagcgauaaaacaaagucugcccccucccgggacccugaacgccugcagaagaucaaagagagccuucugcucgaggauucugaagaggaagagggggaccuguguagaaucugccagauggcugccgccagcuccucuaaccugcucauugaacccuguaagugcaccggcagccugcaguacgugcaucaggauuguaugaaaaaguggcuucaggcuaaaaucaauuccgggucuagccuggaggccgugacgacaugcgagcucuguaaggaaaagcuggagcuuaaccuggaagacuucgauauucacgagcuccaucgggcgcacgcuaacgagcaggccgaauaugaguucaucuccagcggacuguaccuggucguucuccugcaccuuugcgaacaaucuuuuuccgacaugaugggcaauaccaacgagccuagcacccgcgugagacugcagcggaugauucccaaaaagacagaaaccaucacaggccaucucauccugccgaauuucauuuga

SEQ ID NO: 71881 - RNA, 876 nt, Artificial Sequence
  derived and/or modified sequence opt5 from MARCH8__Homo_sapiens__NP_001002266
augagcaugccccugcaccagaucuccgccauuccuucucaagacgcuaucagcgccagaguguaccgguccaagaccaaagagaaggaacgcgaggaacagaacgagaaaacacucggccauuucaugucucacagcuccaauauuucuaaggcggggagcccgcccuccgcuagcgccccugcccccgucucuuccuuuagcagaacgucuaucaccccuuccagccaggauauuugccggaucugucauugcgaaggagacgaugagucuccccugaucacaccuugucacugcaccggcucccuucauuucguucaccaggcuugucugcaacaguggauuaaaagcuccgacacacgcugcugugagcucugcaaguaugaauuuaucauggagaccaagcugaaaccgcuuagaaagugggaaaaacugcagaugacaucuagcgagcggcgcaagauuauguguuccgugaccuuccacgugaucgccauuacgugcgucguguggagccucuacguucugaucgauagaaccgcugaggaaauuaaacaggggcaagccacaggaauccuggaguggcccuuuuggaccaagcucguggucguggcgaucggcuucacagggggacugcuuuuuauguauguucaguguaagguguacguccagcuguggaaacggcucaaggccuauaaccgcgugauuuacgugcagaauugcccugaaaccucuaaaaagaacaucuucgagaaaagcccccugacggaaccuaauuuugagaacaagcauggcuauggcauuugccacuccgacacaaauucuagcuguugcaccgagcccgaagauacaggggcugagaucauucaugucuga

SEQ ID NO: 71882 - RNA, 999 nt, Artificial Sequence
  derived and/or modified sequence opt5 from MARCKS__Homo_sapiens__NP_002347
augggcgcccaguucagcaagaccgcugccaaaggggaggcggcugccgaaagacccggagaggccgcuguggccuccucuccuagcaaggcuaacggccaagaaaaugggcacgucaaaguuaacggagacgccuccccggcggccgcugagucuggcgccaaggaagaacugcaggcuaaugggagcgcccccgcggccgauaaagaggaaccugcugccgcuggauccggcgccgccucucccagcgcugcggagaagggcgaaccugccgcugccgccgcucccgaggccggggcguccccuguggagaaggaagcuccggccgagggagaagccgcugagcccggcagcccuacagccgcugaaggggaggccgcgucugccgcuuccagcacgucuucccccaaagccgaggacggagcuaccccuagccccucuaacgaaacaccgaagaaaaagaaaaagcgguuuuccuucaagaaauccuuuaagcucagcggcuucucuuuuaaaaagaauaaaaaggaggccggggaaggaggcgaggcggaagccccugcugccgagggcgggaaagaugaggcugccggaggcgccgcugcggccgcugccgaagccggggcugccagcggagagcaggcggcugcccccggcgaagaggccgcugccggggaagagggagcggcuggcggcgacccucaggaggccaagccccaagaagccgcuguggcccccgagaagccuccggcuuccgaugaaaccaaagccgcggaggagcccagcaaggucgaagagaaaaaggccgaagaggcuggggccucugcugccgccugcgaagcuccuuccgcggccggacccggcgcuccucccgagcaggaggccgccccggcugaggagccugccgcggcugccgccagcucugcuugugccgcgcccagccaggaagcucagccugagugcucccccgaagccccucccgccgaggcugccgaguga

SEQ ID NO: 71883 - RNA, 1563 nt, Artificial Sequence
  derived and/or modified sequence opt5 from MARCO__Homo_sapiens__NP_006761
augagaaacaagaaaauccugaaggaggacgaacuccugagcgagacccagcaagccgcuuuccaccagauugccauggaacccuuugagaucaaugugccuaaaccgaagcggcgcaacggcgucaauuucucccuugcgguuguggugauuuaccugauccuccugacagcuggggccggacuucuggucgugcagguucucaaccugcaggccagacugcgggugcucgaaauguauuuucugaaugauacgcuugcugccgaggacucucccagcuucucccugcuccaaucugcucauccuggcgagcaccuggcccagggggcgagccgccuucagguccugcaggcccaacucaccugggugagaguuucccaugaacaucugcugcagcggguggauaacuuuacacagaaucccggaauguuccgcauuaaaggcgagcagggggcuccuggacuccaaggccacaagggcgccauggggaugcccggagcuccuggcccgcccgggccucccgccgaaaagggagcgaaaggcgccauggggagagacggagcuaccggcccuucuggcccccaggggccgccuggagucaagggcgaggccgggcugcagggaccccaaggcgcuccugggaaacagggagccacaggcacccccggcccccagggggagaagggaagcaaaggcgaugggggacuuaucggcccuaagggggaaacaggcaccaagggagagaaaggcgaccuggggcucccgggauccaagggcgaucgggggaugaaaggagacgccggcgugauggggcccccuggcgcucagggaagcaagggcgauuuugggcgccccggaccucccggccuggcgggguucccgggagccaaaggcgaccaagggcagccuggccuucagggagugcccggcccucccggggcugucggacacccuggcgccaagggggaacccggaucugccggcuccccggggagagcuggccugccuggaagccccggcucucccggggccacgggacucaaaggcuccaagggggauaccggacugcagggccaacagggccggaagggggagagcggaguuccuggcccggcgggggugaaaggagaacagggcucucccgggcuggcuggaccuaagggcgcccccggccaggccgggcaaaaaggagaccagggcgugaagggguccagcggagagcagggcgucaaaggggagaagggagaacgcggcgagaacuccgugucuguuagaaucgugggcagcuccaaucgggggcgcgcugaagucuacuauagcggaacauggggcaccauuugcgaugacgaguggcagaacucugacgccaucguguuuuguagaaugcucggguacuccaagggacgggcucuguauaaaguuggcgccgggacaggacaaauuuggcuugauaaugugcagugcagaggcaccgaaagcacgcuguggucuuguacaaagaacagcuggggccaccaugacugcucccacgaggaggaugcgggggucgaauguucuguguga

SEQ ID NO: 71884 - RNA, 2343 nt, Artificial Sequence
  derived and/or modified sequence opt5 from MARK1__Homo_sapiens__NP_001273055
augagcgccagaacaccccugccuaccgugaacgagcgggacacggaaaaucacaccuccgucgauggcuacacagagccgcauauccagcccaccaagucuagcucccgccaaaacauuccuagaugccgcaauucuaucacaagcgcuaccgacgaacagccccacauugggaacuaucggcuccagaaaacaaucggaaagggcaauuucgccaaaguuaagcuggcgagacaugugcuuaccgggcgggagguggcugucaaaauuaucgauaagacgcagcugaacccuaccucccuccaaaagcuguuucgcgaagugagaaucaugaaaauucuuaaucaccccaacaucguuaagcuguucgaggugauugagacagagaaaacccucuaccuggucauggaauaugccucuggaggcgaaguguuugacuaccugguugcccaugggcggaugaaggagaaagaggcucgcgccaaguucagacagaucgugagcgcuguccaguauugucaccagaaguacauugugcaccgggaucucaaagccgaaaaucugcuucuggacggagauaugaacaucaagauugcggacuuuggcuucuccaaugaguuuacagugggcaacaaacucgauaccuucugcgggagcccuccguaugccgcucccgaacuguuucaaggaaagaaauacgacggcccugaggucgauguuuggucucuuggggugauccuguacacgcucguguccggaagccugcccuucgacggccagaaucugaaggaacuccgcgagagaguccugcgggggaaauaucgcaucccuuuuuacaugucuacagauugugagaaccuucugaagaagcuccuggugcuuaaucccauuaaaagaggaucccuggaacagaucaugaaggaccgguggaugaacguuggccaugaggaagaggaacucaaaccguauaccgagccugaccccgauuucaacgacacaaagagaauugauaucauggugaccaugggcuuugcccgcgacgagauuaaugaugcucugaucaaccagaaauacgacgaagucauggccaccuauauccugcucgggcggaagccucccgaguucgaaggaggcgagagccugucuuccgggaaucuuugccaaagaagccgccccuccucugaucugaacaauagcacacuccaguccccugcgcaccugaaggugcagcggagcauuucugccaaccaaaaacagagacgcuucuccgaccaugcuggaccgagcauucccccugccguuucuuacacgaagcggccccaggcuaauagcguggaauccgagcagaaagaggaaugggauaaggacgucgccagaaaacuuggcucuaccacaguggggagcaaguccgagaugaccgccagcccucuggucggacccgaacgcaagaaaucuuccacaaucccgagcaacaauguguauucuggcggcuccauggcucggagaaacaccuacguuugugagcgcacgacagaucgguacguggcgcuccaaaaugggaaggacagcucccugaccgagaugucugucagcuccaucucuagcgccggauccagcguggcuucugccguuccuuccgccagaccccggcaccagaaaagcaugucuaccuccggccacccuauuaaggugacacugcccaccaucaaagacgggagcgaggcuuaucgcccuggaacaacgcagagaguccccgccgcgucuccgagcgcucauuccaucagcaccgccacaccugaucggaccagauuuccccgcgggucuuccagccgguccacauuccacggcgaacagcucagagaacgcagaucuguggccuacaacggacccccugcuagcccgucccaugagaccggcgccuuugcucacgcccggcgcggcacgucuaccgggauuaucagcaagauuacauccaaguucgugagacggucuaccagcggagaacccaaagagcgcgacaaggaggaaggcaaagauuccaagccuagaagccugcgguuuacauggucuaugaaaaccacguccagcauggaccccaaugauaugaugcgcgagaucagaaagguucuugacgcgaacaauugcgauuaugaacaaaaagagcgguuccugcucuuuuguguccauggggacgcccgccaggauucucuggugcagugggaaauggaggugugcaagcugccuagacuuucccucaacggaguccgguucaagagaauuagcggcacaucuaucgcuuuuaaaaacauugccuccaagaucgcuaaugagcugaaacuguga

SEQ ID NO: 71885 - RNA, 2367 nt, Artificial Sequence
  derived and/or modified sequence opt5 from MARK2__Homo_sapiens__NP_001034558
augagcuccgccagaacaccccugccuacccucaacgagcgggacacggaacagccgacccugggccaccuugauucuaagcccagcuccaaaucuaauaugauccgcgggagaaacagcgcuacauccgccgacgagcaaccucauauuggaaauuaccggcugcucaagaccaucggcaaagggaacuucgcgaaggugaaacuggcucgccacauucuuacaggaaaggaagucgccguuaagaucauugauaaaacccagcucaauucuagcucccuccagaagcuguuuagagaggugcggaucaugaaagugcugaaccaucccaauaucgucaagcuguucgaagugauugagacagagaaaacccuguaucuuguuauggaauacgccagcggcggggagguguuugacuaucuggucgcucacggacgcaugaaggaaaaggaggccagagcuaaauuccggcagaucgugucugccguucaauacugccaucagaaguuuauugugcaccgcgaucucaaagcggagaaccugcuucuggacgccgauaugaauaucaagauugcugacuucggcuuuuccaacgaguucacguuuggcaauaaacucgauaccuucugugggagcccucccuaugccgcuccugaacuguuucagggaaagaaauacgacggcccggaagucgauguguggucucugggggugauccucuauacacuggucuccggaagccuucccuucgacggccagaaccugaaggagcucagagaacggguucugcgcgggaaguaccggauuccuuuuuacaugucuaccgauugcgagaaucuucugaaaaaguuccucauccugaaccccuccaaaagaggaacacuggagcaaaucaugaaggaccgcuggaugaaugugggccacgaagacgaugagcucaaaccuuauguggaaccccugccggacuacaaggauccuagacggaccgagcuuauggucagcaugggcuauacgagagaagagauucaggacucccugguggggcagcgcuacaacgagguuauggccacauaucuccugcuuggauacaagucuagcgaacuggagggcgauaccaucacacucaaaccccggccuuccgcggaccugaccaacagcucugcccccucccccagccauaaggugcagagaucugucagcgcuaauccuaaacaacgccgguucuccgaucaggccgcugggccggccauucccaccucuaacagcuauuccaagaaaacacagagcaauaacgccgaaaauaagagaccugaggaagaccgcgagucuggacggaaggcuuccagcacggcgaaagugcccgccucuccucugcccggccucgagagaaagaaaaccacaccgaccccuuccacaaacagcguucuguccaccucuacgaaucgcagccggaacucuccccuucuggaaagagcuucccucgggcaagccagcauccagaauggaaaggauucccugacaaugccuggcagccgcgccucuaccgcuuccgccagcgcggcugugucugccgcccggcccagacagcaccagaaauccaugagcgcuucuguccauccuaacaaggccagcggccugcccccgaccgaguccaauugugaagugccucggcccagcacagcuccccaacgcgucccuguggccucuccguccgcgcacaacauuagcuccucugggggagcccccgacagaaccaauuuuccucggggcguuagcuccagaucuacauuccacgcugggcagcuucgccaggugcgggaucagcaaaaccuccccuacggagucacgccugccagccccuccggccauucucaggggagacgcggcgcuagcggauccaucuuuagcaaguucaccucuaaauuugugagacggaaucuguccuuccgcuuugccagacggaaccugaacgagccugagagcaaggaccgcguugaaacacucagaccccacguggucggcucugggggaaaugacaaagagaaggaagaguuccgggaagcgaaaccgcgcucccugagauuuaccuggagcaugaagacaaccucuuccauggagccuaacgagaugaugcgggaaauccgcaaagugcuugaugccaauagcugccaguccgagcugcaugaaaaguacaugcuccuguguaugcacggcacgcccgggcaugaggacuucgugcagugggaaauggagguuugcaagcugccuagacuuagccucaacggaguccgguuuaaaagaauuucuggcaccagcauggcuuucaagaauaucgccuccaaaauugcuaacgagcugaagcuguga

SEQ ID NO: 71886 - RNA, 2262 nt, Artificial Sequence
  derived and/or modified sequence opt5 from MARK3__Homo_sapiens__NP_001122390
augagcaccagaacaccccugccuacggugaacgagcgggacaccgaaaaucacacaucccauggcgaugggcgccaggaggucaccucuagaacaagccgguccggagcccgcugcagaaacucuaucgcuagcugugccgacgaacaaccgcacauuggcaauuaccggcuccugaagaccaucgggaagggaaacuucgcgaagguuaaacuugcucgccauauucugacaggcagagagguggccaucaagauuaucgauaaaacccagcucaaucccacgucccugcagaagcuguuucgggaagugcgcaucaugaagauucuuaaccacccuaauaucgucaaacucuucgaggugauugagaccgaaaagacacuguaucugaucauggaguacgccucugggggagaaguuuuugacuaucucguggcucauggcagaaugaaagagaaggaggcccggagcaaauuccgccagauugucuccgcugugcaauacugccaccagaagagaaucguucaccgggaucugaaggccgaaaaccuucugcucgacgcggauaugaauauuaaaaucgccgacuuuggcuucagcaacgaguuuaccgucgggggaaagcuggauacauucuguggcucucccccuuaugcugcccccgaacuuuuucaggggaaaaaguacgacggaccugagguggauguguggucccugggcgugauccucuauacccuggucagcgggucucugccguucgacggacagaaucucaaagaacugcgcgagagaguucuucggggcaaguaccggauucccuuuuacauguccacggauugcgagaaccugcucaaacgcuuccuggugcuuaauccuaucaagcggggcacacuggaacaaauuaugaaggacagauggaucaacgcugggcaugaggaagacgagcucaaacccuuuguggaaccugagcuggauauuagcgaccagaagcgcaucgauaucauggucggaaugggcuauucucaggaggaaauucaggagucccugagcaaaaugaaguacgacgaaaucaccgccacauaucuccugcuugggcggaaauccucugagcuggaugcgagcgacuccagcagcuccagcaaucucucucuggccaaggugagacccagcuccgaucuuaacaacucuaccggacaaagcccgcaccauaagguucagcgcuccgugucuucuucccagaaacaacggagauacagcgaccacgcuggcccugccauucccucugucguggcuuauccuaagcgcucccagaccagcacagccgauuccgaccugaaagaagaugggaucucuagccggaaguccucuggaagcgccguuggcggcaaagggauugcucccgcgucccccaugcucggaaaugccagcaacccuaauaaggcugacaucccggagagaaagaaaucuuccacggugcccagcucuaacaccgccuccggcgggaugacacgccggaauaccuacgucuguagcgagagaacaaccgccgaccggcacucugugauccagaacggaaaggaaaauagcacgauuccugaucagcgcacacccgucgcuuccacccauagcaucucuuccgccgcgaccccugacagaauuagauuccccagaggcacagcuagccgcuccaccuuccacgggcaaccgcgggagagacgcacagccacguauaacggcccucccgccucuccuagccugucccaugaagcuacaccccugucucagaccagaagccggggauccaccaaucucuuuucuaaacugacaagcaaacuuacccgcagaaacauguccuuccgguuuaucaagcgccugccuacggaguacgagagaaauggccgguacgaagggagcucucgcaacguguccgccgagcagaaggaugaaaauaaggaggcuaaacccagaagccuccgguucaccuggucuaugaagacaaccuccagcauggacccgggagauaugaugcgcgaaauuagaaaaguucuggacgccaacaauugcgauuaugagcagcgggagagauuucugcuuuucugugugcacggcgacgggcaugcggaaaaccucguccaaugggagauggaagugugcaagcugccucgccugucucucaacggaguucgguuuaaaagaaucuccggcacaagcauugccuucaagaauaucgcuuccaaaaucgccaacgagcugaaacuuuga

SEQ ID NO: 71887 - RNA, 2259 nt, Artificial Sequence
  derived and/or modified sequence opt5 from MARK4__Homo_sapiens__NP_001186796
augagcuccagaaccgugcuggcccccggcaacgaccgcaauucugauacacacgggacgcucggaagcggccgguccucugacaaggggccuagcugguccucuagaagccugggagcucggugccgcaacuccaucgccagcuguccggaggaacagccccaugucggcaauuacagacuucugcggaccauugggaaaggaaacuucgcgaagguuaaacucgcucgccacauccugacaggcagagagguggccauuaagaucauugauaaaacccaacuuaauccuucuucccugcagaagcucuuucgggaagugcgcaucaugaagggccugaaccaucccaauaucgucaaacuguucgaggugauugaaacagagaagacccucuaucugguuauggaguacgccagcgcuggggaaguguuugacuaucuugucucucacggaagaaugaaagagaaggaagcccgggcuaaauuccgccagaucguguccgccguucauuacugccaccagaagaacauugugcacagagaucugaaggcggagaaucuccugcuugacgccgaggcuaacaucaaaauugccgauuuuggcuucagcaaugaauuuacacuggggucuaagcucgacaccuucuguggauccccucccuaugcugccccugagcuguuucaaggcaaaaaguacgaugggccggaagucgacaucuggagccugggagugauucucuauacgcugguguccggcucucuucccuucgauggccauaaccugaaagagcuccgggaacgcguccugagagggaaguaccggguuccuuuuuacaugagcaccgacugcgaguccauccuuagacgcuuccuggugcucaaucccgcgaaacgguguacacuggagcagaucaugaaggauaaguggauuaacaucggauaugaaggcgaggaacugaaaccuuacaccgagcccgaagaggacuuuggggacacaaagagaauugaggugauggucggaaugggcuauacccgcgaagagaucaaagaaagccucacgucucagaaguacaaugaggugacagccaccuaucugcuucuggggcggaaaacagaagagggaggcgauagaggcgcuccggggcucgcccuggcucgcguucgggccccuuccgacaccaccaacggaacaagcucuagcaagggcacgucccacucuaaggggcagagaagcuccagcucuaccuaccaucgccaacggagacacuccgauuucugcggacccagcccugcuccccuucaccccaaacgcucuccuacauccaccggcgaggccgaacugaaggaggaacggcucccggggagaaaagcgagcuguuccacagccggcucuggaagccggggccugcccccuuccucucccauggugagcuccgcucauaacccuaauaaggccgagauucccgagcgcagaaaagacagcaccucuacgccgaacaaucugccucccuccaugaugacacggagaaacaccuaugucugcaccgaacgcccuggggccgagcggcccagccuccugccuaauggaaaggaaaacucuuccggcacacccagagugccgccugcuagccccucuagccacucccuugcgcccccuagcggggagcgcucuagacuggcccggggauccaccauccgcagcacauuccauggcgggcagguuagagaucggcgcgcuggcggaggcgggggaggcggggugcagaauggaccgcccgccuccccuacgcucgcccacgaagcugcuccccugccugccggcagaccccggccuaccacaaaccuguuuaccaaacuuacaucuaagcucacccgcagagucgccgacgagcccgagcggaucgggggcccggaagugacgagcugucaucugccuugggaucagaccgagacagcgccccgccugcucagauucccuugguccgucaagcugaccucuagccggcccccggaagcccuuauggcugcccugagacaagcuacagccgcggcccgcugccgguguagacagccucagcccuuucuccuggcuugccugcacggaggcgccgggggaccugagccccuuucccacuucgaaguggagguuugccaacucccccgcccuggccugagaggggugcuguuucggcgcgucgcuggaaccgcccucgccuuccggacgcuggugacaagaauuucuaaugaccuugagcuguga

SEQ ID NO: 71888 - RNA, 1782 nt, Artificial Sequence
  derived and/or modified sequence opt5 from MARS2__Homo_sapiens__NP_612404
augcugagaaccagcgugcuccggcugcuuggccgcacaggggccuccagacugucucuccuggaggacuucggaccccgguacuauagcuccggcucucuuagcgcuggggaugacgccugcgauguccgcgcguacuuuacgaccccuaucuucuauguuaacgcugccccgcacauuggacaucuguacuccgcccuccuggcugacgcccuguguagacaccggcgccucagaggccccucuacagcugccacccgguuuagcacagggaccgaugaacauggacugaagauccagcaagcggccgcuacagccggccuugcuccuaccgagcugugcgaccgcguguccgaacaguuccagcagcucuuucaagaggccggcauuagcuguacggauuucaucagaaccacagaagcgcggcaccgcguggccguccagcauuuuuggggagugcugaaaucuagagggcuucuguauaagggcguuuacgaggggugguauugcgcuuccgacgaguguuuccuccccgaagccaaagugacccagcagccuggacccagcggcgauucuuuuccugucucccuggagagcgggcacccggugucuuggacaaaggaagagaauuacauuuuccggcugucccaauuucgcaaaccccuccagagauggcugcggggaaacccucaggcuaucacccccgagccuuuccaccauguugugcuucaguggcuggacgaggaacuccccgaucugagcgucuccagacgcucuagccaccuucauuggggcaucccggugccuggcgacgauucccaaacgauuuacguguggcuggacgcccucgucaauuaucugacaguuaucggguaccccaacgccgaauuuaagagcugguggccugcuaccucucacauuaucggaaaggacauucugaaauuccacgcgaucuauuggcccgccuuccuccugggcgcugggauguccccuccccagcggauuugcgugcauagccacuggacaguguguggacagaagaugucuaaaagccuuggcaaugucguggauccgagaaccugccugaaccgcuacaccguugacggguuucgguauuuccuccugagacaaggagugcccaauugggauugugacuacuaugaugagaaggucgugaaacuucugaacuccgaacucgccgacgcccugggcggccugcucaaucgcugcacagcuaagcggaucaacccuucugagacguaccccgccuuuuguaccacaugcuucccuagcgagcccgggcugguuggaccguccgugagagcgcaggcugaagauuacgcccuugucagcgccguggcuacccugccuaagcaggucgccgaccauuaugauaauuuucgcaucuacaaagcucucgaggccgugucuuccugcguucggcagacaaacggcuucgugcaaagacacgcgcccuggaagcugaauugggaaagcccugucgacgcccccuggcuggggaccgugcuucauguugcucucgagugucugcgcguguuuggaacgcugcuccagccugucacacccucucuggccgauaaacuucugucccggcucggcgugagcgcuuccgaaagaucucugggggagcuguauuuccuuccgcgguuuuacggccacccuugccccuucgagggacgcagacucggccccgaaaccgggcugcuguuuccucggcucgaccagagcagaaccuggcuggugaaggcccaccgcacauga

SEQ ID NO: 71889 - RNA, 2703 nt, Artificial Sequence
  derived and/or modified sequence opt5 from MARS__Homo_sapiens__NP_004981
augagacuguucgugagcgacggcguccccgggugccucccuguucuggccgcugccggacgggcgcgcggcagagcugaggugcuuaucuccaccguggggccggaagauugugucgugcccuuucugacacggccuaagguucccgugcuccagcuggacucuggaaacuaccuuuucagcacguccgccauuugccgcuacuuuuuccugcucucuggcugggagcaagaugaccugaccaaucaguggcuggaaugggaggccacagaacuccagccugcucugagcgccgcucuuuauuaucuggucgugcaggggaaaaagggagaggauguucucggcuccgugagacgggcccugacccacaucgaccauucucuuagccgccaaaacugucccuuucuggcgggcgagacagaaucccucgccgauauuguccuguggggagcucuguacccucuccugcaggacccggccuaucuucccgaggaacugagcgcucuccacucuugguuccagacccuguccacacaggagccuugccaaagagccgcggagaccgugcuuaaacagcagggagugcuggcccuccggcccuaccugcagaagcaaccucagcccagcccggcugaaggccgcgccgucacgaaugagccugaagaggaggaacuggcuacccucucugaggaagagaucgccauggccguuacagcuugggaaaaagggcuggagucccuucccccucugagaccccagcaaaaccccgugcucccuguggcgggagaacggaauguccugauuaccagcgcccuuccguaugugaacaauguuccccaucugggcaacaucaucgggugugugcucucugcugaugucuuugcccgcuacuccagacugcggcaguggaauacacuguaccucugcggaaccgacgaguauggcacggccacagagaccaaggcucuggaagagggccuuacaccucaggaaauuugugauaaguaccacaucauucaugccgacaucuaucgcugguucaacauuagcuuugauaucuucgggagaaccaccacaccccagcaaacgaaaauuacccaggacaucuuucagcagcugcucaagcggggauucgugcugcaagacacaguugagcagcugagaugcgaacacugugcgcgcuuucuugcugaucgguucguggagggcgucugcccuuucuguggguacgaggaagccagaggagaccagugcgauaaaugcggcaagcucaucaaugccguggagcugaaaaagccccaguguaaggucugccgcuccuguccggugguucaaucuagccagcaccuguuucucgaccugccuaaacuugaaaagcggcuggaggaguggcucgggagaacccugcccggauccgauuggacaccuaacgcucaguucauuacccgcagcuggcugcgggacggccuuaaacccagaugcaucacgcgcgaucucaaguggggcacaccugugccccuggaaggguuugaggacaaagucuucuaugugugguuugaugccaccauuggauaccugucuaucaccgcuaauuauacagaccagugggaacggugguggaagaacccggagcaaguugaucucuaccaguucauggccaaagacaaugugccuuuucauucccuggucuuccccuguagcgcgcuuggcgccgaagacaacuacacccuggugucucaccucauugcuacagaguaucugaacuacgaggaugggaaguuuagcaaguccagaggagugggcguuuucggggacauggcccaggauacgggcauccccgcugacaucuggcgcuuuuaucugcuuuacauucggccugaaggacaagauucugccuucagcuggaccgaccuccugcugaaaaauaacuccgagcuccugaauaaccuuggcaauuuuaucaacagagcggggauguucgucagcaaguucuuuggaggcuaugugccggaaauggugcugacacccgaugaccagcggcuccuggcccaugucacccuggagcuucagcacuaccaccagcuccuggaaaaagugcgcauuagagaugcucugcggucuauccucacaauuuccagacaugggaaucaauauauccagguuaacgagccuuggaagcgcaucaaaggaagcgaggccgaccggcagagagcuggcaccgugacggggcuggccgucaauauugccgcgcuucugucugugaugcuccagcccuacaugccuaccguuuccgcuacaauccaagcccagcugcagcugcccccucccgcuugcagcauucuucugaccaacuuccucuguacacugccggccggccaccagaucggaaccguguccccucucuuucaaaagcuggaaaaugaucagauugagucucuucgccagagauucggcgggggacaagccaagacgagccccaaaccugcugucguggaaacaguuaccacagccaagccccagcagauccaggcgcugauggacgaggugaccaaacaaggcaacauuguccgggaacucaaggcucagaaagccgauaagaaugagguggccgcugagguggccaagcugcuggaccuuaaaaagcagcuggcggucgcugaagggaaaccgccugaggcccccaaggggaaaaagaagaaauga

SEQ ID NO: 71890 - RNA, 522 nt, Artificial Sequence
  derived and/or modified sequence opt5 from MARVELD1__Homo_sapiens__NP_113672
augcugcccccuccgcccagacagccucccccucaagcccgggcugcccgcggcgcggugagacuccagcggcccuuccugcgcagcccucuugggguccugagacuccugcagcuucuggcuggagccgccuuuuggaucaccauugcuacauccaaguaccagggcccgguucacuucgcccucuuugugucugugcuguucuggcugcucacgcuggggcuuuauuuucugacccuccugggaaaacaugagcuuguccccgugcugggcagccgguggcucaugguuaacguggcucacgacguccuggccgcggcccuguacggggcugccacaggaaucauguccgaucaaaugcagcgccauucuuauugcaaucucaaggacuacccucugcccugugcuuaucacgccuuccuugcggccgcugugugcggcggcguuugucaugggcuguaccuccugagcgcccuuuauggaugcggcagacggugucaggggaaacaggaaguggcuuga

SEQ ID NO: 71891 - RNA, 1641 nt, Artificial Sequence
  derived and/or modified sequence opt5 from MARVELD2__Homo_sapiens__NP_001231663
augagcaacgacggcagaucccggaaucgcgauagacgguacgacgaggugcccucugaucugccuuaucaggacaccacaauccgcacgcacccgacccuccaugauagcgaaagagccgucuccgcugacccccugccucccccuccccuuccucugcaaccgcccuucgggccugauuuuuacucuagcgacacagaggaacccgccauugcgccugaucucaagcccguucggcgcuucgugccggacuccuggaaaaacuuuuucagaggaaagaaaaaggauccugagugggacaaacccgugucugauauccgguauauuagcgacggcgucgaaugcuccccucccgcuagccccgcccgcccuaaucacagaucuccgcugaacuccuguaaggaccccuacgggggaagcgagggcaccuuuucuucccggaaggaggccgaugcuguguucccucgcgaccccuaugggagccuugauagacauacacagaccguucggacauacucugaaaaaguggaggaauauaaucugcgcuacuccuacaugaaaagcugggccggacuccugagaauccugggcgucguggagcuccugcuuggcgcugggguuuuugccugcgugaccgcguauauucacaaggacuccgagugguacaaccuguucggauauucucagccuuacggcaugggaggggucggcgggcucggaagcauguauggcggcuacuauuacacggggcccaagaccccguuugugcugguggucgccggacuugcuuggaucacaaccaucauuauccugguucucggcauguccauguacuaucggacaauucugcuggauagcaauugguggccucucaccgaguucgggaucaacguggcccuguuuauucuuuacauggcugccgcgaucguguaugucaaugacacgaacagaggaggccuguguuacuauccccucuucaauacaccugugaacgccguguuuugccgcguugaagggggacagauugcugccaugaucuuccuguucgucaccaugaucguguaccuuauuucugcucugguuugucucaaacuguggcggcaugaagccgccagacgccaccgggaguauauggaacaacaggagugcgagauggcuacauccggcgauagacagcgcgacagcgaagugaauuuuaaggagcugcggaccgcgaagaugaaacccgaacuccugucuggccacaucccucccgggcauauuccgaagccuaucgucaugcccgauuacguggccaaauaccccgucauucagaccgacgaugagagagaacgcuauaaggcuguguuccaagaccaguuuagcgaguacaaagagcuuuccgccgaaguucaggccgugcugcggaaguucgacgagcucgaugcugucaugucuagacugccucaccauagcgaaucccgccaggagcacgaacggaucagcagaauccacgaggaguuuaaaaagaagaaaaacgacccgacauuccuugaaaagaaagagcggugugauuaucugaagaauaaacucucucauauuaagcaacgcauccaggaauacgacaaggugaugaacugggauguucagggauauuccuga

SEQ ID NO: 71892 - RNA, 1233 nt, Artificial Sequence
  derived and/or modified sequence opt5 from MARVELD3__Homo_sapiens__NP_001017967
auggaggaccccagcggcgccagagaaccucgggcucgcccgagagagcgggaucccgggcgcagaccucaccccgaccagggacggacccaugaucgcccuagagaccggcccggcgauccucgcagaaagcgguccucugacgggaaccgcagacgggauggagaccgcgauccggaaagagaccaagagcgggauggcaauagagaccgcaaccgggauagagaacgcgagcgggagagagaacgcgaccccgaccgggggccuagacgcgauacacaccgggacgccggacccagagcgggcgagcauggcgugugggaaaaaccucgccagagccggacgagagauggggcucggggacugaccugggacgccgccgcucccccgggcccugcccccugggaggcuccugagccuccccagccccagcgcaagggggauccgggaagacggagacccgaauccgagccucccucugaacgcuaccucccuagcacaccccggccgggcagagaggaagucgaguauuaccaauccgaggccgaagggcugcuugagugccacaaauguaaguaucugugcaccggacgcggcguugugcagaucguggaagucgugcucaauggcaugguucugauuuguaucguggcgucuuacuucguccuugccggguuuagcgcuuccuucagcucuggaggcggguuuggaaacaauuauuacuccccuuucgagggcacagaacuggaacaggugagacagcucgaccaacaguauaccauucugcggagcccccugaucuacgggggaguugccgugucucucggccugggcguccuuacaaugggggugcugcuccagggagcuaaaucccgcaccaugcugagcggcaaguggcuucugacggaggccgcguuuucucuccuggccgcugugggguacugcaccggaauuggcgucuaucugcauguugcccuccagaucaacuccacagauaccuguaagacaagagagcggcuguacgcucgcaaagggcuuaccuggauggacugccaacuggccggcacggauggagccgcugcgacauucgccugucuccuggugaucauguauggcgcuagcgugguccuugcccugagauccuaccgggagcagaagcgcuauaaagggucuagagaacagccuggaagcuacuccgacgcccccgaguaucucuggagcggcacccuguga

SEQ ID NO: 71893 - RNA, 978 nt, Artificial Sequence
  derived and/or modified sequence opt5 from MAS1__Homo_sapiens__NP_002368
auggacggcagcaacgugaccuccuucgucguugaggaacccacaaauaucucuacggggagaaacgccagcgugggaaaugcucaccggcagauuccuaucgugcauugggucauuauguccaucucuccggugggcuuuguugagaacgggauucugcucugguuccugugcuuucgcaugagacggaaucccuucaccguguacaucacacaccuuagcaucgccgauauuucccugcucuuuuguaucuucauucugucuaucgacuaugcgcuugauuacgaacugagcuccggacauuauuacaccauugucacacucagcgugaccuuucuguucggcuauaacacagggcuguaccuccugaccgcuaucucuguugagcgcugccuuuccgugcuguauccuauuugguacagaugucaccggcccaaguaccaaagcgcccucgucugcgcccugcuuugggcucugucuugucucgugacgaccauggaauaugugaugugcaucgaccgcgaggaggaaucccauagcagaaaugauugucgggccgucaucauuuuuaucgcuauucugucuuuccugguuuuuacaccucucaugcugguguccagcaccauccuuguggucaaaauucgcaagaacacaugggccucccacucuagcaaacuguacaucgugaucaugguuaccauuaucauuuuccucaucuuugcgaugcccaugagacugcuuuaucugcucuacuaugaguacugguccacguucggaaaucugcaccauauuagccuccuguucucuacaaucaacuccagcgccaauccuuuuaucuauuucuuugugggcucuagcaagaaaaagcgguucaaggaaucccugaaagucgugcuuacccgcgcuuuuaaggacgagaugcagccgagacggcagaaagauaacugcaauacaguuaccguggagaccgucguguga

SEQ ID NO: 71894 - RNA, 1137 nt, Artificial Sequence
  derived and/or modified sequence opt5 from MAS1L__Homo_sapiens__NP_443199
augguguggggcaagaucugcugguucagccagagagccggguggaccgucuuugcugagucccaaauuucucugagcuguucccucugccugcacucuggagaccaggaagcccagaaccccaaucuuguuagccagcuguguggcguguuccuccaaaacgagacaaaugaaacgauccauaugcagauguccauggcgguggggcagcaggcucugccucuuaacauuaucgccccgaaagccguccuggugucucucugcggaguucugcugaauggcaccguguuuuggcuccuguguugcggggcuacaaaccccuacauggucuauauucuucaccugguggccgcugauguuaucuaccucuguugcagcgccgugggauuccugcaagucacccuucugacauaucauggcgugguguuuuucaucccugacuuucucgcgauucugucccccuucagcuuugaggucugucugugccuccugguugccaucucuaccgaacggugugugugcgugcuuuucccuauuugguaccgcugccacagacccaaguauacauccaaugucguguguacccugaucuggggccucccuuuuugcauuaacaucguuaaaagccuguuccuuacguacuggaagcaugugaaggcuugugucauuuuucugaaacucucugggcuguuccacgccauccugucccucgugaugugcguuagcucucugacccuucugauccgguuccucuguugcucccagcagcagaaggcuacacgcguguaugccgucgugcaaauuagcgcgccgauguuucugcuuugggcccugccccucuccgucgcuccucugaucaccgauuucaaaauguuugugacaaccucuuaccugauuagccucuuccugaucauuaauuccagcgccaaccccaucaucuacuuuuucguuggaucucuuagaaagaaacggcugaaggagucccuccgcgugauucugcagagagcucuggccgacaaaccugaggucggccggaauaagaaggccgcugggaucgaucccauggaacagccgcacagcacgcaacauguggagaaccuucucccucgcgaacacagaguugacguggagacauga

SEQ ID NO: 71895 - RNA, 1143 nt, Artificial Sequence
  derived and/or modified sequence opt5 from MASP1__Homo_sapiens__NP_001027019
augagauggcugcugcuguacuaugcccuuugcuucagccuguccaaggcuucugcccacaccguggagcucaacaauauguuuggccagauccaaagccccggguacccugacuccuauccgucugauagcgaagucacauggaacauuacgguucccgacggauuccggaucaaacuguacuuuaugcauuucaaucuugaguccucuuaucugugugaauacgauuaugugaagguggagaccgaagaccagguccucgcgacauuuugcggccgcgagaccacagauaccgagcagacaccugggcaggaagugguucugagccccggauccuucaugagcauuaccuuuagaucugacuucuccaacgaggaacgguuuacgggcuucgaugcucacuacauggccguggacgucgaugaguguaaagagcgcgaagacgaggaacugagcugcgaucauuacugucacaauuauaucgggggauacuauugcucuuguagauuuggcuacauucuccauaccgacaaccggacaugccgcguggaguguuccgauaaucuguucacccaaagaacaggcguuaucaccagcccugacuuucccaacccuuauccgaagucuuccgaaugccuuuacacgaucgagcuggaggaaggguucauggugaaucuccaguucgaggacauuuuugauaucgaagaccaccccgaggucccuugucccuaugauuacauuaaaaucaaggugggaccuaaggugcugggccccuucugcggggaaaaagccccggagccuauuagcacacagucccacucuguccuuauccuguuucauagcgacaacuccggagagaaucggggcuggcgccucagcuacagagcugccgggaacgaaugccccgagcugcagccucccguucacggaaagauugaacccucucaagcuaaauauuucuuuaaggaucaggugcugguguccugugacaccggcuacaaaguccucaaggauaauguggagauggacacauuccagaucgaaugccugaaggauggcaccuggagcaacaaaaucccuaccuguaagaaaaaugagauugaccuugagucugaacucaagagcgagcagguuacagaauga

SEQ ID NO: 71896 - RNA, 5592 nt, Artificial Sequence
  derived and/or modified sequence opt5 from MAST2__Homo_sapiens__XP_011539364
augaagagaucccggugccgcgacagaccccagccucccccucccgaucggcgcgaggacggcgugcaaagagccgcugagcugucccagucucugccuccucggcgcagagcgcccccugggcggcagcgccuggaggaaagaaccgggccggcgggccccgaggggaaagaacaggaugucguuaccggggugagcccucuucuguuccggaagcucuccaaccccgacaucuuuucuagcacgggcaaagugaagcugcaacgccagcuuucccaggaugacuguaaacuguggagagggaaucucgcuucuagccuguccggaaagcagcugcucccucugucuagcuccguccacagcucugugggccaaguuaccuggcaguccagcggcgaggccucuaaccuugugcggaugcgcaaucagucccuggggcagagcgcccccucccucacagcuggacugaaggagcuuucucugccgagacggggcagccucauuuccacccugugcagaggggccgaagucaaccaacacauguucagcccuacaucugcucccgcccuguuucucaccaaagugccuuucuccgccgauugcgcccuggcuacaagcccccuugccaucuuucugaauccccgcgcucacucuagcccuggaaccccgugcuccucucggccccucccuuggagcuguagaacguccaaccgcaagagccugauuguuaccucuuccacaagccccacccuuccucggccccauucuccgcugcacggccauacaggaaauuccccucucgacagccccagaaacuucuccccuaaugcccccgcgcacuuuucuuucgugccugcccgccggaccgauggaagacgcuggagccuggcuucccugcccucuagcggcuacggcacgaacacaccguccagcaccgucucuuccagcuguucuucccaggagaaacuccaccagcugccuuuucaacccacagccgacgaacuucauuuccugaccaagcacuuuagcaccgagucugugcccgaugaggaagggcggcagagcccugcuaugagaccgcgcucccggagccucucucccggaagauccccugugagcuucgacuccgagaucauuaugaugaaucaugucuauaaagaacgguuucccaaggccacagcccagauggaggaacgccuggcugaguucaucucuagcaacacgccugauuccguucuuccccuggcggacggcgcccucucuuucauccaccaccaggugauugagauggcuagagacugucuggauaagagccgguccgggcugaucaccucucaauacuuuuaugaacuccaggacaaucuggagaaacuucugcaggaugcccaugaaagaagcgaguccagcgaaguggccuucgucaugcagcucgugaagaaacugaugauuaucauugcucgcccugcccggcugcuugagugccucgaguuugaccccgaagaguucuaccaccuccuggaagcggcugagggacaugccaaggaaggccaagggaucaaaugugauauuccgagauauaucguuucucagcucggacugacacgcgacccucuugaggagauggcccagcuguccagcugcgauucucccgacaccccugaaacagaugacuccaucgagggccacggcgcuagccuccccucuaagaaaaccccguccgaagaggauuuugagacgauuaagcugaucagcaacggggccuacggagcuguguuccuggucagacauaaguccacacggcagcgcuuugccaugaaaaagauuaauaaacaaaaccuuauccucagaaaccagauucagcaggcguucguggaacgggacauccugaccuuugccgagaauccuuucguugugagcauguuuuguucuuucgacaccaagcgccaccugugcauggucauggaauauguggagggcggggauugcgcuacacuccugaaaaacaucggagcccuucccgucgacauggugagacuguacuuugcugaaaccguucucgcccuggaguaccugcacaauuauggcauugugcaucgggaucuuaagccugacaaccuccugaucacaagcauggggcacauuaagcugacggauuucggccucuccaaaaucggacugaugucucuuaccacaaaucuguacgagggccauauugaaaaggacgcgcgcgaguuccucgauaaacaagucugugggacccccgaauauaucgcccccgaggugauccugagacagggauacggcaagccuguugacuggugggcuauggggauuauccuguaugaauuucuugugggaugcgucccguucuuuggcgauacacccgaggaacucuucggacaggugauuagcgacgaaaucguguggccugagggcgaugaagcccugcccccugacgcucaagaucugaccuccaaacuccugcaccagaacccccuugagcggcugggaacgggcucugccuacgaaguuaagcagcaccccuuuuucaccgggcucgacuggacaggacugcugcgccagaaggccgaguuuauuccgcaacuugagagcgaagacgauaccuccuauuucgacacaagaucugagcgguaccaucacauggauagcgaagacgaggaggaagucuccgaggauggcugucuggaaaucagacaguuuagcucuugcagcccccgcuucaauaaaguguacagcucuauggagcggcucucccugcucgaagagagacgcaccccucccccuacgaagcggagccuguccgaggaaaaagaggaccauucugaugggcuugcuggacugaagggcagagaccgcagcugggugauugggucccccgaaauccuccggaaaagacugagcgucucugaguccagccacacagaaucugauagcuccccgccuaugaccgugcgccggagauguucuggccugcuugacgcgccccgguuucccgagggaccugaggaagccagcuccacacugcgcagacagccccaggagggcaucuggguucucaccccuccgucuggggaaggagugagcggccccgucaccgagcauuccggggaacaacggccuaagcuggaugaggaggcugugggacgcagcucuggcuccagccccgccauggaaacaagagggcggggcacgucccagcucgccgagggagcuaccgccaaggcgauuucugaccuggcuguuagacgcgcccggcacagacuucugagcggcgauuccacagaaaaacgcaccgcccggccugugaacaaggucaucaaaucugcuagcgccacagcgcucucccugcugauucccagcgagcaccauaccugcucuccgcuugcuuccccuaugagcccccacucucaguccagcaauccuucuagcagagacuccucucccagccgcgacuuccugccugcccucggguccaugcggcccccgaucauuauccauagagccggaaagaaauauggcuuuacgcugcgcgcuaucagaguguacaugggggauagcgacguuuauacagugcaccauauggucuggcacguggaggauggaggcccugccuccgaagcuggccuccggcagggggaccugauuacccacgugaacggagagcccguccauggccuuguucacaccgaagugguggagcugauccugaagucugggaauaaagucgccauuagcacaacaccccucgaaaacacauccaucaaggugggaccugcgcgcaagggcucuuacaaagccaagauggcuagacggagcaaacgcuccagagggaaggauggacaagagucucggaaaagaagcucccuguuccgcaagauuacgaagcaggccagccuucugcauaccucucggucccucagcucucugaauagaucccucagcucuggcgaguccggcccggggagccccacacacucccacagccugucuccucgcagccccacccagggauaucggguuacaccugacgcugugcauuccgucggcgggaacucuagccaauccucuagccccuccucuagcgugccuuccagcccggccggaucuggccacaccagacccuccagccuucaugggcuggccccuaaacugcagcggcaguaccgcucucccagacggaaguccgcuggaagcaucccucucagcccccuggcgcacacgccgucuccuccgcccccuaccgccagcccccagcgcuccccuagcccgcuuucuggccauguugcucaagccuuccccacaaaacugcaccucuccccuccccugggcagacagcucagccggccuaagucugccgaacccccgcgcagcccucugcuuaaaagagugcaguccgcugagaagcuggccgcggcucuggccgccucugaaaagaaacucgcuaccagccggaagcacucccuggaucuuccccauucugagcugaaaaaggaacucccuccccgcgaggucagcccucuggaggugguuggggccagauccgugcucagcggaaaaggcgcgcugcccgggaagggaguccuucagccggcuccuucucgggcccugggcacacugagacaagaccgcgccgaacggagagagucccuccagaagcaggaagcuauccgcgagguggauagcuccgaagacgauaccgaggaggggcccgaaaauucucagggagcccaagagcugagccuugcuccccacccugaagugucccagucugucgccccgaaaggcgcgggcgagagcggggaggaagaccccuuuccuucccgggaccccagaagccugggaccuaugguucccucucuccugacaggcauuacccuggggccuccccgcauggaguccccgagcggaccucaucggagacucggcucuccccaggccaucgaagaggcugccuccuccucuuccgcugggccuaaccuuggacagagcggcgccacggaucccauuccgccugaaggcuguuggaaggcccaacaucugcacacacaggcucugaccgcgcucucucccagcaccuccgggcugacacccaccagcuccugcucuccucccagcuccacgucuggaaaacuuagcaugugguccuggaagucucugaucgagggcccugaccgcgccagcccgucccggaaagcuacaauggccgggggacucgccaaccugcaggaucuggagaauaccacacccgcucaaccuaagaaccucagccccagagaacagggcaaaacccagccucccucugccccucgccuugcgcauccguccuaugaggaccccagccagggguggcugugggaaucugagugugcucaagccgugaaggaagauccugcccuguccauuacacaggugcccgacgcuagcggagaucggagacaggacgucccuugccgcggcuguccccucacccagaagucugagccgucccugagacggggccaagagccugggggacaccagaaacaucgcgaucuugcccuggugcccgacgaacuccugaagcagacguga

SEQ ID NO: 71897 - RNA, 7872 nt, Artificial Sequence
  derived and/or modified sequence opt5 from MAST4__Homo_sapiens__NP_001158136
augggcgagaaggugagcgaagcccccgagccugucccgagagggugcuccggacacggcucucggacccccgcuagcgcccugguugcggcuuccucuccuggggccagcuccgccgaaucuagcuccggaagcgagacacucucugaagagggcgagcccgggggauucucccgcgaacaucagccucccccuccgcccccucugggcggcacgcuuggggcuagagcccccgcugccugggcgccugccagcgugcugcucgagcggggagugcuggcucuucccccgccucugcccggcggggccgucccucccgcuccccgcggaucuuccgccagccaagaagagcaggacgaggaacucgaucacauccugucuccuccgcccaugccuuuuagaaaauguuccaaccccgacguggcgagcggcccugggaagucccugaaauacaagcggcagcucucugaggauggacgccagcugagacggggcagccuuggcggggcccugaccggacgcuaucuccugcccaauccgguugcuggccaagccuggccugcuuccgccgaaacaagcaaccuugugagaaugcggucucaggcccuggggcaguccgcucccagccucaccgcgucucugaaagagcugagccucccucgcagaggauccuucugccggacaucuaaucgcaagagccugauuggcaacgggcagucccccgcccuuccuagaccccauagcccgcugucugcucacgccggaaauuccccucaagacagcccccggaacuuuucucccuccgccagcgcucauuucuccuuugccagacgcaccgauggccggagauggucucucgcgagccugccuuccucuggcuacgggacaaauaccccgagcuccacggucagcucuuccuguagcucucaggaaaagcuucaccagcugcccuaucagccuacccccgacgagcuccacuuccuguccaaacauuuuugcacaaccgagagcaucgcuacagaaaaccgcugucggaauaccccuaugagaccccgcucucggagccuguccccuggaagaagccccgccugcugugaucacgagauuaucaugaugaaccauguguacaaggaacgcuucccgaaagccacggcucaaauggaggaacggcucaaggagauuaucacaucuuauuccccugacaauguucugccccuugccgauggcgugcugagcuuuacccaccaccagaucauugagcucgcuagagacugccuggauaaaucccaucaggggcuuaucacaucucgcuacuuccuggaacuccaacacaagcuggacaagcugcuccaggaggcccaugaucggagcgaauccggagagcuggcguuuauuaaacagcuugucagaaagauccugauugugaucgcccggccugcucgccuccuggaaugucuggaguucgaccccgaggaauuuuauuaccuucucgaggccgcugaaggccacgccaaagaggggcagggcauuaagaccgacaucccgagauacaucauuucucaacugggacugaacaaagauccucucgaggaaauggcgcaucugggcaauuaugacagcgggaccgccgagacacccgaaacggaugaguccgugucuagcuccaacgcuagccuuaagcugcggagaaaaccucgcgaaucugacuucgagaccaucaagcucauuuccaauggagccuacggcgcugucuauuucguucggcacaaggagagcagacagcgcuuugccaugaaaaagaucaacaaacagaaccugauucugagaaaucagauccaacaggccuucguggaacgggauauccuuacauuugcugagaaccccuucguggucucuauguacugcuccuuugaaacccgcagacaccucuguauggugauggaguauguugaagggggagacugcgcgacacugaugaagaauaugggcccccugccuguggauauggcccggauguacuucgcugagaccguccucgcccuggaguaucuucauaacuacgggauugugcaccgcgaccugaaaccggauaaucuccugguuacgagcaugggccauaucaagcugacagacuuuggacuuucuaaggugggccucauguccaugaccaccaaccuguacgaagggcacauugagaaagaugccagagaauuccuggacaagcaggucugcggaacacccgaguauaucgcuccugaagugauucuccggcagggcuacgggaaacccgucgacuggugggccaugggaaucauccuguaugaguuucuugugggcuguguuccuuucuuuggggauacccccgaggaacuguucggccaagugauuagcgacgagaucaauuggccugaaaaggaugaggcgccgcccccugacgcucaggaucucauuacacugcugcuucgccagaacccccucgagagacugggaacgggcggggccuacgaagucaaacagcaccgguuuuuccgcucccuggacuggaauagccuccugagacaaaaggccgaguucaucccucagcuugaaucugaggaugacaccagcuauuuugauacacgguccgaaaaguaccaucacauggagaccgaggaagaggacgauacaaacgacgaagauuucaauguggagauuagacaguuuucuagcugcucccaucgcuucucuaaaguuuuuagcuccaucgaccggauuacccaaaacucugcugaagagaaggaggacagcguggauaaaacgaaguccaccacacugcccagcaccgaaacacucucuugguccagcgaguauucugaaaugcagcagcuguccaccagcaauuccucugacacggagagcaacagacacaaacuguccagcggacuucugccgaagcucgccaucucuacagaaggcgagcaggaugaggcggcuuccuguccuggggacccccaugaagagcccggaaagccugcccugcccccugaagagugcgcccaagaggaaccggaggucaccacacccgcuagcaccaucucuagcuccacccucucugugggcagcuucuccgaacaccuggaucagauuaaugggcgcucugaguguguggacagcacagauaacuccagcaaaccuucuuccgaacccgccagccacauggcucggcagagacuugaguccacggagaagaaaaagaucucuggcaaaguuaccaagagccuguccgccucugcgcucagccugaugauuccuggagacauguuugccgucuccccccugggcagcccgaugucuccucauucccuuagcucugaucccuccagcucucgcgacagcuccccuucucgggauagcuccgcugccagcgcuuccccccaccagccuaucgugauucauucuagcgggaaaaacuacggauucacaaucagagccauccgcguguacgucggcgacuccgauauuuauaccgugcaccauaucguuuggaauguggaagaggggucucccgccugccaagcuggacugaaggcgggcgaccucauuacacacaucaacggcgaaccgguccacgggcuggugcauaccgagguuauugaacuccugcuuaagagcggaaauaaaguguccaucacgacaaccccuuuugagaacaccucuaucaagacaggccccgcccggagaaauagcuacaaaucccggaugguccgcagaagcaagaaaucuaagaagaaagagucccuggaacggcgcagaagccucuucaagaaacuggcuaagcagcccucuccucugcuucacaccucccggagcuuuucuugucugaacagaucccucagcuccggggagagccugccgggaucucccacacauagccucuccccucgcucucccacgccuagcuaucgguccacccccgacuucccuucuggcacaaauagcucccagucuagcuccccgagcucuuccgcccccaacagcccugccgggucuggacacauuagacccuccacccugcacggccuugcuccuaaacugggcgggcagcgcuaccggagcggaagacgcaaguccgccggcaauaucccccugucuccgcucgcgcggacaccuagccccaccccccaaccuacguccccccagagaagcccuucuccgcugcuugggcauucccugggaaacagcaagauugcucaggccuuucccucuaaaaugcacagcccucccaccaucgugcgccauauuguuagaccuaaguccgccgaacccccgcggucuccucuccugaaacgcgugcaaagcgaggaaaagcucucccccucuuauggcagcgauaaaaagcaccugugcuccagaaagcauagccuugaggucacacaggaggaagugcagcgggagcagucucaacgcgaagcuccucugcagucccuggacgagaaugugugugauguccccccucucagcagagcccggcccguugagcaggggugccugaaaagaccggugucccgcaaggugggacggcaggaaucugucgacgaucuugacagagauaaacugaaggcgaaagugguugugaagaaagcugacggcuucccugagaagcaagaaagccaccagaagucccacggccccgggucugaucucgagaacuucgcccuguuuaaacucgaagagcgcgagaagaaagucuaccccaaggccguggaacggagcuccaccuucgagaauaaagcuagcaugcaggaagccccuccgcugggaucucuucugaaggacgcucugcauaagcaggccuccguuagagcgagcgagggcgccaugucugaugggcgggugcccgcugaacaccgccaaggaggcggggacuuuagacgggccccugcucccggaacacuccaggacggccugugucauucccuugaucgcggcaucagcgggaaaggagagggcaccgagaagucuucccaggccaaagaacugcucagaugcgagaagcuggacagcaaacucgccaacaucgauuaucugcggaagaagaugucucuugaagacaaagaggauaaucugugcccuguccugaagcccaaaaugacagcugggagccacgaaugucucccuggaaaccccgugcgcccgaccggcgggcagcaagagccucccccugcguccgagagcagagccuucguuuccucuacgcacgcugcccagaugagcgccguguccuuugucccccugaaggcucuuacaggacggguggacucuggcaccgaaaaaccgggccugguggccccugagagccccguccgcaagucccccucugaauacaagcucgaggggagaagcguuuccugccugaaaccuauugagggaacccuggauaucgcgcuccuuagcggcccccaggcuucuaagacagaacugccuuccccggagagcgcccaaucucccuccccuagcggggacgugcgggccucugugcccccuguccugcccuccagcucuggaaaaaagaacgauaccacguccgcuagagaacucagcccuagcucccugaaaaugaauaagucuuaccuucuggagccgugguuccuccccccuagccgcggccugcagaacucccccgccgugucucugccugaccccgaauuuaagcgggauagaaaagggccgcauccuacagcgcgcagccccggaaccguuauggaguccaauccccagcagcgggagggcucuagcccuaagcaccaagaccauacaaccgaucccaaacuccuuacaugucugggccagaaccugcacuccccugaccucgccagaccgcgcugcccccugccucccgaagcuagcccuucucgggagaagcccgggcuuagagaauccagcgagcgcggaccgccuaccgcccggucugaaagauccgcugcccgcgcugacacgugucgggagcccagcauggagcugugcuucccugaaaccgccaaaacauccgauaauucuaagaaccuccugagcgugggcagaacccaucccgacuuuuauacacagacccaggcgauggagaaagccugggcuccggggggaaagacgaaucacaaggauggcccuggggaagcccgcccccccccuagagacaacuccucucugcacagcgcuggaauucccugugagaaagaacucggcaagguccggcgcggcguggagccuaaaccggaggcccuucuggccagacggucccugcaacccccugggaucgaaagcgagaagucugaaaaacucuccagcuuccccucucugcagaaggauggagcuaaggagccugagagaaaagaacagccccuucagcggcauccuagcuccauuccgcccccuccccugacagcgaaggaccucucuagcccugccgcucgccaacacugcuccagccccucucaugccuccggcagagagccgggggccaaaccuagcaccgcugaacccuccucuagcccccaggauccucccaagccuguugccgcgcacuccgagucuagcucccacaaaccgcggcccggaccugaccccggcccucccaagacaaagcauccggaucgcucucugagcucccagaaaccuagcgugggggccaccaagggcaaagaacccgcuacccaaucucugggaggcuccagcagagaggggaagggacacucuaaauccggcccugacgucuuucccgccacaccugggagccagaauaaggcuucugauggaaucggccagggggagggcggacccagcgugccgcuccauacggaccgggccccccuugaugcgaagccucagcccaccuccggcgggcgcccucuggaaguccuggagaaaccggugcaccuccccagaccuggacaucccggcccuagcgaacccgccgaccaaaagcuguccgcuguuggggagaaacagacacuuucuccuaagcaccccaaaccgagcaccgugaaggacuguccuacacugugcaaacagaccgauaaccggcagacggacaagucccccucucaaccugccgcuaauacagaucgcagagccgaaggaaagaaauguaccgaggcucucuacgcccccgcggagggcgacaagcuggaagccgggcugagcuucguccacuccgagaaccggcucaaaggcgcugaacgcccggccgcuggagugggcaagggguucccugaggccagaggaaaaggccccgggccccagaagccucccaccgaagccgauaagccuaauggaaugaaacggucuccgagcgcgacaggccaguccagcuuucgcucuaccgcucuucccgagaagucccugagcugcucuuccagcuucccugagacaagagccggcguucgggaagcuucugccgccuccagcgacacgucuuccgcuaaagccgcggggggaaugcuggagcuccccgccccuagcaacagagaucaucgcaaggcucagcccgccggcgaagggcggacccacaugacaaaauccgacagccugccgucuuuuagagugagcacccuuccucuggagucccaucaccccgauccuaauacaaugggaggcgcuucucaucgcgaccgggcccucagcgucaccgcgacggugggggagaccaagggaaaggaucccgccccugcucaacccccgcccgccagaaaacagaacgugggccgcgacguuacaaagccuucccccgcuccuaacaccgaccggcccauuucucugagcaaugaaaaagauuucgucgugagacagcgccggggcaaggagucccugagaagcucuccucacaaaaaggcccucuga

SEQ ID NO: 71898 - RNA, 2640 nt, Artificial Sequence
  derived and/or modified sequence opt5 from MASTL__Homo_sapiens__NP_001165774
auggaccccaccgccggcagcaagaaagagccugggggaggcgcugccacagaagagggggugaacagaaucgcggucccgaagcccccuuccauugaagaguucucuaucguuaaacccauuagccggggagcuuuuggcaagguguaccuggggcagaaaggaggcaagcucuaugccgugaaggucgugaaaaaggccgauaugaucaauaaaaacaugacgcaccaaguucaggcugaacgcgacgcccuggcucuuuccaagucuccuuucauugugcaucuguacuauagccuccaguccgccaauaacgucuaccuggugauggaguaucuuaucggcggggauguuaaaucucugcuccacaucuacggauauuuugacgaggaaauggcggugaaguacauuagcgaggucgcccuggcucuggauuaccuccauagacacggcaucauucaucgggaccugaagcccgauaauaugcuuaucuccaacgaagggcacauuaaacugaccgacuucggacucagcaaggugacacugaaucgcgauaucaacaugauggacauucuuaccacaccuucuauggccaaaccgagacaggauuauucccggacccccggccaagugcugagccucaucucuucccugggguuuaauacaccuaucgcugagaagaaccaggaccccgccaauauucugagcgcgugccucucugagaccucccagcugagccagggacuugucuguccuauguccguugaucaaaaagacacgacccccuacucuagcaagcugcucaaauccugccuggaaacaguggccagcaacccgggcaugccugugaagugucuuaccucuaaucugcuccagucccgcaagagacuggcuacaagcucugccagcucccagucucacaccuucaucagcuccgucgagagcgaaugccauucuucccccaaaugggagaaggacugucaggaaagcgaugaggcucugggcccuacgaugaugucuuggaacgccguggagaaacucugcgccaaguccgcuaaugcgauugaaacaaaaggguuuaacaagaaggaccuggagcuugcccugagccccauccacaacuccucugcucuccccaccacaggacggagcuguguuaaucuggccaaaaagugcuucuccggcgaagugucuugggaggccgucgaacuugaugugaacaauauuaacauggacaccgauaccagccaacugggguuucaucaguccaaucagugggcuguugacagcggaggcaucucugaggagcaccucgggaaacgcucccugaagagaaacuucgaacugguggauagcucuccuuguaaaaagaucauucaaaauaagaaaacaugcgucgaguauaagcacaacgaaaugacgaauuguuacaccaaccagaauacaggacucaccguggagguccaggaccugaaacuuuccgugcauaagagccagcaaaacgauugcgccaauaaagaaaacaucguuaauucuuuuacagacaagcagcagaccccggagaagcugcccauuccuaugaucgcgaaaaaccucaugugcgagcuggaugaagacugugagaagaacagcaaacgggacuaucuguccagcucuuuccuuugcuccgaugacgaucgcgcuagcaagaauauuuccaugaacucugacagcuccuuucccggcaucucuaucauggaaagcccucucgagucccagccccuggauucugacagaagcauuaaagaguccagcuucgaagagucuaauaucgaagauccgcugauugugacgccugacugucaagagaagacaucccccaaaggcgucgaaaacccugccgugcaggagagcaaucagaagaugcucgggcccccucuggagguucuuaagacccuggccucuaaacggaacgcuguggccuuccgcuccuuuaauagccacaucaacgcuucuaauaacuccgaacccagcagaaugaauaugaccucccucgaugccauggacauuagcugcgcguacucuggaagcuauccgauggccaucacaccuacccagaagcggagauccuguaugccccaucaacagacacccaaccagauuaaaucuggcacgccuuaccgcacccccaagagcguccggagagggguggcucccguggaugacggacgcauccugggcacaccugauuaccuggcccccgagcuucuccuggggcgggcucacggcccugccguugacuggugggcgcugggagucugccucuucgaauuucugaccggcaucccgccuuucaaugacgagacaccccagcaaguguuucagaacauucuuaaaagagauaucccguggccugaaggggaggagaagcuguccgacaaugcccagucugcuguggaaauucuccugaccaucgaugacacgaagcgcgccggaaugaaagagcugaagcggcauccccuuuucagcgaugucgacugggaaaaccuccaacaccagaccaugccuuuuauuccccagccggaugacgagacagauaccuccuauuucgaagcuagaaacacagcccagcaccugaccgugucuggcuuuagccuguga

SEQ ID NO: 71899 - RNA, 1188 nt, Artificial Sequence
  derived and/or modified sequence opt5 from MAT1A__Homo_sapiens__XP_005269899
augaacggccccguggacgggcugugcgaucacagccucuccgagggagucuucauguuuaccucugaaagcguuggcgaggggcauccugacaagaucugugaucagauuuccgacgccgugcuggaugcucaccuuaaacaagacccgaaugccaagguggcgugcgaaacagucuguaaaacgggaauggugcugcucugcggcgagaucaccucuauggcuaugguugauuaccagagagugguccgggacacaauuaagcauaucggguaugaugacagcgccaaaggauucgauuuuaagaccuguaacgugcugguugcccuugaacagcagucccccgacauugcucaaugcgugcaccuggaucgcaaugaggaggacgucggcgccggcgaccaggggcucauguucggauacgcuacagaugaaaccgaggaauguaugccucugacaaucauccuggcccauaagcucaacgcgagaauggccgaccugcggcgcucuggccuucugcccuggcucagaccugauagcaaaacccaggugacggugcaguauaugcaagacaauggggcugucauucccguucggauccacaccauugugaucuccgugcagcacaacgaggauauuacacuggaggaaaugcgcagagcccuuaaggagcaggucauccgggcugugguuccugccaaauaccuggacgaagauaccguguaucaucuccagccgagcggacgcuuugucauuggcgggccccaaggagacgcgggcgugacaggcagaaagaucaucguugauaccuacgggggauggggcgcccacgggggaggcgcuuucucugggaaagacuauacgaagguggaucgguccgccgcuuacgccgcccgcugggucgcuaagagccuggugaaagcgggacugugcagacggguccucgugcagguuucuuacgccauuggcguggcugagccucuguccaucagcauuuuuacauauggcaccucucagaagacagaacgcgagcuucuggacgucgugcauaaaaauuucgaccucagacccgggguuaucgugcgggaucuggaccuuaagaaaccuauuuaccaaaagaccgccuguuauggacacuuuggcagauccgaguuccccugggaagucccgcgcaaacugguguuuuga

SEQ ID NO: 71900 - RNA, 1188 nt, Artificial Sequence
  derived and/or modified sequence opt5 from MAT2A__Homo_sapiens__NP_005902
augaacggccagcugaauggguuccacgaggccuuuaucgaagagggaaccuuccucuuuacaagcgaauccgugggcgaggggcaucccgacaagauuugcgaucaaaucucugacgcuguccuggaugcccaccuucagcaggacccugaugcgaaaguugcuugugaaacgguggccaagaccggaaugauucugcucgccggcgagaucacaagcagagcugccguggacuaccagaaagucgugcgggaggcuguuaagcauauuggguaugaugacuccucuaaaggauucgauuacaagaccugcaacgugcuggucgcccuugaacaacagagcccggacaucgcgcagggcgugcaccuggaucgcaaugaggaagacaucggcgccggggaucagggacucauguuuggcuaugcuacagacgagaccgaggaauguaugccccugacaauuguucuggcccauaagcucaacgcuaaacuggccgagcuuagacggaaugggacccugccuuggcuccgccccgacuccaagacgcaagugaccguccaguacaugcaggauagaggagcggugcugccuauccgggugcacacaauugucaucucuguucagcacgacgaagaggugugccuugaugaaaugcgcgacgcccugaaagagaaggugauuaaagcugucgugcccgccaaguaucucgaugaggacaccaucuaccaucugcaaccuagcggcagauucguuauugggggaccgcagggcgaugcuggccugacagggcggaagaucaucguggacaccuauggaggcuggggagcccacgggggcggggccuuuuccggaaaagauuacacgaaggucgaccgcagcgcugcguacgccgcuagauggguggccaaaucucucguuaagggcggccugugucggcgcgugcuuguccagguguccuaugccauuggggucagccauccccugucuaucuccauuuuccacuacggaacaagccaaaaaucugaaagagagcuccuggaaaucgugaagaaaaacuuugaucuucggccuggcguuauugugcgcgaccuggaccucaagaagcccaucuaucagagaaccgcugccuacgggcacuucggacgggauuccuuuccuugggagguccccaaaaagcugaaauauuga

SEQ ID NO: 71901 - RNA, 1005 nt, Artificial Sequence
  derived and/or modified sequence opt5 from MAT2B__Homo_sapiens__NP_037415
auggugggcagagagaaggaacugagcauccacuucguccccggguccugccggcucguugaggaagaggugaacauuccuaaucgcagagugcuggucaccggagccacaggccuucuggggcgggcugugcauaaagaauuucagcaaaacaauuggcacgccguuggauguggcuuccgcagagcgcggccgaaguuugaacaggugaaccuccuggacucuaaugcuguccaucacaucauucaugauuuccagccccacgugaucguucacugcgccgccgagcgcagaccugacguggucgagaaccagcccgaugcugccagccaacuuaauguggacgcuuccgggaaccuggccaaagaggcggccgcugugggagccuuucucauuuacaucucuagcgauuaugucuucgacggcacgaauccucccuaccgggaagaggauaucccugcuccgcugaaccuguauggcaagaccaaacucgacggggagaaggccguucuggaaaauaaccuuggagcggccgugcugcgcauucccauccucuacggcgagguggaaaagcuggaggaauccgcugucacagugauguuugauaaaguucaguucucuaauaagagcgccaacauggaccauuggcagcagagauuuccuacccacgugaaagaugucgcuacagugugucggcaacuugccgagaagcgcaugcuggaccccuccauuaaagggaccuuccauuggagcggaaaugagcagaugacaaaguaugaaauggccugcgcuaucgcggaugccuuuaaccucccuucuucccaccugagacccauuaccgacagcccgguucugggcgcucagcggccucgcaacgcccagcucgacuguucuaagcuggagacgcuugggaucggacaaagaacccccuuccggauuggcaucaaagaaucccuguggccuuuucucaucgauaagagauggcgccagacaguguuccacuga

SEQ ID NO: 71902 - RNA, 1527 nt, Artificial Sequence
  derived and/or modified sequence opt5 from MATK__Homo_sapiens__NP_002369
augcagggccacuuccccgccgagagacgggaagggcgcccuagacggggaacccgcggccaacagcagcugcucgugagcccgagauuucugcgggcuuggcaucccccucccgucuccgcccgcaugccuacaagacggugggcgcccgggacgcagugcaucaccaagugugagcacacacgcccuaaaccgggagaacuugcuuucagaaagggcgacguugugaccauucuggaggccugcgaaaacaaaucuugguaccgggugaagcaucacacaagcgggcaagagggacuccuggccgcuggcgcccuucgcgagagagaagcucuguccgccgaucccaaacucucucugaugccuugguuucauggcaagaucagcgggcaggaggcgguccagcagcugcaacccccugaagacggacucuuccuggugcgggaguccgcccgccaccccggcgauuauguucuuugugugucuuuugggagagacgucauucacuaccgggugcugcauagagauggacaccucaccaucgacgaggcuguuuucuuuugcaaucugauggauaugguggaacauuauagcaaggacaaaggcgccauuuguacaaaacuuguccgcccgaagcggaagcacgggaccaaauccgcugaggaggaacuggccagagcgggauggcuccugaaccugcagcaccucacgcugggcgcccagaucggcgaaggggaguucggagcugugcuucagggcgaguaccuggggcaaaagguggccgucaagaauaucaaaugcgauguuaccgcucaggccuuucucgacgaaacagccgugaugaccaagaugcagcaugagaaccuggugcgccuucugggagucauucuccaccaaggccuguauaucgugauggaacauguuagcaaagggaaucuggugaacuuccuccggacaagaggacgcgcucuggucaauaccgcgcagcuucugcaguuuucucuccacguggccgagggcauggaauaccuggaguccaagaaacuuguucaucgggaucuggcugccagaaacauucucgugagcgaggaccuggucgccaaggugucugauuucggccuggcuaaagccgaacgcaaggggcucgacuccagccggcugccugucaaguggacggcgcccgaggcucuuaaacacggaaaguuuacaucuaaauccgacguguggagcuucggcguucugcucugggaaguguucuccuaugggagagccccuuaccccaagaugucucugaaagaggucagcgaagccguggagaagggauaccgcauggagcccccugaaggcuguccggggcccguucacgugcugauguccagcugcugggaggcugaaccugcccggagacccccuuuucggaaacuugcugagaagcucgcccgcgagcugagaucugcgggcgcccccgcuuccgucagcggacaggaugccgacggcucuaccagcccgcggucccaagaaccuuga

SEQ ID NO: 71903 - RNA, 2871 nt, Artificial Sequence
  derived and/or modified sequence opt5 from MATN2__Homo_sapiens__NP_002371
auggagaagaugcuggccggcugcuuccuccugauccuugggcagauugugcugcuccccgcugaagccagagagcggagccgcggaagauccaucucucggggccgccacgcgagaacccauccucaaacagcucugcuugaaagcuccugugagaacaaacgggccgaccuggucuuuauuaucgauucuagccgcuccguuaauacgcacgacuacgccaaggugaaagaguucauuguggauauccuccaguuucuggacaucgggccggaugucaccagagugggacugcuccaguauggcucuacaguuaagaacgaguucagccugaaaaccuuuaagcggaaguccgagguggaacgcgcugucaaaagaaugcggcaucuuagcacagggaccaugacaggacuggccauucaguacgcucucaauaucgccuucucugaggcggaaggcgcccgcccccugagagagaacgugccucggguuauuaugaucgugaccgacggccgcccccaagauuccgucgcugagguggccgcuaaggccagagacacggggauucuuaucuuugcgauuggagugggccaggucgauuucaauacccugaaaagcaucgggucugaaccucacgaggaccauguuuuucucguggccaacuucucccagaucgaaacacugaccagcguguuucagaagaaacugugcacagcucacauguguucuacccucgagcacaauugcgcccauuucuguauuaacauccccggauccuaugucugccgguguaagcaaggcuacauucugaauagcgaucagacgacaugcagaauccaggaccuuugugcuauggaagaucacaacugcgagcagcugugugugaauguuccuggguccuuugugugccaaugcuauucuggauacgcccucgccgaggacggcaagcgcugugucgcuguggacuauugcgcgagcgaaaaccauggcugugagcacgaaugcguuaaugccgauggguccuaccugugucagugccacgagggauucgcucuuaacccggacaaaaagaccuguacaaaaauugauuacugcgccagcucuaaucauggcugucagcacgaaugcgugaacaccgacgauuccuauagcugucauugccugaagggguucacccucaaccccgacaaaaagacaugccggagaaucaauuacugugcccugaacaaaccuggaugcgagcacgagugugucaauauggaagagucuuauuacugccgcugucaucggggcuauacgcuggaucccaacgggaagaccugcagcagaguggaccacugugcucaacaggaucacggaugcgaacagcucugucugaauacagaggacuccuuugucugccaguguucugaaggcuuccuuaucaacgaggaucugaagaccugcagccgcguggacuacugccuccuguccgaccauggcugugaguauagcugcguuaauauggaucggucuuuugccugucaaugcccugaagggcacgugcuuagauccgacggaaaaacaugugcgaagcuggauagcugcgcucucggcgaccaugggugugagcacucuugcgucuccagcgaagauuccuucgugugucagugcuuugagggauacauucugcgcgaggacggcaaaaccugucggagaaaggauguuugccaggccaucgaccacgggugcgaacauauuugugugaacucugaugacagcuacacgugcgagugucuggaaggcuuccgccucgccgaggauggaaaacggugcagacggaaggacgucuguaaguccacacaccauggcugcgaacacaucugugugaauaacggaaauucuuauauuugcaaauguagcgagggguuugugcuggcugaggauggccgcagaugcaagaaauguaccgaagggcccaucgaccuuguuuucgucaucgacggauccaagagccugggcgaggaaaacuuugagguggugaaacaguucgucaccgggauuaucgauucucucacaauuuccccgaaggccgcucgggugggccugcugcaauacagcacccagguucauacagaauuuacgcuuagaaauuucaacucugccaaggacaugaaaaaggcgguggcccacaugaaauauaugggaaagggcuccaugaccgggcucgcucugaaacacauguuugagcgcagcuucacacagggagagggcgcccggccucugucuaccagagucccccgcgcugccaucguguucacagaugggagagcgcaggacgauguuagcgaaugggccuccaaggcuaaggccaauggaauuaccauguacgcugugggcgucgggaaagccaucgaggaagaacuccaagaaauugccagcgagccuacgaacaagcaucuguuuuaugcugaggacuucucuaccauggaugaaaucuccgagaaacuuaagaaaggcaucugcgaagcgcuggaggacagcgauggacggcaggacucccccgccggcgagcuccccaagacagugcagcagccuaccgaaucugagccgguuacaauuaacauccaagaucugcugagcugcuccaauuuugcugugcagcaccgcuaccuuuucgaagaggacaaccuccugagaucuacccagaaacugagccauuccacgaagcccucugggagcccucucgaagagaagcacgaucaauguaaaugcgagaaucugauuauguuucagaaccuugccaaugaagagguccggaagcugacacagcgccucgaagagaugacccagagaauggaagcccuggagaaccggcugcgcuauagauga

SEQ ID NO: 71904 - RNA, 1461 nt, Artificial Sequence
  derived and/or modified sequence opt5 from MATN3__Homo_sapiens__NP_002372
augcccagaccugccccggcucggcgccugcccggccuccugcuucugcucuggccucugcuucugcuccccagcgccgcgccugaccccguggcuagaccuggguuccggcgccuggagaccagaggaccgggcgggucccccggacggcgcccuucucccgccgccccugauggcgcucccgccagcgggacauccgaaccgggcagagcucggggagccggcgucugcaagucucgcccucuggaccucguuuuuaucauugauagcuccagaucugugcggccccuggaguucacgaaagugaagaccuuugucagccgcaucauugacacacuugauaucgggccugcggacaccagaguggccguugugaacuacgcuuccacagucaaaauugaguuccagcugcaagccuauaccgauaagcagagccucaaacaggcugugggacggaucacaccccugucuaccggcacgauguccgggcuugccauccagaccgcgauggacgaggccuuuacaguugaagcuggagcccgcgagcccagcucuaauauuccuaagguggcuaucauugucaccgauggcagaccgcaagaccaggugaacgagguggccgcccgggcucaggcguccgggaucgaacuguacgccgucggaguugauagagcugacauggccagccucaagaugauggccucugagccccuggaagaacacguguucuauguggagacauacggcgucauugaaaaacuguccagccgcuuucaggagaccuucugugcucucgauccuugcgugcugggcacgcaucaaugucagcacguuugcaucuccgacggggaaggaaagcaucacugugagugcucucagggcuauacacuuaaugccgacaaaaagaccuguagcgcgcuggaucggugcgcucucaacacacaugggugugaacacauuugcgugaaugacagauccggaagcuaccacugugagugcuaugagggcuacacccugaacgaagaucgcaaaaccugcucugcccaggacaagugugcccuugggacacauggaugccaacacaucugugucaaugaucggacgggcucccaucacugcgaguguuacgaaggcuauacccugaacgcugacaagaaaacaugcagcgugagagauaagugugcccucgggucucacggaugccagcauaucuguguuagcgacggcgcugccuccuaccacugcgauuguuaucccggguacacccugaaugaggacaaaaagacaugcucugcgaccgaagaggcccgccggcuggugagcacggaggaugcuugcggaugugaagccacacucgcuuuucaggacaaagucuccagcuaucugcaaagacuuaacaccaagcuggacgauauucucgagaaacugaagaucaaugaauacggccagauucaucgcuga

SEQ ID NO: 71905 - RNA, 2544 nt, Artificial Sequence
  derived and/or modified sequence opt5 from MATR3__Homo_sapiens__NP_001181883
augagcaaguccuuccagcaaucuagccuguccagagacucucagggccacgggcgggaucucagcgccgcuggaaucggccugcuugccgcggcuacccagucccugucuaugcccgccagccucgggcgcaugaaccagggaacagccagacuggcuucccuuaugaaucugggcaugucuagcucccucaaccaacagggggcccauagcgcucugucuuccgccagcacgucuucccacaaucugcagagcauuuuuaacaucggaucccggggcccucucccgcugucuagccagcaucgcggcgacgcggaucaagccuccaauauucuugcuagcuucgggcugucugccagagaccucgaugagcugucccgguaccccgaagacaaaaucaccccugagaaccuuccccagauucugcuccagcugaagcgcagacggacagaagagggaccuacccugagcuauggccgcgaugggagaucugcuacacgggaacccccuuaccgcgugccgagagacgauugggaggagaaacggcacuuucgcagagacagcuucgaugaccggggacccucccucaauccuguccuggauuaugaccauggcucuagaagccaggaauccggguacuaugaccgcauggauuacgaggacgaucggcuuagagacggagaacgcugccgggaugacagcuuuuucggcgagaccucucacaacuaucacaaguuugauuccgaguacgaaagaaugggccgcgggcccggaccucugcaagagcggagccucuucgaaaagaagagaggcgcucccccgucuuccaauaucgaggacuuucaugggcugcuuccuaagggauacccccaccugugcagcaucugcgaucucccuguucauuccaacaaagaauggucucagcacauuaauggcgcgagccacucccgccggugucagcugcugcucgagaucuaucccgaguggaaccccgacaaugauacagggcauaccaugggagacccuuucaugcugcaacagucuacgaacccggcccccggcauucuuggcccucccccucccagcuuucaccuugggggaccggcugugggcccuagagggaaucucggagccggcaacgggaaccugcagggcccccgccauaugcagaagggacggguggaaaccuccagagucgugcacaucauggacuuccaacggggcaaaaaucuucgcuaccagcugcuccagcugguugagccuuuuggggugauuagcaaccaucugauccucaauaagauuaacgaagccuucaucgagauggccacaaccgaagaugcccaggcugcggucgacuauuacacaaccacgcccgcccugguguucggaaaaccuguuagagugcaccuuucucaaaaguauaagcggaucaaaaagcccgagggcaaaccggaucagaaguuugaccagaaacaggagcuggggagagucauucaccucuccaaucugccucauagcggauacucugauuccgcugugcugaaacuugccgaacccuauggcaaaaucaagaacuacauucucaugcgcaugaaaagccaagccuucaucgagauggaaacacgggaggacgcuauggccaugguggaucacugccugaagaaggcgcugugguuucaggggagaugugucaaaguugaccucucugaaaaguacaaaaagcuggugcuucgcauucccaauagaggcaucgaucugcucaagaaagacaagagccggaaacgcuccuauagcccugauggaaaggagucuccguccgacaaaaagagcaagaccgauggcucccagaaaacagagucuagcaccgaagggaaggagcaggaagagaaauccggagaggacggcgaaaaggacaccaaagaugaccaaacagagcaggaacccaacaugcugcuggagucugaagaugagcuucucguggacgaggaagaggcugccgcccugcuggaaagcggguccucugucggagaugagacggaccucgcuaaucugggcgauguggccagcgacgggaagaaggaaccuuccgauaaagcuguuaagaaagacggcagcgccucugcggccgcuaagaaaaagcugaaaaagguggauaagaucgaggagcuggaccaggaaaacgaggccgcucucgaaaauggaauuaaaaacgaggaaaauaccgagcccggcgccgaguccagcgaaaacgcggaugacccuaauaaggacacaucugagaacgccgaugggcaauccgacgaaaacaaagaugacuacaccauccccgaugaguauagaauuggaccuuaccagcccaaugucccggugggcaucgacuauguuauuccuaagacaggguucuacugcaaacuguguagccuguuuuauaccaacgaggaaguggcuaagaauacgcauuguucuucccuuccccacuaccagaagcucaaaaaguuccugaacaaacuggccgaggaacggcgccagaagaaagagacauga

SEQ ID NO: 71906 - RNA, 1842 nt, Artificial Sequence
  derived and/or modified sequence opt5 from MAU2__Homo_sapiens__NP_056144
auggccgcucaggccgcggcugccgcccaagcugccgcugcccaggcggcccaggcugaggccgcugacagcugguaccuggcccuccugggcuucgcggaacacuuuagaaccuccucucccccuaagauccggcuuugcgugcauugucugcaggccgucuucccguuuaaacccccucaacgcauugaggcuagaacacaccuccagcuggggagcguucuuuaucaucacacgaagaacuccgaacaggcccggucucaucuggagaaggcuuggcucaucagccagcaaauuccccaguucgaagaugugaaguuugaggccgccucccugcugucugagcucuacugccaggaaaauagcguggacgcugcgaaaccucugcuucgcaaggccauccagauuucccaacagacccccuauuggcacuguagacuccuguuccagcuggcucaacuucacacacuggagaaggaucucgucagcgccugcgaccugcugggagugggcgccgaauacgcucggguuguggggucugaguauacccgcgcccucuuucugcuuuccaaaggaaugcugcuccugauggagagaaaacuucaggaaguccauccucugcucacacuguguggccagaucguggagaacuggcaggggaauccgauccaaaaagaaagccugcggguuuucuuucucgugcugcaggucacccacuaccuugaugcgggacaggugaagucugugaaacccugccugaagcagcuccaacaguguauucagacaaucuccacccugcaugacgaugagauucuuccuagcaaccccgcugaccuguuccacuggcucccuaaggaacacaugugcguccugguuuaucuggugacggugaugcauucuaugcaggccggcuaccucgagaaagcccaaaaguacaccgauaaagcucugaugcagcuugagaagcugaaaaugcucgacuguucccccauccugagcuccuuucaggucauucugcuugaacacaucauuaugugccgccucgugacaggccauaaggccaccgcucugcaggagaucucucaaguuugucagcugugccagcaaagcccgagacucuucuccaaucacgccgcgcagcugcauacacuucuggggcucuauugcgugagcgucaacuguauggauaaugccgaagcucaguuuaccacggcccugcggcugacaaaccaccaggagcuuugggcuuucaucgugaccaaucucgccucuguuuacauucgcgaaggaaacagacaccaagaggugcuguauucccugcucgagcggaucaauccugaccauagcuuccccgucucuagccacugccugcgcgcggccgcuuuuuacgugagaggccuuuucuccuuuuuccaggggcgguauaacgaagccaaaagauuucugcgcgagacacucaagaugucuaaugcugaagaucugaaccggcugaccgccuguagccuuguccuccugggacauauuuucuacgugcugggcaaucacagagaguccaacaacaugguugugccugccaugcagcucgcuagcaagauccccgacaugucuguccagcugugguccagcgcgcuucugcgcgaccucaauaaagccugcgggaacgcuauggaugcccacgaagccgcucaaaugcaucagaauuuuucucagcagcugcugcaagaccacauugaggccuguucccuucccgagcauaaccucaucaccuggacagauggaccuccgcccgugcaguuccaggcgcaaaauggcccuaacacgagccuggcuucccugcucuga

SEQ ID NO: 71907 - RNA, 1200 nt, Artificial Sequence
  derived and/or modified sequence opt5 from MAVS__Homo_sapiens__NP_001193420
augcccgugcaggagacccaagccccugaaagcccgggcgagaacuccgaacaggcucugcagacacucucucccagagccaucccucggaaucccgacgggggaccucuggagagcuccucugaucuugcggcucugagcccccucacguccucuggccaccaggaacaagacaccgagcuggggagcacacauaccgccggagccacauccagccuuaccccuucucgcggcccggucucccccagcguuucuuuccagccucuggcuagauccacaccccgggccagccgccucccugggcccaccggaucugugguguccacgggcaccagcuuuuccucuagcuccccgggccuggcuagcgccggggcggccgagggaaagcagggcgcugaaucugaucaggccgagccuauuaucugcuccagcggggcugaagcccccgcgaacucucugccuagcaaaguccccacaacccucaugcccgugaauacaguugcccugaaggugccugcuaacccggccuccgucucuaccgugcccagcaaacuuccuacguccagcaagcccccuggagcuguucccucuaaugcccugacaaacccggccccuuccaaacuccccauuaauagcaccagagcuggcauggugccuucuaagguccccacauccauggugcugaccaaggugagcgcguccaccgucccuacagacgggucuagccggaacgaggagacgcccgccgcuccgaccccugccggagccacaggcggcuccucugcuuggcuugauagcuccagcgaaaaucgcgggcugggaucugagcucuccaaacccggcguucuggccagccaaguggacucucccuucuccggguguuuugaagaucuggcgaucagcgcuucuaccagccucggaaugggcccuugccacgggccggaggaaaacgaguacaaguccgagggaacauucggcauucauguggccgaaaaucccagcauccagcugcuugagggcaacccugggcccccugccgaccccgauggaggcccuagaccccaggcugaccggaaauuucaggaacgcgaggucccgugucacagaccuucucccggggcccuguggcuccaaguggcuguuaccggagugcuggucgugacgcuucugguugugcucuaucggcgcagacugcauuga

SEQ ID NO: 71908 - RNA, 483 nt, Artificial Sequence
  derived and/or modified sequence opt5 from MAX__Homo_sapiens__NP_002373
augagcgacaacgaugacaucgaaguggaauccgaugaggaacagcccagauuccaaucugccgcugacaagcgggcccaccauaaugcgcuggagcgcaaaagacgggaucacauuaaggacagcuuucauucccuccgcgauucugucccuagccugcagggcgaaaaggcuuccagagcccagauccuugacaaagccaccgaguacauucaguauaugcggcgcaaaaaccacacacaucaacaggauaucgacgaucugaagagacagaaugcucuccuggagcagcaaguucgggcccuugaaaaggcucgcucuagcgcccagcugcagacgaacuacccguccagcgacaauucucucuauaccaacgcgaaaggguccacaauuagcgccuucgauggaggcucugacuccagcucugaguccgaacccgaggagccucagagcagaaagaaacugcggauggaggcuuccuga

SEQ ID NO: 71909 - RNA, 1482 nt, Artificial Sequence
  derived and/or modified sequence opt5 from MAZ__Homo_sapiens__NP_001036004
auguuccccguguuuccuugcacccugcucgccccgcccuucccuguccugggccuugacagcagagggguuggaggccugaugaacuccuuucccccuccccaggggcacgcucaaaauccucuccaggugggagccgagcugcagucucgguucuuugcgagccagggcugugcucaauccccguuccaggccgcccccgcuccucccccuacaccccaggccccggcugccgaaccucuucagguggaucugcuccccguccuggcggccgcucaagagucugccgcugccgcggccgcugccgcugccgccgcugcggccguggcugccgccccucccgcucccgccgcggcuagcacgguugacaccgccgcccugaagcagccuccggcucccccucccccucccccgccuguguccgcccccgcugccgaagcggccccucccgcuucugccgcuacaaucgccgcggccgcugccaccgcugucguggccccuacaagcaccguugccguggcucccgucgcguccgcccucgagaaaaagacaaaaagcaaggggccguacauuugcgcucugugugccaaagaauuuaagaacggauauaaucuucgcagacaugaggccauccacaccggcgcuaaggccggccgggugccuucuggggcgaugaaaaugcccacgauggugccccugucccuccugagcgucccucagcuuucuggagcuggcgggggaggcggggaggccggagccggcggcggggcugccgcgguugcugccggaggcguggugaccacaaccgccuccgggaagcgcauucggaaaaaccaugcuugcgaaauguguggaaaggccuucagagaugucuaccaccugaaucgccauaaacucagccacucugacgagaagccguaucagugccccgugugucaacagagauuuaagcggaaagaucgcauguccuaccacguuagaagccaugacggcgcugugcacaagccuuauaacugcucccauugugggaaaucuuucagccggcccgaucaccucaauucccacguccgccaggugcauagcacagaaagaccuuuuaagugcgagaaaugugaggccgcguucgccaccaaggaccggcugcgcgcucacacgguuagacaugaagagaaagugcccugccacgucugcggaaagaugcugucuuccgccuacaucagcgaucauaugaaggugcacucucaaggcccucaccaugucugugaacugugcaacaaaggcuuuacaaccgcugccuaucuucggauucacgccgugaaggaccaugggcugcaggcucccagagcggaucgcauccucuguaaacugugcagcguucacuguaagacaccggcccagcuugcuggacacaugcagacccaucugggcggggccgccccucccgugccuggagacgcuccccaaccgcagccuaccugcuga

SEQ ID NO: 71910 - RNA, 1569 nt, Artificial Sequence
  derived and/or modified sequence opt5 from MB21D1__Homo_sapiens__NP_612450
augcagcccuggcacggcaaggccaugcaaagagcuagcgaggccggggcgaccgcuccuaaagccuccgcccggaacgcucgcggagccccgauggaccccacagaaucuccugcugcccccgaggcggcccugccuaaggcuggcaaauucgggcccgccagaaagagcggaucccggcagaaaaagucugcuccugauacgcaggaacgcccgcccgugagagccaccggcgcgcgggccaagaaagcuccucagcgcgcccaagacacacagcccagcgaugcuaccuccgccccuggggccgagggacucgaacccccggcugcgagagagccugcccugucucgggcuggcagcugccgccagagaggcgcccgguguuccacaaagccccgcccuccucccgggcccugggacgucccgagccccggacuuccuguuucugcccccauccuggugagacgggaugcugccccuggcgcguccaaacuccgcgcugugcuggagaaacuuaagcugagcagagacgauauuucuaccgccgccgggauggucaagggagugguugaccaucuccugcugcggcucaagugcgauuccgcuuuuagaggcguggggcugcuuaauacaggaagcuacuaugaacacgucaaaaucucugcccccaacgaguucgacgugauguuuaagcuggaaguuccgcgcauucagcucgaggaguacuccaauacccgggcuuauuacuucgugaaauuuaagagaaacccuaaagaaaauccccugagccaauuccuugagggcgaaauccuguccgccucuaagaugcucagcaaauuucgcaagauuaucaaggaggaaaucaacgauauuaaagacacggaugucaucaugaagcggaaaagaggcggguccccugcggugacccugcugauuagcgagaagaucucuguggacauuacacucgcccuggaguccaaaagcucuuggcccgcuagcacccaggaaggacuucgcauccagaauuggcuguccgccaagguccggaagcagcucagacugaaaccuuucuaucuuguucccaagcaugcuaaagagggcaacggguuucaagaagagacauggcgccugucuuucagccacauugaaaaggagauccucaauaaccauggaaaauccaagaccuguugcgagaauaaggaagagaaauguugccggaaggacugucugaaacugaugaaguaccuccuggaacagcuuaaagagagauuuaaggauaagaaacaccuggacaaguucagcucuuaucacgugaaaacggccuuuuuccaugugugcacacagaacccgcaagauucccagugggaccgcaaggaucucggccuguguuucgacaauugcgucaccuacuuucuucagugucugcggacagaaaaacucgagaacuacuucaucccugaguuuaaucuguucagcucuaaccugauugauaagagauccaaagaauuucucaccaagcagaucgaguaugaacggaacaaugaguuccccguguuugacgaguucuga

SEQ ID NO: 71911 - RNA, 1476 nt, Artificial Sequence
  derived and/or modified sequence opt5 from MB21D2__Homo_sapiens__NP_848591
augaagauggccgcucccaccgccaacaaagcggcuagccuggggugcaauaacaagccugccuucccggagcucgacuuuagauccggggcccggguggaagaacugaauaaacuuauccaggaguucacaaagcacgaucaacgcgaguacgacgaucagagagcucuggaaauucauacggccaaagacuuuaucuucucuaugcucggaaugguccagaagcuggaucagaagcugcccguugcuaacgaguaucugcuccugagcggcggggugcgggagggaguggucgaccuggaucucgacgaacugaauguguacgcccgcggcaccgauuaugacauggauuuuacacuucugguuccugcgcucaaacugcacgacagaaaccaacccgugacccuugauaugcggcauuccgcccugugucacucuuggcucagccugcgccuguucgacgaggggacaauuuccaaguggaaagacugcuguaccaucgucgaucauauuaauggagcuacaaacuacuuuuucucuccuaccaagguggccgacugguuuuaugauagcaucuccaucguucucagcgaaauucagaaaaagccccagagaggcaugccuaagguggagaaagucgagaagaauggcacgaucauuucuaucauucugggggugggauccagccggaugcuuuacgacaucgugccggucguuucuuucaaaggcuggcccgcuguggcccaguccuggcugauggaaaaccacuuuugggaugggaagauuaccgaggaagaggugaucagcggauucuaucucgucccugcgugcucuuacaaaggcaagaaagacaaugaauggcgccuguccuuugccagaagcgaggugcaacuuaagaaguguaucuccucuagccugaugcaggcuuaccaggccugcaaagcuauuaucauuaagcuccugucccggcccaaagccaucagcccuuaucaccuucgcucuaugaugcucugggccugugauagacugcccgcuaacuaccuugcgcaggaggacuaugccgcucauuuccugcucgggcugauugaugaccuucaacacugccugguuaauaagauguguccgaacuacuucaucccucagugcaauaugcucgaacaucuguccgaggaaacagugaugcugcacgcccggaaacucagcucuguccgcagcgaucccgccgagcaccugagaaccgcuaucgaacaugugaaggccgcgaaccggcuuacacuggagcuccagagacgcggauccaccacgucuauuccuagcccccaauccgacggcggcgaccccaaccagccugaugaccggcuggcuaagaaacugcagcagcuuguuacagagaauccgggcaagagcaucucuguguuuauuaaccccgaugacgucaccagaccucacuuccgcaucgaugacaaauuuuucuga

SEQ ID NO: 71912 - RNA, 1968 nt, Artificial Sequence
  derived and/or modified sequence opt5 from MBD1__Homo_sapiens__NP_001191065
auggccgaggacuggcuggauugccccgcucucggcccuggguggaagagacgggaaguguuccgcaaaagcggagccaccuguggcagauccgacacauacuaucagucuccgacgggggaucggauccgcagcaaggucgagcugaccagauaccuuggacccgcgugcgaccugacacucuuugauuucaaacaaggcauucuguguuauccugcucccaaggcccacccuguugccguggcuuccaaaaagcggaagaaacccucucgcccugccaagaccagaaaacgccagguggggccgcagagcggagaaguccggaaggaggcucccagagacgaaacaaaagccgauaccgacacagcgccugccuccuuucccgcuccuggcugcugugagaacugcggcaucucuuucagcggggauggaacccagcggcaacgccuuaagacgcuguguaaggacugcagagcccagcggauugcuuuuaaucgcgagcagagaauguucaaacgggugggcuguggggaaugcgccgcgugucagguuaccgaggauugcggagccugcuccacaugucuccugcaacugccccaugacguggcuagcggccucuuuugcaagugugaaagacgccggugccugagaaucgucgagcgcucucggggguguggagugugcagaggcugucagacccaggaggauugcggccacuguccgauuugccuucgcccuccccggccugggcugagacgccaguggaaauguguucaacggagaugccuccgcggaaagcaugcccggagaaaaggcgggugcgacuccaagauggcugcccggcgcagacccggagcccagccccugccuccgcccccucccagccagucuccugaacccacagagccgcacccucgggcucuugcgcccuccccucccgccgaguucaucuacuauuguguggacgaagaugaacugcaaccuuacaccaacagacgccagaaucggaaaugcggcgcuugugccgccugccucagacgcauggacugugggagaugcgauuuuuguugcgacaagcccaaguucggaggcagcaaccagaaacggcagaagugucgcuggagacaaugccugcaguuugcuaugaaacggcugcucccgucugucugguccgagagcgaggauggcgccggguccccuccucccuaucgcagacggaagcgccccucuagcgcgagacggcaucaccugggaccgacgcuuaaacccacacuggcuacccgcacagcccagccugaccacacccaggcccccaccaagcaagaagcuggcgggggauucgugcucccucccccuggcacagaucugguguuucuuagagagggggccuccagccccguccagguuccgggcccuguggcugccucuacggaagcgcugcuccaggaggcccaguguuccggacugagcuggguggucgcucugccccaagugaagcaggaaaaagccgacacccaggaugaguggacaccuggcaccgcuguucucacaucucccgugcuggucccggggugcccuagcaaggccguggaccccggacuuccuuccguuaaacaggagccucccgaucccgaagaggacaaggaagagaauaaagacgauucugcgagcaagcuggccccggaagaggaggcuggcggggccggaacccccgugaucacggaaauuuucucccucggcgggacacgguucagagacaccgcugucuggcugccuagccuucaaggccgccauucuggacgggaggauggcugcaaggugugggaaaccgaggacacagucgagcccaccuccacaagcuggaacccuagaggguggcccggaacgcacgugucucuguccccuccgcccgccagcaugauguggguuuccugucgccggucuuggugcccuagcucccagucuuga

SEQ ID NO: 71913 - RNA, 1236 nt, Artificial Sequence
  derived and/or modified sequence opt5 from MBD2__Homo_sapiens__NP_003918
augagagcccaccccggcgggggacggugcuguccugagcaggaagagggcgaaagcgcugccgggggauccggcgcugggggagacucugcgaucgagcaaggcggccaggggagcgcccuggccccgucccccgugucuggaguccgcagagaaggcgcucgcgggggaggccgggggagaggacgguggaagcaggccggccgcggcgggggaguuugcggcagagggcggggacgcggcagagggcggggacgcggcagaggccgggggcgcggaagaggccggccucccagcgggggauccggccucgggggcgauggaggcggguguggaggcgggggaucuggcgggggcggagcuccuagacgcgagcccgugccuuucccgagcggcuccgccgggcccggaccucggggccccagagcgaccgagagcgggaaacgcauggacugcccugcccugcccccgggauggaagaaagaagaggugauucggaagucuggccuuuccgcugggaaaagcgaugucuacuauuuuucuccuuccggcaagaaguucagaagcaaaccccagcuggcccgcuaccucggaaacacaguggaccugucuuccuuugauuuccggacgggcaagaugaugccuagcaaacuucaaaagaauaaacagagacugcgcaacgacccccucaaucagaacaaggggaagcccgaucugaauaccacacugccuauccggcagaccgcuuccauuuuuaaacaaccgguuacaaaggugaccaaccaucccucuaauaaagucaagagcgacccucagagaaugaacgaacagccccgccaacucuucugggagaaacggcugcagggacuuuccgccagcgaugugacagagcagaucauuaagaccauggaacugccuaaaggccuccaggggguuggacccggcucuaaugacgagacgcugcuuuccgcgguggccagcgcucugcacaccucuagcgccccgaucacagggcaagucuccgcugccguggaaaagaacccugccguguggcucaauaccucucagccccuguguaaggcuuuuaucgucacagaugaggacauuagaaaacaggaggaacggguucagcaagugcgcaagaaacuggaggaagcgcucauggccgauauccugagcagagcugccgacaccgaggaaauggacauugagauggauuccggcgacgaagccuga

SEQ ID NO: 71914 - RNA, 876 nt, Artificial Sequence
  derived and/or modified sequence opt5 from MBD3__Homo_sapiens__NP_001268382
auggagagaaagcggugggaaugccccgcccugccucagggcugggagcgcgaagaggugccgagacggagcgggcucuccgcuggacaccgcgacgucuucuacuauucucccagcggcaaaaaguuuagauccaaaccucaacuggcccgguaccuugggggaucuauggaucugagcaccuucgacuuucgcacaggcaagaugcucauguccaaaaugaacaagucuagacagcggguucgcuaugauagcuccaaucaggugaaggggaaacccgaccugaacacggcgcuuccugugagacagaccgcuagcaucuucaagcaacccgucacaaaaauuaccaaucauccuucuaacaaggugaaauccgauccgcagaaggccguugaccagccccggcagcuguuuugggaaaagaaacucagcggacugaaugccuucgauaucgcugaggagcuggugaagacaauggaccucccuaaaggccugcaaggcgucgggcccggauguaccgaugaaacacuucugucugccauugcuuccgcccuccacaccagcacgaugccuaucaccggccagcugucugcggccguggagaagaaccccgggguuuggcuuaauacaacccagccgcugugcaaggcuuuuauggugacagacgaagauauucgcaaacaggaggagcucguccaacaggugagaaaacggcuggaagaggcccugauggcugacaugcucgcccauguggaggaacuggcgcgcgauggagaagccccucuugacaaggcuugugccgaggacgaugacgaggaagaugaggaagaggaagaggaggaacccgacccugaucccgagauggaacacgucuga

SEQ ID NO: 71915 - RNA, 627 nt, Artificial Sequence
  derived and/or modified sequence opt5 from MBD3L2__Homo_sapiens__NP_653215
augggcgagcccgccuucaccagcuuuccuucccugccggugcucgggaagcugaaaagaaacaugaugcccugggcucuccagaagaaacgggaaauccacauggccaaggcgcaucgcagacgggcugcccgcucugcccugccuaugagacucacaagcugcauuuuccggcgccccgucacgagaauccggucccacccugacaaucaaguucgcagacggaaaggagaugagcaucuggaaaagccccagcagcuuugugcuuaccgcagacugcaggcccuccaaccuugcucuagccagggcgagggguccucuccgcugcaccuggaaagcgugcucuccauucuggcucccggaaccgccggcgagagccuugaccgggcgggggccgagcgcgugagaucuccucuggaacccacaccuggacgguuucccgcugucgccggcggcccgaccccugggaugggaugucagcuucccccuccccuguccggccagcuugugacacccgcugauaucagacgccaagcccggagaguuaagaaagcgcgcgagcggcuggccaaggcucuccaggccgacagacuggcucgccgggccgaaaugcugaccgggggauga

SEQ ID NO: 71916 - RNA, 1725 nt, Artificial Sequence
  derived and/or modified sequence opt5 from MBD4__Homo_sapiens__NP_001263199
augggcaccacagggcuggagagccucucccugggagacagaggcgccgcucccacggugaccucuagcgaacggcuugucccugauccgcccaacgaccugcgcaaggaggauguugccauggaacucgagagagugggggaagacgaggagcagaugaugaucaaacgguccucugaaugcaauccucugcuucaagagcccauugcgagcgcucaguucggagccacagccggcaccgaaugucgcaaguccgugccuugcgggugggagagagucgugaaacagcggcuguuuggaaagacagcuggccgcuucgauguuuacuuuaucucuccccagggccucaaauucagaagcaaguccagccuggccaacuaucugcacaagaauggggagaccucucucaaaccugaagacuuugauuucacagugcuguccaagcggggaauuaaaagccgcuacaaggacuguucuauggcugcccuuaccucccaucugcaaaaccagagcaauaacucuaauuggaaccucagaacgcgguccaaaugcaagaaggaugucuuuaugccgcccagcuccucuagcgagcugcaggaaucccgcggccuuagcaauuucaccucuacacaucugcuccugaaagaggacgaagggguggaugacguuaacuuuagaaaggugcggaaaccuaagggaaaagucaccauccugaagggcauucccaucaaaaagacaaagaaagggugucgcaaguccugcagcggauucgugcagucugauagcaaaagagaguccguguguaauaaggcggacgccgagucugaaccugucgcucagaaaagccaacucgaccggaccguuugcaucuccgaugccggcgcuuguggcgagacgcugagcgugacaucugaagagaacucccuugugaagaagaaagaaagaagccugucuuccgggagcaauuuuugcuccgagcagaagaccucuggaauuaucaacaaauucuguagcgccaaggacuccgagcacaaugaaaaauaugaggauacauuucucgaaucugaggaaauuggcaccaaggucgaggugguugagcgcaaggaacaucugcacaccgacauccuuaaacgggggagcgagauggauaacaacugcucccccacaagaaaggacuucacggaagauaccauuccgcgcacacagaucgagcggagaaaaaccagccuguacuucucuuccaaguauaauaaagaggcgcucagcccuccccgccggaaggccuuuaagaaauggacaccucccagaucucccuucaaccuggugcaagaaacccuguuucacgacccuuggaagcuccugauugcuacgaucuuccuuaaucgcacauccggaaaaauggccaucccgguccuguggaaguuucucgagaaauaccccagcgcugaaguggcccggaccgccgauuggagagacguuucugagcugcuuaagccucugggccucuaugaucugcgcgcuaaaaccauugugaaguucagcgacgaauaccugacaaagcaguggaaauaccccaucgagcuccacgggauuggaaaguauggcaacgacuccuaccggaucuuuugcgucaaugaguggaaacaggugcauccugaagaucacaagcugaacaaauaucaugacuggcuuugggagaaucacgaaaagcugagccucucuuga

SEQ ID NO: 71917 - RNA, 4485 nt, Artificial Sequence
  derived and/or modified sequence opt5 from MBD5__Homo_sapiens__NP_060798
augaacggcgggaaggagugcgacggaggcgauaaagaagggggacugcccgccauccaggugccugucggcuggcaaagacggguugaccagaauggggugcucuacgugagcccguccggaucucugcuuagcugucuggagcaggucaagaccuaucuccugacagauggcacgugcaaauguggccuugaaugcccccugauucucccuaagguguucaacuuugaccccggggcugccguuaaacagcgcaccgcggaggaugugaaggcugacgaagaugucacaaagcuguguauccacaaaagaaagauuaucgccguggccacccugcauaaauccauggaggcuccucaccccucucucguucugacaagcccuggaggcgggaccaaugccacaccggugguccccucccgggcugccaccccucgcucugugagaaacaagagccaugagggaauuaccaauuccgugaugcccgaaugcaaaaacccuuucaaacuuaugaucggcagcucuaaugcgauggggcggcuguacguccaagagcuccccggaucccagcagcaggaacugcacccgguuuauccucgccaaagacuuggcagcucugagcauggccagaagucccccuuucgggggagccacggaggccugccuucucccgccuccagcgggucccagaucuacggagacggcucuauuagcccccgcaccgauccucucggguccccggacguguucacaagaagcaaccccggauuucacggcgcuccuaauucuucccccauccaucugaaccggaccccucugagcccgcccucugugaugcuccacggcagcccuguccaguccucuugugccauggcugggcgcacaaauauuccccugagcccuacccuuacgacaaaaucccccgugaugaagaaaccuaugugcaacuucagcaccaauauggagauccccagagccauguuucaucacaagccgccucaaggacccccucccccgcccccucccucuugugcgcugcagaaaaagccucucacauccgaaaaagauccccugggcauucuugacccuauccccagcaagccgguuaaccagaauccugugauuaucaaccccaccucuuuccacuccaacguccauagccaagugccuaugaugaauguuuccaugcccccggccguggucccucugcccucuaaccucccucugcccaccgugaagcccgggcacaugaaucauggaagccacguccagcgggugcagcauuccgcuucuacaagccuguccccuagcccgguuacgucucccgugcacaugaugggcaccgggaucggccgcauugaggccuccccucagagaagccggucuuccagcacaucuagcgaucacggaaacuuuaugaugcccccugucggcccccaagcuaccuccagcgggaucaaagugccuccgagaucuccccgcuccacaauuggaagcccucggcccuccaugccuucuagccccuccacgaagucugacggccaucaccaguauaaggacaucccgaauccucucauugccgggaucagcaacguucugaauacgcccuccucugccgcuuuccccacagcgagcgccggauccagcucugugaagucccagccuggccuucuggggaugccccucaaccagauccugaaucaacauaacgcugccagcuuuccugccucuucccuucugagcgcugccgcgaaagcucagcucgccaaucagaacaagcuggccggcaauaacucuuccagcuccagcaauucuggagcugucgccggcagcgggaacaccgaaggacacuccacccugaacacaauguucccgcccaccgcuaauaugcuccugccuacaggcgaggggcagucuggcagagccgcgcuucgcgauaagcugaugagccaacagaaagacgcccuccggaagagaaaacagcccccuacgaccgugcugucccugcuucgccagucucaaauggauagcuccgcugugcccaagccgggaccugaccuccugcggaaacaggggcagggcucuuuucccauuagcuccaugagccaacugcuccagucuauguccugccagagcucucaccuguccagcaacuccacaccuggauguggcgccucuaauaccgcccuucccugcagcgcuaaccagcugcauuucacagauccuuccaugaauagcucuguucuccaaaacaucccccugagaggggaagcgguccacugccauaaugccaacaccaauuucgugcacuccaacagcccggugccuaaucaucaccuggcuggacuuauuaaccagauccaggccucuggcaauugugggaugcucagccaguccggaauggcucugggcaacucucugcaccccaaucccccucaaagccgcauuuccacgucuagcaccccggucauccccaacuccaucgugagcucuuacaaccagacauccagcgaggccgggggcuccggaccuucuagcuccauugccaucgcuggcaccaaucaucccgcgauuacaaagaccacgucuguucuccaggacggggugaucgucacaaccgccgcuggaaacccucugcagagccaacuucccauuggcuccgauuuuccuuucguggggcaggagcacgcccugcauuuuccgagcaauucuacauccaacaaucaccucccccauccucugaaccccagccugcuuucuucccucccuaucagccugcccguuaaucagcaacaucugcucaaccagaaucugcuuaacauucugcagccgucugccggagaaggcgacaugagcuccaucaauaacacccucucuaaucaccagcugacccaccuccaaagccuucucaacaauaaccagauguucccucccaaccagcagcaacagcagcugcugcagggcuaucaaaaucuccaggcuuuucaggggcaguccacaauccccugcccugccaacaauaaccccauggcgugucuguuccaaaauuuucaggugcggaugcaggaggaugcugcccuucugaacaagagaauuagcacgcaaccuggacucaccgcccugccggaaaaucccaacacaacccugccucccuuccaggacacaccuugcgagcuucagccccgcaucgauccgucccugggccagcaagucaaagacgggcucgugguuggaggcccuggggacgcuucuguggaugccauuuacaaggcggucguggacgcugccagcaaaggaaugcaaguggucaucaccacggccguuaauuccacaacccagauuucucccaucccugcucugagcgccauguccgcuuuuaccgccucuaucggcgauccccucaaccugagcuccgcggugagcgccgugauucacggccggaauaugggaggagucgaccaugauggcagacuucggaacucucgcggggcuagacugccuaagaaucucgaccacgggaaaaacgugaaugaaggcgauggguucgaguacuuuaaguccgccagcugucacacaucuaagaaacagugggacggagagcagagcccccggggcgaaagaaaccgcuggaaguaugaggaguuccuggaucauccgggccacauccauuccucuccuugccacgaacggcccaauaacguuuccacccugcccuuucuuccuggggaacagcauccgauucugcugcccccuagaaacugucccggagacaaaauccuggaggagaauuuccgcuacaacaauuauaagagaacaaugaugagcuucaaagaacggcucgagaacacgguggaacgcugcgcucacauuaauggcaacagaccucggcagucccgcggguuuggagagcugcuuagcaccgccaagcaggaucugguccucgaggaacaaucucccagcuccucuaauagccuggagaacucccuggugaaagacuacauccacuauaauggcgauuucaacgccaagucuguuaaugggugugugccuagccccuccgacgcuaagucuaucagcuccgaagacgaucuuagaaacccggacagcccuucuuccaaugagcugauucauuaccggccccgcacauuuaacgucggagaucucguguggggccagaucaaaggccugaccagcuggccugggaagcucguuagagaagacgaugugcacaauucuugccagcaaucccccgaggagggaaaagucgaaccggagaagcugaaaacacuuaccgaaggccuggaggcguauagccgggugcgcaagagaaaccggaaguccgggaaacugaacaaucaucucgaagccgcuauucacgaggccaugucugagcuggacaagaugagcggaacggugcaccagaucccucagggcgauagacagaugcgcccucccaaacccaagcggagaaaaauuucccgcuga

SEQ ID NO: 71918 - RNA, 3012 nt, Artificial Sequence
  derived and/or modified sequence opt5 from MBD6__Homo_sapiens__NP_443129
augaacggcgggaaugagagcuccggagccgacagagcuggcgggcccguggccaccucugucccuaucggauggcagcggugcguucgcgaaggcgcggugcuguacauuagcccguccgggacagagcucucuagccuggaacaaacgagauccuaucuucugucugauggaaccuguaagugcggccucgaguguccccugaacgugccuaaagucuucaauuuugacccccuugcuccugugacacccggcggggccggaguuggcccugccagcgaagaggauaugaccaagcugugcaaccaccggcgcaaagcuguggccauggcuacacucuacagauccauggagaccacauguagccauucuuccccgggggaaggagccagcccccagauguuccacaccgucucuccuggacccccuuccgcgcggcccccgugccgcgugccucccacgaccccucugaaugggggacccggcagccugcccccugagccgcccucuguuucccaggccuuuccuacacucgcuggccccgggggacuguucccucccagacuugccgacccggugccuagcggcggguccucuagcccccgguuucugccucgcggaaacgcucccuccccugcucccccgccuccucccgcgaucagccucaaugcccccucuuauaacuggggcgcugcccugagauccagccuugucccgucugaucuggggagcccucccgcuccccaugccuccucuagcccucccuccgacccuccccucuuccacuguagcgaugcccugaccccgccuccccugccucccucuaauaaccucccggcucauccuggacccgcgucccagccucccgugagcucugccacaaugcaucugccccuugugcugggcccucucggcggggcuccgaccgucgaaggacccggcgccccucccuuucuggccuccagccuucuguccgcugccgcgaaggcucaacacccuccccucccuccgcccucuacgcugcaggggcggcgcccuagagcccaggcccccagcgcuucccacucuagcucccugcggccuagccagcgcagaccccggagaccgccuacaguuuuccgccuccuggagggacggggcccccaaacccccagacgcucucggccuagagcccccgcuccugugccgcagcccuuuucccuuccugagcccagccagccuauucugcccucugugcucucccugcuugggcugccgacaccuggccccagccacucugacggcagcuucaaucuccugggcuccgaugcccaucugccucccccucccacccucagcucuggguccccgccucagccccgccaccccauccaaccuagccugccgggaaccacauccggcucucuuagcuccguccccggggcgccugcucccccugccgccucuaaagcucccgugguuccuagcccggugcugcagucccccucugaaggacucggcaugggggccggcccugcgugcccccugccuccccuggccggaggcgaggcuuuuccguucccuagccccgaacaggggcuugcccucuccggagcuggcuuucccgggaugcugggagcccugccucucccccugagccuuggccaaccuccgcccucuccucugcucaaccacucccuguucgggguccugacgggcggaggcgggcagcccccucccgagccgcuucucccucccccuggaggccccgggccuccccuggccccgggagaaccugagggccccagccugcucguggcuucucugcuucccccuccgcccuccgaccugcucccucccccuagcgcgcccccuucuaaucugcuggccuccuuccuuccccuccuggcucuggggccgaccgccggcgauggagagggcagcgccgaaggggcuggaggcccuuccggggagcccuuuagcggacucggcgaccugucuccucuucuguuucccccgcucagcgccccucccacacugauugcgcugaacuccgcccuucucgccgccacccuggaucccccuucuggcacacccccucagccguguguucugagcgcuccccagccugggcccccuaccuccucugugacgacagccaccaccgaccccggagcgagcucccucggcaaggcuccuucuaauagcgggcggccgccccaacugcuuuccccucugcucggagccagccugcugggcgaccuuucuucccugacaagcucucccggggcccucccuucccugcuccagcccccgggaccucugcuuagcggccagcugggccuccagcugcugcccgggggaggcgcucccccuccccuuuccgaagccucuagcccucuggcuugccuccugcaaucccuccagaucccgcccgagcagccugaagcccccugucugccucccgagagcccggcgucugcccuugagccugaacccgcuagaccuccccuguccgcccucgcuccgccucaugggagccccgaucccccuguccccgagcugcugaccggacgcggcucugggaagcggggaagacgcggcggcgggggacuucggggcaucaacggggaagccagaccugcccggggacgcaaaccgggcagcagacgggagcccgggagacuggcucucaaguggggaacacgcggcggcuucaacgggcagauggaacgguccccuagacgcacgcaccauuggcaacacaauggagagcuggcggagggcggggccgaacccaaagacccucccccuccgggaccccauucugaggaucucaaggugccucccggcgucgugagaaaaagccggcgcgggagacggcgcaaguacaacccuaccagaaauuccaacucuagccggcaggacauuacacuggaacccuccccgaccgcucgcgccgccguuccucuuccucccagagcucggcccggacgccccgccaagaauaaaagacggaagcuggcgccuuga

SEQ ID NO: 71919 - RNA, 465 nt, Artificial Sequence
  derived and/or modified sequence opt5 from MB__Homo_sapiens__XP_005261662
augggccugagcgacggggaguggcagcucgugcugaacgucuggggaaagguugaagccgauauccccggccacgggcaagaggugcuuauuagacuguucaaaggacauccugaaacccucgagaaguuugacaaauucaagcaccugaaauccgaagaugagaugaaggcuucugaggaccuuaagaaacauggcgccacagugcugacggcgcucgggggaauccugaagaaaaagggccaccaugaagcugagauuaaaccgcuggcccagagccacgccaccaagcacaagauccccgucaaauaccucgaauuuauuuccgagugcaucauccaggugcugcagucuaagcauccuggcgauuucggggcugacgcccaaggagcuaugaauaaagcccuugagcuguuucggaaggauauggcgagcaacuauaaagaacucggcuuccagggguga

SEQ ID NO: 71920 - RNA, 1032 nt, Artificial Sequence
  derived and/or modified sequence opt5 from MBIP__Homo_sapiens__NP_001138363
auggccgcugccaccgagcugaacagacccagcuccggcgaccggaaucucgaacgcagaugccggccuaaccugucucgcgaggugcuuuacgaaaucuucagaagccugcacacacucgucgggcagcuggaucuucgggacgauguugugaagauuacgaucgacuggaauaaacugcaaucccucucugcguuucagccggcucugcuguucagcgcccucgagcagcauauucuguaucuucagcccuuucuggccaagcuccaauccccuaucaaagaagagaacaccacagcuguggaggaaauuggacgcaccgagaugggcaauaagaacgaagucaaugauaaauucucuaucggggaccugcaggaggaggaaaagcacaaggagagcgaucuuagagacgugaaaaagacacagauccauuuugaucccgaaguugugcagauuaaagccggaaaggcugagaucgaccggcgcauuuccgccuucaucgaaagaaaacaagcggagauuaacgagaauaacguccgggaauuuuguaaugugaucgauugcaaccaggagaauagcugugcccgcaccgacgcuauuuucacaccuuaccccggcuuuaagucucacguuaagguguccagagucgugaacaccuaugggccucagacgcggccggaaggaauccccggcagcggccauaaaccuaauucuaugcugcgcgauugcgggaaccaggccguggaggaaagacuccaaaacaucgaggcucaucugcggcugcagaccggaggccccgucccuagagacauuuaccagcgcaucaagaaacucgaggacaagauucuggaacuugaggggaucucccccgaauauuuccaaagcguuucuuuuuccggaaaacggagaaaggugcagccgccucagaauuacagccuggccgagcucgaugagaaaauuuccgcgcugaagcaggcccuucugcgcaagucucgggaagcugagagcauggccacacaccaccuccccuga

SEQ ID NO: 71921 - RNA, 747 nt, Artificial Sequence
  derived and/or modified sequence opt5 from MBL2__Homo_sapiens__XP_011538118
augagccuguuccccucccucccucugcuucugcucucuaugguggccgcuagcuacuccgagaccgucacaugcgaagacgcccagaagacguguccggcgguuaucgcuugcucuagccccggcauuaacggguuuccuggaaaagauggcagagacgggaccaagggagagaaaggcgaacccgggcaaggacugcggggccuucagggcccucccgggaagcugggaccuccgggcaaucccgggccuuccggaucucccggcccuaaagggcagaagggagaucccggcaagagcccggacggcgauuccagccucgccgccucugagcgcaaagcucugcagacagaaauggccagaaucaagaaauggcugaccuucucccucgggaagcaagugggaaacaaauuuuuccugacaaauggcgagauuaugaccuuugagaaggugaaggcucuuugugucaaauuccaggccagcguggcgacaccucggaacgccgcugaaaauggggccauccagaaccugauuaaggaggaagccuuucucggaaucaccgacgagaaaacggagggccaguucguugaucugaccgggaaucgccuuacauauaccaacuggaaugaaggagagcccaacaaugcuggcucugacgaagauugcgugcugcuccugaagaacggccaauggaaugacgucccuuguuccacaagccaccuggcggugugcgaguuucccaucuga

SEQ ID NO: 71922 - RNA, 1149 nt, Artificial Sequence
  derived and/or modified sequence opt5 from MBNL1__Homo_sapiens__NP_066368
auggccgugagcgucacccccaucagagacacaaaguggcugacgcucgagguuugccgggaguuccagcgcggcaccuguuccagaccugauacagaaugcaaauuugcucacccgucuaagagcugucaaguggaaaacgggcgggugauugccugcuucgacucccugaaaggacgcuguucuagagagaauugcaaguaccuucaucccccuccccaccugaaaacccagcucgaaaucaacggccggaauaaccugauucagcagaagaauauggcgaugcuugcucaacagaugcagcuggccaacgccaugaugccuggggcuccccuccagccugucccgauguuuagcguggcccccucccuggcuacaaaugccucugcggccgcuuucaacccuuaucugggacccguuagcccuucccucgugcccgccgagauccugccgaccgcuccuaugcuugucacaggcaaucccggggugccuguucccgccgcggccgcugccgcugcccaaaagcugaugcgcaccgauagacucgaggugugucgggaauaccagcgcggaaacugcaauagaggcgagaacgacugucgguuugcccaucccgcugauagcacgaugauugacaccaaugauaacacagucaccgugugcauggacuauaucaaaggccgcuguucuagagaaaagugcaaauacuuccacccuccggcgcaucugcaggccaagaucaaagcugcccaguaucaagugaaucaggccgcugccgcgcaggcugccgccacagcugccgcuauggggauuccccaagccguccuuccuccccugccuaagcggcccgcgcucgagaagaccaacggagccacggcuguuuuuaacacaggcaucuuccaguaccagcaggcccuggcuaauaugcaacugcagcagcacaccgccuuucucccgccuggguccauucugugcaugacacccgcgaccagcguggugccuaugguccacggagccacccccgcuacagugucugccgcuacgaccuccgccacaagcguuccuuucgccgcuaccgcgacagccaaccagauccccauuaucucugcugagcaucuuaccucccacaaauaugugacgcaaauguga

SEQ ID NO: 71923 - RNA, 1104 nt, Artificial Sequence
  derived and/or modified sequence opt5 from MBNL2__Homo_sapiens__NP_659002
auggcccugaacguggcucccgucagagacaccaaguggcucacacuggagguuugccggcaguuccaacgcggcacguguagcagauccgaugaagagugcaaauuugcccacccuccgaagucuugucagguggaaaaugggcgggugaucgcgugcuucgacagccuuaaaggacgcuguuccagagagaacugcaaguaccugcaucccccuacccaccucaaaacacagcuggaaauuaauggccggaacaaucuuauccagcaaaagaccgcugccgccaugcuggcucagcagaugcaguuuauguuccccgggacaccucuccaucccgucccuaccuuuccggugggacccgccauuggcacaaacaccgcuaucucuuucgccccuuaucuggcgcccguuacgccuggggugggacugguccccaccgagauucucccgacaaccccugugaucguucccggcagcccucccgugacaguccccggcuccaccgccacgcaaaagcugcuucgcacagauaaacuggagguguguagagaauuucagcgggggaauugcgcucgcggagagaccgacuguagauucgcccacccugcugauucuacaaugaucgacaccagcgauaacaccgugacagucugcauggacuacauuaagggccgguguaugcgcgaaaaaugcaaguauuuucauccgcccgcccaccuccaggcgaaaaucaaggccgcucagcaccaagccaaucaggcugccguugccgcucaggcggccgcugccgccgcuacggugauggccuucccucccggggcgcugcauccucuucccaagagacaagcucuggagaaauccaacggaaccagcgccguguuuaauccgucuguccuccacuaccagcaggcccugacauccgcucagcugcaacagcaugccgcuuucauuccuaccggcagcgugcucugcaugacacccgccaccucuaucguuccuaugaugcacuccgcgacgagcgccacagugucugcugccaccacccccgcuacauccgucccuuuugccgcgaccgccacagcuaaccagauuauccugaaguga

SEQ ID NO: 71924 - RNA, 1488 nt, Artificial Sequence
  derived and/or modified sequence opt5 from MBOAT1__Homo_sapiens__NP_001073949
auggccgcugagccccagccuagcucccugucuuacagaaccacaggcagcacguaucuccacccgcuguccgaacuucuggggaucccccucgaccaagugaacuucgucguuugccagcugguggcccuuuuugcggcuuucugguuucggauuuaccugcgcccuggaaccacaucuagcgaugugagacaugccgucgccaccaucuucggcauuuauuuugugaucuucuguuuugggugguacuccguucaccucuucgugcugguccugaugugcuaugcuauuauggugacagccucuguuagcaauauccaucgguacuccuuuuucguggcuaugggauaucucaccaucugucacauuagccgcaucuacauuuuucauuacggcauccugacaaccgacuucucugggccccuuaugauugucacgcagaagaucaccacacuggccuuucaggugcacgauggacucggcagacgggcggaggaccuguccgccgaacaacaccgccuugcuauuaaagugaagccuagcuuccuggaguaucucucuuaccugcugaacuucauguccgucaucgccggccccugcaauaacuuuaaagauuauaucgcuuucauugaagggaagcauauccacaugaaacuccuggagguuaauuggaagagaaagggauuucauagccuuccugagccgucucccaccggcgccgugauucacaaacuggggaucacacucgugucccugcuucuguuccucacccugacgaagacauuuccugucaccugucugguggacgauugguucguucacaaagcgagcuuucccgcccggcucugcuaccuguauguggucaugcaggcuuccaagccuaaauacuauuucgccuggacacuugcugacgccgugaacaaugccgcuggauuuggcuucucugggguugauaagaacggaaauuuuuguugggaccugcucagcaaccugaauauuuggaagaucgaaaccgcgaccuccuucaaaauguaccuugagaacuggaauauccagacagccacguggcugaagugcguguguuaccagcgcguccccugguauccgaccgugcucacauuuauucugagcgcucuguggcauggcgucuacccuggcuauuacuucaccuuccucacagggauccuggugacccuugccgccagagcuguucggaacaauuaucgccacuacuuucugucuuccagagcccucaaagcgguguaugaugcuggaacgugggccgucacacaacuggccgugagcuacaccguugcucccuucgugaugcuggccgucgaaccuaccauuucucuuuacaagagcauguauuuuuaccuccauaucauuucccugcugaucauccucuuccugcccaugaaaccccaggcucacacacagcggcgcccucagacccuuaacucuauuaacaagagaaaaacagacuga

SEQ ID NO: 71925 - RNA, 1563 nt, Artificial Sequence
  derived and/or modified sequence opt5 from MBOAT2__Homo_sapiens__NP_620154
auggccaccacaagcacgaccggcuccacacugcuccagccccugucuaacgcugugcaacuuccuaucgaccaggucaauuucguugugugccagcuguuugcccuccuggcggcuauuugguucagaaccuaccuucacagcuccaagacaucuagcuuuauccggcauguggucgccacccugcucgggcuguaucuggcccucuucuguuuuggaugguacgcucugcacuuccuugugcaguccggcauuucuuauugcaucaugauuaucaucgggguugagaacaugcauaauuacuguuuuguguucgcccugggauaucucacagucugccaagugacccgcguuuacauuuuugauuauggccaguacagcgcugacuucuccgggccgaugaugaucauuacgcagaaaaucaccagccuggccugugaaauucacgauggaauguuuagaaaggacgaggaacuuacaucuucccagcgggaucuggcggugcgcagaaugcccagccuccuggaguaccugucuuauaacugcaauuucaugggcauccucgccggcccucuguguuccuacaaagacuauauuaccuuuaucgaagggcggagcuaccauaucacacaaucuggagagaacggcaaggaggaaacccaguaugagcgcacggaacccuccccuaauacagcugucgugcagaaacuucuggugugcgggcucagccugcuuuuccaccugaccauuuguacaacccuccccgucgaguacaacaucgaugagcacuuccaggccaccgcuuccuggccuacaaagauuaucuaucuguacauuucucugcucgccgcgagaccgaaguacuauuuugccuggacgcuggcugacgccaucaauaacgcugccggauucggcuuucggggguacgaugaaaauggagccgcucgcugggaccuuaucagcaaccugcggauucaacagaucgagauguccaccagcuucaaaauguuucucgauaauuggaacauucagacagcgcuguggcuuaagagaguuugcuaugaacgcaccucuuucucccccacaauccaaaccuuuauucugagcgccaucuggcauggcguguacccuggcuauuaccucacguuccugacaggggugcugaugacccucgcugccagagccaugcggaauaacuuucgccacuauuucaucgagcccucucagcugaaacuguuuuacgacgucauuaccuggaucgugacacagguugcuauuagcuacaccguggucccuuucgugcuucucuccaucaagcccucucugacauuuuauagcuccugguacuauugucugcauauucuuggaauccucguucugcugcuccugccggugaaaaagacgcagagacggaagaacacccacgaaaauauucaacuuagccagucuaaaaaguucgaugagggcgagaacucccuggggcagaauagcuucucuacaaccaacaaugucugcaaccagaaucaagaaaucgccuccagacacagcucccucaaacaguga

SEQ ID NO: 71926 - RNA, 1308 nt, Artificial Sequence
  derived and/or modified sequence opt5 from MBOAT4__Homo_sapiens__XP_011542911
auggaguggcuguggcuguucuuucugcaccccaucagcuucuaccagggcgccgcuuuuccuuucgcccuucuguuuaacuaucucugcauuauggacuccuucucuaccagagcgcgguaccuguuucuucugacagggggaggcgcucucgccguggccgcuauggggagcuaugccguccugguuuucacgccggcugugugugccguggcgcugcucugcucccuggcuccccaacagguccaucgcuggaccuuuuguuuccagaugucuuggcagacacuuugccaccugggacuccauuacaccgaauauuaccugcacgagccucccagcgugagauuuuguaucacacuuuccucucugaugcuccugacccaacggguuacaagccugucccucgauauuugcgaaggcaaggugaaagcugccagcgggggauuccgcucuagauccagccugucugagcaugucuguaaggcccuuccuuauuuuuccuaccuccucuucuuccccgcccugcuuggcggcagccugugcucuuuucagcgguuccaggcgcgcgugcagggguccagcgcccuccacccuagacacuccuuuugggcucugucuuggcggggacugcaaauccucggccuggaaugucuuaauguugccgugagccgcgucguggacgcuggggccggacugaccgauugccagcaguucgaguguauuuacguggucuggacgaccgccggccucuuuaaacugacauauuacucccauuggauccuugacgauagccugcuccacgcugcgggguucggaccggagcugggccagucucccggcgaagagggguauguuccugacgccgauaucuggacccuggaaagaacacaucggauuuccguguuuagccgcaaguggaaccaaucuaccgcuagauggcuccggcgccugguguuccagcacagcagagccuggccccuucugcagacguuugccuucuccgcuugguggcacggacuccauccuggccaagucuuuggguucgugugcugggccguuaugguggaggcggacuaccugauccacucuuuugcuaaugaguucauucggagcuggcccaugagacuguucuaucgcacacuuaccugggcccauacacagcucaucauugccuacaucaugcuggcugucgaagugcggucccugagcucucucuggcugcuuugcaacuccuauaauagcguuuuuccgaugguguacuguauucugcuccugcugcuugccaaaagaaagcacaagugcaacuga

SEQ ID NO: 71927 - RNA, 594 nt, Artificial Sequence
  derived and/or modified sequence opt5 from MBP__Homo_sapiens__NP_001020252
auggccagccagaagagacccucccaacggcacggcucuaaauaccuggcuaccgccagcacaauggaccaugcgcgccacggguuccucccuagacaucgggauacgggaauccuggacuccauuggccgcuuuuucgggggagauagaggcgcuccgaagcgggggucuggaaaagugcccuggcuuaagccuggccgcagcccccugccuucccacgccagaucucagcccggccucugcaacauguauaaagacagccaucacccugcccggaccgcucacuacgggucccugccgcaaaagagccauggacgcacacaggaugagaaucccgucguucacuuuuucaagaacaucgugaccccuagaacacccccucccucucagggcaaagggcggggacuuucccugagccgcuuuucuuggggcgccgaagggcagagaccgggauucggcuauggcgggcgggcuuccgacuacaagagcgcccauaaaggauuuaagggcguggaugcgcaggggacccucucuaaaauuuucaagcugggaggccgcgacuccagaagcggguccccuauggcccggagauga

SEQ ID NO: 71928 - RNA, 1956 nt, Artificial Sequence
  derived and/or modified sequence opt5 from MBTD1__Homo_sapiens__XP_005257525
auggagaacaccaaggaccugacagaacacagcuccagaucugagcggaaacgcagagauagcuucggcauguuugacggguacgauuccugcucugaagacacgagcuccucuagcuccagcgaggaaucugaggaggaaguggcuccccucccuuccaaucugccgaucauuaagaacaauggacaggucuauaccuaccccgauggcaaaagcgggauggccacaugugagaugugcggaaugguuggcgugcgggacgccuucuauucuaagaccaaacgcuuuuguuccgugagcugcucuagauccuacagcuccaacucuaagaaggcgagcauccuugcucggcugcaagggaaaccucccacaaagaaagccaagguccuccagaaacagccucugguggccaaacuugcugccuaugcucaguaccaagccacccugcagaaucaggcgaagacaaaggccgcuguuuccauggaaggauucagcuggggcaacuauauuaauucuaacuccuuuaucgccgcucccgugaccuguuucaagcaugccccuaugggcacgugcuggggagauauuagcgagaauguccgcguggagguuccgaacaccgacuguucucuccccacaaaaguguuuuggaucgcggggaucgucaagcuggccggcuacaaugcucugcucagauacgaaggguucgagaacgauagcggacuggacuuuuggugcaauauuuguggcuccgauauccacccugugggguggugcgccgcuucuggaaaaccccuugugccuccccggaccauucagcauaaguauacaaacuggaaagccuuccuggucaagcgccucaccggcgccaagacgcugccgccugacuuuagccaaaaaguuuccgaaagcaugcaguaccccuucaagccuuguaugagaguggagguggucgauaaacggcaccuuugccgcacaagaguggcuguuguggaaucugucaucggcgggcggcugcgccucguguaugaggaguccgaagacagaaccgacgauuuuuggugccauaugcacagcccccugauucaccauaucggauggucucgguccauuggccacagauucaagcgcagcgacaucaccaaaaagcaggaugggcauuucgacacacccccucaccuguuugcgaagguuaaagagguggaucaguccggagaaugguucaaggagggcaugaaacucgaagccaucgacccgcugaaucuuucuaccauuugugucgcuacaauccggaaggugcuggccgauggguuucucaugauuggaaucgacggcagcgaggccgcugauggcuccgacugguucugcuaccacgccacgucucccagcauuuuuccugucggguucugugagaucaacaugaucgaacugacacccccuagaggauauaccaaacuucccuuuaagugguucgauuaccugcgcgagaccggcuccauugcggcuccggugaagcucuuuaacaaagacguuccuaaucauggguuccgggugggaaugaagcuggaagccgucgaccugauggagcccagacucaucugcguggccacaguuacccgcauuauccaccggcugcuucgcauucauuuugauggcugggaagaggaguaugaccaauggguggauugugaaagcccugaccuguaccccgucggguggugccagcucacgggcuaccagcugcaaccucccgcuucucaguccagcagagagaaccagucugccuccagcaaacagaagaaaaaggcuaagucucaacaguauaaaggacacaagaaaaugacaacccuucagcugaaggaggaacuccuggauggcgaggacuacaauuuccugcagggggccagcgaucaagaauccaacggaagcgcgaauuuuuauaucaaacaggagccguga

SEQ ID NO: 71929 - RNA, 3159 nt, Artificial Sequence
  derived and/or modified sequence opt5 from MBTPS1__Homo_sapiens__NP_003782
augaagcuggugaacaucuggcuccugcuucuggucguucuccugugcggcaaaaagcaccuuggggacagacuggagaaaaagagcuucgaaaaagcccccuguccuggaugcucccaucucacccugaagguggaguuuucuagcacaguggucgaauacgaguauauuguggcuuucaauggcuacuuuacggccaaggcgcggaacuccuucaucucuagcgcucugaaauccucugaaguugauaauuggcgcauuaucccgagaaacaaucccagcuccgacuauccuagcgauuuugaggugauucagaucaaggagaaacagaaggccgggcuccugacccuugaagaccaccccaacaucaaacgggucacaccucagcgcaagguguucagaucucugaaguacgccgaguccgaucccaccguuccuuguaaugaaacacgguggagccagaaauggcagucuucccgcccgcucagacgggcuagccugucucuuggauccggcuuuuggcaugccaccgggcgccacagcuccagacggcugcuccgcgcuauucccagacaaguggcccagacacugcaggcggacguccuguggcagaugggauauaccggcgccaacgugcggguggcugucuucgauacgggccucucugagaagcauccucacuuuaaaaauguuaaggagcgcaccaacuggacaaaugaaagaacccuggacgaugggcuuggacacggcacauucguggccggggugaucgcuagcaugcgggagugccaaggauuugcccccgacgcggaacugcauauuuucagagucuuuaccaacaaucagguguccuacacgagcugguuccucgaugccuucaacuaugcuauccugaaaaagauugacguucuuaaucugucuaucggcgggccugauuuuauggaccaccccuucguggacaaagucugggagcucacagccaacaacgugauuaugguuuccgcuaucggaaaugauggcccgcuguacggcacccugaacaauccugccgaccagauggaugugaucggggucggaggcauugacuuugaagauaacaucgcccgcuucagcucucgggggaugacaaccugggagcuccccggaggcuacgggagaaugaagccugacauugugaccuauggagcuggcguccgcggcagcggggugaagggaggcugucgggcgcuguccgggacaucuguugccagccccguggucgcuggagccgugacgcuucugguuuccaccgugcagaaaagagagcucgucaaucccgccagcaugaagcaagcucugaucgccucugcgcgccggcuuccuggcgugaacauguuugaacaggggcauggcaaacuggaucuccugagagcuuaccagauucucaauuccuauaagccgcaagccagccugucucccuccuacaucgaccugacagagugcccuuauauguggcccuacuguagccagccuaucuauuacggaggcaugcccaccgugguuaacgucacaauucuuaaugggaugggagugaccggccgcaucguggauaaaccggacuggcagccuuaccugccccagaacggggauaauauugaagucgccuucuccuauucuagcgugcucuggccuugguccggauaccuggcuaucucuauuagcguuacgaagaaggccgcuuccugggagggcaucgcccaagggcacgugaugaucacagucgcgagccccgccgaaaccgagucuaaaaacggcgcugagcagaccuccacagugaagcugccuauuaaaguuaagaucauucccaccccgccucggagcaaaagagugcuuugggaccaguaucacaaucuccgcuacccucccggauauuuuccccgggacaaccugagaaugaagaaugauccgcuggacuggaacggcgaucauauccacacaaacuuccgggacauguaccagcaucuccgcucuaugggguauuuugucgaagugcugggagcccccuucacgugcuuugaugcuucccaauacggcacccuucugaugguugacagcgaggaagaguacuucccugaagagauugccaagcucagacgggauguggacaaugggcugucucuggucaucuuuagcgauugguauaacacauccgugaugagaaaagugaaguucuacgacgagaauacccgccagugguggaugcccgauacaggaggcgcgaacauuccugcccuuaaugaacuccugagcgucuggaacaugggguucucugacggccuguaugagggagaauuuacccucgcuaaucacgauauguacuaugccuccggcuguagcaucgcuaaauuccccgaggacgggguugugaucacgcagaccuuuaaggaccagggacuggaggugcuuaaacaagaaacagccgucguggagaacguuccuauucugggccucuaccagauccccgccgaagggggaggccggauugugcuguauggggauuccaauugccuggacgauucucauagacagaaggacuguuucuggcuucucgaugcucugcugcaguacaccagcuacggcgucacaccgccuucccucucucacagcggaaaccgccaaagacccccuuccggcgcggggucugugacccccgagcggauggaaggaaaucaucugcaccgcuauagcaagguucuugaggcccaccugggcgacccgaaaccuagaccccucccugcuugcccccggcuguccugggccaagccccagccucugaacgagacggccccgagcaaucuuuggaaacaucagaagcuccugucuaucgaucuggacaaagugguccuccccaacuuucgcuccaauagaccucaagugcggccccugagcccuggggaaucuggagcuugggauauucccggcggcaucaugccugggcgcuacaaccaggagguuggacagacaaucccgguguucgccuuucuuggcgcgauggucgugcuggcuuucuuugugguccagauuaacaaggccaaauccagacccaagcggcgcaagccuagaguuaaacggccccaacucaugcaacaggugcacccucccaagaccccgagcguguga

SEQ ID NO: 71930 - RNA, 1560 nt, Artificial Sequence
  derived and/or modified sequence opt5 from MBTPS2__Homo_sapiens__NP_056968
augauccccgugagccuggucguugugguggucggcggguggaccgugguuuaccucacagaccuggugcuuaaguccucugucuauuucaaacacagcuacgaggauuggcuggaaaacaauggacucuccauuucuccuuuucauaucagauggcagacggccguguucaaccgggcuuuuuauagcuggggccgcagaaaggcccggaugcuguaccaaugguucaauuuugggaugguuuucggagugauugcgauguuuuccucuuucuuucuucugggcaaaacccucaugcagacacuggcucagaugauggccgacagcccguccagcuauucuuccagcagcuccucuucuuccagcuccucuagcuccucuagcuccagcucuagcuccucuagcucccugcacaacgagcagguccuccaaguggugguccccgggaucaaucugccuguuaaccagcuuaccuacuucuuuacagccgugcugauuagcggagugguccaugaaaucggccacggcaucgcugccauucgcgaacaggugagauucaauggguuuggaaucuuccucuucauuaucuaucccggcgcuuuuguugaucuguucaccacacaucuucagcugauuucuccugugcaacagcuccggaucuuuugcgccgggauuuggcacaacuucguccuggcgcugcucggaauccuggcccuugugcugcuccccguuauccugcuuccuuuuuacuacaccggcguggggguccugauuacggagguggcugaggacuccccggccaucggaccccgcggccucuucgucggcgaucuggugacccaucugcaggacuguccuguuacaaaugugcaggauuggaacgagugccucgacaccauugcuuaugaaccccaaaucggguacuguauuagcgccucuacacugcagcagcuuuccuuuccugucagagcguauaagcggcuggauggaagcaccgagugcuguaauaaccacucccucacggacgugugcuucucuuaccgcaauaacuuuaauaaaagacugcacacaugucuucccgcccggaaggcuguugaagccacccaagugugccgcacaaacaaggauuguaaaaagagcuccucuagcuccuucugcaucaucccgagccuggagacccauaccagacucauuaaagucaagcacccuccccagaucgacaugcuguaugugggccacccucugcaucuccacuacacagugucuauuacguccuuuaucccccgguucaacuuucugagcauugaucuucccguugucguggagaccuucgugaaauaucugaucucucucuccggggcucuggccaucgucaaugccgugccuuguuucgcucuggacggacaguggauucuuaacagcuuucucgacgcgacacugaccucuguuaucggcgauaaugacgugaaggaucugauuggguucuuuauccuccugggaggcagcguccuucuggccgcuaacgugacacucggccuguggaugguuaccgcccgcuga

SEQ ID NO: 71931 - RNA, 954 nt, Artificial Sequence
  derived and/or modified sequence opt5 from MC1R__Homo_sapiens__NP_002377
auggccgugcagggcagccaaagacggcugcucgggucccugaacucuacccccacagcuaucccucagcuuggacuggccgcgaaucagacgggcgcucgcugccucgaggucagcauuuccgacgggcuguuccuuucucugggacucguuagccugguggaaaacgcccugguggucgccaccaucgcuaagaauagaaaccuccacuccccgauguacuguuuuauuugcugucuggcccuuucugaucugcucgugagcggcuccaauguucuggagacagcugugauccuucugcucgaagccggggcgcuggucgcccgggcugccgugcugcagcaacucgacaacguuauugaugugauuaccugcagcucuaugcuguccagccuuuguuuccugggagcuaucgccgucgaccgcuauaucucuaucuuuuacgcgcucagauaucauuccauugugacacugccccgggcccgcagagcuguggccgcuaucugggucgccagcguuguguucucuacccuuuuuauugccuacuaugaucacguggcuguccugcucugccuggugguuuucuuucuggcgaugcucgugcugauggccguccuuuacgugcauaugcuggcucgggccugucagcacgcccagggcaucgcucgccuccauaaaagacagcggccuguucaccaaggcuucgggcugaagggagccgugacacuuaccauucugcucggcaucuuuuuccugugcugggggcccuuuuuccugcaccucacgcugaucguccuuuguccugagcauccuaccugcggauguauuuuuaaaaauuucaaccuguuccucgcgcugaucauuugcaaugcuaucauugacccccugaucuaugccuuucacucccaggaacuucgcagaacacucaaggaggugcugaccugcagcugguga

SEQ ID NO: 71932 - RNA, 894 nt, Artificial Sequence
  derived and/or modified sequence opt5 from MC2R__Homo_sapiens__NP_001278840
augaagcacaucauuaacagcuacgagaauaucaacaauaccgccagaaacaauuccgacugcccccgggugguccugccugaagagauuuucuuuacaaucucuauuguuggcgugcucgaaaaccugaucgugcuucuggcugucuucaaaaauaagaaccuccaggccccgauguacuuuuucaucuguagccuggcgauuuccgauaugcuugggucucuguauaaaauccucgagaauauucugaucauucugcgcaacaugggauaucucaagcccagaggcagcuuugaaacgaccgcugacgauaucauugacucccuguucgugcuuucucugcucgggagcaucuuuucccugagcguuaucgccgccgaucgguacauuacaaucuuccaugcccuucgcuaucacucuauugugaccaugagacggacagucgugguucugaccgugaucuggacauuuugcaccggaacgggcauuaccauggucaucuucucccaucacgugccuacagugaucaccuuuacaagccucuucccccugaugcuggucuuuauucucugucuguacguucauauguuccuucuggcucgcucucacaccagaaaaaucuccacgcucccucgggcuaauaugaagggggccauuacacugaccauccuucugggaguguucaucuuuugcugggcgcccuucgugcuccacguccugcugaugacauuuuguccuagcaacccguauugcgccuguuacaugucucucuuccaagugaauggcaugcugauuaugugcaacgcuguuaucgaccccuuuauuuacgccuuccgcuccccugagcuuagagaugcuuuuaagaaaaugaucuucuguagccgguauugguga

SEQ ID NO: 71933 - RNA, 972 nt, Artificial Sequence
  derived and/or modified sequence opt5 from MC3R__Homo_sapiens__NP_063941
augaacgccagcugcugucugcccuccgugcagccuacccucccgaauggcucugagcaucugcaagcucccuucuuuagcaaccaguccucuagcgccuucugcgaacaggucuuuaucaagccugagguuuuccuuucccuggggauugugucucuccuggaaaauauccuugugauucuggcggucgugagaaacggaaaucuccacagccccauguacuuuuuccuguguucccuggcuguugccgacaugcucgugagcgucucuaacgcccuggagacaaucaugauugcuaucgugcacuccgauuaucuuacguuugaagaccaguucauccaacauauggauaauauuuuugacagcaugaucugcauuucucugguugccuccaucuguaaccuccuggcuauugccguggaucgguacgucaccaucuucuaugcgcuucgcuaccacagcauuaugacagugagaaaagcccugacccucaucguggcuaucugggucugcuguggcguuugcggggugguguuuauugucuauucugaguccaagauggugaucguuugucugauuacaauguucuuugccaugaugcugcucaugggaacccuguacgugcauauguuccuuuucgcucggcugcacgucaaacgcaucgccgcgcucccucccgccgacggcguggcuccucagcagcacagcugcaugaagggggccguuacaauuaccauccugcuuggaguguuuaucuucuguugggcuccguuuuuccugcaucucguccugauuaucacgugccccaccaauccuuauugcauuuguuacacagcccacuuuaacaccuaccuggugcucaucaugugcaauuccgucauugauccccugaucuaugccuucagaucucuugagcugcggaacacauuucgcgaaauccucuguggcugcaauggcaugaaccugggguga

SEQ ID NO: 71934 - RNA, 999 nt, Artificial Sequence
  derived and/or modified sequence opt5 from MC4R__Homo_sapiens__NP_005903
auggugaacagcacccacagaggcaugcauacaucccugcaccucuggaaucggucuagcuaccgccugcauuccaacgccucugagagccuugggaagggauauuccgacggcgggugcuacgaacagcuguucgucucucccgagguuuuugugacgcucggagugaucagccugcuugaaaauauucuggucaucguggcuauugccaaaaacaagaaucuccacuccccuauguauuucuuuaucuguagccuggcgguugcugauaugcuggugucugucuccaacggcagcgagaccauugugaucacacuccuuaauucuaccgacacagaugcccaauccuucaccguuaacaucgacaaugugauugauagcgucaucuguucuucccugcuggccagcauuugcucccuccugucuaucgcuguggacagauacuuuacaauuuucuaugcccuucaguaccauaacaucaugaccgugaaacgggucgggauuaucaucagcugcauuugggcugccuguacgguuuccggaauccuguuuauuaucuauagcgauucuuccgcggugauuaucugccucaucaccauguucuuuacaaugcuggcccugauggcuagccucuacgugcacauguuccugauggcccgccuucacauuaagagaaucgcuguccugccgggcaccggcgccauucggcagggggcgaauaugaaaggagccaucacacucaccauucugaucggcguguuuguuguguguugggcucccuucuuucuucaucugaucuucuacauuucuugcccucagaaccccuauugugucugcuucaugagccacuuuaaucucuaccugauccugauuauguguaacuccaucauugacccucucaucuaugcccugcgcucucaagaacuuagaaagacguucaaggagauuaucugcugcuacccccucgggggacugugugaucugagcucccgguauuga

SEQ ID NO: 71935 - RNA, 978 nt, Artificial Sequence
  derived and/or modified sequence opt5 from MC5R__Homo_sapiens__NP_005904
augaacagcuccuuccaucugcacuuucucgaccugaaucuuaacgccaccgagggcaaucugucugggcccaacgugaagaauaaaagcuccccuugcgaagauaugggaaucgcugucgagguuuuccucacacugggcgugauuucucuucuggaaaacauccucgugauuggggccaucgucaagaauaaaaaccugcacagcccgauguacuuuuucguguguucccuggcgguugcugacaugcucgugucuaugagcuccgccugggagacgauuaccaucuaucugcuuaauaacaagcaucuggucaucgccgaugcuuuugugagacacauugacaauguuuucgauagcaugaucugcauuucuguggucgccuccauguguagccuccuggcuaucgccguggaccgguacgugacaaucuuuuaugcgcuucgcuaccaucacauuaugaccgccagacggucuggagcuauuaucgccggcaucugggcuuucugcacaggguguggaauugucuuuauccuguauuccgaaagcaccuacguuauucucugccugaucucuauguucuuugccaugcuguuccuccuggugucccuuuauauucacauguuucugcucgcgcgcacacaugugaaaagaaucgccgcucugcccggcgccagcuccgcucggcagcgcaccucuaugcaaggcgccgucacggugaccaugcuucuggggguuuucacaguguguugggccccuuucuuucuccaccugacccugaugcucagcugcccccagaaccuguacuguuccagauucaugagccauuuuaauauguaccuuauccugauuaugugcaacucugucauggauccucucaucuaugcuuuccggucccaggagaugcgcaagacauuuaaggagauuaucuguugcagaggauuccggauugcgugcagcuuuccccgcagagacuga

SEQ ID NO: 71936 - RNA, 1941 nt, Artificial Sequence
  derived and/or modified sequence opt5 from MCAM__Homo_sapiens__NP_006491
augggccugcccagacucgugugcgccuuccugcuugcugccuguugcuguugcccucgggucgcggggguuccgggagaggcugaacagcccgccccugagcugguggaaguggaggucggcagcaccgcccuccugaagugugggcuuucccaaucucagggaaaccugagccacguggacugguuuuccguucauaaagaaaagcgcacacucaucuucagagugcggcagggccaggggcaaucugagcccggagaguacgaacagcgccugagccugcaggauagaggcgcuacgcucgcccugacccaggucacaccucaagacgagcggauuuuucuuugccagggcaaacgccccagaucccaggaauaucggauccagcugcgcguguacaaggcuccugaggagccgaauauucaaguuaacccccucgggaucccugucaauucuaaagaacccgaggaaguggccaccugugugggaagaaacggcuauccuauuccccaggugaucugguacaagaaugggcggccgcugaaggaggagaaaaaccgcguccacauccagagcucccaaacaguugaaagcucuggacuuuauacccugcaguccauucucaaggcgcagcuggugaaagaggauaaggacgcccaguucuacugcgaacugaauuauagacucccuagcggcaaccauaugaaagagucucgggaagugacaguccccguguuuuacccuaccgagaagguuuggcuggaaguggagcccgucgggaugcuuaaggagggagaucgcguggaaaucagaugucuggcugacggcaaucccccuccgcacuucuccauuagcaaacaaaaccccucuacgcgggaggccgaagaggaaaccacaaaugauaacggcguucucgugcuggagccugcuagaaaggagcauuccgggcgcuacgaaugccagggacuugaccuggauaccaugaucagccuccuguccgagccccaggaacugcucgucaauuaugugucugacguccgggugagcccugccgcgcccgagagacaggagggcuccagccugacacuuaccugugaagccgagucuucccaagaucuggaauuucaguggcuccgcgaggaaacggggcagguucuggagcggggaccggugcuucagcugcacgaccucaaaagagaggcuggcgggggauaccgcugcgucgccagcgugccuucuauucccggccugaaccggacacaacugguuaauguggcuaucuucggcccucccuggauggccuuuaaggaaagaaaagucugggugaaggagaacauggugcucaaccugagcugcgaagccuccgggcacccucgccccaccauuucuuggaauguuaacggaacagcuagcgagcaggaucaggacccgcagcggguccuuuccacccugaaugugcucgugaccccugaacugcuggagacaggcgucgaguguacggcgagcaacgaccuugggaaaaauaccucuauccucuuccuggaacuggugaaccucacaacccugacacccgauuccaauaccacgacaggacuuagcaccucuaccgccagcccccauacaagagcuaacuccaccuccacagagcgcaagcugccugaaccggagucucggggcguugugaucgucgccgugauuguuugcauccucgugcuggccguccugggggcugugcuuuauuuucucuacaagaaaggcaagcugcccuguagacggagcggaaaacaagaaauuacgcugccucccucccgcaagucugagcucguuguggaggucaaaagcgacaagcugccugaagagaugggccuucugcagggguccagcggagauaagagagcccccggcgaccagggggaaaaauauaucgaucuccggcacuga

SEQ ID NO: 71937 - RNA, 543 nt, Artificial Sequence
  derived and/or modified sequence opt5 from MCAT__Homo_sapiens__NP_055322
augagcgugagagucgcccggguugcuugggugcgcggccugggggccuccuacagacggggagcgucuagcuuccccgugccuccgcccggcgcucagggggucgccgagcuccugcgcgacgccaccggagcugaagaggaagccccuugggcugccacagagagacggaugcccggccaaugcuccgugcuucuguuuccugggcagggaucucagguugugggcaugggccgcgggcuccugaacuaucccagaguccgggaacuuuacgcggccgcucgcagagugcugggauaugaucuccuggagcugagccuccacggcccucaggagacgcuggaccggaccguucauugucaaccggccaucuucguggcuucccuugccgcggucgaaaagcugcaccaucuccagcccucugugauugagaauugcguggccgcugccggguuuagcgucggagaauuugcugcccugguuuucgccggcgcuauggaguucgcggagggguccacagugagcccugaagaguuucuuuga

SEQ ID NO: 71938 - RNA, 2178 nt, Artificial Sequence
  derived and/or modified sequence opt5 from MCCC1__Homo_sapiens__NP_064551
auggccgcugccagcgcgguguccguccugcucguugcugccgagagaaaccgguggcaccgccugcccucucuucugcucccuccgagaaccuggguguggcggcagcgcaccaugaaguacacgaccgccacaggcagaaauaucaccaaagugcugauugcuaacagaggggaaaucgccugccgcgucaugagaacagcuaagaaacuuggagugcagaccguugccguguauagcgaggcggaccgcaauuccaugcaugucgauauggccgacgaggcuuacucuauuggccccgccccuagccagcaguccuaucugucuauggaaaagaucauucagguggcuaaaacaagcgccgcgcaagccauccaccccggguguggauuccucuccgaaaacauggaguuugcugagcugugcaagcaggaaggcaucauuuucaucgggccucccccuagcgccauucgggauaugggaaucaagucuaccuccaaaagcauuauggcugccgccggcguuccgguggucgagggcuaccauggggaagaccagucugaucagugucugaaggagcacgcuagacggaucggauaucccgugaugauuaaagcggugcgcggcgggggaggcaaggggaugagaaucguccgguccgagcaagaauuucaggagcagcucgaaagcgcccgcagagaggcuaaaaagucuuucaaugacgaugccaugcugaucgaaaaguuuguugacacgccucggcauguggaggugcaggucuucggagaucaccacggcaacgccguguaccuuuuugagagagacugcuccguucaacgccggcaucagaaaauuaucgaagaggcucccgccccuggcauuaagagcgaagugcggaaaaagcugggggaggcggcuguccgcgccgccaaagcugugaauuauguuggagccggcaccguggaguucaucauggauuccaagcacaacuuuuguuucauggaaaugaauacacggcuccaggucgagcaucccgugaccgaaaugauuacagggaccgaccuggucgaguggcaacuuagaaucgcugccggagaaaagaucccgcugucucaggaggaaauuacgcuccagggccacgcguuugaggcccgcaucuacgcugaggauccuagcaacaauuucaugcccguggccgggccucugguucaccuguccacaccccgggcugaccccagcaccagaauugaaacaggagugcgccagggcgacgaggucucugugcauuacgauccuaugaucgccaagcucguugugugggcggccgaccggcaagcugcccugaccaaacuuagauauucccugcgccaguacaacauugucggccuccacaccaauaucgauuuucugcuuaaccugagcgggcauccggaguucgaagcuggaaaugugcacacagacuucaucccccagcaucacaaacagcuccugcugucucggaaggccgccgcuaaagagagccucugccaagcggcccugggccuuauucugaaggaaaaagcuaugacggauaccuuuacacuccaggcccacgaccaguucuccccuuuuucuagcuccagcgggagacggcugaacaucucuuauacccgcaacaugacacuuaaggauggaaagaauaacguggccauugcuguuaccuacaaucaugacggcuccuauagcaugcagaucgaggauaaaacguuccaaguccuggggaaccucuacucugaaggcgacuguacauaucugaagugcuccgugaauggaguggccagcaaagcgaagcugauuauccucgagaacaccauuuaccuguuuuccaaagaaggcucuaucgagaucgauauucccgucccuaaguaccuuagcuccgugucuagccaggagacccaagggggaccccuggcuccgaugacaggcaccaucgaaaagguuuucgugaaagccggggacaaggucaaagccggagacucccucauggugaugauugcuaugaagauggagcacacaaucaaaagcccuaaggauggcacgguuaagaaaguguuuuauagagaaggggcccaggcgaaucggcauacaccccuggucgaguucgaagaggaggaaucugacaagagagaguccgaauga

SEQ ID NO: 71939 - RNA, 1692 nt, Artificial Sequence
  derived and/or modified sequence opt5 from MCCC2__Homo_sapiens__NP_071415
augugggccgugcugagacucgcucugcggcccugcgcccgcgcgagcccugcuggcccgagagccuaccacggggacuccgucgccucucuuggaacccagcccgaucugggcagcgcucucuaucaagagaacuacaagcagaugaaagcccugguuaaucagcuucaugaacggguggagcacaucaagcugggaggaggcgaaaaagcucgcgcccuccauauuuccagagggaagcugcugccucgggagcgcaucgacaaccucauugaucccggaucuccuuuccuggaacuuagccaguuugcgggcuaucaacuguacgacaaugaggaggugcccggcgggggaaucauuacaggcaucgggagagucuccggaguggaauguaugaucauugccaacgaugcuacgguuaaaggcggggccuauuacccugugaccgucaagaagcagcuccgggcucaggagaucgccaugcagaaucgccugccgugcauuuaucuuguggacucuggaggcgcguaccugcccagacaagccgauguuuucccugaccgggaucacuuuggccgcacauucuacaaccaggcuaucaugagcuccaaaaauauugcccagaucgcuguggucauggggagcuguaccgccggaggcgccuaugugcccgcuauggcggacgaaaacauuaucgugagaaagcaggggacaaucuuucucgccggaccuccccuggucaaagcugccaccggcgaggagguuucugccgaagaucucgggggagcugaccugcauugccggaaguccggcgugagcgaucacugggcccuggacgaccaccaugcgcuucaccugacacgcaaaguggucagaaaucucaacuaccaaaagaagcuggaugugaccauugagccgucugaggaaccucuuuuccccgcugacgaacuguauggcaucguuggggccaaucucaaacgguccuuugaugugagagaggucauugcccgcaucguggacggaagccgguucacggaguuuaaggcuuucuacggcgauacccugguuacaggguuugccagaauuuucggauauccugugggcaucgucgggaacaauggcgugcuguuuucugaauccgcuaaaaagggaacccauuucguccagcucuguugccagcgcaacaucccccugcuuuuccugcaaaauauuacaggcuuuaugguggggcgggaguacgaagccgagggaaucgcgaaagacggcgccaagaugguugcugccguggcuugugcccagguccccaaaauuacccucaucauugggggaagcuauggcgcggggaacuacggcaugugcgggagagccuacuccccucgcuuccuguauaucuggccgaacgcucggaucucugugaugggcggggaacaggccgcuaauguucuugccacgauuacaaaggaucagagagcccgcgagggaaagcaauuuagcuccgcugacgaggcggcccugaaagaacccaucauuaagaaauucgaggaagagggcaacccuuacuauagcucugcucgggugugggaugacgggaucauugaucccgccgacaccagacucguccugggacuguccuuuagcgccgcucucaaugccccuaucgaaaagacagacuucggcauuuuucgcauguga

SEQ ID NO: 71940 - RNA, 360 nt, Artificial Sequence
  derived and/or modified sequence opt5 from MCCD1__Homo_sapiens__NP_001011700
auggugcugccccucccuuggcugagcagauaccacuuccuucggcugcuccugccguccuggucucuugcuccccagggcagccaugggugcuguucccaaaacccuaaggccucuauggaggaacagaccagcucccgcggaaauggcaaaaugacaucucccccuagagggcccggaacgcaccggaccgccgagcuggcgcgcgcugaggaacuccuggaacagcagcuggagcucuaucaagcccugcuugagggccaggaaggggccugggaggcucaggcccugguccucaagauccagaaacugaaggaacaaaugagacggcaucaggagagccuuggaggcggcgcuuga

SEQ ID NO: 71941 - RNA, 3060 nt, Artificial Sequence
  derived and/or modified sequence opt5 from MCC__Homo_sapiens__NP_001078846
augauggccgcugccgcggcugccgccgcuggcagcuccucuagcgggggaggcgggggaggcuccgggucuagcuccucuagcuccgacaccagcucuacaggagaggaagagagaaugcggcgccuguuccagacgugcgauggcgacggcgauggguacaucuccagaaacgaccuccugauggugugucggcaacuuaauauggaagagagcgucgccgaaauuaugaaccagcugggagcugaugagaauggcaagaucucuuuucaggacuucacccgcugcagaaugcagcucguucgggagauucgcaaagaagagguggaucuguccgccaagagcgacaacucuuguacaaagaagcugagagaucggaucgcguccuggcccaccagcuccgacaauucucugggggcccucagcgcugcccgcgaauccugggaguaugauagcggagcuagagaccugcaaucuccugaugugcagucccagagcgcccugcagaaacuccuggaguacggcgggucuagccuucaccaacaggcggcccugcauaagcuccugacacaguccccgcacauuggaaacucugucggcggcagcuaucuugaacuggcuaauacccuccauuccgccgcucuggccagccugaagggggacaucguggagcucaacaaacggcugcagcaaacagaacgcgagagagaccuucuggaaaagaaacucgccaaggcucagugcgagcagucucaccugaugcgggagcaugaagauguucaagagcgcaccacgcuuagauacgaagaacggaucaccgaacugcacuccgugauugcggagcucaauaaaaagaucgacagacugcagggaacaaccauucgcgaggaagaugaguauagcgaacugcggucugagcucucccagagccagcacgaagucaacgaggacuccagaucuauggaucaagaccagacaagcguguccauccccgagaaucagucuaccaugguuacggccgauauggacaacuguagcgaucuuaauuccgaacuucagcgcgugcugacaggccucgagaacgucgugugcgggcggaagaaaagcucuuguucccugagcguggcugaagucgacagacauauugagcaacuuaccacagccucugagcacugcgaucuggccaucaagaccguugaagagauugaaggagugcucggccgcgaccuguacccuaaucuggcugaggaacgguccagaugggagaaagagcucgccgggcugcgcgaagagaacgaaagccuuaccgcgaugcuguguucuaaggaggaggagcucaaccggacaaaagcuacgaugaaugccaucagagaggaacgcgaccggcugagacggcgcgugagagagcugcagacccggcuucagagcguccaggccacaggacccuccagcccuggcagacucaccucuacaaaccgccccaucaauccuuccaccggcgaacugagcacguccucuagcuccaacgauauuccgaucgcuaagauugccgagcgggugaaacugucuaagacaagaagcgaauccucuagcuccgaccgccccguucucgggagcgagaucucuuccauuggagugucuagcuccgucgcugagcaucuggcccacagccuucaagauugcucuaauauccaggaaaucuuucagacccuguauucccacggcagcgcgauuuccgagagcaagaucagagaguucgaaguggagaccgaacggcucaacucucgcauugagcaucugaaaagccagaaugaccugcuuacaaucacccucgaagaguguaaguccaacgccgaaagaaugucuaugcugguugggaaauacgagagcaaugcuacagcccugcggcucgcucugcaauacuccgagcagugcauugaagccuaugagcuucugcucgcgcuggccgaaucugagcagagccugauccuuggacaauuucgcgcugccggcgugggguccucuccuggcgaucagagcggagacgaaaacaucacgcagaugcucaagagagcucacgauugccggaaaaccgccgagaaugccgcuaaggcgcugcugaugaagcucgacggcuccugugggggagccuucgcugucgccggcugcagcgugcagcccugggagucucuguccagcaacucucauacauccaccacaagcuccaccgccucuagcugugauacggaauuuaccaaagaggacgaacaacgccuuaaggauuacauucagcagcugaaaaaugacagagcugccgucaagcucacaaugcuggagcuggaauccauccacauugauccucuuagcuaugacgugaaaccccgcggggacucucagcggcucgaucuggagaacgcgguucugaugcaagagcucauggcuaugaaggaagagauggccgaacugaaggcccagcuuuaccugcucgagaaagagaagaaagcucuggaacugaaacuuuccaccagagaggcccaggaacaggcguaucuggugcauaucgagcaccucaaaagcgaagucgaggagcaaaaggaacagcggaugagaucucugagcuccacaucuagcggauccaaggacaaaccgggcaaggagugcgcugaugccgccucuccugcucucagccuggccgaacuucgcaccacguguuccgagaaugaacuggcugccgaguucacaaacgcgauucggagagagaaaaagcucaaagcccgcgugcaggaacugguuagcgcucuggagcggcuuaccaagucuuccgaaaucagacaccaacagagcgccgaguuugugaacgaccugaaacgcgcuaauuccaaccucgucgccgccuacgaaaaggcuaagaaaaagcaucagaauaaacugaagaaacucgagucucagaugauggcgaugguggagcggcacgaaacacaagugagaaugcugaagcagcgcauugcccuucuggaggaagagaacagccggccccauaccaaugagaccucccucuga

SEQ ID NO: 71942 - RNA, 531 nt, Artificial Sequence
  derived and/or modified sequence opt5 from MCEE__Homo_sapiens__NP_115990
auggccagagugcugaaggcugccgcggcuaacgccgucggccucuucagccggcugcaggcccccaucccuaccguucgcgcuuccucuacaagccaaccgcuugaccaggugacgggguccguguggaaucugggaagacucaaccacgucgccauugcugugcccgaucuggagaaagccgcggccuuuuacaagaauauccuuggcgcucagguuucugaagccgugccucugcccgagcauggggucagcgugguuuucgugaaccucggaaauaccaaaauggaacugcugcacccucucggccgggacucccccauugcuggguuucugcagaagaacaaagccggaggcaugcaucacaucugcauugaggucgauaauaucaacgcggccgugauggaccuuaagaagaaaaagauccgcucucugagcgaagaggugaaaauuggcgcucaugggaagccugucaucuuccuccacccgaaagauuguggaggcguucugguggagcuugaacaagccuga

SEQ ID NO: 71943 - RNA, 2958 nt, Artificial Sequence
  derived and/or modified sequence opt5 from MCF2__Homo_sapiens__NP_001093325
augcaggacaucgccuuccugagcggcgggagaggaaaggauaacgcuuggauuaucaccuuucccgagaauugcaacuuccgguguauuccugaagaggugaucgccaaaguccucacauaccugacguccauugcgcgccaaaauggcucugacagcagauuuaccaucauccuugaucggcgccuggacacaugguccucucucaagauuagccugcagaaaaucuccgcuucuuucccggggaaccuucaccugguucucgugcugagacccaccagcuuucugcagcggacauucaccgauauuggauuuugguucucccaggaagacuuuaugcucaagcugccuguggucaugcuuagcucuguguccgaucugcucacauauaucgacgauaaacaacugacccccgagcuuggcgggacgcugcaguacugccauagcgaauggauuaucuuccgcaaugccauugagaacuuugcccucaccguuaaggagauggcucagaugcugcagucuuucggaacagaacuggccgagaccgaacucccugacgauauccccuccaucgaggagauucuggcuaucagagccgaacgguaucaccuucugaagaaugacauuacagcggugaccaaagagggcaagauccuccugacgaaccuugaagucccugauacagagggcgccgugagcucucgccuggaaugucauagacaaauuuccggggacuggcagaccaucaauaaacuccugacacagguucacgacauggagaccgcuuuugauggauucugggagaagcaucagcugaaaauggaacaauaccuccagcuguggaaguucgagcaggacuuucaacagcuugugaccgaagucgaguuccugcucaaccagcaggccgaacuggcugaugugacaggcacgaucgcccaagugaagcagaaaauuaagaaacuugagaaucuggacgagaacagccaggaacuccuguccaaggcgcaguuugucauccugcacgggcacaaacucgccgcuaaucaucacuaugcccuggaucuuauuugccaacgguguaacgagcugcgcuaccucucugacauccugguuaaugaaauuaaggcuaaaagaauccagcugagccggaccuucaagaugcauaagcugcuccagcaggcccgccaaugcugugaugagggagaaugccugcuggccaaccaggagaucgacaaauuucaguccaaggaggaugcucagaaagcgcuccaagacauugaaaacuuccuggagauggcccuuccguuuaucaauuaugaacccgagacacugcaguacgaguucgaugugauucucagcccugaacugaaggugcagaugaaaaccauccaacugaaacuugagaacauuagaucuaucuuugaaaaucagcaggcuggcuuccggaaccucgccgacaagcacgucagacccauucaguuugugguuccuacacccgagaaucuggugaccuccgggacgccguucuuuagcucuaagcaaggaaagaaaacauggcgccagaaccagagcaaucugaagaucgaagucgugccugacugucaggagaaacgguccucuggccccagcuccagccucgauaacggcaauucucuggacguucuuaagaaccacgugcugaaugagcucauccaaaccgaaagagucuacgugcgcgagcuguauaccguccugcuuggguaccgggccgaaauggauaacccugagauguucgaccucaugccuccccugcugagaaauaagaaagauauucucuucggaaacauggcugaaaucuaugaguuucauaaugacauuuuccuguccagccuugagaacugcgcccacgcgcccgaacgcgugggcccguguuuucuggagcggaaggaugacuuccagauguacgcuaaauauugccagaacaagcccagaucugaaacaaucuggcgcaaauacuccgagugcgccuuuuuccaggaaugucaacggaagcucaagcauagacugcgccuggauagcuaucuucucaaaccuguucagcggauuaccaaguaccagcugcugcucaaagagcugcuuaaguacuccaaagacugcgaggggucugcccugcucaagaaagcucuggaugccaugcuggaccuucuuaagagcgugaaugauuccaugcaccaaaucgcuaucaacggauauauuggcaaucucaacgaacuggggaagaugaucaugcagggaggcuuuucugucuggauuggccauaaaaagggggccacaaaaaugaaggaccucgcgagauucaaacccaugcagcggcaccuguuucuuuacgagaaggccaucguguucuguaagcgcagaguugaaagcggagagggcuccgaccgguauccuagcuacucuuuuaaacacugcuggaagauggaugagguggggauuacggaauaugucaaaggagacaauagaaaguucgagaucugguacggcgaaaaagaggaaguguauaucgugcaggcuuccaacguugaugucaagaugaccuggcugaaggagauucgcaauauccuccugaaacaacaggagcugcuuacagugaagaaacggaagcagcaggaccaacugaccgaaagagauaaauuucagauuagccuccagcagaacgacgagaagcaacagggggccuucaucucuacagaagagaccgaacuggagcauacguccaccguggucgaggugugugaagcuauugccagcguucaggcggaggccaauacaguguggaccgaggcuucucagagcgccgagaucuccgaagaacccgcugaguggagcucuaacuacuucuacccgacauaugaugaaaaugaggaagagaaccgcccucucaugagacccgucuccgagauggcccugcuuuacuga

SEQ ID NO: 71944 - RNA, 3345 nt, Artificial Sequence
  derived and/or modified sequence opt5 from MCF2L2__Homo_sapiens__NP_055893
augcugagcugccucaaggaggaaaugcccccucaggagcugaccagacggcuugccacagugaucacgcacgucgacgaaauuaugcaacaggagguucgcccgcugauggcuguggaaaucauugagcagcuccauagacaguucgccauccuguccggcgggcggggagaggauggcgcgcccauuaucaccuuuccugaguucucuggguuuaaacacauccccgacgaagauuuccuuaacgugaugacauaccugaccagcauuccuuccgucgaagcugccucuaucggauuuauugugguuaucgaccgcagacgggauaaguggagcuccgugaaagccucucucacacgcauugcugucgccuuccccggcaaucugcaacugaucuuuauucucagaccuagccgguucauccagcgcaccuuuacagacaucgggauuaaguauuacagaaacgaguucaaaaccaaggugccgaucauuaugguuaauuccgugagcgaucugcauggauauaucgacaagucucagcuuacgcgggagcugggcggcacccucgaauaccgccacgggcagugggucaaccauagaacagcuauugagaauuuugcccugacccuuaaaacaaccgcgcaaaugcugcagacguucggauccugucucgccacagcugaacugccccggagcaugcugucuaccgaggaucuccugaugucccacacacgccagagagacaaacuucaggaugaacugaagcuccugggcaagcaagggaccacccuucugagcugcauccaggagccugccacaaaaugucccaacucuaagcucaaucugaaccagcuggagaaugugacgaccauggaacggcuccuggugcaacuugacgagacagaaaaggcuuuuucccacuucuggagcgagcaucaccugaaacucaaccagugccugcagcuucagcauuucgaacacgauuuuuguaaggccaaacuggcgcucgacaaucugcuggaggagcaagccgaguucaccggaaucggcgacuccgucaugcacguugaacagauucucaaggaacauaaaaagcuggaggaaaaaucucaggagccucuugagaaggcucagcugcucgcccuggugggggaucaacugauccagagccaccauuaugcugccgacgccauuagaccccgcugcguggaacuucggcaccucugugaugacuuuaucaacggaaauaagaaaaagugggauauucugggcaaaucccuggaguuccauagacagcucgacaaggucagccaguggugcgaagcuggcaucuaccugcuugcgucucaagccguggauaaaugucagucccgcgaggggguugacaucgcucugaacgauauugccacauuucucggaaccgugaaggaguauccgcugcugagcccuaaggaguucuacaaugaauuugaacuucuccugacgcuggacgccaaagcuaaggcccagaaaguccuccagcggcuggaugacgugcaagagaucuuccacaagagacagguuucucuuaugaaacuggcggcuaagcagacacgccccgugcaaccugucgcuccccaccccgaaagcuccccuaagugggugucuagcaaaaccucccagccgagcaccucugucccccucgcccggccucugagaacauccgaggagcccuacaccgaaacagagcugaacagccgcggcaaggaagacgaugagacgaaauuugaagugaagucugaggagauuuucgaaucccaucacgagcgggggaacccugaacuugagcagcaggccagacucggagaccugagcccccgccggagaaucauucgggaucugcucgaaaccgaggagaucuauauuaaagaaaucaaguccaucauugacggcuacaucacaccgauggauuuuauuuggcugaagcaucuuaucccugacguucugcaaaauaacaaagauuuccucuuugggaauauucgcgagcuguaugaguuccacaacagaaccuuccugaaggaacuugagaaaugcgccgaaaaucccgagcuccuggcucacuguuuucugaagcggaaagaagaccuccagaucuacuucaaguaucauaaaaaccugccuagagcccgcgcgaucuggcaggagugccaggauugcgccuacuuuggagugugucaacggcagcuugaccacaaucugccccucuucaaguaucugaagggcccuucucagagacugauuaaauaccagaugcuucugaagggccuccuggauuuugaaagccccgaggacauggagaucgauccgggggaacucggaggcuccgcuaaagacgggccuaagcgcacaaaagacucugccuucagcaccgagcugcaacaggcucuugccgucauugaagaucugaucaaguccugcgagcucgcgguggaccuggccgcuguuacggaaugucccgaugacauuggaaagcugggcaaacuucugcuccaugggcccuuuagcguguggaccauccacaaggauagauacaaaaugaaggaccugauccgguucaaaccuucucagcgccaaauuuaucucuuugagagaggcaucgucuucugcaagauucggauggagccgggagaucagggccugagcccccauuacuccuuuaagaaagccaugaaacuuaugacacugucuauccgccagcucgggagaggaucccaccggaaguucgaaauugcuagccgcaacggccuggagaaguauauccugcaggccgccucuaaagaaaucagagacuguugguuuagcgagauuuccaaacuucugauggaacaacagaauaacaucaaggaucaggggaauccucaguucgagaugagcaccucuaagggauccggcgcugggagcggccccuggauuaagaacauggagcgggcgacaaccuccaaagaagacccugccucuagcacgggaggcaucaaggggugcuccucucgcgaguucagcuccauggauacauuugaagacugugagggagcugaggauauggaaaaagagucuagcgcccucucccuggccggccucuuccaaagcgacgacucucacgaaaccugcuccagcaagucugcuuuucuggagagaggggaauccagccagggagagaaagaggaacgggaugaggaagagacagccaccagaucuaccgaagaggagcgcgcgggcgcuuccacagggcggcuugcccccgccggcgcuacggccggauuccaggcgagagcucugcgcccucggaccagcgcccaggaauccuga

SEQ ID NO: 71945 - RNA, 3378 nt, Artificial Sequence
  derived and/or modified sequence opt5 from MCF2L__Homo_sapiens__NP_001106203
augagauucuggcugcggaccgaggaaauggcccucgaggaaauggugcagcgccugaacgcugucagcaagcacacagacgagaucaugcaucaagauauuguuccccuuugcgccgcggacauccaggaucagcugaaaaagagauuugcuuaccucuccggcgggcggggacaggacggcucuccugugauuacguucccggauuaucccgccuuuagcgaaaucccugacaaagaguuccaaaaugugaugaccuaccugacauccauucccucucuucaggaugccgggaucggauuuauccuggucauugaccgcagacgggauaaguggaccagcgugaaagcuagcguucuccgcaucgccgcuucuuucccugccaaccugcagcuggugcucguccugagacccacaggcuuuuuccagcggacccuuagcgacauugcguuuaaguucaaucgcgaugacuuuaagaugaaagugccuguuaucaugcuguccagcgugccggaucuccacggguauauugacaagucucaacugacagaggaccuuggaggcacccuggauuacugucauuccagauggcucugccagcggacggccaucgaauccuucgcucugauggucaaacagaccgcccagaugcugcaaucuuuuggcacagagcucgcugaaaccgagcugcccaacgacgugcaguccacaagcucugugcuuugugcccacaccgagaagaaagauaaggcgaaggaagaccugcgccucgcccugaaagaggggcauuccguccuugaaagccugagagagcuccaggcugaaggauccgagccuucuguuaaucaagaucagcuggacaaccaggccacggugcagcggcugcucgcucaacugaaugagacagaagccgccuucgaugaguucugggcuaagcaccagcagaaacuugaacagugccugcaacuccgccacuuugagcagggcuucagagaagugaaggcgauucuggacgccgcuagccagaaaaucgccaccuuuacagauaucgggaacucccuugcccaugucgagcaucugcuccgggaccuggcuagcuucgaggaaaagucuggaguggccguugagagagcgcgcgcucugucccucgauggcgaacagcugauugggaauaaacacuaugccguggacagcauccggcccaagugucaagagcuuagacaccugugcgaccaguuuucugccgaaauugcucgccggagaggacuccugagcaagucccuggagcuucaccgccggcucgagaccucuaugaaauggugugaugaaggcaucuaccugcuggccagccagccugucgacaagugccagucccaagauggcgcugaggccgcgcuccaggaaauugagaaauuccuggagaccggggccgaaaacaagauccaggagcuuaaugcuaucuauaaagaauacgagagcauucugaaccaagaccucauggaacaugugagaaagguuuuucagaagcaggccucuauggaggagguguuccaccgccggcaggcuucccugaaaaagcuggccgcgagacaaacacgccccguccagccgguggccccucggcccgaagcucuugccaaaagcccuugucccucucccggaaucagacggggcuccgagaauagcuccucugaagggggagcucuccgcagaggcccuuaccggagagccaagagcgagauguccgaaucucgccaggggcggggaagcgccggcgaggaggaagagucccuggcuauucugagacgccaugucaugagcgaacuccuggauacggagagagcguauguggaagaacuucugugcguucucgagggcuacgccgcugaaauggacaacccgcugauggcccaucugcuuucuaccgggcuccacaauaaaaaggaugugcuguuuggaaacauggaggaaaucuaucacuuccacaaccggauuuuucugcgcgagcucgagaauuacacagacugucccgaacuggucggcagaugcuuccuugagcggauggaagauuuucagaucuaugagaaguacugccaaaacaaaccucgcuccgaaagccuguggagacaguguucugacugccccuucuuccaggagugucagcggaagcucgaucauaaacugucccuggacagcuaucuucucaagccugugcaacgcaucaccaaauaccagcugcugcucaaggagaugcugaaguacucuagaaauugcgaaggggccgaggaucuucaggaagcucugagcuccauucucggaauccugaaagccguuaacgacagcaugcaccugauugcgaucacaggcuaugacgggaaucuuggcgaucugggaaagcuccugaugcaaggcucuuuuuccguguggaccgaccauaaacgggggcacacgaaggucaaagagcucgcucgcuucaagcccaugcagagacaccuguuucuucaugaaaaagccgugcuguucuguaagaagcgggaggagaacggagaaggcuacgagaaagccccgagcuauuccuacaagcagucucucaauauggcugccguggggauuacagaaaacguuaaaggagaugcgaagaaauuugagaucugguauaaugcuagagaagaggucuacauugugcaggccccuacccccgagaucaaggccgcuugggugaacgaaauccgcaagguccugaccagccaacugcaggccugccgggaggcuucccagcacagagcccuugaacagucucaaagccugccucuccccgcgccuacauccaccucucccagccgcggcaauucccggaacauuaaaaagcuggaggagagaaaaacagacccgcucagccuggaaggguaugugucuuccgccccucuuacgaagccucccgagaaaggcaagggauggagcaagaccucucauucccuggaagcucccgaggaugacggcggguggagcucugccgaggagcagaucaauuccagcgaugcugaggaagacggaggccucgggccgaaaaagcugguucccggaaaauacacaguggucgccgaucacgagaagggcgggccugacgcccugcgcgugcgguccggcgauguuguggaacuuguccaggagggagacgaaggccugugguacgugagagaucccaccacagggaaagagggauggguuccugcuagcucucucagcgugcgccugggccccuccgggucugcgcagugucucagcuccucugagagcuccccuggaucugccguccugagcaacuccagcucuugcuccgaaggcgggcaagcucccuucagcgaccuucagggcuga

SEQ ID NO: 71946 - RNA, 441 nt, Artificial Sequence
  derived and/or modified sequence opt5 from MCFD2__Homo_sapiens__NP_001164979
augaccaugagaagccugcuccggacacccuuccugugcggccuucugugggccuuuugugcuccuggggcccgcgcggaggaaccggcugccuccuucucucagcccggaagcaugggccucgacaagaacacggugcacgaucaagagcauaucauggaacaccuggagggggucauuaauaaaccugaagccgagaugucuccccaggagcuucagcugcauuacuuuaagaugcacgacuaugauggaaacaaucuccuggacggccuggaacucuccaccgcuaucacacauguucacaaagaggaagggagcgagcaggccccucugauguccgaggaugaacuuauuaacaucauugacggagugcugagagaugacgauaagaauaacgacggcuacaucgauuaugcugaguucgccaaaucucuccaauga

SEQ ID NO: 71947 - RNA, 1269 nt, Artificial Sequence
  derived and/or modified sequence opt5 from MCHR1__Homo_sapiens__NP_005288
augagcgugggcgccaugaagaaaggggucgggagagcuguuggccucgggggaggcuccgggugccaggccaccgaggaagacccccugccuaacuguggagcgugcgcuccgggccaaggcgggcggcgcuggagacugccccagccugccuggguggagggaucuagcgcccggcuuugggaacaggcuacaggcacgggguggauggaucuggaggccucccuccugcccaccggaccuaaugcuucuaacacaagcgacggccccgauaaucuuaccuccgccgggucuccuccgcgcacaggaagcaucuccuacauuaacaucauuaugcccagcguguucggcaccaucugucugcucggcauuaucggaaauucuacagucaucuuugcggugguuaagaaauccaagcugcacuggugcaacaaugugccugacauuuucaucauuaaccugagcgucguggaucuccuguuucuucugggaaugcccuucaugauccaucagcucaugggcaaugggguuuggcacuuuggagaaaccauguguacgcugauuaccgccauggacgcuaacucucaauucacauccaccuauauccuuacagccauggcuauugauagauaccuggccaccgugcauccuaucagcucuacgaaauuucggaagcccuccgucgcgacacucgugaucugccugcugugggcccucagcuucauuuccaucaccccgguguggcuguaugcucgccuuauuccuuuucccggcggggccgucggauguggcaucagacugccuaaucccgacacagaucucuacugguucacccuguaucaguuuuuccuugcuuuugcccugcccuucguugugauuaccgccgcuuacgugcggauccuccagcgcaugacaucuagcgucgcgccugccucccagagaagcauccggcugcgcacgaagagagugacccggacagcuauugccaucugccugguuuucuuuguguguugggccccguauuacguccuccaacugacccagcuuucuauuucccgccccacacugaccuucguguaccucuauaacgcugccaucagccugggcuacgcuaauucuugccuuaacccuuuuguuuauauugugcugugugagacguucagaaaacggcucguccugagcgugaagcccgcggcccaggggcagcugagagccgucuccaaugcucaaacagccgacgaggaacgcaccgagucuaaaggaaccuga

SEQ ID NO: 71948 - RNA, 1023 nt, Artificial Sequence
  derived and/or modified sequence opt5 from MCHR2__Homo_sapiens__NP_001035269
augaaccccuuccacgccagcugcuggaauaccuccgcugagcugcucaacaagucuuggaauaaagaauuugccuaccagacagcgagcguggucgacacgguuauccugccuuccaugauuggcaucauuuguucuaccgggcuugugggaaacauccugauuguguucacaaucaucagaagccggaagaaaaccgucccggauauuuauaucugcaaucucgcuguggccgaccugguucauauugugggcaugcccuuucuuauccaccaaugggcccgcgggggagagugggucuucggcgggccucuguguacaauuaucaccucccucgauacaugcaaccaguuugcuuguucugccauuaugaccgugaugagcguugacagauacuucgcucuggugcagcccuuucggcugacgcgcuggagaacccgguauaagacaauccgcaucaaucucggacugugggccgcguccuucauucuugcccugccugucuggguguacagcaaagugaucaaguuuaaggauggcgucgaaucuugcgcuuucgaccucaccucccccgaugacguucugugguauacacuuuaccugaccauuacgacauuuuucuuuccucucccgcugauccugguguguuauauucucauccugugcuacaccugggagauguaccagcaaaacaaagaugccagauguugcaaucccagcgugccuaagcagcgggucaugaaacuuacaaagauggugcugguucucguggucguguucauccugucugcugcccccuaucauguuauucagcuugugaaccugcagauggaacaaccuacccucgcguucuacgucggcuauuaccuguccaucugucugagcuaugccucuuccagcauuaaucccuuucucuacauccugcuuuccgggaacuuccagaaacgccugccgcagauucagagacgggcuaccgagaaggagaucaauaacaugggaaauacacucaagucucacuuuuga

SEQ ID NO: 71949 - RNA, 1158 nt, Artificial Sequence
  derived and/or modified sequence opt5 from MCIDAS__Homo_sapiens__NP_001177716
augcaggccugcggcgggggagcugccggcagacgggcguucgacagcaucugucccaaccgcaugcuggcucucccugggagagcccugcuuugcaagccgggaaaacccgagcggaaguuugccccuccccgcaaauucuuuccuggcuguaccgggggaucccccgugucugucuacgaagauccuccggacgcugagcccacagcccugccugcucucacgaccauugaucugcaagaccuugccgauugcagcucccugcucggcucugacgcgcccccuggcggggaucuggccgcuagccagaaucacucccaucagacagaagccgacuucaaccugcaggauuuuagagacaccguugaugaccucaucucugauagcuccagcaugaugucucccacacuggcuuccggagacuucccguuuagcccuugugacauuucucccuucggcccuugccuuuccccuccccuggauccccgggcccuccaaagcccgccccugcgcccucccgacgugccucccccggagcaguauuggaaggaaguggcggaucagaaucagagagcccuuggggacgcucuggucgagaacaaucaacuccacgugacccugacacagaaacaggaggaaaucgccucucugaaggagcggaacguucagcucaaggaacuggcuucccgcaccagacaucuugccagcgugcuggauaaacucaugauuacgcaaucccgggacuguggagccgcugcggagccuuuucugcuuaaggccaaagcuaagcgcucucuggaggaacucgucagcgccgccggccaggauugcgcugagguggacgccauccugagagaaaucuccgagcggugugaugaagcgcugcagagccgcgaccccaaaagaccucggcuccugcccgagccugcuaauaccgauacaagacccgggaaccuucacggagccuuccgcggccugcggaccgacugcucuagauccgcccucaaucugagccauucugagcuugaagagggcgggagcuuuuccacacgcauucggucucacagcaccaucagaacgcuggcuuucccgcaaggaaacgccuuuacaauucgcaccgcuaauggcggguacaaguuccgguggguuccuuccuga

SEQ ID NO: 71950 - RNA, 2625 nt, Artificial Sequence
  derived and/or modified sequence opt5 from MCM10__Homo_sapiens__NP_060988
auggacgaggaagaggauaaccugagccuccugaccgcccuucuggaagagaaugaauccgcucucgacugcaacucugaggagaauaacuuccugacaagagaaaauggcgagcccgaugccuuugacgaacuuuucgaugcggacggggauggagagagcuacacggaggaagcugacgauggcgagaccggggaaacacgggacgagaaggaaaaccuggccacccucuuuggagauauggaggaccugacagaugaggaagaggugccugccucccagucuaccgaaaaucgcguccugccggcucccgccccuagacgggagaaaacaaacgaggaacuccaagaggaacugcgcaaucuucaggagcagaugaaggcucugcaggaacaacucaaaguuaccacgaucaagcagaccgccagccccgcgagacugcagaaauccccugagaagucuccccggccuccgcuuaaggaacgcagagugcagcggauucaagagagcacauguuucuccgccgagcuggacgugcccgcucucccucgcaccaaaagagucgcccggacacccaaggcuagcccucccgacccgaaaucuuccagcucucgcaugaccuccgccccuagccagccccugcagacgaucucuagaaacaagccuuccggcauuacacgggggcagaucgugggaacccccggcagcuccggcgaaacaacccaacccauuugcguugaggcguuuucugggcugcgccucagacggccuagagugagcuccaccgaaaugaauaaaaagaugacaggacgcaagcugauccggcuuagccagaucaaagagaagauggccagagagaaacuggaagagauugauugggucacguucggcgugauccucaagaaaguuaccccgcagucugugaacuccgggaagacauuuagcauuuggaaacugaaugaccuucgcgaucugacccaaugugucucucucuuccuguuuggagaagugcacaaggcucuguggaagacagagcagggcaccguggucgggauccucaacgccaaucccaugaaaccuaaggacggaagcgaagagguuugccuguccauugaucauccccagaaagugcuuaucaugggcgaggcucuggaccucggcacguguaaggccaaaaagaagaacggggaaccuugcacacagaccgugaaccugcgggauugugaguauugccaauaccacguccaggcccaguauaaaaagcugucugcuaaaagagcggaccugcagagcaccuucuccggaggccgcauucccaagaaauuugcccggagagggacaagccucaaggaacgccugugucaagauggauucuacuauggcggggugucuuccgcuagcuacgccgccucuaucgcugccgcgguugcuccgaagaaaaagauccagaccacacuguccaaucucguggucaaaggaacgaaccugauuauccaggagacccggcagaaacuuggcauuccucaaaagagccuguccugcucugaagaguuuaaggagcucauggaccugcccacauguggcgccagaaaucugaagcagcaucuugccaaagcuaccgccagcgggaucaugggauccccuaagcccgcuauuaaaucuaucagcgccuccgcgcuccugaagcagcagaaacaacgcaugcuggaaaugcggagaagaaagagcgaggaaauccagaaacgcuuccuccagucuuccagcgagguggaaucuccugccguucccuccagcucuagacaaccgccugcucagccuccccggacaggcagcgaguuccccagacuggagggggccccggcuaccaugacgcccaaacuuggacgcggcgugcuggaaggggaugacguccucuuuuaugacgaguccccucccccucggcccaagcugagcgcccuggcggaagccaagaaacuugcugccauuaccaagcucagagcuaagggccaggugcugacaaaaaccaacccuaauucuaucaagaagaaacagaaggauccccaagacauucuggaggucaaagagcgcguggaaaagaacacaauguucuccagccaggccgaggaugaacucgagccggcccggaaaaagcggcgcgaacagcuggcuuaccuugaguccgaggaauuucagaagauccugaaagcgaagucuaaacacaccggcauucucaaggaggccgaagcugagaugcaagaaagauacuucgagccucugguuaaaaaggagcagauggaagagaagaugcggaauauccgcgaagugaaaugcagagucgugacgugcaagacaugugccuauacccauuuuaaacugcuugagacaugcguuagcgaacagcacgaguaccacuggcaugacggagugaagcgguucuuuaaaugucccugcgggaaccgcuccaucucucucgauagacugccuaauaagcacuguagcaacugcggacuguauaaaugggagcgggacggcaugcucaaggaaaagaccgggcccaaaauuggaggcgagacccugcuuccgcgcggggaggaacaugccaaguuccuuaauucccucaaauga

SEQ ID NO: 71951 - RNA, 2715 nt, Artificial Sequence
  derived and/or modified sequence opt5 from MCM2__Homo_sapiens__NP_004517
auggccgagagcuccgaaucuuucaccauggcuagcucccccgcccagagacggcgcggcaacgacccucugacaucuagcccggggagauccucucggcgcacggaugcgcucaccagcucccccggaagagaccugccucccuuugaggaugaaagcgagggccuucuggggacagaaggaccucucgaggaggaagaggacggcgaagaacugaucggggauggaauggagcgggacuaccgcgcuauucccgaacuugaugccuaugaggccgaaggccuggcucucgacgaugaggacguggaggagcugaccgccucucaaagagaggcugccgaacgggcgaugcgccagagagaucgggaggccggccgcgggcugggaagaaugcggcgcggccuccuguacgacuccgaugaagaggacgaagagagaccugcucggaagagacgccaggucgagcgggccacagaagacggggaggaagaugaggaaaugaucgagagcauugagaaucuugaagaccugaaaggacacucuguuagagaguggguguccauggcuggcccgcgccucgaaauccaucaccgguucaagaacuuucugagaacccauguggauagccacgggcauaaugucuucaaagagcgcauuucugacaugugcaaggagaaccgggaaucccuugugguuaauuaugaggaucuggccgcgagagaacacgugcucgccuacuuucugcccgaggcuccugccgaacugcuccagaucuucgacgaggcugcccuggaggucgugcuugccauguaucccaaauacgaucgcaucacaaaccacauucauguucggaucagccaucugccucucguggaggaacugagaucccuucgccaacugcaccucaaucagcugauucggaccucuggagucgugacgagcuguaccggcgugcugccccagcucuccauggucaaguauaacugcaauaaguguaacuuuguucugggcccguucugccagagccaaaaucaggaagugaaaccugggucuugucccgagugccaguccgcuggaccuuuugaagugaacauggaggagacaaucuaccagaauuaccaacggauuagaauccaggaaagccccggcaaggucgcggccgggcgccuucccagaucuaaagacgcuauucugcucgccgaucugguggacagcuguaagccuggagaugagaucgaacuuaccggcaucuaucacaacaauuacgacgggucccugaacacagccaacggauucccgguuuuugcuaccgugauucucgccaaucacgucgcgaaaaaggacaacaagguggcuguuggcgagcugacggaugaagacgugaaaaugaucacaucucugagcaaggaucagcaaauuggcgagaaaaucuucgccuccauugcccccagcaucuaugggcaugaggacaucaagcggggacucgcucuggcccuuuuuggcggggaaccuaaaaaucccggaggcaagcacaaagucagaggggauauuaacgugcugcucugcggcgacccuggaaccgcuaagucucaguuccugaaguacaucgagaaagucuccagccgcgccauuuucacaaccggccagggggcgucugccgugggacugaccgcuuauguucagcggcaucccguguccagagaauggacacuugaggccggcgcucucguccuggccgaucgcggggugugucugaucgacgaguuugauaagaugaaugaccaagauagaacgagcauucacgaagcgauggagcagcaguccaucucuaucagcaaagccggaauuguuaccucccuccaggcucggugcacagugaucgccgcugccaacccgauuggcgggcgcuacgacccuucucugaccuucagcgaaaaugucgaucuuacagagcccaucauuuccagauuugacauccuguguguggugcgggacaccguugauccuguccaagacgaaaugcucgcccgcuucguggugggcagccaugucagacaccaccccucuaacaaggaggaggaaggacuggcuaauggcuccgcggccgagccugcuaugcccaacacguaugggguggaaccgcugccucaggagguucuuaaaaaguacauuaucuacgccaaggaacgggugcaucccaaacucaaucagauggaucaggacaaggucgccaaaauguauagcgaucugcgcaaggagucuauggcuacaggauccauccccauuaccgugagacacaucgagagcaugauucggauggccgaagcgcaugcucgcauccaccugagagacuacguuauugaggaugacgugaacauggccauccgggucaugcucgaaucuuuuaucgauacccaaaaauucagcgugaugagauccaugcgcaagacauuugcccgguaucugagcuucagacgcgacaauaacgagcuucugcucuuuauucugaagcagcugguugcugaacaggugaccuaccagcggaauagauucggcgcccaacaggauacaaucgaggucccugagaaagaccuuguggauaaggcgcgccagauuaacauccacaaccucucugcuuuuuaugacuccgaacuguuccggaugaauaaauuuagccaugaccugaagagaaaaaugauucuccaacaguucuga

SEQ ID NO: 71952 - RNA, 5943 nt, Artificial Sequence
  derived and/or modified sequence opt5 from MCM3AP__Homo_sapiens__XP_006724127
augaaccccaccaauccuuucagcggccagcagccguccgccuuuucugcuagcuccucuaacguggggacacugcccagcaagccucccuucagauuuggacagccuucccucuucggccaaaauucuacgcugagcgggaaauccagcggauuuucucaggucuccagcuuccccgccucuuccggcguuagccauucuuccagcgugcaaacccuuggguuuacacagaccuccucugugggaccuuucagcggccuggaacauacauccaccuuugucgcgacaagcggcccgucuuccagcucugugcucgggaacaccggauucagcuuuaagucccccacgucuguuggcgcuuucccuagcaccuccgccuuugggcaggaagccggagaaaucgugaauagcggcuucgggaaaacagaguucucuuuuaagccccuggaaaacgcugucuucaaaccuauucuuggagccgaauccgagcccgagaagacccagagccaaaucgcuucuggcuuuuucacauuuucccacccgauuagcuccgccccuggcgggcuggcgcccuucucuuuuccucaggugaccagcuccucugccacgacaagcaauuucaccuuuuccaagcccguuagcucuaacaauucccucagcgcuuucacacccgcccugucuaaccagaauguggaagaggaaaaacggggaccuaaguccaucuuuggcagcucuaacaauagcuucuccagcuuuccggucucuuccgcugugcugggggagcccuuccaggccagcaaagcgggagugagacaaggcugcgaggaagccgucucccagguugagccucuccccucucugaugaaggggcuuaaaagaaaggaagaccaggaucggagcccucgcagacauggacacgagcccgcugaagacuccgauccgcugucucggggcgaccauccucccgauaagcgcccugugagacucaaccggccccgcggcgggacccuguucggaagaaccauucaagacguguuuaaaagcaauaaggaggucggccggcuugggaacaaagaggccaagaaagaaacaggauucguggaguccgcugaaucugaucacauggccaucccuggcgggaaccagagcguucuggcccccucccgcaucccgggcgugaauaaggaggaagagacggagagcagagagaagaaggaggacucucuccggggaaccccugcucgccaguccaacagaagcgaaucuacagauucccugggcgggcugagccccucugaggucaccgcgauucaguguaagaauauccccgacuaucucaacgaucggacaauucuggaaaaucacuuuggaaaaaucgccaaggugcaaagaauuuucacccgccgguccaagaaacuugcuguugugcacuuuuucgaccacgccagcgccgcucuggcccgcaaaaagggcaagucccuccauaaagauauggcgaucuuuuggcaccgcaagaaaauuagcccuaacaagaaaccguucucucugaaggagaagaaacccggggacggagaggucagcccuuccacggaagacgcucccuuucagcacucuccucuuggcaaggccgccgggcggacaggcgcuagcucccugcucaauaaaucuagccccgugaagaaaccuucccugcugaaggcccaucaguucgagggagauucuuuugacagcgcuuccgaaggcagcgaggggcucggacccugcguccugucucuuuccacccugaucggcaccguggccgagacaagcaaggaaaaauauagacuccuggaucagcgcgaccggaucaugagacaagcgcgcguuaagcggaccgaucuugacaaagccagaacauucguggggacgugucuggauaugugcccggagaaggaacgcuacaugcgggagaccagaucucagcucuccgucuuugaagugguuccuggaacagaccagguggaucacgcugccgcugucaaagaguauagccgguccucugccgaccaggaggaaccccugccucaugagcugcgcccccucccggugcugagcagaaccauggauuaccuugugacacaaauuauggaccagaaagaaggcucccugcgggacugguaugauuucguuuggaacagaacccgcgggauccggaaagacauuacgcagcagcaccucugugauccucugaccgucagccugaucgagaagugcacaagauuccauauucacugugcgcacuuuaugugcgaagaacccaugucuuccuucgacgccaagaucaauaacgagaauaugaccaaaugucuucaaagccucaaggaaauguaccaggaucugcgcaacaaaggcguguuuugcgcuucugaggccgaguuccagggauauaaugugcugcucagccugaacaagggcgacauccuuagagagguccaacaguuucauccugcugugagaaauuccucugaaguuaaauucgccgugcaggccuuugcugcgcugaacagcaacaauuucguccgcuuuuucaagcucgugcaguccgccucuuaccugaacgcuugucugcuucacugcuacuuuagccaaauuagaaaggaugcccuccgggcccugaauuucgcuuauacaguuuccacccagcgcagcacgaucuucccccuggacgggguggucagaaugcuccuguuucgggauugcgaggaggccacagacuuccuuaccugucauggacugacagugucugauggcugcguugaacucaaccgcuccgcguuucuggagcccgaagggcugagcaaaaccagaaaguccguguucauuacccggaaacuuacagucucugugggagagaucgugaauggcgggccucucccgcccgucccucgccacacgcccguuuguagcuuuaacucccagaauaaguacauuggcgagucucuggcugccgaacugccugugagcacccagagacccggauccgacacagugggcgggggacggggcgaggaaugcggggucgagccugaugccccgcucagcucucugccccaaucccuuccugcucccgccccuagccccgugccgcugccucccguucucgcgcugacccccucuguggcuccuucccuguuccagcuuagcguccagcccgaaccuccgcccccugagcccgugccuauguauucugacgaggaccucgcccagguuguggaugaacugauccaagaggcccugcagagagacugugaagaggucggaagcgcuggcgccgcuuacgccgcggccgcucucggcguguccaacgccgcuauggaagaucugcuuacagccgccaccacggggauccugcgccacauugcugcggaggagguuucuaaagaacgggagagacgcgaacaggagcggcaaagagccgaagaggagcgccucaagcaggaacgggagcuggugcugagcgaacuuucccagggacuggcugucgagcucauggagagagugaugauggaauuugugcgcgagacaugcagccaggaacugaagaaugccgucgagaccgaccaacggguuagaguggcccgguguugcgaagaugugugugcucaucucgucgaccuguuccuuguggaggagaucuuucagaccgccaaagaaacacugcaggagcuccagugcuucuguaaguaucugcaacgcuggagagaagcgguuaccgcucggaaaaagcugcgcagacagaugcgggccuuucccgccgcuccgugcugcguggaugucuccgacagacuucgcgcccuggcgccuucugcugagugucccauugccgaagagaaccucgcccggggccugcucgaucuggggcacgcuggaagacuuggcaucagcugcacacgccugcggagacuccgcaauaaaacggcccaucagaugaaggugcagcacuucuaccaacagcugcuguccgacguugcuugggccucucuugaucugccuagccucguggcggagcaucugcccgggcggcaggaacacgucuuuuggaagcucgugcugguccuuccugacguggaggaacagucccccgagucuuguggacggauucuggccaacuggcugaaaguuaaguucaugggcgaugaaggcagcguggacgacaccuccagcgaugcugggggaauccaaacacucucucuguucaauucccuuagcucuaaaggcgaccagaugauuuccgucaacgugugcaucaagguugcccacggggcucugagcgauggagccaucgacgccguggagacccagaaagaucuccugggcgcuucugggcucaugcugcuucugccgccuaagaugaaauccgaggacauggcggaagaggaugucuauuggcugagcgcccuccugcaacuuaagcagcugcuccaggcuaagcccuuucagcccgcccugccucucguggugcugguuccgucccccggaggcgacgccgucgaaaaagagguggaggauggccuuaugcugcaagaccuggugagcgcuaagcucauuucugauuacacagucaccgaaaucccugacacgauuaaugaccugcaggggagcaccaaagugcuucaggccguucaguggcuggugucccauuguccccacucucucgaucugugcugucaaacacucauccaguacgucgaggacggaauuggccaugaguucagcgggcgcuuuuuccacgauagacgggagcgcagacugggaggccuugcgucccaggaaccuggggcuaucaucgagcuguuuaacucugugcugcaguuccucgccagcguuguguccucugagcaacugugcgaccuuagcuggcccgucaccgaauuugccgaggcuggaggcucccggcugcucccucaucugcacuggaacgccccggaacaccuggcguggcucaagcaggccgugcuuggcuuccagcugccccaaauggaucugccuccccucggggcuccuuggcugcccguuuguagcauggugguccaguaugccucucagauuccguccagccgccagacacaaccugugcuucagucucagguggagaaucugcuccauagaaccuacugccgguggaaauccaagagccccucccccguccacggagcuggcccuucuguuauggaaauccccugggacgaucugauugcccuguguaucaaccauaagcucagagacuggacaccuccgcgccuucccgugaccagcgaggcucuguccgaggaugggcagauuugcguguacuuuuucaaaaaugaccugaagaaauacgaugucccucucagcugggaacaagcccggcugcagacgcagaaggagcuucagcugagagaaggacgccucgcgaucaaacccuuucacccuucugccaacaauuuccccaucccgcugcugcacaugcaucggaacuggaagagauccacagagugcgcucaagaaggccggauuccuagcaccgaggaccucaugcgcggggccucugcugaggaacuucuggcccagugucugagcuccucucuccugcuugagaaggaagagaauaaaagauuugaggaucagcugcagcaauggcucagcgaagacuccggagccuucaccgaccugacaucucugccccucuaucuuccucagacccuggugagccugucccacacgaucgagcccguuaugaagacaagcgugaccacaucuccucaguccgauaugaugcgggaacaacuccagcugagcgaggcuaccggcacaugccuuggcgaacgccugaaacaucucgagagacugauucgguccucucgcgaggaagaggucgcgagcgaacugcaccucuccgcccuucuggacaugguggauaucuga

SEQ ID NO: 71953 - RNA, 2457 nt, Artificial Sequence
  derived and/or modified sequence opt5 from MCM3__Homo_sapiens__NP_001257401
augcugaucugcagccagggccccagacucuuccuggaggugaccuuugggggaggcaaguccucugaagucuucgccccuggguggagccacccgggaaaccuucaugcuacacugguugagguggugcucuggcaacgggccuggcgcguccccugguguuggacgaugugguccugcggcagacugcgggaaauuaccuggacaucuuggaccacacgccuucugaauaacgcguuugaggaacucguggcuuuccagagagcccugaaagacuuuguugccagcaucgaugcuaccuacgccaagcaguaugaggaguucuacguggggcuggaaggauccuuuggcucuaaacacgucagcccucggacacucaccuccuguuuccugagcugcgugguuuguguggagggcauugucacgaagugcucucuugugcgccccaaaguggucagauccguucauuauuguccugcuaccaagaagacaaucgaacggcgcuacagcgaccugaccacacucguggccuuucccucuuccagcguguauccuaccaaagaugaggagaauaacccgcuggaaacggaguacgggcuuucugucuauaaggaccaccagacaauuaccauccaagaaaugcccgagaaagcgccugccggacagcugcccagauccguggauguuauccucgacgaugaccugguggauaaggcuaaaccuggcgaccggguccaggugguugggacauaccgcugccugcccggaaagaagggcggguacaccagcggaaccuucagaacagugcucauugccuguaaugucaaacagauguccaaggaugcucaaccgucuuuuagcgccgaagacaucgcgaaaauuaagaaauucuccaagacgcggagcaaagauaucuuugaccagcuggccaagucucuugcuccuuccauucauggccacgacuaugugaagaaagccauccugugccuccugcuuggcggggucgagcgcgaucuggagaacggaagccacauuagaggcgacaucaauauccuccugauuggggaucccucuguggcuaagagccagcugcuccgguacguucuguguaccgccccuagagccauccccacaaccggacgcggcuccucuggggugggacuuacagcugcggucaccacggaccaggaaacaggcgagcggagacuggaagccggcgcuauggugcucgccgaucgcgggguugugugcauugacgaguucgauaaaaugagcgacauggaucggaccgccauccaugaagucauggagcaaggaagagugaccauugcuaaggccggcauccacgcgcgccugaacgcucggugcuccgugcuugccgccgcuaaucccguuuaugggagauacgaccaguauaaaacaccuauggagaacaucggacugcaggauagccuccugucucgcuucgaccugcucuuuauuaugcuggaccaaauggauccggaacaggaccgggagaucuccgaucauguccuuagaaugcaccgcuaccgggcccccggcgaacaggacggggaugcuaugccucugggcagcgccguggacauucucgcgaccgaugaccccaauuucucucaggaggaucaacaggacacacagaucuaugaaaagcacgauaaccugcugcauggaacgaagaaaaagaaagagaagaugguguccgccgcuuuuaugaaaaaguacauucacgucgccaagaucaucaaaccugugcuuacccaggagagcgcuacauacauugccgaagaguauuccagacuccggucucaagacagcauguccucugauaccgcgcgcacaagccccguuaccgccagaacgcuggaaacccugauccggcucgcuacagcccaugcuaaggccagaauguccaaaaccguggaccugcaggacgccgaggaggcugucgaacuugugcaguacgcguauuucaagaaaguucuggagaaggaaaagaaacgcaagaaacggagcgaggaugaaucugagacagaggacgaagaggaaaagucccaggaggaucaagaacagaaaagaaagcgcagaaaaacccggcagccggacgccaaggauggcgacagcuacgauccuuaugacuuuucugauacggaggaggaaaugccccaggugcacacaccuaagaccgcugacucccaagagacaaaagaaagccagaaggucgagcucucugaaagccgccugaaagccuucaagguggcccugcuugauguuuuuagagaggcucaugcccaguccauugggaugaaucggcucaccgagagcaucaaccgcgacucugaggaacccuucuccagcguggaaauucaagcggcucuguccaaaaugcaggaugacaaucaggucauggugucugagggaaucauuuuucugaucuga

SEQ ID NO: 71954 - RNA, 2592 nt, Artificial Sequence
  derived and/or modified sequence opt5 from MCM4__Homo_sapiens__NP_877423
augagcucccccgccucuaccccuagcagacggggcucccgcagagggcgggcuacaccggcccagacgccccgcucugaggacgcgagaagcuccccuucucaacggcgcagaggagaagauagcaccuccacaggcgagcugcagcccaugccuaccagccccgggguggaccuccagucuccugcugcccaggauguccuguucuccagcccgccccaaaugcacucuuccgccaucccucuugacuuugauguuagcucuccccugacauacggaaccccuuccagccggguggaaggcacaccccgcuccggggugagaggaaccccgguccggcagcgcccugaccucggcucugcucagaagggccuucagguggaucugcaaagcgacggggccgcugccgaggauauuguugcguccgaacagagccugggacagaaacucgugaucuggggcacggacgucaacguggccgcuugcaaggagaauuuccagagauuucugcaacgguucauugauccccuggccaaagaggaagagaacguugggaucgacauuaccgaaccucucuauaugcagcgccugggagagaucaaugugaucggcgagcccuuucuuaacgucaauugugaacauauuaagucuuucgauaaaaaccuguacagacagcucaucuccuauccccaagaggugauuccuacauuugacauggcugugaaugaaaucuucuuugaccgguacccggauagcauucuggagcaccagauccaggucagacccuucaacgcccuuaagaccaagaauaugcgcaaccugaauccugaagacauugaucagcucaucacaaucucugggaugguuauucggaccagccaacugauccccgagaugcaggaggcguuuuuccagugccaggugugugcccauacgacaagaguggaaauggaccgcggacggauugcugagccuuccgucugcggcagaugucacaccacacauucuauggcccugauccacaaccgcagccucuuuuccgauaaacaaaugauuaagcugcaggaaagccccgaggacaugccggcuggccagaccccucacaccgugauccuuuucgcccauaaugaucugguugacaaagugcagcccggggaucgggucaacgugacaggaaucuauagagccguuccuauucgcgugaauccccgggucucuaacgugaaguccgucuacaaaacgcacaucgacgugauucauuauagaaagaccgaugcuaagcgccuccacggccuggacgaagaggcggagcaaaaacuuuucagcgaaaagcggguugagcugcucaaagaacugucuagaaagccugacaucuacgagcggcuggccuccgcucucgcccccagcauuuacgaacacgaggauaucaaaaaggggauccugcuucagcuguuuggaggcacacgcaaagacuucucccauaccgggagaggaaaguuucgggccgagauuaacauccuccugugcggcgauccgggcacaucuaagagccagcuucugcaguauguguacaaucucgucccuagagggcaauauaccuccggaaaaggcucuagcgcuguggggcugacggccuacguuaugaaggaccccgaaacacgccagcuggugcuccagaccggagcgcugguccuuuccgauaacggcauuuguugcaucgacgaguucgauaaaaugaaugaaagcacccggucugugcugcacgaggugauggagcaacagacacucuccauugcuaaggccgggaucauuugucagcugaacgccagaaccagcguucuggcugccgcuaaucccaucgaaucucaguggaacccuaaaaagacaacgaucgagaauauucaacuuccgcauacccuccugucccgcuuugaccugaucuuccuccugcuugauccccaggacgaagccuaugauagacggcuggcgcaccaucucgucgcccuguacuaucagagcgaggaacaggcugaggaggaacugcuugacauggccgugcucaaggauuacauugcuuacgcccacucuacaaucaugccucgccugagcgaggaagcgucccaagcccugauugaggcuuauguggacaugagaaaaaucggcagcucucggggaauggucuccgccuacccccgccagcucgaaagccugaucagacuugcugaggcccacgccaaggugcggcuguccaacaaaguugaggcuauugacguggaagaggcgaagcgccuccauagagaagcccugaaacagucugcuaccgauccucggacaggcaucgucgacauuagcauccugaccacggggauguccgccaccucucgcaagagaaaggaggaacuugccgaggcucucaaaaagcugauucugagcaaaggaaagacacccgcccucaaauaucagcaacuguuugaggauauccggggccaguccgacaucgcgauuaccaaggauauguucgaagaggcucuuagagcccuggccgacgaugacuuucucacagugaccgggaagacgguucgccugcuguga

SEQ ID NO: 71955 - RNA, 2205 nt, Artificial Sequence
  derived and/or modified sequence opt5 from MCM5__Homo_sapiens__NP_006730
augagcggcuucgacgaucccgggaucuuuuacuccgacucuuucggaggcgaugcccaggcugacgaggggcaagccagaaagagccagcugcagcggcgcuuuaaagaguuccucagacaguaucgggugggaaccgaucgcacaggcuuuacguucaaguacagagacgaacugaaacggcacuauaaccuuggggaauacuggauugaggucgaaauggaggaucuggcguccuuugacgaggaucucgcugacuaucuguacaagcaaccugccgaacaucuucagcugcucgaggaagccgcuaaagagguugccgaugaggugacccgcccgagacccucuggagaagaggugcugcaggacauccaggucaugcugaagucugaugcuuccccuucuagcauucggucccucaagagcgacaugaugucucaccuggugaaaauccccggcauuaucaucgccgcguccgccguucgcgcuaaggccacaagaauuagcauccaaugccggucuugucgcaauacccuuacaaacauugcuaugagaccuggccuggaaggguaugcccucccccggaaaugcaauaccgaccaggcgggacgcccuaaguguccgcuggaucccuacuucaucaugccugacaaaugcaaguguguggauuuucagacacuuaagcugcaggagcuccccgacgccgucccucauggcgaaaugcccagacacaugcaacuguacugcgaucgguaucugugugacaaagugguuccggggaacagagugaccauuaugggaaucuacuccauuaagaaauucggccucacgaccagccgcgggcgggauagagucggagugggcauccgcagcuccuauauccgggugcugggcauucaggucgacacagaugggagcggaagauccuuugcuggcgccguuucuccucaggaggaggaagaguuccgccggcuugcugcccugcccaauguguacgaagugaucagcaaguccauugccccuagcaucuuugggggaaccgacaugaaaaaggcuauugcgugccuccuguucggcgggucuagaaaacgccuucccgauggacugacacggagaggcgacaucaaccuccugaugcugggcgaccccgggaccgccaagucccaacuccugaaguucgucgagaaauguagcccuaucggaguguauacgucuggcaaggggagcuccgcugccggacuuacagccucuguuaugcgcgauccgagcucccggaauuuuauuauggaaggcggggcuauggugcuggccgacggcggagucgugugcaucgaugaguucgacaaaaugagagaggaugaccggguugcgauucaugaagcuauggagcagcagaccaucagcauugccaaggccggcaucacaaccacccucaacucucgcuguuccgugcuggcugccgcuaauagcgucuuugggagaugggaugaaacaaaaggagaggacaacaucgauuucaugcccacgauucuuucucgguuugacaugaucuucauugugaaggaugaacacaaugaggagagagacgucaugcuggccaagcacgugaucacccuccauguuuccgcgcugacacagacccaagccguggaaggcgagauugaucuggcuaaacucaagaaauuuaucgccuacugccgcgucaagugcgggccucggcugagcgcugaagccgcggagaaacuuaagaacagauauauuaucaugcgcuccggagccagacagcacgagcgggacucugaccgcagaagcuccauccccauuacagugcggcagcuggaagcuaucguucgcauugccgaggcucucucuaagaugaaacugcagccuuucgccaccgaagccgauguggaggaagcucugagacuuuuucaagucagcacgcucgacgcggcccuguccggcacacugagcgggguggagggcuucaccucucaggaggaucaggaaaugcucucccggaucgagaagcagcugaaacgcagauuugcuauuggaagccaagugucugaacauuccaucaucaaggacuucaccaaacagaaguaccccgagcacgccauucacaagguucuucagcugaugcuccggcgcggcgaaauccagcauagaaugcaacggaaaguccuguacagacugaaguga

SEQ ID NO: 71956 - RNA, 2466 nt, Artificial Sequence
  derived and/or modified sequence opt5 from MCM6__Homo_sapiens__NP_005906
auggaccuggccgcugccgcggagcccggcgcugggagccagcaccucgaagugagagaugaggucgccgaaaagugccaaaaacuguuccuugacuuucuggaggaguuccaguccucugauggagaaaucaaguaccuccagcuggccgaggaacuuauucggccugagcgcaacacccugguugugagcuuuguggaccucgaacaguucaaucaacagcuguccacaacgauccaggaggaguuuuauagagucuacccguaucugugucgggcucucaaaaccuucgugaaggaucgcaaagaaauuccccuggccaaggacuuuuacguugcuuuccaggaucuuccuacaagacauaagauccgggagcugaccucuagccgcauuggccuccugacaagaaucuccgggcaagugguccggacccaccccgugcauccugaacuuguuucuggaacauuucugugccucgacugucagaccgugauccgcgaugucgagcagcaguucaaauauacgcaacccaacauuugcagaaauccugugugugccaaccggcgcagauuucugcuggacaccaauaagagccgguucguggauuuucagaaaguccgcauccaggaaacacaagcggagcucccgagaggcuccauuccccggagccuggagguuauccuuagagccgaagcuguggagucugcccaggcuggggacaagugcgauuucaccggaacacugauuguggucccugacguguccaaacucagcacccccggcgcccgcgcggaaacgaacucucggguuuccggcguggacggguacgagacagaaggaaucagaggccugcgcgcccuugggguccgggaucugagcuauagacucguguuccuggcuuguugcguugccccuaccaauccccgcuuuggaggcaaggagcugcgggacgaggaacagacagcugagucuauuaagaaccagaugaccgugaaagaaugggagaaggucuucgaaaugucccaagauaaaaaucucuaccacaaccuguguaccagccuuuuuccgacaauccaugggaaugacgaggugaagagaggaguccugcucaugcuguucggcggcgugccuaaaacgaccggggagggaacaucccuucgcggcgauaucaacguuugcauugugggggaccccucuaccgccaagagccaguuucugaaacacgucgaagaguucuccccucgggccguguacacaagcggaaaggcuucuuccgcggccggccucaccgcugccguugugagagaugaagagagccacgaguuugucaucgaagccggggcucugaugcuggccgacaauggaguguguugcauugaugaguucgacaagauggaugugcgcgaccagguugcgauccaugaagcuauggagcagcaaacgauuucuaucacaaaagccggcgucaaggccacccucaacgcucggaccagcauccuggccgcugccaaucccauuuccggccacuaugacagaucuaaaagccuuaagcagaacaucaaccuguccgcgcccauuaugagccgguuugaucucuucuuuauccugguggacgaaugcaaugaggugacagauuacgccauugcucgcagaaucgucgaccugcauucucggaucgaggaauccauugauagaguguauagccuugacgauauccgccgguaccuccuguucgccagacaguuuaaaccuaagauuucuaaggaguccgaagacuucaucguugagcaguauaaacaucugcgccaaagagaugggagcggagugaccaaguccucuuggcggauuacaguccgccagcucgaaagcaugaucagacuguccgaggcuauggcccggaugcacuguugcgacgaggugcagccgaaacacguuaaggaagcguuccgccuucugaacaaaucuauuaucagaguggagacgcccgaugucaaucucgaccaggaagaggaaauccaaauggagguggaugagggcgccgggggaauuaacggccacgcugacagcccugcccccguuaaugggaucaacggcuacaaugaagacauuaaccaggaguccgcuccuaaggccagccugcggcugggauuuucugaauauugucgcaucuccaaucuuauugugcuccaucugagaaaggucgaggaggaagaggaugaaagcgcccugaaacggucugagcucgugaacugguaccugaaggaaaucgaguccgagaucgacagcgaagaggaacuuauuaauaaaaagcgcaucauugagaaagugauccacagacugacccauuacgaucacguccucauugaacugacacaggcuggccugaaggggucuaccgagggaagcgaguccuaugaagaggaccccuaccuuguugugaacccgaauuaucuccuggaagauuga

SEQ ID NO: 71957 - RNA, 2160 nt, Artificial Sequence
  derived and/or modified sequence opt5 from MCM7__Homo_sapiens__NP_005907
auggcccugaaggacuacgcucucgagaaagaaaaggugaaaaaguuccugcaggaguuuuaucaagaugacgaacuuggcaaaaagcaguucaaguacgggaaccagcuggucagacucgcccaccgggagcagguugcgcuguauguggaucuugacgauguggcugaagacgaucccgagcuggucgacagcaucugcgagaaugcccgcagauacgccaaacucuuugcugaugccgugcaagaacugcugccucaguauaaggagcgggaaguugugaacaaagacguccucgauguguacauugagcaucgccugaugauggagcagagaucccgggacccgggaaugguucgcucuccccagaaucaauauccugcugaacuuaugagacgguucgagcuguacuuucagggccccagcuccaacaagccucgcgugaucagagaaguccgggccgauucuguggggaaacucgugaccguccgcggaauuguuacaagagugagcgaggugaagcccaagauggucguggcgacguacaccugugaccagugcggcgccgaaacauaucagccuauccaauccccgaccuucaugccccugauuauguguccuucucaggagugccagacaaaucggagcgggggacgccuuuaccugcaaaccagaggcucccgguuuaucaaauuccaggagaugaagaugcaggaacacagcgaccagguucccgugggcaacaucccuagaucuauuacaguccucguggagggggaaaauacccgcaucgcucaacccggagaucauguuuccgugacgggcauuuuucugccgauccugcggaccggguucagacaggucgugcagggacuccugagcgagacauaucuugaagcccaccgcauugucaaaaugaacaagucugaggacgaugaguccggcgcuggggaacugacccgggaggaacucagacagaucgccgaggaagacuuuuacgagaaacuggcggccagcauugcuccugagaucuauggacaugaagaugugaagaaagcccuucugcuccugcugguuggcggcguggaccaaucuccccgcgggaugaagauccggggaaauauuaacaucugucucaugggcgauccuggggucgcuaagucccagcugcuuagcuacauugacagacuggcuccccgcucccaguauacaaccggacggggcucuagcggggugggacucacggccgcuguucugagagauuccgugagcggcgagcuuacacuggaaggcggggcgcucguccuggccgaccagggagugugcuguaucgaugaguucgacaaaauggcugaggccgaccgcaccgccauucacgaagugauggagcaacagacaaucucuaucgcuaaggccggcauucugaccacccucaaugcgcggugcuccauccuggcugccgccaaccccgcuuacgggagauacaauccucggcgcagccuugaacagaacauucagcugccggccgcucuccugucuagauuugaucugcuuuggcucauccaagaccggcccgauagagacaaugaucugcgccuggcccagcacauuacauauguucaucagcacagccggcaaccucccucccaguucgagccucucgacaugaaacugaugagacgcuacaucgcgauguguagagaaaagcagcccauggucccggagucucuugccgauuauaucacggcugccuacguggagaugcggcgcgaagccugggccagcaaagacgcgaccuauacauccgccagaacccugcucgcuauucugcggcugagcacagcccuugcucgccucagaaugguggaugucguggagaaggaagacguuaacgaggccauccggcugauggaaaugucuaaggauucccugcucggagacaaaggccagaccgcccgcacgcaaagaccugcugaugugauuuucgcgacaguccgggagcuggugagcgggggccgcucuguuagauuuuccgaggccgaacagcggugcgugagcagaggauucacccccgcucaguuucaggccgcccuugacgaguacgaggaacugaacgucuggcaagugaaugcuucccgcacccggaucacauucguuuga

SEQ ID NO: 71958 - RNA, 2523 nt, Artificial Sequence
  derived and/or modified sequence opt5 from MCM8__Homo_sapiens__NP_001268449
augaacggcgaguacagagggcggggauucggccgcgggagauuucagagcuggaagcggggacgcggcgggggaaauuucuccggcaaauggagagaacgggagcaccgccccgaccugucuaagaccacaggcaaaagaacgagcgaacaaaccccucaguuucuccuguccacaaagaccccgcagucuaugcagagcacacuugaucgguucauccccuauaaaggguggaagcuguacuuuuccgagguguauucugacagcuccccucucauugaaaagauccaagccuucgagaaauuuuucacccgccauauugaucuguacgacaaggaugagaucgaaagaaaaggaagcauucuugucgacuuuaaggagcugacagaaggcggggagguuaccaaccucauccccgauaucgcuacggagcugcgggacgccccugagaaaacccuggcgugcaugggacucgcuauucaccaggugcugacaaaggaucuugaacgccaugccgccgaacugcaggcucaggagggccucucuaaugacggggaaaccauggugaacgucccccacauccaugccagaguguauaauuacgagccucugacacaacuuaagaacguucgggcuaauuauuacggaaaauacauugcccugcgcggcaccguggucagaguguccaacaucaagccgcucuguacgaaaauggcguuccugugcgccgcuuguggcgagauucagagcuuuccccugccugaugggaaguauucucuccccacaaaaugcccuguucccgugugucggggaagauccuucaccgcccugcgcagcucuccgcuuacagucaccauggacuggcaguccaucaagauucaggaacugaugagcgaugaccaacgggaggcuggcagaaucccucgcaccaucgaaugcgagcucgugcacgaccugguggauuccuguguccccggggacacaguuacgauuaccggaaucgugaaagugucuaaugccgaagagggcagccggaacaagaaugauaagugcauguuucuucuguacauugaggcgaacuccaucagcaauucuaaagggcagaagacaaaauccagcgaagacggauguaagcacggcaugcucauggaguucucucugaaagaucuguaugccauucaggaaauccaagcugaggaaaaccucuucaagcugaucgucaauagccuuugcccugugauuuuuggccaugagcugguuaaggccgggcucgcucuggcccuuuucggaggcucccagaaauacgccgacgauaagaacagaauccccauucgcggggacccccacauccugguggucggagauccuggccucgggaaaucucagaugcugcaggcugcguguaacguggccccgcggggcguuuaugugugcggaaauaccacaaccacgagcggccugacagucacccucuccaaggacuccucuuccggggauuuugcucuggaggccggagcccuugugcugggcgaccaagggauuugcggaaucgacgaguucgauaaaaugggcaaccagcaucaggcucuccuggaagccauggaacagcaaagcaucucucuggcgaaggcuggggucguguguucccuucccgccagaaccagcauuaucgccgcugccaauccuguuggcggacacuacaacaaggcuaaaacaguguccgagaaucucaagaugggcucugcccugcugagccgcuuugaccucgucuucauucugcuugauacccccaacgagcaccaugaccaucugcucuccgaacacgugaucgcgauucgggccgggaaacagagaacaaucucuagcgcuacgguugcccgcaugaauagccaggauagcaacaccucugugcuggaggucguguccgaaaagccucugagcgagcggcuuaaagugguucccggagaaacaauugacccgaucccucaccagcuccugagaaaguauaucggcuacgcucggcaauacgucuauccccgccugucuaccgaggccgcgagagugcuccaggauuuuuaccuggagcuucggaagcagucccagagacugaauagcucuccuauuacaacccgccaacucgaaagccugauccggcugacggaggccagagcucgccuugaacucagagaggaagccaccaaagaggacgcugaggauauuguggaaaucaugaaguauuccaugcuggggacauacagcgacgaguucggaaaccuggauuuugaacggucucagcauggcuccgggaugagcaaucgcuccaccgccaaaagauucauuucugcccucaacaaugucgcugagcggacauauaacaauaucuuucaguuccaccaacugcgccagaucgcgaaggaacuuaacauucagguggccgacuuugagaacuucaucggcagccugaaugaucagggauaccuccugaaaaagggccccaaaguuuaucaacugcagaccauguga

SEQ ID NO: 71959 - RNA, 3432 nt, Artificial Sequence
  derived and/or modified sequence opt5 from MCM9__Homo_sapiens__NP_060166
augaacagcgaccaggugacccuggucggccaaguuuucgaguccuacgugucugaauaucacaagaaugauauccuccugauucuuaaagagagagacgaagaugcccauuaccccguggucgugaacgcuaugacacuguuugagacgaauauggaaaucggggaguauuucaacauguuuccuagcgagguucucaccauuuucgacuccgcccugcggcgcucugcgcuuacaauccugcagagccucucccagccggaagcugugucuaugaagcagaaucugcacgccagaauuagcggacugcccgucugcccugagcucgugcgggaacauauccccaaaaccaaggauguuggccacuuucuguccgugacagggaccgucauccgcacaagccuugugaaagugcuggaguucgagagagacuacauguguaacaagugcaagcaugucuuuguuauuaaagccgauuucgaacaauauuacaccuuuugucggccuucuuccugccccagccucgagucuugugacuccagcaaguucacgugccugucuggacuuuccagcuccccuacccgcuguagagauuaucaggaaaucaaaauucaggaacaggugcaacggcugucugugggcagcaucccgcgcuccaugaaggucauucucgaagacgaucugguggacagcugcaaaucuggggaugaccugacaaucuacggaauuguuaugcagagauggaagcccuuucagcaggacgugcggugugaggucgagaucgugcucaaggcuaauuacauccaaguuaacaaugaacaguccagcggcauuaucauggaugaggaagugcagaaagaguucgaagacuuuugggaguauuacaagucugauccuuucgccggccgcaacgucauucuggcuagccuuugcccccaaguguucgggauguaucuggucaaacucgccguggcgaugguucuggccggaggcauccagagaaccgacgcuacagggacccgggugcgcggagagucccaccuucugcucgucggcgauccugggacgggaaagucucaguuucugaaauacgccgcuaagauuacacccagaagcgugcugaccacaggcaucggcuccaccagcgccgggcucaccguuacagcggugaaagacucuggagaauggaaucuggaggccggcgcucuuguccuggccgaugcugggcucuguugcaucgacgaguucaacucccugaaggagcacgaucggacgagcauucaugaagccauggagcagcaaaccaucucuguggccaaggcuggacuugugugcaaacugaauacaagaaccacaauucucgcggccaccaacccgaagggccaguaugacccucaggaguccguuagcgucaauaucgcucuggggagcccccugcucucucgcuuugaucugauucuugugcugcucgacacgaaaaacgaagacugggaucggaucaucagcuccuucauucuggagaacaagggauacccuucuaaaagcgaaaagcugugguccauggagaagaugaaaacauauuuuugucuuaucagaaaucuccagcccacccugagcgacgugggcaaccaaguccugcuccgcuacuaccagaugcagcggcagucugauugcagaaaugccgcccgcaccacaauucggcugcuugagucccugaucagacucgcugaagcccacgcgcgccugauguuccgggacaccgugacacuggaggaugcuauuacgguugugagcgucauggaaucuuccaugcaaggcggggcccuucucggaggcgugaacgcccugcauaccagcuuucccgagaauccuggggaacaguaucagagacagugugagcugauccucgagaagcuggaacuucaaucucugcucagcgaggaacugcgccggcuggagagacuucagaaccaguccguucaccaaagccagccgcgggugcucgaagucgagacaacccccggaucucugcgcaauggcccuggggaggaauccaacuucagaacaagcucccagcaggagauuaauuacucuacccacaucuuuagccccggcggauccccugaaggcucucccgugcuggacccgccuccccaucucgagccuaaccggagcacguccagaaaacacucugcucaacauaagaauaaccgcgaugacagccuggauugguucgacuuuauggccacccaccaguccgaacccaaaaauacaguuguggucagcccucaucccaagaccucuggggagaacauggcuuccaagaucagcaauucuacaucccagggaaaagaaaagagcgaaccgggccagcggucuaaaguggauauugggcuucugccuucccccggagagaccggcgugcccuggagagccgacaacgucgaaagcaacaagaaaaagcgccucgcgcuggauuccgaggccgcuguuagcgccgacaagccugacucugugcugacgcaccacgugccgagaaaucuucaaaaacucugcaaggagcgggcucagaaacugugucgcaacagcacaagaguccccgcccagugcaccgugccuucccauccccagucuacaccuguucacagccccgaucggaugcuggacuccccuaagcgcaaaagacccaagucucucgcgcaaguggaggagccggccaucgaaaaugucaaaccucccgggagcccuguggcuaagcuggccaaguucaccuuuaaacagaaguccaaacuuauucauucuuucgaggaucacagccacguuucccccggcgcuaccaagaucgccgugcauagcccgaaaauuucucagcggcgcacaagacgggacgccgcucugccugucaagcgccccggaaagcucacguccaccccuggcaaccaaaucagcucucagccccagggggaaacaaaagaggugucccagcaacccccugagaagcacggaccgagagaaaaaguuaugugugcgcccgagaagcggaucauucagccugaacuggagcugggcaaugaaaccgggugcgcccaucuuacaugugagggagauaaaaaggaggaagugagcggcuccaacaagucugggaaaguccacgcuugcacccuggccagacucgccaauuucuguuuuacgcccccuagcgaguccaagagcaaaucucccccuccggaacgcaagaaccggggcgagagaggacccuccagcccucccacaaccaccgcuccuaugcgcgugucuaaacggaaguccuuccagcugagaggcuccacagaaaagcucaucgugucuaaagagagccuguuuacccuucccgagcugggggacgaagccuucgauugcgacugggaugaggaaaugcgcaagaaauccuga

SEQ ID NO: 71960 - RNA, 1923 nt, Artificial Sequence
  derived and/or modified sequence opt5 from MCMBP__Homo_sapiens__NP_001243307
augcccugcggcgaggacuggcugagccacccucucgggaucgugcagggauucuuugcccaaaacggcgucaauccggauugggaaaagaaaguuauugaguacuucaaggaaaaacugaaggagaacaaugcucccaaaugggugccuucccuuaacgaagugccccugcauuaucucaagccuaauucuuuugucaaguucagauguaugauccaggacauguuugaucccgaguucuacauggggguguaugagaccguuaaccagaauacaaaagcccacgugcugcauuuuggaaaguaccgggacgucgcggaaugcggcccucagcaagagcuugaucugaacagcccgcgcaauacgacccucgaaagacagacauucuauugugugcccguuccuggggaguccaccugggugaaagaggcuuacgucaacgccaaucaggcccgggugucucccagcacauccuauaccccuucucgccacaagagaagcuacgaagacgaugacgauauggaccugcagcccaacaaacaaaaggaucagcaugcuggagcccggcaggcuggcuccgugggcgggcugcaguggugcggagagccgaagcgccucgaaacagaggccagcaccggccaacagcuuaauucucuuaaccuguccagcccuuuugaccucaauuucccccugccuggggaaaaaggacccgcgugucuugucaagguuuacgaggauugggacugcuuuaaagugaacgacauucuggagcucuauggcauccugucuguggaucccguccuguccauucucaacaaugacgaaagagaugccagcgcucugcuugacccuauggaguguacggauaccgccgaggaacagcgggugcacucuccgcccgcuucccugguuccucgcauccacgugauccucgcccaaaagcugcagcauauuaacccccuucugccugcgugccucaauaaagaagagagcaagacauucgucuccucuuuuaugagcgagcugucccccgugagagccgaacugcucggguuccugacccacgcucugcugggagacagccucgccgcugaguaccugauccuucaucugauuucuacaguuuauacccggcgcgaugugcucccgcugggcaaauucacggucaaccuguccggcuguccuagaaauagcacauuuaccgaacaccucuaccggaucauucagcaccuggugcccgccucuuuccgccuucagaugacaaucgagaacaugaaucaucugaaguuuauuccucacaaggacuauaccgccaacagacucgucagcgggcugcugcaacuucccuccaauaccucucucgugaucgaugaaacacugcuggagcagggacagcucgacacgccuggcguucauaacgugaccgcucugagcaaucuuaucacauggcagaaagucgauuacgacuucuccuaucaccaaauggaguuucccugcaacauuaauguguucaucaccagcgaagggcggucucugcucccggcggacugucagauucaucugcagccucagcugaucccucccaacauggaggaauacaugaacucccuucucagcgccguucugcccucugugcugaauaaguuuagaauuuaccucacacugcuucgcuuccuggaguauuccaucagcgaugagaucaccaaagcugucgaagacgauuuuguggagaugcggaagaacgacccgcaauccauuacggccgaugaccuccaccagcugcuggugguugccagaugccuuucucucagcgcuggacagacaacccugucccgcgaacgguggcugagagccaaacagcucgagucucugcgccggaccagacuucaacagcagaagugcgucaauggcaacgaacuguga

SEQ ID NO: 71961 - RNA, 1743 nt, Artificial Sequence
  derived and/or modified sequence opt5 from MCOLN1__Homo_sapiens__NP_065394
augaccgcccccgcuggcccuagagggagcgagacagaacggcugcucacgccgaaccccggauacggcacccaggccgggccuucccccgcgccucccacaccuccggaggaagaggaccugcgcagacggcuuaaguauuucuuuaugucucccugcgauaaauuccgcgcuaagggaagaaaaccuuguaagcugaugcuccaaguggucaaaauccugguugugaccgugcagcuuauucuguuuggccucagcaaucagcuggccgucacauuccgggaagagaacaccaucgccuuucgccaccuguuccuccugggguacuccgacggagcugaugacacauuugccgcuuauaccagagagcagcuuuaccaagccauuuuccaugcgguggaucaguaucuggcccuccccgacguuucucugggccgguacgcuuaugugcgcggcgggggagauccuuggacgaauggcagcgggcuugcccugugccagagauacuaccaccggggacaugucgaccccgcuaacgauaccuuugacaucgauccgauggugguuacagacuguauucagguggauccucccgaacgcccucccccucccccguccgacgaccucacccugcuggagucuagcuccagcuauaagaaucucacacugaaguuccacaaacuugucaacgugaccauccauuuuagacugaagacgaucaaucuccaaucucugauuaacaaugaaauccccgauugcuacacauucuccgugcuuauuaccuuugacaacaaagcccacagcggccggaucccuauuucucuggagacacaggcgcacauccaggaguguaagcaucccuccgucuuccagcacggggauaauagcuuccgccuccuguuugacguuguggugauucugaccugcucucucuccuuccugcuuugugccagaagccugcuccggggauuucugcuucaaaacgaguucgucggcuuuauguggagacagcgcggccgggugaucucccugugggaaagacucgaguucguuaaugggugguauauccugcuggugaccucugauguccucacaauuagcggaacgaucaugaaaauuggcaucgaagcuaagaaccuggccuccuacgacgugugcagcauucuucuggggaccucuacacuccugguuugggugggagucauccgcuaucugaccuuuuuccauaauuacaacauccuuauugcuacacuccggguggcccugccuuccgucaugagauuuuguugcuguguggccguuaucuaucugggcuacugcuucugcggguggauugugcucggacccuaccacgucaaguuucgcagccugucuauggugagcgaaugucuuuucucccugaucaacggcgaugacauguuuguuaccuucgcugcgaugcaggcccaacagggccggucuagccucguguggcuguucucccagcuguaucuuuacagcuuuauuucucucuucaucuauaugguccugucccuguuuaucgcucucauuacgggggccuacgauacaaucaaacacccgggaggcgccggggcugaggagagcgaacugcaggccuauauugcgcaaugccaggacucuccuaccuccggaaaguucagacgcggcagcggguccgcuuguucucuucugugcuguugcggccgggaucccagcgaggaacauucccuccuggugaauuga

SEQ ID NO: 71962 - RNA, 1734 nt, Artificial Sequence
  derived and/or modified sequence opt5 from MCOLN3__Homo_sapiens__XP_011540041
auggagggcagacgggccggggcuggacgcgaaaugcagcuguucagagccgcgcccaagccuccggcugagauggccgaccccgaaguggucguuagcuccugcucuagccacgaggaagagaaccgguguaauuuuaaccaacagaccuccccuucugaggaacuccugcuugaggaucagaugcgcagaaaacugaaguucuuuuucaugaaucccugcgaaaaauuuugggcccggggccgcaagccuuggaaacucgcuauccagauucugaagaucgccauggugacaauucaacuugugcuguucgggcucagcaaccagauggucguggcuuuuaaggaggagaauacgaucgccuucaaacaucuguuucugaagggauacauggacagaauggaugacaccuaugcgguuuacacacaguccgauguguaugaccagcucauuuucgccgucaaccaauaccugcagcuuuauaaugugucuguuggcaaccacgcuuacgaaaauaaagggaccaagcagagcgccauggcuaucugucagcauuuuuauaaacggggaaacaucuaccccggcaaugauacauucgacauugauccugagaucgaaaccgagugcuuuuucguggaaccggacgagcccuuccacauuggcaccccugccgagaacaagcugaaucucacacuggauuuucaucgccuucugacggucgaacuccaauucaagcugaaagcgaucaaccugcagaccgugagacaccaggagcuccccgacuguuacgauuuuacacugaccauuacauucgacaauaaggcccacuccgggcggaucaaaauuagccuugacaacgauaucucuauccgcgaaugcaaggacuggcauguguccggaagcauucagaaaaacacccacuauaugaugaucuuugaugcuuucgucauucugacgugucucguuucucugauccuuugcauuagauccgugauccggggccugcaacuccagcaggaguuugugaauuucuuucugcugcauuacaagaaagaagucagcgugucugaccaaauggaguucguuaacgggugguauaucaugauuaucauuuccgauauccucacaauuaucggaagcauccugaagauggagauucaggccaagucccuuaccucuuacgacguguguagcauccugcucggcacauccaccaugcuggucuggcuuggggugauucgcuaucugggauuuuucgcuaaauacaaucuccugauccugacccuccaggccgcccugccuaacguuauuagauuuugcuguugcgcugcgaugaucuaucuuggcuacugcuucuguggcuggauugugcuggggcccuaccacgauaaguuccggagccucaauauggucucugaaugccuguuuucccugaucaacggagacgauauguucgccacauuugcuaaaaugcagcaaaagagcuaucuuguguggcuguucucuagaaucuaccucuauagcuuuauuucccuguucaucuacaugauucucucucuguuuaucgcccuuauuacggacaccuaugagacaaucaaacaguaccagcaggauggcuucccggaaaccgagcugcgcacauuuaucagcgaauguaaggaccucccuaauuccgggaaguaucggcuggaggacgaucccccugucagccuguucugcuguugcaaaaaguga

SEQ ID NO: 71963 - RNA, 1833 nt, Artificial Sequence
  derived and/or modified sequence opt5 from MCPH1__Homo_sapiens__NP_001166045
auggccgcucccauccugaaggacguggucgccuacguugagguguggagcuccaacggcaccgaaaauuauucuaaaacauucacgacccagcucguggauaugggggcgaaggucagcaaaacauuuaacaagcaagugacccacguuauuuucaaagacggauaccaguccacaugggauaaggcucagaagagaggcgugaaacuggucucugugcuuuggguugagaagugccggaccgccggggcccauaucgacgaaagccuguuuccugcugccaauaugaacgagcaccucuccucucugauuaaaaagaaacgcaaguguaugcagccgaaggauuucaauuuuaaaacacccgaaaacgacaagagauuccagaaaaaguuugagaaaauggcuaaggagcuucaacggcagaaaaccaaucuggaugacgaugugccuauccuccuguucgaaagcaacggaucccugauuuauacgcccaccaucgagaucaauagcucucaucacuccgccauggaaaagcgccuccaggagaugaaggagaaaagagaaaaccugagcccuacaucuucccaaaugauucagcagagccaugacaaucccucuaacucccuuugcgaggcgccucugaauaucagccgggauacccucuguuccgacgaauacuuugccggcgggcugcacucuagcuucgaugaccuuugcggaaacuccggcuguggcaaucaggagcgcaagcuggaagggagcauuaacgacaucaaaucugaugucugcauuuccagccucgugcugaaggcuaacaauauccacucuagcccguccuuuacacaucuggacaaaucuagcccccaaaaguuccucuccaaccugagcaaggaggagauuaaucuucagagaaacaucgccggaaaaguggucaccccugaucagaagcaagcugccggcaugucucaggaaacguuugaggaaaaauaucggcugucccccacacucagcucuaccaaggggcaccuucuuauccauucccgcccuagaagcuccucuguuaaacggaagcgcgugagccacggaucccacucucccccgaaggagaaauguaagagaaaacggagcacacgcagauccauuaugccucggcugcagcucugcagaagcgaagaccgccugcagcauguggcgggccccgcccuggaggcucucucuuguggggaguccagcuacgaugacuauuucucuccugauaaucugaaggaacgguacuccgagaaccuuccucccgaaagccaacugcccucuagcccggcccagcucuccugcagaagccugucuaaaaaggagcgcaccuccaucuucgaaaugagcgacuuuuccugugucggaaagaaaacccggacaguggauauuacgaauuucaccgcuaagacaaucucuagccccagaaaaaccggcaacggcgaggggcgcgccacauccucuugcguuaccagcgccccugaggaagcucugcggugcuguagacaggcgggaaaggaggacgccugccccgaaggcaauggguuuuccuacacgauugaggauccugcucugcccaaaggacacgacgacgaucucacaccgcuggagggcucucuggaagagaugaaggaagccguggggcucaaaagcacccagaacaagggaaccacauccaagaucagcaauucuuccgagggcgaagcccaaagcgagcaugagccuuguuucaucgucgacugcaacauggaaaccucuacagaggaaaaagagaaucugcccggcggguauuccggaagcauguga

SEQ ID NO: 71964 - RNA, 1428 nt, Artificial Sequence
  derived and/or modified sequence opt5 from MCRS1__Homo_sapiens__NP_001012300
augaccagaggcaccgggggaacggcccagcggggccgcagcgggcccgacucccaaggacugcucgauucuagccugauggcuuccggcaccgccucuagaagcgaggacgaagagucccuugcggggcagaagcgggcuucuagccaggcccugggaacaaucccuaaacgcagauccagcucucgguucauuaagcgcaaaaaguuugaugacgaacucguggaguccagccuggccaaaucuuccaccagagcuaagggcgccagcggcgucgaaccggggcggugcucuggauccgagcccagcuccucugagaagaaaaagguuagcaaagcuccuuccacacccgugccucccagcccugccccggcgcccggccuuaccaagcgcgugaaaaagucuaagcagccucugcaagucacaaaagaucucgggagauggaagcccgccgacgaucugcugcucaucaacgcugugcugcagaccaaugaccuuacguccguucaccugggagugaaauucagcugucgguuuacccuccgcgaaguccaggagagaugguacgcccugcuuuaugauccugugauuucuaagcuggcuugccaggccaugcggcaacuccaucccgaagcgaucgccgcuauucagagcaaagcccuguucuccaaggcugaggagcagcugcucucuaaaguuggcagcacaucccagccgacccuggaaacauuucaagaccuucugcaccgccauccugaugccuucuaccucgccagaaccgcuaaggcgcugcaggcccacuggcagcuuaugaagcaauauuaccugcucgaggaccagacggugcagccccugccuaaaggggaucagguccugaacuuuagcgacgcugaagaccucaucgaugacucuaagcugaaagauaugcgggacgaggugcuugaacaugagcugaugguggccgauagacgccaaaagcgggagaucagacagcucgaacaggagcugcacaaauggcagguccuuguugacuccauuacaggaaugagcucucccgauuucgacaaucaaacccuggccgugcuccgcggccggauggugagauaucugaugcgcucccgggaaaucacacugggcagagcuaccaaggauaaccagauugacgucgaucucagccuggaggggcccgccuggaagaucucccgcaaacagggagugauuaaacuuaagaauaacggcgacuuuuucaucgcgaaugaagggcggagaccuauuuacaucgacggacgcccgguucuguguggcucuaaguggcggcucagcaacaauuccguggucgagaucgcuucucugagauuuguguuccugauuaaccaggaucuuaucgcccucauucgggccgaggcugccaaaaucacaccccaauga

SEQ ID NO: 71965 - RNA, 2337 nt, Artificial Sequence
  derived and/or modified sequence opt5 from MCTP1__Homo_sapiens__NP_001002796
augcuggacagcugcaagcucaaauccgccuguaaccugcccuucaucugcaauaagaaaauuaucaacaccgcuggcacaucuaaugccgaggugccucuugcggauccggggauguaccagcuggacauuacgcucagacggggacaaagccuggcugcccgcgauagaggcgggaccuccgaccccuaugucaaguuuaaaaucggaggcaaggaaguuuuccggucuaagauuauccacaaaaaccuuaauccugugugggaggaaaaggccuguauccugguggaucaucuccgcgagccccuguacauuaaagucuuugacuaugauuucgggcugcaggacgauuuuaugggaagcgcuuuccucgaccugacacagcuugaacugaacagaccuaccgaugugacacucacccugaaggacccccacuacccugaucaugaccuuggcaucauucugcucuccguuauccugacaccgaaagagggcgagucucgggacgugaccaugcugaugcgcaagagcuggaagagauccagcaaagaacucucugagaaugaagucgugggguccuauuuuagcguuaagucucuguucuggcggacgugcggacgccccgcccuuccugugcugggcuuuuguagagcugagcuccagaaccccuacugcaaaaauguccaauuccagacccagucccugcggcuuagcgaucugcaccgcaagucucaucucuggagagggauuguguccaucacacugauugagggacgggaccugaaagccauggauagcaacggccucuccgacccuuaugugaaguuucgccuggggcaccagaaauacaagucuaagaucaugcccaaaacccuuaauccgcaauggagagaacaguucgauuuucaccuguacgaggaacggggaggcgucaucgacauuacagcgugggauaaggacgccggcaaaagagaugacuucaucgggcgcugucagguugaucucagcgcucugucccgggagcagacccauaaacuugaacugcaacucgaggagggagaaggccaccuggugcugcucgugacgcugacagccagcgcuaccgucucuauuuccgaccuuagcgugaacucucuggaggaccagaaagaaagagaggaaauccucaagcgcuauagcccucugcggauuuuccauaaucugaaggauguuggguuucuucaggugaaagucaucagagccgagggacucauggcggccgacgugacaggcaaguccgaucccuucugcguuguggagcugaacaaugaccgccugcucacccacaccgucuacaaaaaccugaacccugaauggaauaagguguuuacauucaacaucaaagauauucacucuguccuugaggugacgguuuaugacgaagaucgggacagaagcgcugauuuucuggggaagguggccaucccccuccuguccauucaaaauggagagcagaaggcuuacguccugaaaaacaagcagcuuaccggccccacaaaaggcgugaucuaucucgaaauugacguuaucuucaaugccgugaaggccagccugcgcacccugaucccuaaagagcagaaguacauugaggaagagaaccggcucucuaagcaacugcuucugagaaauuuuauccgcaugaaacggugugucauggugcucgugaacgcugcguauuacguuaauuccugcuucgauugggacagcccgcccagaucucuggccgcuuuuguccuguuccuuuuugugguguggaacuucgaacucuacaugauuccucugguccugcuccugcuucugacauggaauuauuuucucaucauuuccgggaaggauaaccggcagcgcgacaccgugguugaggacaugcuggaggaugaagaggaagaggacgauaaagacgauaaggacagcgaaaagaagggauucaucaauaaaauuuacgccauccaggaggugugugucuccgugcagaacauccuggaugagguugccucuuucggcgaaagaauuaagaauacguuuaacuggacagugcccuuccuuagcuggcucgcuaucgucgcccugugcguguuuaccgcgauucuguauugcaucccucuccgguacauuguucuggugugggggaucaacaaguucaccaaaaagcugagaucccccuaugcuaucgacaauaacgagcuucucgauuuucugucucgcgucccgagcgacgugcaagugguccaguaccaggaacugaaaccugaucccucccauagcccuuauaagcggaaaaagaauaaccuuggauga

SEQ ID NO: 71966 - RNA, 2472 nt, Artificial Sequence
  derived and/or modified sequence opt5 from MCTP2__Homo_sapiens__NP_001153115
auggaccuggauaagcccagcguguggggcucccucaaacagagaacccggccucugcuuaucaaccugucuaagaaaaaggucaaaaagaauccgagcaagcccccugaccuccgcgccagacaccaucuggaucggcgccuuucccugucuguucccgaccuccuggaggcugaagcccuggcgccugaggggagacccuacagcggaccucaauccucuuauacaagcgugccguccagccucucuacggcuggcauuuuccccaaauccucuagcuccagccugaagcagucugaagaggaacuugauuggucccaggaggaggccagccaccuucauguggucgaaaccgacuccgaggaagccuacgcuucuccugccgagcggcgcagagugagcuccaacgggaucuuugaucuccagaaaacaagccugggaggcgacgcucccgaggaaccugagaagcugugcgggucuuccgaucugaaugccagcaugaccucucaacacuucgaagaacagagcguucccggagaagcguccgacggccucucuaaccugccgagcccuuuugccuaucugcucacaauucaucugaaagagggccggaaucuugugguccgcgauagaugugggaccuccgaccccuacgugaaguucaagcugaacggaaaaacacucuauaagagcaaaguuaucuacaagaaucugaacccugugugggaugagauugucgugcuucccauccagucucuggaccagaaacuccgggugaaggucuaugaccgcgaucugaccacguccgacuuuaugggcagcgcuuucguuauccugucugaucucgaacugaauagaaccacagagcacauucuuaaacuggaagaccccaacucccucgaggaugacaugggggugaucgugcugaaucuuaaccuggucgugaagcaaggagauuuuaagcggcaccgcuggagcaauagaaaacggcucuccgccucuaagagcucccugauuagaaaccugcgccucucugaaagccugaaaaagaaucagcuuuggaacggcaucauuuccaucacccugcucgaggggaaaaacguuagcggaggcucuaugacagagauguucgugcagcugaagcugggcgaccagcgguacaaguccaaaacccuuugcaagagcgcuaauccucaauggcaggaacaguuugauuuccauuacuuuucugacagaauggggauucucgauaucgaggucuggggaaaagacaacaagaaacacgaggagcgccugggcacguguaagguggacaucuccgcccugccgcucaagcaagcgaauugccuggaacuuccccuggauagcugucucggggcccugcugaugcuuguuacacucaccccuugcgcuggagugucugucagcgaccugugugugugcccccuggccgaucucuccgagcggaaacagauuacacagagauauugucugcagaacagccuuaaggacgucaaagaugugggcauccugcaaguuaaggugcucaaagcugccgaccugcuggccgcugauuucucugggaaguccgacccuuuuugccuucucgagcugggaaaugaucgccugcagacccauaccgucuacaagaaccucaaucccgaauggaacaaaguguucacauucccgauuaaggacauccacgauguucuggaggugacggucuuugacgaagauggcgacaaaccucccgacuuccuuggcaagguggcgauuccucugcucagcauccgggaugggcagcccaauuguuaugugcugaaaaacaaggaccuggagcaggccuuuaaaggaguuaucuaccuugagauggaucucauuuauaauccugucaaggcuuccaucagaaccuucacaccccgcgaaaagcgguuuguggaggacucuagaaaacugagcaagaaaauucugucccgcgauguggaccgggucaagagaaucaccauggccauuuggaacacaaugcaauuccucaaaucuugcuuucagugggaaagcacccugcgguccacgaucgccuucgcugagucugaaaagaagggccuuaucgagcgcauuuacauggugcaggauaucguuagcacagugcagaauguccuggaggaaauugccuccuuuggggagagaaucaaaaacaccuucaauuggaccgugccguuucucagcucucuggcgugccugauucuugcugccgccacaaucauucuguauuucaucccucuccgguacaucauucugaucuggggaauuaacaaguuuaccaaaaagcucagaaaccccuacuccaucgacaauaacgaacugcuugauuuccugagccgcguucccucugacgugcaaaaaguccaguaugcugagcucaagcuguguuccagccacucuccucugcggaagaaaagauccgcccuuuga

SEQ ID NO: 71967 - RNA, 549 nt, Artificial Sequence
  derived and/or modified sequence opt5 from MCTS1__Homo_sapiens__NP_001131026
augggcaaggggagauucgacgagaaagaaaacgugagcaauugcauccagcugaagaccuccgucauuaaaggaaucaagaaccaacucauugagcaguuucccggcaucgaaccuuggcugaaucagauuaugccgaaaaaggaucccguuaagaucgugcggugucacgagcauaucgaaauucuuacagugaacggggagcuccuguucuuucgccagagagagggaccuuucuaccccacgcugcggcuucugcacaaauauccuuuuauccucccccaucaacaggucgacaagggcgccauuaaauucgugcugucuggggcuaauaucaugugcccuggacugaccagcccgggcgccaagcucuaccccgcggcuguugauacaauuguggccaucauggccgaaggcaaacagcacgcucugugugucggggugaugaagauguccgccgaggacauugaaaagguuaacaaaggaaucggcaucgagaauauucauuaucuuaacgaugggcuguggcacaugaagaccuacaaauga

SEQ ID NO: 71968 - RNA, 993 nt, Artificial Sequence
  derived and/or modified sequence opt5 from MCU__Homo_sapiens__NP_001257608
auggccgcugccgcgggcagaagccugcuccugcuucuguccucucgcgggggaggcgggggaggcgcugggggaugcggcgcccucaccgccggcuguuuccccgggcugggagugagccggcacagacagcaacagcaucaccggacaguccaucagcgcaucgcuuccuggcagaaccuuggcgccguuuacugcucuacgguggugccuagcgacgaugucaccgugguuuaucaaaaugggcugccggugauuuccgucagacuccccucucggcgcgagagaugucaguuuacacugaagccuaucagcgacuccgugggaguuuuccugcggcagcuccaggaagaggaucgcggcauugacagaguggcuaucuacagccccgaugggguccggguggccgcgucuaccggaauugaccugcuucugcucgaugacuuuaaacuggugaucaacgaucuuacauaucacguccgcccucccaagagaguugaaaugggcuucugccaugugggccaaaauggguuugagcugcucaccuccagcuaccugccugccucugcuucccagagcgccgaaaucauugcugugcggaucgagauuucucgcaaagccgagaagagaacaacccugguccucuggggaggccuggcguauauggccacgcaguucgggauccuugcucggcugaccuggugggaauacuccugggacauuauggagccggugacauauuuuaucaccuacggaagcgccauggcuauguacgccuauuucguuaugacaagacaggaauacguguaucccgaggcccgcgaucggcaauaccuccuguuuuuccacaaaggcgcuaagaaguccagauuugaccuugagaaauauaaccagcugaaggaugcgauugcccaggcugaaauggaccucaaacgccugcgggacccucugcaaguccaccucccccugagacagaucggggagaaggauuga

SEQ ID NO: 71969 - RNA, 1080 nt, Artificial Sequence
  derived and/or modified sequence opt5 from MCUR1__Homo_sapiens__NP_001026883
auggacugcggcagcgucgggggacagagaacccaacggcugcccggccgccagagacuccuguuccuuccuguggggcuguccggacggccgggcgggucugagacaagcgcccgcagaugucucuccgcucugucugauggacuuggcgcccugcggccccgcgcgccugcugccagaggcgggguuagccgggccuccccucuccugcugcuccugcuugugcccucuccccgccuggcugccgcugccccuagacggcagcucggagacugggaacgcagcagacugggcuacgcggccccgcccgcugggcgguccagcgccuggcgcugcucuccuggaguggcugccgcggccggcgcccuuccccaguaucacgggccugcucccgcucuggucuccuguagacgggagcucagccugucugccggaucccugcaacucgaaagaaagcgccgggauuuuacgagcucuggcuccagaaaacuguacuucgacacccaugcccuugugugccugcucgaggauaacggcuuugcuacacagcaggcggaaaucauuguuagcgcccuggugaagauccuugaggcuaauauggacauugucuauaaagauauggugaccaagaugcagcaagagaucacauuccagcagguuaugucccagauugccaacgugaaaaaggacaugaucauccuggaaaagucugaguuuagcgcccuccgcgcugaaaaugagaaaauuaagcuggagcugcaccaacucaaacagcaggucauggaugaagugaucaaggugcggaccgacacaaaacuggauuucaaccuugagaaguccagagucaaggaacuguacagccucaaugagaaaaagcugcuugaacugcgcaccgagauuguugcccuccaugcgcaacaggaccgggcucugacgcagaccgauagaaaaaucgagacagaaguggccgggcugaagaccaugcucgagucucacaaacuggacaacauuaaguaucuugccggauccaucuuuacaugucugaccguggcucucggcuucuaccgccuguggauuuga

SEQ ID NO: 71970 - RNA, 6270 nt, Artificial Sequence
  derived and/or modified sequence opt5 from MDC1__Homo_sapiens__NP_055456
auggaagacacccaggccaucgauugggacguggaagaggaagaggaaacagagcaaagcuccgagucucugagaugcaacguggaacccguuggacggcugcacauuuucagcggggcucauggaccugagaaggauuuuccccugcaccuuggcaaaaaugugguggggagaaugcccgacuguuccgucgcccugccuuuccccucuaucagcaagcagcaugccgaaauugagauccucgcuugggauaaagccccuauucugagagacugcggaucccuuaacggcacgcagauccugcggcccccuaaggugcucucuccggggguuagccaccgccugagagaucaggagcugauccucuuugccgaccugcuuugucaauaccaucggcuggaugugucccuccccuucgucagccgcggaccucugaccguggaagagacacccagaguucagggcgaaacccagccucagcggcuucugcucgcugaggacucugaagaggagguggauuuucuguccgaacgcagaauggucaaaaagagccggacaaccucuuccagcgugauugugcccgagucugacgaagagggccacuccccgguccucgggggacucggcccucccuucgccuuuaaucugaacagcgauacagacguugaagaggggcaacagccugcuaccgaggaagccuccucugcggcccgcagaggagcuacgguggaggccaagcagagcgaagcugagguggucaccgaaauccagcuugagaaagaccaaccccuggugaaggagcgggauaaugacacaaaaguuaagcgcggcgccgggaacggagugguccccgcgggcgugauucucgaaagaucccagccuccgggcgaggauagcgacaccgauguugacgaugacucucggcccccugggagacccgccgaagugcaccuggagcgcgcucagccuuucggauuuaucgauuccgacacagaugccgaggaggaacggauucccgcuaccccggucgugaucccuaugaaaaagagaaagauuuuccauggcgucgggacgcgcggacccggcgccccugggcuugcccaucugcaggaaagccaggcuggaucugacacagacguggaggaaggcaaagcgccccaggccguuccucucgaaaagagccaggcuuccauggugaucaauucugauaccgacgaugaggaagaggucagcgccgcccugacacuggcucaccucaaagaaucccaacccgccaucuggaaccgggacgcggaggaagauaugccgcagagagugguucugcuucagcgcagccagaccaccacagagcgggacucugauacggacguggaggaagaggaacugccugucgagaauagagaagcugugcucaaggaucacaccaaaauucgcgcccuggugcgggcccacuccgagaaggaccaaccgcccuuuggcgauagcgacgauucuguugaggcugacaaauccagcccugggauccaucuugaaagaucccaggccucuacaaccgucgacauuaacacacagguggagaaggaagugccgcccggaagcgcuaucauucacaucaagaaacaucaggucuccguggagggcaccaaucaaacggauguuaaggccgucgggggaccugcgaaacugcucgucgugucucuggaggaagccuggccccugcacggcgacugcgagacagaugcugaagaggggaccagccucaccgccuccguuguggcugacguccgcaagagccagcugccugccgaaggcgaugcgggagccgagugggcugccgcugugcuuaaacaggagcgggcccaugaaguuggcgcccaagggggacccccuguggcucaagucgagcaggaccugcccaucucuagagaaaaccucacagaucuggugguggacaccgauacacugggcgaguccacgcagccgcaacgggaaggggcgcaggucccuaccggacgcgagagagagcagcacguuggcgggacaaaggacagcgaagauaauuauggcgacucugaggaucuugaccuccaggccacccaauguuuccuggaaaaccagggacuggaggcugugcaguccauggaagacgagcccacacaggccuuuaugcucaccccuccccaagagcugggcccgagccacugcucuuuccagacgaccgggacacuugaugaaccuugggaggugcuggccacccagcccuucugucuccgggaaagcgaggacuccgagacacagccuuuugauacccaucuggaggcuuacggacccugccugucucccccuagagccauuccgggcgaccaacaccccgaguccccuguccauacggaacccauggggauccagggacgcggccggcagacaguggauaagguuauggggauuccuaaagagaccgcggaaagagugggccccgagcgcggaccucuugagagagaaacagagaagcuccugccggaacggcaaaccgacgucaccggcgaggaagaacugacaaaagggaagcaggaucgcgagcagaaacagcuccuggcuagagacacgcaacggcaggaauccgauaagaauggagagagcgccucccccgaacgcgacagagagucucuuaagguggaaaucgagaccagcgaggaaauucaggagaaacagguucaaaagcagacacugccuuccaaagccuucgaacgggagguggagcgccccgucgcuaacagagaaugugauccugccgagcucgaagagaaggugcccaaaguuauccuggaacgggacacccagcgcggcgagccggaagggggaucucaggaccaaaagggccaggcgagcuccccuacacccgaacccggggugggcgcuggagaucugccuggccccaccucugccccugucccgagcgggucccagagcggaggcagagggucucccguguccccucggagacaccagaagggacuucucaacugcaaaaugcccccugccgagaaggcuagccgcauccgggccgcugaaaaagugucuagaggcgaccaagagucccccgaugccugucugccgccuacgguccccgaagcgccugcgcccccucagaagccccugaauagccagucucaaaaacaccucgcuccgccuccccugcuuagcccccugcucccuagcauuaagccgacaguucgcaaaacccggcaggacggcucccaggaggcccccgaggcuccucugagcucugaacuggagcccuuucauccuaagcccaagaucagaacccgcaaaagcucccggaugacaccuuucccggccaccucugccgcucccgaaccucaccccagcacauccacggcgcagccugugacccccaagccgacaucucaagccaccagaagccgcacaaaccgguccucugugaaaaccccugagcccgucgugcccacggcuccugaacuucagcccagcaccuccacagaucagccuguuaccagcgagccgacaucucaggugaccagagggcggaagucccgcagcucugucaaaacacccgagaccgugguuccuacggcccucgaacugcaacccuccacaagcaccgacagaccugugaccuccgagcccacaucucaggccacccggggacgcaagaauagaagcuccgucaagacgccggaaccugugguccccacagcuccugagcugcagcccagcaccucuacagaucagccugugaccuccgagcccacauaucaagccacccggggccgcaaaaaccgcagcucuguuaagacgccggaaccugugguccccaccgcgcccgagcuccggccuagcacauccaccgacagaccggugacacccaaaccuaccucucgcacgacacggagcagaaccaauauguccucuguuaagacacccgaaaccguggucccuaccgcucccgagcugcagauuagcacauccacggaucagccugugacccccaaaccgacaagccgcaccacacggucuagaaccaacauguccagcgugaagaauccugaauccacgguucccaucgccccugagcuucccccgucuacaagcaccgagcaaccugucacccccgaacccacaucccgcgccaccagagggcggaagaaccgcucuagcggaaaaacaccugagacgcuggugcccaccgcuccuaagcucgaaccguccacaagcaccgaccagcccgugacaccugagcccaccucucaggccacgagaggccggaccaaucgcuccagcgucaaaacaccugaaaccgugguucccacagcgccugagcugcagccgucuaccuccacagaucaacccgugacgccugagcccaccagccaggcuacaagagggcggaccgacagaucuagcgucaagaccccugaaacagugguucccacggccccggagcugcaggccuccgcuucuaccgaucagccugugacaagcgaacccaccucccgcacaacccggggacgcaaaaaccgcagcuccgucaagacgcccgagacagugguuccugccgcucccgaacuucaaccuucuaccagcaccgaccagccggugacacccgagccuaccucccgggccacaagaggccggaccaaucgcucuagcgucaagacgcccgaguccauugugccuaucgcgcccgaacugcagccgucuacaagcagaaaccagcucgugaccccugagcccacaucccgggccacccgcugcagaacgaaucggagcucugucaaaaccccugaacccguugugccgacagcuccugagccccaucccaccacauccaccgaccaaccugugacacccaagcugaccagccgcgccacgagacggaaaacaaacagaucuuccgucaagaccccuaaaccgguggagcccgcugccagcgaucucgaaccuuuuacccccacagaccagucuguuaccccugaggccauugcucagggcgggcaguccaagacacugagaagcuccacggugcgggcgaugcccgucccuaccacaccggaguuccaaagccccgugaccacagaucagccuaucucucccgagccuaucacccagcccagcugcauuaaaagacaacgcgccgcuggaaauccgggcucccuugccgccccuaucgaccacaagcccuguucugcuccccuggaaccuaagagccaggccucccggaaccagagauggggagcgguucgcgcugccgagucucucacggccauucccgagccugcuagcccgcagcugcuggaaacccccauccaugccucccaaauucagaaaguggagccugcggggcggucuagauuuacacccgaacuucagccuaaggccagccagucccgcaaacggagccuggcuaccauggauucucccccgcaccaaaagcagccucagagaggcgaggucucccagaaaacagugaucaucaaggaagaggaggaagacaccgccgagaagcccgggaaagaagaggaugucgugacgccuaagcccggaaaacgcaagcgggaccaagcugaagaggagccuaaccgcauucccagcagaucucuccggagaacaaaacugaaucaggaauccaccgccccgaagguucucuucacaggcgugguggaugcucgcggcgagagagccguccuggcgcuugggggaagccuggccggcuccgcugccgaggcuucucaccucguuaccgaccggauccgcagaaccgugaaguuucugugcgcccuggggcggggcauucccauccuuagccuggauuggcuccaucaguccagaaaagccggcuucuuucugccucccgacgaguacguggucacagauccugagcaagaaaagaacuucggguuuagccuccaggacgcucugucucgggcgcgcgagagacggcuucuggaaggauaugagauuuacgugacgccgggcguucagcccccucccccucagaugggcgaaaucaucuccuguugcgggggaaccuaucugcccagcaugccucgcucuuacaaaccccaaagaguggucauuacauguccgcaggacuucccucacugcagcaucccccuccgggugggccugccucuucugucccccgaguuccuccugaccgggguccucaagcaggaggccaaaccggaggcuuuugugcugucuccucuugagaugagcuccacauga

SEQ ID NO: 71971 - RNA, 741 nt, Artificial Sequence
  derived and/or modified sequence opt5 from MDFIC__Homo_sapiens__NP_001159817
augagcggcgccggggaggcucuggcccccggaccugugggcccgcagagagucgcggaagcugggggaggccaacucggguccaccgcccagggaaagugcgacaaagauaacacagagaaggacaucacgcaggccaccaauucucacuucacacauggcgaaaugcaggaucaaagcauuuggggcaaccccuccgacggggagcugauccggacccagccucagcgccuuccccagcugcaaacaucugcucagguuccuagcggagaagagauuggcaaaaucaagaaugggcacaccggacucuccaacggcaaugggauucaucacggagccaaacauggcucugcugauaacagaaagcugagcgcccccgugucccagaagaugcaccggaaaauccagagcucucuuuccgugaauagcgacaucucuaagaaauccaaggucaacgcgguguuuagccagaaaacagggucuuccccugaggauuguugcguucacuguauucuggccugccucuucugugaauuucugacccugugcaauaucgugcucggccaagcuagcuguggaauuugcacguccgaggccuguugcuguugcugcggcgacgaaaugggggaugacuguaacugcccgugugauauggacugcggaaucauggaugcuuguugcgagucuagcgacugucuggagauuugcauggaauguugcggcaucuguuuccccuccuga

SEQ ID NO: 71972 - RNA, 741 nt, Artificial Sequence
  derived and/or modified sequence opt5 from MDFI__Homo_sapiens__NP_001287733
auguaccaggugagcggccaaagacccuccgggugcgacgccccuuauggagcuccgucugccgcgcccggcccugcucagacccugagccuccugcccgggcuugaggucguuacaggauccacgcacccugccgaagccgcucccgaggaaggcucucuggaggaagccgcuaccccuaugccgcaggggaacggacccggcaucccucagggccucgauagcacagaccuggaugugcccaccgaggccgugacaugucaaccucaggggaauccccuuggaugcaccccgcugcucccuaacgacuccggccaucccucugagcucgggggaacacggcgcgcgggcaauggggcccugggaggcccuaaggcucacagaaaacugcagacccaucccagccuggccucccagggcagcaagaaaucuaaguccagcucuaaauccacgaccagccaaauuccccuucaggcucaggaagauuguugcguccacuguauccugucuugccucuucugugaguuucugacacuuugcaacauugugcuggacugugcgaccugcggguccuguagcuccgaagauucuugccucugcuguugcuguugcggaagcggcgagugugccgacugcgaucugccuugugaccuggauugcgggauccucgacgccuguugcgaguccgcugauugucuggaaauuugcauggagugcuguggacuuugcuucagcucuuga

SEQ ID NO: 71973 - RNA, 2868 nt, Artificial Sequence
  derived and/or modified sequence opt5 from MDGA1__Homo_sapiens__NP_705691
auggaggugaccugccugcuccugcuugcccugauccccuuccacuguagaggccagggggucuacgcuccugcccaagcgcagauuguucaugcuggacaggccugcguggugaaggaagacaacaucagcgagcgggucuauacaauucgcgaaggcgauacgcucaugcugcagugucuugugaccgggcacccgagaccccaaguucgguggacaaaaaccgccggauccgcuucugacaaguuucaggagacaagcguguucaaugaaacccugcgcaucgagagaauugcccggacacagggcgggcgcuacuauugcaaagcugagaacggagucggcgugccugccaucaaguccaucagaguugaugugcaguaccucgacgaacccaugcugaccguccaucaaacggugucugaugugcggggcaauuuuuaucaggagaaaaccgucuuccugcgcuguacaguuaacagcaauccucccgcgagauuuauuuggaagcggggguccgacacccucucucacagccaggauaacggaguggacaucuacgaaccucuguauacacagggcgagaccaaggugcuuaaacugaagaaucuccgcccgcaagauuacgccuccuacacgugccaggucagcgugagaaacguuugugggauucccgacaaagcuaucacauuccggcugaccaauacaaccgccccucccgcucuuaagcugucugugaacgagacccucgucgugaauccuggagaaaacguuacagugcagugccugcugacgggcggggauccccucccgcaacugcaguggucccauggaccuggcccccuuccucugggcgcccucgcgcaagggggaacccugagcauucccucuguccaggcccgcgacuccggcuauuacaauuguacagcuaccaacaauguggggaaccccgccaaaaagacagucaaccuucuggugagaagcaugaagaaugcuaccuuucagaucacgccugauguuauuaaagagucugaaaacauccagcucggacaggaccugaagcuguccugccacguggacgccgucccgcaggagaaagugacauaucaaugguucaagaauggcaaacccgcccggaugagcaagagacuccugguuacccgcaacgauccugaacuucccgcugugaccuccucucuggagcucaucgaccugcacuuuagcgauuacgggacauaucuuuguauggcguccuucccuggagcccccgucccggaccugagcguggaggugaauauuucuuccgaaaccguuccucccacaaucagcgucccuaaaggccgggcuguggugacggucagagagggcucucccgccgaacuccagugcgaggugcgcgggaagccucggcccccgguucuguggagcagaguggauaaggaagccgcucugcucccuuccggacugccccuugaggagacccccgacggcaaacugcgccucgaacgggucucuagagauaugagcgggacauaccgcugccagaccgcccgguauaacggauuuaaugugagaccucgcgaggcgcagguucaacugaacgugcaguucccgcccgaagucgagccuuccagccaggacgugcggcaggcucugggcagacccguucuucuccgguguucucugcugcgcggguccccucaaagaauugccagcgccguguggcgguuuaagggccagcuccugcccccucccccggucgugccugcugccgcugaagcccccgaucaugcggagcuuagacuggacgccgugacacgcgauucuuccggaagcuacgagugcuccgucucuaaugacguuggcagcgcugccugucucuuccagguguccgcuaaagccuacucuccugaguucuauuuugacacccccaacccgacgcggagccacaagcuguccaaaaauuacagcuaugugcugcaauggacccagagagaaccugaugcggucgaccccgugcuuaacuaccgccucucuaucagacagcugaaucagcauaacgccguugugaaggcuauuccuguccggcgcguggaaaaggggcaacugcucgaguauauccugacagaucuuagaguuccccacuccuacgaggugcggcugacccccuauacaaccuucggagccggcgacauggcuagccgcaucauucacuacacggaaccuaucaauucuccgaaccucuccgauaacacaugccauuuugaggacgagaaaauuuguggguacacccaggaucugacagacaauuucgauuggaccagacagaacgcccugacccagaaucccaagcggagcccuaacacaggacccccuacggacaucucuggcacccccgaaggguauuacauguuuauugaaacaagccgcccuagagagcuuggcgaucgggcccgccucgucuccccgcuguauaaugcuagcgcgaaauucuacugcguguccuuuuucuaucacauguacggaaagcauaucggcucccugaaccuccugguuagaagccggaauaaaggggcccuugacacccacgcuuggucccugucuggaaacaagggcaauguguggcaacaggcccauguccccaucagcccuuccgggcccuuucagauuaucuucgagggagugagaggcccuggguaucucggcgauauugccaucgacgacgugacacugaagaaaggagaauguccccgcaagcagaccgauccgaacaaagucguugugaugccuggcucuggggcucccugccaaagcucuccccagcuguggggaccuauggccauuuuucuucucgcgcugcagcgguga

SEQ ID NO: 71974 - RNA, 2871 nt, Artificial Sequence
  derived and/or modified sequence opt5 from MDGA2__Homo_sapiens__NP_001106970
auggaccugcucuacggccugguguggcuucugaccguccuccuggaggggaucagcggacagggcguuuaugcucccccuacagugagaauugugcacuccgggcuugccugcaacaucgaagaggaacgguacucugagcgcgucuauacgauuagagaaggagagacccuggagcucacaugucuggugaccggccauccgcggccccaaauccgcuggacaaagaccgccgggagcgcguccgauagauuccaggacucuagcguuuuuaaugaaacacugcggauuaccaacauccagcgccaccagggaggcagauacuauugcaaagcugagaauggccucggguccccugccaucaagucuauucggguggaugucuacuaucuggacgaucccgugguuacggugcaucaaagcaucggagaagccaaagagcaguucuacuacgagcgcaccgucuuucuuagauguguggcuaacuccaauccucccgugcgguauagcuggcgcagaggccaggaaguccugcuccaggggucugacaagggaguugagauuuacgaaccuuucuuuacacaaggcgagaccaaaauccugaaacuuaagaaccugcggccgcaggauuaugccaauuacuccugcauugcuagcgugcgcaacguguguaauauccccgacaagauggucucuuucagacucuccaacaagacagccagcccuucuauuaaacugcugguggaugaccccaucguugugaauccuggggaagcgaucacccucgucugcgugacgacaggaggcgagcccgccccgucccugaccuggguucggagcuuuggcacacuuccugagaagaccgugcugaacgggggaacccucacaauucccgcuaucacguccgaugacgccggcaccuauucuuguauugcuaauaacaaugucgggaacccugccaaaaagagcacaaacaucauugugagagcgcugaagaaaggacgcuucuggaucacccccgaucccuaccacaaggacgacaauauccagauuggccgggaagucaaaaucuccugccagguggaggccguuccuagcgaggaacuuacauuuucuugguucaagaacgggagaccgcugcgcuccagcgaacggauggugauuacccaaacggaucccgacgucucuccuggaacaaccaaucucgauaucauugaccugaaauuuaccgauuucggcacauauaccuguguggcuagccugaagggcgggggaaucuccgacaucucuauugauguuaacaucagcuccagcacagugcccccuaaucucacggucccccaggagaaaucuccgcuggugaccagagagggcgacacaauugaacuucagugccaagugaccgggaagccuaagcccaucauucuguggucccgcgccgauaaagagguugcuaugccugacggaagcaugcagauggaaucuuacgauggcacacuccggaucgucaacguguccagagagaugagcgggauguaccgcugucagaccucccaguauaauggcuuuaacgugaagccccgggaagcccugguccaacuuauugugcaguacccucccgccguugagccggcuuuccuggagaucagacagggacaggaccgcucugugacgaugagcugccggguccucagagcguauccuauccgggugcugaccuacgaauggcgccugggcaauaaacuccugagaacagggcaauucgacucccaggaguauaccgaauacgccguuaagucucuuagcaacgagaauuauggaguguacaacugcuccauuaucaaugaggcuggcgccgggcgguguagcuuucuggucacaggaaaagccuacgcucccgaauuuuauuacgauaccuauaaccccguguggcagaauagacaucgcguuuacucuuauucccuccaguggacgcaaaugaacccugacgccguggaucggauugucgcguacagacugggcauccgccaggcugggcagcagagauggugggagcaagaaauuaagaucaacggcaauauccagaagggagagcugauuacauauaaccuuaccgaacucaucaaaccggaggccuacgaggugcggcugacaccccugaccaaguuuggcgaaggggacagcaccauucgcgugaucaaauacucugccccugucaauccccaccucagagaguuccacugcggauuugaagauggcaacauuugucuguucacacaggacgauacggacaauuuugauuggaccaagcaauccacagcuacccggaacacaaaauauaccccuaauacggggcccaacgccgaccgcagcggaucuaaggagggcuucuacauguauaucgaaacaagcagaccucggcuugagggggagaaggcucgccugcucucccccguuuuuagcaucgccccgaaaaauccuuacggccccaccaacaccgcguauugcuucucuuucuucuaccauauguauggacagcacauuggcgugcugaauguguaccugagacuuaaggggcagacaaccaucgaaaacccucucugguccagcuccggaaauaaaggccagcgguggaacgaggcccaugucaauauuuaccccaucacaucuuuucaacugauuuucgaagggauccgcggaccgggcaucgagggggauauugcuaucgacgaugugagcauugccgaaggcgagugugcuaagcaggaccuggccacgaaaaacuccguugacggagcggugggcauccucguccacauuuggcuguucccuaucauugugcuuaucucuauccugagccccagacgguga

SEQ ID NO: 71975 - RNA, 1059 nt, Artificial Sequence
  derived and/or modified sequence opt5 from MDH1__Homo_sapiens__NP_001186040
augagacggugcagcuacuuccccaaggacgugaccgucuuugauaaagacgauaaguccgagccuauccgcguucuggugacaggcgccgcugggcagauugccuauucucuccuguacagcaucggaaacggcuccguguucgggaaagaccaaccgauuauccuuguccugcucgauauuacgcccaugaugggagugcuggacggcguucuuauggaacugcaggauugugcgcucccucugcugaaggacgugaucgcuaccgauaaagaggacgucgccuuuaaggaucucgacguggccauccugguugggucuaugcccagacgggaaggaauggagcgcaaggaucuucugaaagcuaaugugaagauuuucaaaagccagggcgccgcucucgacaaguaugccaaaaaguccgucaaggugaucguggucggcaacccugcgaauacaaacugccugaccgccucuaaaagcgcucccuccauuccuaaggaaaauuuuagcugucuuacaagacuggaccacaaccgggccaaagcucagaucgcccucaagcuggggguuaccgcgaaugaugugaaaaacgugauuaucuggggaaaucauucuuccacacaauacccggacgucaaccacgccaaggugaaacugcagggcaaggagguugggguguaugaggcucucaaggaugacagcuggcugaaaggagaguucgucaccacggugcagcagcgcggcgccgcuguuauuaaggccagaaaacuuucuuccgccaugagcgcugcgaaggccaucugcgaucaugugcgggacaucugguuugggacccccgaaggagaguucgucucuaugggcgugauuuccgauggcaauagcuacggggucccugacgaucugcucuauuccuuucccgugguuaucaaaaacaagacauggaaguucguggaaggacugccuauuaaugacuuuucucgcgagaaaauggaucuuaccgcuaaggaacugacagaggaaaaagagagcgccuucgaauuucucuccagcgccuga

SEQ ID NO: 71976 - RNA, 1017 nt, Artificial Sequence
  derived and/or modified sequence opt5 from MDH2__Homo_sapiens__NP_005909
augcugagcgcccucgcuagacccgccuccgcggcucugcggcgcucuuucagcaccuccgcccagaacaaugccaagguggcuguccuuggcgccucugggggaaucggccaaccucugagccuccugcuuaaaaacuccccgcugguuucuagacucacacuguacgacauugcucacacgcccgggguggccgcggaucugagccauaucgagaccaaggccgcugugaaaggauaucucggcccugaacagcugcccgacugccuuaaggggugugaugucgugguuauuccugccggagugccccggaaaccuggcaugacacgcgacgaucuguuuaauaccaacgcuacaaucgucgccacccucacagcggccugcgcucagcacuguccggaggccaugauuugcgugaucgcuaaucccguuaacuccaccaucccuauuacggccgaaguguucaagaagcauggcgucuacaaucccaacaaaaucuuuggggugaccacacuggacauugugagagccaauaccuucgucgcugagcuuaagggacuggauccugcgcggguuaacgugcccgugaucggcgggcacgccggaaaaacaauuaucccgcucauuagccaguguaccccuaaggucgacuuuccccaagaucagcugacggcucugacaggccgcauccaggaagccgggaccgaggugguuaaagccaaggcuggagccggcucugcgacacucuccauggcuuaugccggcgccagauucguguuuagccuggucgacgcuaugaaugggaaggagggagugguugaaugcucuuucgugaaaucccaggagaccgaauguaccuacuuuagcacaccucuucugcucggcaagaaagggaucgagaagaaccugggaauuggcaaagucucuuccuucgaggaaaagaugaucagcgaugccauucccgagcuuaaggcuuccaucaaaaagggggaagacuuugugaaaacgcugaaguga

SEQ ID NO: 71977 - RNA, 264 nt, Artificial Sequence
  derived and/or modified sequence opt5 from MDK__Homo_sapiens__NP_001257481
augcagcacagaggcuuccugcuccugacccuucuggcccuccuggcucuuacaagcgccguggcgaagaaaaaggcugacugcaaauacaaguuugagaacuggggagccugugaugggggcacggggaccaaaguccggcaaggaacacugaagaaggcccgcuauaaugcucagugccaggaaaccaucagaguuacaaaacccuguaccccuaagacaaaagccaaggcuaaagccaagaagggcaaagggaaggacuga

SEQ ID NO: 71978 - RNA, 2040 nt, Artificial Sequence
  derived and/or modified sequence opt5 from MDM1__Homo_sapiens__NP_001191957
augcccgugagauucaagggccugagcgaguaccagcggaacuuucucuggaaaaaguccuaucugucugaaagcugcaauuccucugucgggcgcaaauacccuugggccggacuuagaagcgaccaacugggcaucaccaaggagccguccuucauuucuaaacggcgcguucccuaucacgauccucagaucagcaagucccucgaauggaacggggcuauuagcgagucuaaugugguggccucccccgaaccugaggcgcccgagacaccuaagagccaggaagcugagcagaaagacgucacgcaagaaagagugcauucucuggaggccucccggguuccgaagcgcaccagaagccacucugccgauucccgggcugagggagccagcgacguggaaaacaaugagggcgucacaaaccauacccccgugaaugaaaacguugagcuugaacacuccacaaaagugcugucugagaaugucgauaacgggguguuucauaauaagagccaguucgugccucccuuuaaaggaaacuccgucauccacgagaccgaauacaagcgcaauuucaagggccucagcccuguuaaagagcccaagcugagaaacgaccugcgggaaaaucgcaaccucgagacagugucuccggaaagaaaauccaacaagauugaugaccggcugaaacuugaggcugagauggaacugaaggaucuccaccagccuaaacgcaagcugacccccuggaagcaucagagacuuggcaaagugaauagcgaguaucgggccaaguuucugucuccugcgcaauaccucuauaaagccggggcuuggacgcacgucaagggaaacaugcccaaucagggcagccugaacgccaugugguacgcugaagugaaagagcugagagaaaaggccgaguucuaccgcaagcggguucaggggacccauuuuuccagagaccaccucaaucagauccugucugauagcaacuguugcugggacguguccagcacaaccucuuccgagggaacagucagcucuaauauccgcgcgcuugaucuggccggcgaccccaccucccacaaaacgcuccaaaaguguccuagcacagaaccggaggaaaaagggaacauuguggaggagcagccccagaagaauaccacagaaaaacugggaguuuccgcuccuaccauccccgugcggagacgccuugccugggacaccgagaacacaucugaagauguccaaaagcagccuggcgagaaggaagaggaggacgauaaugaagaggaaggcgaccggaaaacggggaagcaggcuuucaugggagagcaggaaaaacuggaugugagagagaaaagcaaagccgacaagaugaaggagggcuccgauucuagcgucuccagcgaaaaagggggacgccuccccaccccgaagcugcgggagcugggcgggauucaaagaacacaucacgaccucaccacacccgccgugggaggcgcuguucuggugucucccuccaaaaugaagccucccgcgccugaacagcgcaaacggaugaccagccaggauugccuugagacgucuaagaacgacuuuacaaagaaggaauccagagccgucagccugcucaccucucccgcugccggcaucaagaccguggauccgcugccucuucgggaggacagcgaggacaauauucauaaauucgccgaagcuacacugcccguuuccaagauccccaaauauccuaccaacccgcccgggcagcucccuagcccuccucacgugcccucuuacuggcauccuucccgccggauucaaggaagccugagagaucccgaguuucagcacaaugucggcaaggccagaaugaacaaccugcagcucccgcagcacgaagcguucaaugacgaggaugaggaccgccuguccgaaaucucugcucggagcgccgccuccucucuuagagcuuuccaaacacuggcccgcgcuaaaaagagaaaggagaacuuuugggggaaaacguga

SEQ ID NO: 71979 - RNA, 1335 nt, Artificial Sequence
  derived and/or modified sequence opt5 from MDM2__Homo_sapiens__NP_001138809
augugcaacaccaauaugagcgugcccacagacggcgccgucacgaccucccagaucccugcuucugagcaagaaacacugguuagaccgaagccccuccugcuuaaacugcucaagagcgugggggcccagaaagauaccuacacaaugaaggaggugcuguucuaucuuggacaguacauuaugaccaaacggcuguaugacgaaaagcagcaacacaucgucuacuguuccaacgaucuccugggcgaccuguuuggggugccuucuuucagcguuaaggagcaucgcaaaauuuauacaaugaucuacagaaaucucguggucgugaaccagcaggaauccucugauagcggaaccuccguuagcgagaaucggugccaccuggagggcgggucugaccagaaggaucuugugcaagaacugcaggaggaaaaacccuccagcucucaucucgucucccgcccuagcacgucuuccagacggcgcgcgauuagcgagaccgaggaaaacuccgacgagcugucuggagaaagacagcggaagcgccacaaaagcgauuccaucagccuuucuuuugacgagucccuggcucucugugugaucagagaaauuugcugugagcggagcucuagcuccgagucuacaggcacccccagcaauccugaucuggacgccggcguguaucaggucacaguuuaccaagccggggaauccgauaccgacagcuucgaggaagacccggagaucucucuggcugauuacuggaagugcacguccuguaacgaaaugaaucccccucuccccagccauugcaaccgcuguugggcccugagagagaauuggcuuccugaggacaagggaaaagauaagggcgaaauuucugagaaagcuaagcuggaaaacuccacacaggccgaggaaggguuugacgugcccgauugcaaaaagaccaucgugaaugacagccgggaguccugugucgaggaaaacgaugacaaaauuacacaggcgucucaaagccaggaguccgaagauuauucucagccgagcaccuccagcucuaucauuuacuccagccaggaggacgugaaggaguucgaacgcgaggaaacccaagauaaggaggaaucuguugaguccagccucccucugaaugccaucgagcccugcgugaucugccagggaagaccuaaaaacggcuguauuguccacgggaagacaggacaccuuauggcuugcuuuacgugugccaaaaagcugaaaaagcggaacaagcccugccccguguguagacagccuauccagaugauuguucucaccuauuucccguga

SEQ ID NO: 71980 - RNA, 1323 nt, Artificial Sequence
  derived and/or modified sequence opt5 from MDM4__Homo_sapiens__NP_001191100
augaccagcuucuccacaucugcccagugcagcacguccgacucugcuuguagaaucagccccggccaaauuaaccaggugcggccuaagcugccgcuccugaaaauccuucacgccgcgggggcucagggagagauguuuaccgucaaggaaguuaugcauuaccugggccaguauauuauggugaaacaacucuacgaucagcaggagcagcacaugguguauugcgggggagaccugcuuggcgaacugcucgggcgccaauccuucucugucaaggaucccagcccucuguacgacaugcugcggaaaaaucucgugacacuggccaccgccacaaccgaugcugcccagacacuugcucuggcccaggaccauuccauggauauccccagccaggaccaacucaagcagucugcggaggaauccagcaccucuagaaagcgcacgaccgaggaugacauuccuacacugcccaccuccgagcacaaauguauccauagcagagaagaugaggaccuuaucgaaaaccuggcccaggaugagacaucucggcucgaccugggauuugaggaaugggacguugcuggccugccuuggugguuccucggcaaucugcgcuccaacuauaccccgagaagcaauggguccacggaucuucaaacaaaccaggugauugaggucggaaagaaugacgaucuggaagacucuaaaagccucuccgaugacaccgauguggagguuacaagcgaagacgaguggcagugcaccgaguguaagaaauuuaacucucccuccaagcgguacugcuuccgcuguugggcccugagaaaggauugguauagcgacugcucuaaacuuacccacagccuguccacaucugauaucacggcuauuccugaaaaggagaaugaaggcaacgacgugcccgacugucggcgcaccaucagcgccccugucgugagacccaaagaugcguacauuaagaaagaaaauuccaagcucuuugacccgugcaacagcguggaguuccuggaucuggcccacucuuccgagagccaggagacaaucucuuccaugggggaacaacucgacaaucugagcgagcagcggaccgauacagaaaacauggaggacugucagaaucuucugaaaccuugcucccucugcgaaaagcgccccagagauggaaacauuauccauggccggaccgggcaccuggucacguguuuucauugcgcuagacgccuuaagaaagccggagcuucuuguccuaucugcaagaaagagauucagcugguuaucaagguguucauugccuga

SEQ ID NO: 71981 - RNA, 1719 nt, Artificial Sequence
  derived and/or modified sequence opt5 from ME1__Homo_sapiens__NP_002386
auggagcccgaagccccuagacggcgccacacccaucagagaggcuaccugcucacacggaacccgcaccugaauaaggaccuugcuuucacgcuggaggaacgccaacagcucaacauccaugggcugcuucccccuagcuuuaauucccaggagauucaggugcugagagucguuaaaaacuucgaacaccucaauucugauuuugaccgguaucugcugcucauggaucugcaagaccgcaacgagaaacuuuucuacagagugcugaccagcgauaucgagaaauuuaugcccauuguguauacaccuaccgucggacucgccugccagcaguacucccugguguuccggaagccccgcggccuuuuuaucacaauucaugacagagggcacaucgcgucuguucugaaugcuuggccugaagaugugaucaaagccauugucgugaccgacggagagcggauccucggccugggggaucugggauguaacggcaugggcauuccgguugggaagcucgcccuguauacagcuugcggaggcaugaauccccaggaaugucuuccugugauccuggacgucgggaccgagaacgaggaacuccugaaggauccccuuuacauuggacugcgccaaagacgggugcgcggcagcgaguaugacgauuuccucgacgaauuuauggaggccguguccucuaaauacgggaugaauugccugauccaguucgaagacuuugcuaacgucaaugccuucagacugcucaacaaguaccggaaucaguauuguacguuuaacgaugacauucagggaaccgcgagcguugccguggcuggccugcuugccgcucugagaaucacaaagaacaagcucuccgaucaaaccauccuguuccagggcgccggggaggcggcccuuggaauugcucaccugaucgugauggcccucgagaaagaaggccugccuaaggagaaggcuauuaaaaagaucuggcuggucgacagcaaagggcucauugugaagggacgcgccucucugacacaggaaaaagagaaguucgcccaugaacacgaggagaugaaaaaucuugaagcuaucguucaagagaucaagcccaccgcgcugauuggcguggccgcuaucgggggagccuuuuccgaacagauucucaaggauauggccgcuuucaacgagcggccgaucauuuuugcccugagcaauccuacgucuaaagcggaaugcuccgcugagcaguguuacaagaucacaaaaggcagagccaucuucgccagcggcucucccuuugacccugucacccugcccaacgggcagacacuuuaucccggacaaggcaauaacuccuacguguucccugggguugcucucggaguggucgccugcggccugcgccagauuaccgauaauaucuuucugaccacagcugaggugauugcccagcaggucagcgacaagcaucucgaagaggggcggcuguauccgccccuuaacacgaucagagaugugucccugaaaauugcggaaaagaucguuaaggacgccuaccaagagaaaaccgcuacaguguauccugagccccagaauaaggaagccuucguccgcucucagauguacagcaccgauuacgaccagauucucccugacuguuauuccuggcccgaggaagugcagaaaauccaaacaaagguugaucaguga

SEQ ID NO: 71982 - RNA, 1440 nt, Artificial Sequence
  derived and/or modified sequence opt5 from ME2__Homo_sapiens__NP_001161807
augcugagcagacucagaguggucuccaccacaugcacgcuggccugucgccaccuucauaucaaggagaaaggcaagccccugaugcucaacccuagaaccaauaaagggauggcuuucacacugcaggaacggcaaaugcuuggacugcagggccuccugccgcccaagauugagacccaggacauccaggcccugcgcuuucacagaaaccucaaaaagaugacaucuccucuggaaaaguacauuuauaucauggggauucaagagcggaaugaaaaacuuuucuaccgcauccugcaggaugacaucgagagccucaugcccauuguuuauaccccuacagugggacuggcgugcucccaguacggccauaucuuuagacggcccaaggggcuuuucauuucuaucagcgaucgcggacacgugagauccauugucgacaacuggccugagaaucaugugaaagcuguuguggucaccgauggcgaacggauccugggccucggggaccugggaguguauggcauggggauuccgguuggaaagcugugucucuacacggccugcgccggcauccgccccgauagaugucugccugugugcaucgacgucgggaccgauaacauugcccuucugaaagaccccuuuuauaugggacucuaccagaagcgggaucgcacacaacaguacgacgaucugaucgacgaguucaugaaggcuauuaccgacagauauggccggaauacacuuauccaguuugaagauuucggcaaccacaaugcuuuuagauuccugcgcaaauaccgggagaaguauuguaccuuuaacgacgauauucaggggacggccgcgguggcccucgcuggacugcuggccgcucaaaaagugaucucuaagccuaucagcgagcacaaaauucucuuccugggcgccggggaagcggcccuuggaaucgcuaaucugauugucauguccaugguugagaacggccucagcgaacaggaggcccagaagaaaaucuggauguuugacaaguacgggcugcuugugaagggaagaaaagcuaagauugauucuuaucaagaacccuucacacauuccgccccggagagcaucccugacaccuucgaggaugccgugaauauccugaaacccucuacaauuaucggcgucgcuggcgcggggcgccucuuuaccccugacgugauucgggccauggcuuccaucaacgaaagacccguuauuuucgcccugagcaaucccaccgcccaggcugagugcacagccgaagaggcguacacgcugaccgaaggacgcugucucuuugcuucuggcuccccuuucgggccggugaagcugacagauggacgggucuuuacccccggccaggggaacaacguguauaucuucccuggcuaccggauucccaucugcuga

SEQ ID NO: 71983 - RNA, 1815 nt, Artificial Sequence
  derived and/or modified sequence opt5 from ME3__Homo_sapiens__NP_001155058
augggcgccgcucuggggaccggaacaagacucgcccccuggccuggccgggcgugcggggcucugccgcgcuggacgcccaccgccccugcccagggaugucacagcaagcccggcccugcuagacccgugccucuuaaaaagcggggguacgacgucacacgcaacccgcaucugaauaaaggaauggccuucacccucgaggaaagacugcaacuuggcauccacggccugauucccccuugcuuucucucccaggauguucagcugcugcggaucaugcgcuauuacgagagacagcaaucugaccucgauaaguauauuauccugaugacacuucaggaccggaacgaaaaacuguucuaccgcgugcucaccagcgauguggagaaguuuaugcccauugucuauacaccuaccguggggcuggcuugucagcauuacggacuuacguucagacggccccgcggccuguuuaucaccauccacgacaaggggcaucucgccacaaugcuuaauuccuggccggaagauaacauuaaagcgguuguggucaccgacggagagagaauccugggccucggggaucugggaugcuauggcaugggcauuccuguggggaagcuggcccuguacacagcuuguggaggcguuaauccccagcaaugccucccugugcugcuugacgucgggaccaacaaugaggaacugcuccgggauccccuguacaucggacugaaacaccagcgcgugcacggcaaggccuaugacgaucuccuggacgaguucaugcaggcugugacggacaaauuugggauuaacugucuuauccaguucgaagauuuugccaaugcgaacgccuucagacugcucaauaaguaccggaacaaguauugcauguuuaaugacgauauucaaggaacagcuucugucgccguugcuggcauccuggccgcccuuagaaucaccaaaaacaagcugagcaaucauguguucguguuucagggcgcuggggaggcggccaugggaauugcucaccuccuggucauggcccuggagaaagaaggcgugcccaaggccgaggcuacacgcaaaaucuggaugguugacuccaaggggcucauugugaaaggacggucucaucugaaccacgaaaaggagauguucgcccaggaucacccugaagucaacagccuugaggaggugguuagacuggugaagccgaccgcgaucauuggcgucgcugccaucgccggggcuuucaccgaacaaauccuccgcgacauggccuccuuucaugagcggcccauuaucuucgcucugagcaauccuacaucuaaagccgaauguacggcggagaagugcuacagagugaccgaaggccgcggaauuuuugccuccggcagccccuucaaaucugucacacuggaggaugggaagaccuuuaucccuggacagggcaacaaugcuuauguguuccccgggguugcccuuggagugauugcuggcgggauccggcacaucccggacgagauuuuucuccugacagccgaacagaucgcgcaggaggucuccgaacaacaucugagccagggcagacucuacccuccccugucuaccauucgcgaugugucccuucggaucgccauuaaaguucuggacuaugcuuacaagcacaaccucgccagcuacuauccugagcccaaggauaaagaggcuuucgugagaucccuggucuacacgccugacuaugacucuuuuacacuggauagcuacaccuggcccaaggaagccaugaaugugcagaccguguga

SEQ ID NO: 71984 - RNA, 558 nt, Artificial Sequence
  derived and/or modified sequence opt5 from MEA1__Homo_sapiens__NP_055438
augggccccgagagacaccugagcggggccccugcucggauggccaccgugguccucggaggcgacacaauggggccggaacgcaucuuccccaaccagacggaggaacugggacaucaaggcccuuccgaggggaccggagauuggucuagcgaagaacccgaggaggagcaggaagagacaggcuccggcccugcgggguacucuuaucagccccuuaaucaggacccugagcaagaagagguugaacuggcuccggugggagauggcgacguggucgccgauauucaggacagaauccaggcccucgggcugcaccuucccgauccuccccuggagagcgaagacgaggaugaggaaggagcuaccgcccucaacaaucauuccucuauuccuauggaccccgagcacguggaacugguuaagcggacaauggcuggcgugagccugccggccccugggguccccgcgugggcccgcgagaucuccgaugcucagugggaagacgugguucaaaaagcccuccaggcuagacaggccagcccugcguggaaguga

SEQ ID NO: 71985 - RNA, 3351 nt, Artificial Sequence
  derived and/or modified sequence opt5 from MECOM__Homo_sapiens__NP_001098547
augauccuggacgaguucuacaacgugaaguuuugcauugaugccagccagcccgacgucggcuccuggcucaaauauaucagauucgcuggguguuacgaucaacacaaucugguugccugccagauuaacgaccagaucuuuuaucgggugguggcggauauugcuccuggagaagaacuucuccuguucaugaagucugaagacuacccgcaugagaccauggcccccgauauccacgaagaacgccaguauagaugugaggacugcgaucaacuguuugaaagcaaagccgagcuugcugaccaucagaaguucccuuguuccacaccccacucugccuuuagcauggucgaagaggauuuccagcagaaacuggaguccgaaaaugaccuccaagagauccauacgauucaggaaugcaaggagugugaucagguguuuccugaccugcagucucuggaaaagcacaugcucagccacaccgaggagcgggaauacaaaugcgaccaaugucccaaggcuuucaacuggaaauccaaucugauccgccaucagaugagccacgauucuggcaagcauuaugagugcgaaaacugugccaaacagguuuuuacagacccuuccaaucuucaaagacacauucggagccagcacgugggggcgcgcgcccaugcuugcccggagugcggaaagaccuucgccacaucuuccggccugaagcagcacaaacauauccacagcucugucaagcccuuuauuugugaagugugccauaaauccuacacccaguucagcaaccucuguagacacaagcggaugcacgcugauugccgcacacaaaucaaauguaaggacugcgggcagauguucuccaccacgucuagccugaauaaacauagacgguuuugugagggaaagaaccacuucgccgcgggcggcuuuuucgggcagggaauuucccuuccuggcacccccgccauggauaagacaagcaugguuaauaugucucaugcuaacccugggcuggccgacuacuuuggagcuaaucgccaccccgccggccucaccuucccgacagccccuggguuuuccuucagcuuucccggacuguucccuucuggccuguaucacagaccuccccucauccccgcuagcuccccggugaaaggccugucuagcaccgagcagacgaacaagucccaaagcccccuuaugacacauccucagauccugcccgcgacccaggauauucucaaagcccugucuaagcacccuuccgucggggacaauaaacccguggaacuucagccggagcggagcucugaggagcgcccuuuugaaaagaucuccgaucaaagcgaguccucugaccuggaugacgugagcacacccuccggaucugaccucgagaccaccagcggcuccgaucuggaaagcgacauugagucugauaaggaaaaauucaaggagaacgggaaaauguuuaaggacaaagucuccccucugcagaaccucgcuagcaucaauaacaagaaggaguacucuaaucauuccauuuucagccccucucuggaggagcagacagccguuagcggagccgugaacgauuccaucaaagcuaucgccagcauugcggaaaaguauuucggcucuacggggcuugugggacugcaggacaaaaaggucggcgcucucccuuaccccuccauguuuccgcugccuuucuuucccgccuucagccaauccauguaucccuuuccugauagagaccuucggucucugccgcucaaaauggagccccagagcccuggcgaagugaagaagcugcagaaaggguccucugagagccccuucgaucugaccacaaagagaaaagacgagaagccucucacccccguuccuuccaaacccccggugaccccugccacaucucaagaucagccccuggaccuuagcaugggaucccgcagccgggcuucuggcacgaagcugacagaaccucgcaaaaaucacgucuuugggggaaagaagggcuccaacguggagagcagacccgccucugaugggucccuccagcaugcucggccgaccccuuucuuuauggaccccaucuacagaguugaaaaacgcaagcugaccgacccucuggaggcccuuaaagaaaaguaucuccggcccagccccggcuuccuguuucacccucaguuccaacugccggaucagagaacauggaugucugcgauugagaauauggccgagaaacucgaauccuuuagcgcucugaagcccgaggccuccgaacuucugcagagcgugccuucuauguucaacuuccgcgcucccccuaaugcccuccccgagaaccugcugcggaagggaaaagaaagauauaccugccgcuacuguggcaagaucuuuccucggagcgcgaaucuuacaagacaccuccggacgcauaccggggagcagccguaccgcugcaaauacugugacagauccuucucuauuagcuccaaccugcaacggcacgucagaaauauccauaacaaggagaaacccuuuaagugccaccugugcgaucgcuguuucggacagcagacaaaucucgaccggcaucugaagaaacacgaaaacggcaacaugucugggaccgccacaagcuccccucacucugagcuugaaagcaccggagcuauccuggaugacaaggaggaugccuauuuuacggagauuagaaauuucaucggcaacuccaaucaugggagccagucuccccgcaacguggaagagagaaugaauggcucccacuuuaaagacgaaaaggcucucgucaccagccaaaacucugaucugcuggacgaugaggaaguggaggacgagguucuucucgaugaagaggacgaagacaaugauauuacaggaaaaaccggcaaggagccugugacauccaaccugcaugaagggaaucccgaggacgauuacgaggaaaccagcgcccuggagauguccugcaagacgucuccgguccgguauaaagaagaggaauacaagagcggacucuccgcccuggaccacauccgccacuucacagauagccuuaaaaugagaaagauggaggacaaccaguauucugaggcugaacuguccagcuuuucuaccagccaugugccugaggaacucaaacagccccugcaccggaaguccaaaucucaagcguacgccaugaugcugagccuuuccgauaaggagucucuccauagcacaucccacucuagcuccaauguuuggcauagcauggcucgcgccgccgcugaguccucugccauucagagcaucucccacguguga

SEQ ID NO: 71986 - RNA, 1497 nt, Artificial Sequence
  derived and/or modified sequence opt5 from MECP2__Homo_sapiens__NP_001104262
auggccgcugccgcggcugccgcccccagcggcgggggaggcgggggagaggaagagagacuggaagagaaguccgaagaccaggaucuccaaggccugaaagacaagccucuuaaauucaagaaagugaagaaggauaaaaaggaggagaaagaagggaagcacgagccgguccagcccucugcucaucacagcgccgaaccugcugaggccggaaaagcggagaccuccgaaggcucuggcagcgcccccgcuguuccugaggccuccgcuucucccaagcagcggcgcagcaucauuagagaccgggggccuauguacgaugacccgacacugcccgaaggauggacgcgcaagcucaaacagagaaaguccggccggagcgccgggaaauaugauguguaccugaucaacccucaaggaaaggcguuucgcucuaaaguggagcuuauugccuauuucgaaaaggucggcgacaccucccuggaucccaaugacuuugauuucacagugaccgggagaggaagcccuucucggcgcgagcagaaacccccgaagaagccuaaaucccccaaggcuccuggcacaggcagagggcggggacgccccaaaggcagcgggaccacaagacccaaggccgcuaccucugagggaguucaggugaaacggguccucgaaaaguccccuggcaagcugcuggugaaaaugccguuucagacgagccccgggggaaaggccgagggcggcggggccaccacauccacccaaguuauggugaucaaacgcccuggaagaaagcggaaagcugaagcggacccccaggccauuccuaagaagagaggccgcaaacccgggucugucguggcugccgccgcugccgaggcgaagaaaaaggcugugaaagaaagcuccauccggagcguccaggagacaguucucccgaucaagaagagaaaaacccgcgagacggugucuauugaagugaaggaggucgugaaaccucugcuuguuuccacacugggagaaaagagcggcaaagggcucaagaccugcaaaucucccggcagaaagagcaaggaguccucuccuaaaggacggagcuccagcgccucuuccccucccaagaaagaacaucaccaucaccaccaucacagcgagucucccaaggccccggugccucugcuuccuccccugcccccgcccccucccgagccugaauccagcgaggaucccacauccccucccgaaccgcaggaccucucuagcuccgucuguaaagaggagaagaugccucgcggcgggucucuggaaagcgacggaugccccaaggagccugcuaaaacccaacccgccguggcuaccgccgcgacagccgcugaaaaguacaaacaucggggcgagggggaaagaaaggauaucguuuccagcucuaugccgcgcccuaaccgggaggagcccguggacuccagaacgccugucaccgaacgcgugagcuga

SEQ ID NO: 71987 - RNA, 6534 nt, Artificial Sequence
  derived and/or modified sequence opt5 from MED12__Homo_sapiens__NP_005111
auggccgcuuucggcauccugagcuacgagcacagaccccugaagcggccucgccuggggccucccgacguguauccccaggaucccaaacaaaaggaagacgagcuuacagcccugaacgucaaacagggauuuaauaaccagccugcgguuuccggcgaugaacacgggucugcuaagaaugugagcuucaaccccgccaaaauuuccucuaauuuuagcuccaucauugccgagaaacuuagaugcaacacacugccugacacgggacggcgcaagccccaggugaaucaaaaggauaacuucuggcuugucaccgcuagaucucagagcgccaucaauacaugguuuaccgaccuggcuggcacaaagccccugacccagcuggccaaaaaggugccuauuuucuccaaaaaggaagagguuuuuggguaccuggcgaaguauacagugcccgucaugcgggccgcuuggcucaucaaaaugaccugugccuacuaugcugccaucagcgagacgaaggugaaaaagcgccacguugauccuuucauggaauggacccagauuaucacaaaauaccugugggagcaacuucagaagauggcggaauauuacagacccggaccggccggcucuggcgggugcggauccaccauuggcccucugccccaugacguggaggucgcuauccggcagugggauuacacagagaaacucgccauguuuauguuccaggacgggaugcuggaucgccacgaauuucuuaccugggugcuggaguguuucgaaaagauuagaccuggagaggacgaacuccugaagcugcuccugccccuucugcuccgguauagcggcgaguuugugcaaucugcuuaccugucccgcagacuugccuauuucugcacgcggcgccuggcccuccagcuggauggggucagcucucauuccagccacguuaucuccgcucagucuacaagcacccugcccacaaccccugcgccgcaacccccuaccuccagcacacccucuacgccuuucuccgaccuccugauguguccccagcacagaccgcuuguguuuggacugagcugcauucuccagaccauccugcuuuguugcccuucugcccugguguggcauuacagccucacagacucccggaucaaaaccggcucuccccuggaucaucugccuauugcucccagcaaccucccuaugcccgagggcaauuccgccuucacacagcaagucagagccaagcugcgcgaaaucgagcagcagauuaaagaacgggggcaggcuguggagguuagauggagcuuugacaagugucaagaagccaccgcgggauucacgaucggccgcgugcuucauacacuggagguccucgauucucacuccuuugagcggagcgacuucucuaacucccuggauagccugugcaauagaauuuuugggcuuggaccguccaaagacggccacgaaaucucuagcgaugacgaugcugugguuucccuccugugugagugggccgugucuugcaagcgcagcgggcggcauagagccauggucguggcuaagcugcucgaaaaacgccaggccgagaucgaagcugagcggugcggagaguccgaagccgcggacgagaagggcagcauugccucuggcucccugagcgcuccuucugcccccaucuuccaggauguccuucugcaguuucucgacacccaagcucccaugcugaccgacccuagauccgaaagcgagcgcguggaguucuuuaaccugguucuucucuucugugaacugauucggcacgauguguuuucucauaauauguauacaugcacccugaucagcagaggggaccucgccuucggagcgccgggcccccggccucccuccccuuucgaugaccccgccgaugacccugagcacaaagaagcugagggguccucuagcagcaagcuggaagaucccggacuuuccgagucuauggacauugauccgagcuccucuguccuguuugaggacauggaaaaaccugauuucagccucuuuucccccacaaugccuugugagggcaaggggucucccagcccggaaaagccugacguggagaaagaaguuaagcccccucccaaagagaagaucgagggcacgcugggagugcuguacgaucagccccgccauguccaguaugccacccacuucccuaucccgcaggaagaguccugcagccacgaauguaaccaaagacuuguggugcucuuuggcguugggaaacagcgggacgacgcuagacaugccauuaagaagaucacaaaagauauucugaagguccugaaccgcaaaggaaccgccgagacagaccagcucgcucccaucgugccucugaaucccggcgaucuuaccuuccucgggggagaagacggccaaaagcggagacgcaacagaccugaggcguuucccacggccgaggauauuuucgcuaaauuucagcaccucucucauuacgaccagcaccaggugaccgcccaagucucccggaaugugcuggaacagaucaccagcuucgcccuggggaugucuuaccaccuuccucucguucagcaugugcaguuuauuuucgaucugauggaguauucccugagcaucucuggccucaucgacuuugcuauucaacugcuuaacgaacuguccgucguggaggccgagcuccugcucaagagcuccgaucuuguuggaagcuacaccacaucucugugccucuguaucguggcgguccugcgccacuaucaugcuugccucauucugaaucaggaccagauggcccagguguucgaaggccuuugugggguugugaaacacggaaugaacagaagcgauggcuccucugccgagcggugcauccuggcuuaccucuaugaccuguacaccagcuguucccaucugaagaauaaguucggggaacucuuuucugauuucugcagcaaagucaagaacacgauuuauugcaauguggagccguccgaaucuaacaugcgcugggcccccgaguuuaugaucgacacacuggagaauccugcggcucacaccuucacauacaccggacucggcaaaagccuguccgaaaaccccgccaauagauacagcuuuguguguaacgcccucaugcacgucugcguugggcaucacgacccugaucgggugaaugacaucgcuauucugugugccgagcuuaccggcuauugcaagucucuguccgcugaauggcucggagugcugaaagcccuguguugcagcucuaacaacggcacauguggguucaaugaucuucugugcaacgucgacguguccgaucucagcuuucaugacucccuggcgacguucguugccauccucauugcucgccaaugucugcuucuggaggaucugaucagaugcgccgcuauucccucucuccugaaugccgccuguagcgaacaggacuccgagccgggagcucggcuuaccugccgcauccugcuccaccuguuuaagacaccucagcucaaccccugccaaagcgauggcaauaagcccaccguggggaucagaucuuccugugaccggcaucugcuugcggccagccagaacagaauugucgauggagcuguguucgccguucugaaagccguguuuguccugggcgacgcugagcucaaggggucuggcuucacagugaccggaggcacggaggaacugccugaagaggaagggggaggcgggagcggaggccgccggcagggcgggagaaauaucuccguugagacagccucucuugacguguacgcgaaauauguccugcgcagcauuugccagcaagagugggugggagaacggugucucaagucccugugcgaggauucuaacgaccuccaggaucccgugcugagcuccgcucaggcccagagacuuaugcaacugaucuguuacccucaccgccugcucgacaaugaagauggcgagaacccgcagcggcagagaauuaaacgcauccugcagaaucuugaccaauggaccaugcggcagagcucucuggagcuccagcugaugaucaagcagacccccaacaaugaaaugaacucccuccuggagaauauugccaaggcuacaaucgaagucuuccaacagagcgccgagaccggguccucuagcggauccacagcgucuaacaugccuagcuccagcaaaacgaagcccguucuuucuucccuggaaagaagcggcguguggcugguggcuccucucauugccaaacugcccaccucuguccaggggcacgugcuuaaggccgcuggagaggagcuggaaaaaggccaacaucucggcuccagcucucggaaggagcgcgauagacagaagcagaaaagcaugucccugcugucucagcaaccguuucucagccuuguucugacaugccugaaggggcaggacgaacagcgggagggacuccugaccucccuuuauagccaggugcaccaaaucgucaacaauuggcgcgaugaccaguaccuggaugacuguaaaccuaagcagcucaugcaugaagcccugaaacugagacucaaccuugugggcgggauguucgauacaguucagcgguccacccaacagacgaccgagugggcuaugcugcugcucgagauuaucauuucuggaacaguggacaugcagagcaauaacgaacuguuuaccacaguccuugacaugcuguccgugcucaucaauggcacccuggccgcggauaugucuagcaucucccaagggucuauggaggaaaacaagagagccuauaugaaucuggcuaaaaagcuccagaaggagcuuggagaacgccagagcgacucccuggagaaaguccggcagcugcucccccugccuaagcaaacaagagaugugauuaccugcgagccccagggcagccuuaucgacacgaaaggcaacaagauugccggguucgauucuaucuuuaaaaaggaaggacugcagguuuccacaaagcagaaaauuagcccuugggaccucuucgagggccugaagcccucugcuccgcuguccugggggugguuuggaaccgugcgcgucgaucggagaguggcccgcggcgaagaacaacagcggcuccuucuguaccacacccaccugagaccucgccccagagccuacuaucucgagccccugccucuuccgcccgaagacgaggaaccucccgcuccuacacugcucgagcccgagaaaaaggcgccugagccgcccaaaaccgauaagccuggggccgcucccccuagcacggaggaacggaagaaaaagucuacaaaaggaaagaaacgcucccagcccgccaccaagacagaggacuacggcaugggcccggggagaagcggaccuuauggcguuaccgugccgcccgaucugcugcaucacccuaaucccggguccaucacacaucucaacuaccggcagggaagcaucggccuuuauacccaaaaucagccucugccggccgggggaccccgcgucgacccuuacagacccgugcggcugccuaugcagaagcuccccacgagaccgaccuauccuggcgugcugcccacaaccaugacaggcguuauggggcuugaaccuucuagcuacaaaaccuccgucuaccgccagcaacagcccgcugugccucagggacaacggcugagacagcagcuccagcaaucucagggcaugcuggggcagagcuccgugcaccagaugacgcccucuagcuccuauggacugcaaacaucucagggcuacaccccguaugucagccauguggggcuccagcagcacacaggaccugccggcaccaugguuccgcccuccuacagcucucaaccuuaucaguccacccacccgagcacaaaccccacgcuuguggauccuacccgccaucugcagcaacggcccucuggcuacguccaccagcaggcgccuacauaugggcauggacugaccuccacacagagauucagccaccaaacccuccagcagacgcccaugauuuccacaaugaccccuaugucugcucagggcgugcaagccgggguucggagcaccgccauccugcccgagcagcagcagcaacagcagcaacagcagcagcaacagcagcagcaacagcagcagcaacagcagcagcaacagcagcaauaccacauucgccagcagcagcaacagcagauccuuagacagcaacagcagcagcaacagcagcaacagcagcagcaacagcagcagcaacagcagcagcaacagcagcagcaacagcaucagcaacagcagcagcaacaggcugccccgccucagccccagccucaaucccagccccaguuucagcggcaaggacugcagcagacacaacagcagcagcaaaccgcggcccucgugcgccagcugcagcagcaacugagcaauacacagccgcagccuucuacgaacauuuucggcagauacuga

SEQ ID NO: 71988 - RNA, 6438 nt, Artificial Sequence
  derived and/or modified sequence opt5 from MED12L__Homo_sapiens__NP_443728
auggccgcuuucggccugcucagcuacgagcagagaccccugaagcggccucgccuugggccgcccgacguguauccucaagaucccaaacagaaggaagacgagcugaccgccgucaacguuaaacagggauuuaauaaccagccugcguucacaggcgaugaacacggguccgcuagaaauaucgugauuaaccccucuaagaucggagccuacuuuagcuccauucucgccgagaaacugaagcuuaauacguuccaagacaccggcaagaaaaagccucaggugaacgcuaaagauaauuauuggcuggucacagcccggucucagagcgcuauccauuccugguuuucugaccucgccgggaacaagccgcugagcauucuggcgaaaaaggugcccauccucuccaagaaagaagauguuuucgccuaccuggcuaaguauagcgugccuaugguccgcgccaccuggcuuaucaaaaugacaugcgcuuacuauucugccauuuccgaggcgaagaucaaaaagagacaggcccccgacccuaaucuggaguggacccaaauuagcacacgguaccuccgcgaacagcuggcuaaaaucucugauuuuuaccacauggccuccagcaccggagacggccccgugccgguuccucccgagguggaacaggcuaugaagcagugggaguauaacgagaagcuugccuuccauauguuucaagaaggcaugcuggagaaacacgaauaccucacguggauucuggauguccuggagaagaucagaccuauggacgaugaccuccugaaacuucugcucccccugaugcuucaguauucugacgaauucgugcaguccgccuaccugagccggcgccucgcuuauuuuugugcgagacggcugucccugcuccugucugauagccccaaucuucuggccgcucauuccccucacaugaugauugggccgaacaauagcucuaucggagcccccuccccuggccccccugggcccggaaugagcccggugcaacucgccuucucugacuuucugagcugcgcucagcacggcccucuugucuacgggcuguccuguaugcuccagaccguuacacugugcugucccucugcccugguguggaacuauagcaccaaugagaacaaguccgcgaacccuggaagcccccucgaucugcuucagguggcuccuucuucccugcccaugccgggcggcaauacagccuucaaccaacagguccgcgccagaaucuacgagguggaacagcagauuaaacaacgggggcgcgcuguugaggugagauggagcuucgacaagugccaggaaucuaccgccggagucacgaucucccgggugcuccauacacuggagguucuggauagacacuguuuugaccgcaccgauagcuccaauucuauggaaacacuuuaccauaagauuuucugggcuaaccagaauaaagacaaccaggagguggccccuaaugaugaggcggucgugacccuccugugcgaaugggccgucagcuguaagcgguccggcaaacacagagcuauggccguggcuaagcugcucgagaaacgccaagccgaaaucgaggcggaacggugcggggagucugagguucuggacgaaaaggagagcauuuccagcucuucccuugccggaagcucucugcccguguuucagaacguccuccugagauuccuggauacccaggcucccucccuuagcgacccuaauucugaaugugagaagguggaguuuguuaaccucgugcugcuguucugcgaauuuauccgccacgacgucuucagccaugaugccuauaugugcacacucaucucccggggcgaccugagcgugacggcuucuaccagaccgcgcucccccgugggggagaaugccgaugaacacuacagcaaagaccaugauguuaagauggagauuuuuuccccuaugcccggagaaucuugugagaacgccaauacaagccuuggccggagaauguccgucaacugcgagaaacuggugaagcgcgaaaaaccucgggagcucaucuuccccucuaauuaugaccugcugagacaccuucaguacgcuacccauuuuccuauuccccucgaugaaagcuccucucacgaguguaaccaacggacaauccugcuguauggcguggggaaggaacgcgacgaggcgagacaccagcucaagaaaauuaccaaggauauccugaaaauccuuaacaagaaaagcacgacagagaccggagucggcgacgaagggcagaaggcccggaaaaauaagcaagagaccuucccgacacuggaaaccguguuuacaaagcuccagcugcuguccuacuucgaucagcaucagguuacgagccaaauuucuaacaaugugcuugagcagaucaccuccuucgcuagcggaacaucuuaucaccucccucuggcccaucacauucagcugaucuuugaccucauggaacccgcccugaacauuaauggccuuaucgauuucgcuauucagcugcucaacgagcuguccgucguggaggccgaacugcuucugaaaagcucuucccucgcggggagcuacaccacaggccugugcguuuguaucguggcuguccucagacgcuaccacuccugccugauccuuaauccugaccaaaccgcccagguguuugagggacuguguggcguugugaagcaugucgugaaccccagcgaaugcucuagcccggagcgguguauucucgccuaucuguacgaccuguauguguccugcucucaccuuagaagcaaauucggggaucuguuuuccucugcuuguagcaaggucaaacagacgaucuacaauaacguuaugccugccaauuccaaccuccgcugggaccccgauuucaugauggacuuuauugagaauccuucugcgagaagcaucaacuauuccaugcugggaaagauucucagcgauaaugcugccaaccgguacucuuucgugugcaacacccugaugaaugugugcaugggccaucaggacgccgggcgcaucaacgauaucgcuaauuuuuccagcgaacuuacagccuguugcaccguccugucuuccgaguggcucggagugcugaaggcucuguguugcagcuccaaccacguuuggggcuucaaugacgugcuuuguacagucgaugugucugaccugagcuuucaugauucccucgccaccuucauugcgauccugauugccagacaaugcuuuagccucgaagacguugugcagcacgucgcucugcccucucuucuggccgcugccuguggggaugccgacgcugagcccggcgcgcggaugacgugccgccugcuccugcaccuuuucagagccccucaggcuuguuuccugccgcaagccacaggaaaacccuuuccuggcauccgguccagcugcgaccgccaucuccuggccgcugcccacaacucuauugaagugggggcgguuuucgcugugcucaaggccaucaugaugcugggagaugccaaaaucggcaauaacagcgucuccucucuuaagaaugacgauuuuaccaugagagggcugcggugugacggaaacgcugaugacauuuggacagccagccagaaucccaaauccugcggcaagucuaucagcauugagaccgcgaaccugcgcgaguaugcuagauacgugcuccggaccaucugccagcaggaaugggugggggagcauugucugaaggaaccugagagacuuugcacagauaaagaacugauucucgaccccguccuguccaauaugcaagcccagaagcuccugcagcuuaucuguuacccucacggcaucaaagagugcacggagggagauaaccugcagcgccaacauauuaagcggauccugcagaaucucgaacaguggacccugagacagagcuggcuugagcugcaacucaugauuaaacagugucugaaggacccgggcucuggguccguugccgaaaugaacaaccuccuggauaauaucgcuaaggccacaauugagguguuccagcagagcgcugaccuuaacaauuccucuaacagcggaaugucccuguuuaaucccaacucuaucggcagcgccgacaccuccagcacacgccaaaaugggauuaaaaccuuccugucuuccagcgaacggagaggaguguggcucgucgcgccucugaucgcccgccuucccacgucugugcagggccggguucugaaggcugccggggaggagcucgaaaaaggccagcaccugggauccagcucuaagaaagagagagaucgccaaaagcagaaaagcaugucccugcucucucagcagccuuuucuuagccuggugcugacaugccucaagggccaagacgaacagcgggaggggcugcuuaccucccugcagaaccaggucaaucaaauccucagcaacuggagagaggaacgguaucaggaugacauuaaggcucgccagaugaugcacgaggcccugcagcugagacucaaucuugugggaggcauguucgauaccguucaacgguccacacaguggaccacagacugggcccugcugcuccugcagaucauuacgucugggaccguggauaugcauacaaacaaugaacuuuuuaccacaguccuggacaugcucggagugcugaucaacggcacccuggcuagcgaucucuccaaugcgucucccggcgggagcgaggaaaacaaacgcgccuacaugaaucuugucaagaaacugaagaaagagcugggagacaagagauccgagucuauugauaaggugcggcaacuccugccgcuuccuaaacagacgugugacguuaucaccugcgaacccaugggcagccugaucgauacaaaggggaacaaaauugcuggauucgacuccaucgacaagaaacagggccuccaggugagcaccaagcaaaaggucucucccugggaucuguuugaggggcagaaaaacccugccccccuguccugggccugguucggaacagugagaguugaccgccgggugauuaaguaugaagagcagcaccaucuccuucuguaccacacccacccuaugccgaaacccagaagcuauuaccugcagccucucccccugccucccgaagaggaggaagaggaaccgacaucuccugucucccaagagcccgaacgcaagagcgcugagcuuucugaucagggcaaaaccacgacagacgaggaaaagaagaccaaaggccggaagagaaaaaccaaguccagcucccgcguggaugaguauccucagagcaauaucuaccgggugcccccuaacuacucucccauuagcucccagaugaugcaucacccgcaaucuacacuguggggguauaaucucguuggacagccucagcagcccggcuucuuucugcaaaaccagagccugacccccgggggauccagacucgacccugccggcucuuucgucccgacgaauacaaaacaggcgcuuagcaacaugcugcaacgcagauccggggcuaugaugcagcccccuucucugcaugccaucaccagccagcagcaacucauccagaugaagcugcuucagcagcaacagcagcagcggcugcuccgccaagcccagacaagacccuuucagcaaggacagccuggcgaucaggcugcccuguucgcggcccaggcucggcccuccccucaacugccgcaguaccccggccuccagcaggcccaaaccaugccucagggguauacaauguacggaacccagaugccccuucagcaaacgagccagcagcaagcuggcucuguggugcuguccccuagcuauaauucucgcgccuaccccgcugcccacuccaacccgguccugauggaaagacuccggcagauucagcagcaaccuagcggguaugugcagcagcaggcgucccccuaccugcaaccccuuaccggaucucagagacugaaucaucaggcccuccagcaaagcccucugguuggcgggggaaucgacgcugugcugacauccgcccaccccaaccucccuagcgucccgcuuccccaggauccuaugcgcccccggcagccucaggugagacaacagcagcgccugcugcaaaugcagcagccccagcaaccgcagccucagcagcccccucaaccccagcagucuucccagagccaaucucagacccucggccugcaggcuaugcaaccucagcagccccuuuuuccgcggcagggccugcaacagacacagcagcaacagcagaccgccgcccucguuagacagcugcaaaagcagcugagcuccaaucagccucagcaaggggugacgcccuacggacaccccucucauuucuga

SEQ ID NO: 71989 - RNA, 6525 nt, Artificial Sequence
  derived and/or modified sequence opt5 from MED13__Homo_sapiens__NP_005112
augagcgccuccuucgugcccaacggcgcuucucuggaggacugccacuguaaucucuuuugccuggccgaucuuaccgggaucaaguggaaaaaguacgucuggcagggaccuacaagcgcgccgauucuguuccccguuacggaagaggacccuauccucuccucuuuuagcagaugucugaaagcugaugugcuuggcguguggcggcgcgaccaaagacccgggcggcgcgaacuguggauuuucugguggggagaggauccuuccuuugccgaccucauccaucacgaucugucugaagaggaggacggcgucugggaaaacgggcugagcuaugagugcagaacccuccuguucaaggccgugcauaaucuucuggaacggugucucaugaaccgcaauuuuguuagaauuggaaaaugguucgugaagcccuacgagaaggaugagaaaccuaucaacaaguccgaacaccugagcugcucuuuuacauucuuucuucauggcgacuccaaugucuguaccagcguggagaucaaccagcaccagccgguuuaucugcucucugaagagcacauuacacuggcucagcaauccaauagccccuuccaggugauccugugcccuuuuggccucaacgggacccugacaggacaggccuucaaaaugucugauuccgcuaccaagaaacuuauuggcgaauggaagcaguucuaccccaucagcuguugccugaaggagauguccgaggaaaaacaagaggacauggauugggaagacgacucucucgccgcggucgaggugcugguggccgggguccggaugauuuauccugcuuguuuuguucuugugccccagagcgauaucccgacgccuucccccgugggaagcacccauugcucuuccagcugccugggcguccaccaggugccugccucuacacgcgaccccgcuaugagcuccguuacccucacacccccuaccucuccggaagaggugcagacggucgauccccaaagcgugcagaaguggguuaaauucuccagcgugucugacggguuuaauuccgauagcacaucucaucacggaggcaagauuccuagaaaacuggccaaccacgucguggaccgggucuggcaggaguguaauaugaaccgcgcgcaaaauaagagaaaauacuccgccagcuccggcgggcugugcgaagaggcuaccgccgcuaagguggccucuugggauuucguugaagccacacagcggaccaacuguagcugccuccgccauaagaaccugaaauccagaaaugcuggacagcagggccaagcgcccucucuugggcagcagcagcaaauccugccuaagcacaaaaccaacgagaagcaggaaaaaagcgagaagccccagaagcggccgcucacaccuuuucaucacagaguguccgucagcgacgaugugggaauggacgccgauucugcuucccagcgccugguuaucagcgcccccgacucucaagugcgguucuccaauauuagaacgaacgacgucgccaaaaccccucagaugcauggcacagagauggcuaauagcccccagccucccccgcuuucuccucaccccugugaugugguggacgaagggguuaccaagacacccagcaccccucagucccaacacuuuuaucagaugccgacgcccgauccucugguccccagcaaaccuauggaggaccgcaucgauucucucucccagagcuuccccccucaauaccaggaagccguggagcccacaguguacgucggaaccgcggugaaccuggaggaagacgaggcuaauauugccuggaaguauuacaaauuuccgaagaagaaagauguugaauuccugccuccccagcucccuuccgacaaguuuaaagaugaccccgugggcccguucggccaggagucugucaccagcgugacagaacugaugguucaaugcaagaaaccucuuaagguguccgaugagcugguccagcaguaucagaucaagaaccaaugucucucugccauugcuagcgacgccgagcaggaacccaaaaucgauccuuacgcuuuuguggagggggacgaagaguuccuguuccccgacaagaaagaucggcagaauuccgaaagagaggccggaaagaaacauaagguugaggacggcaccucuagcgugacaguccugucccacgaagaggaugcgaugagccuuuuuucucccuccaucaaacaggacgccccucgcccgacgagccaugcucggcccccuucuaccucccucauuuaugauagcgaccuggccgugucuuacacagaucuggacaaccucuucaauuccgaugaagacgagcugacccccgggagcaagaaguccgcuaacggaagcgaugacaaagccucuugcaaggaaagcaaaacaggcaaucuugauccucuguccuguaucucuaccgcggaccuccacaagauguaucccacgccuccgagccuggagcaacacauuaugggguuuucccccaugaacaugaauaacaaagaguacggcucuauggacaccacaccuggaggcaccgugcuggaagggaacagcuccucuaucggagcccaguucaagauugaggucgaugaaggcuuuugcagccccaagccuuccgagaucaaagacuucagcuacguuuauaagcccgagaauugucagauccuuguggggugcucuauguuugcuccgcucaaaacacugccuucccaauaccugccccccauuaagcucccugaagagugcaucuauagacagagcuggaccgugggaaaacuggaacuucugucuuccggccccagcaugccuuucauuaaggagggggauggcuccaacauggaccaggaauacggaacggccuauacaccgcagacccauacaucuuuuggcaugcccccuagcuccgcucccccuagcaauucuggggccggaauccuccccuccccgagcaccccucgcuuccccaccccucggacacccagaacgccucgcaccccccggggcgccgggggaccggcuucugcgcaaggcagcgucaaguacgagaacuccgaucuguauucuccugccagcacacccuccaccuguagaccccugaauucuguggagccugcuacaguuccgagcauucccgaagcccacucccuuuacgugaaccucauccugagcgagucugucaugaaucuguuuaaagacugcaacuucgauuccuguugcauuugugugugcaauaugaacaucaagggggccgacguuggcguguacaucccugaucccacccaggaagcucaguaucgguguacgugcggauuuagcgccgucaugaaucgcaaauucggcaacaauuccgggcucuuccuggaggacgaacuugauauuaucggaagaaacacagacuguggcaaggaggcggagaaacgguuugaagcucugagagccaccucugccgagcaugugaaugggggacucaaggaaagcgagaagcuguccgacgaucugauucuucuccugcaggaccaaugcaccaaccuguucucuccuuuuggcgcugccgaucaggaccccuucccuaaaagcgggguuaucuccaacugggugcgcgucgaagagcgggauuguugcaaugacugcuaccucgcgcuggagcacggcagacaguuuauggauaacaugagcggaggcaagguggacgaagcucuugugaaaucuuccugucugcauccguggagcaagcgcaaugaugucucuaugcagugcucccaagacauucucagaaugcugcugagccuucagcccguucugcaggaugccauccagaaaaagcggacagugcgcccuuggggggugcaaggaccccucaccuggcagcaguuccacaaaauggccggcagagggucuuauggaacagacgagagcccugaaccccugccgaucccuacguuucuccugggcuacgauuaugacuaccuuguccugucccccuucgcucuccccuauugggagcggcugaugcuggagccuuacggcucucaacgcgacauugccuacgugguucuuugucccgaaaacgaggcucugcucaauggggccaagagcuuuuucagagaucugaccgcgaucuaugaauccugccggcucggacagcaccgcccugugagcagacugcuuacagacggcauuaugcgggucggguccaccgccucuaagaaacugagcgagaagcucguggcugaaugguuuucccaggccgcugauggaaacaaugaggccuucucuaaacugaagcuguacgcccagguuugucgcuaugaccuuggcccguaccuggcuagccucccccuggauuccucucuccugagccaaccuaaccuuguggcgcccacaucccagagccugaucaccccuccccagaugacgaauaccgggaacgccaauacaccgucugcuacccuggccuccgccgcuagcucuacaaugaccgucacauccggaguggccauuagcaccucugucgcgacggcuaacuccacacucaccaccgccagcacauccagcucuagcuccucuaaucugaacagcggcguguccucuaauaaacuuccuagcuuccccccuuuuggcuccaugaacucuaacgccgcugggagcauguccacccaggccaauacgguucaaagcggacagcugggcgggcagcagacaucugcgcuccaaaccgcuggaaucuccggcgagagcucuucccugcccacacagccucaucccgacgugagcgaauccaccauggauagagacaaggucgggaucccgacagauggagacucucacgccgugaccuauccucccgccauuguuguguacaucauugaucccuucacguaugagaacaccgacgaaagcacaaauuccagcucugucuggacccucggccugcuucggugcuuucuggagauggugcagacacugccuccgcauaucaaguccaccgugagcguucaaauuauccccugucaguaccuccugcagccugucaaacacgaagauagagagaucuacccccagcaucuuaagucucuggcuuucagcgccuuuacgcaaugccgccggccucuccccacauccaccaacgugaaaacacugaccggcuucgggccuggacucgcuauggagaccgcccugagaucucccgaccgcccggaauguauucggcuuuaugcgccucccuuuauccuggccccugugaaggacaaacagacagagcugggcgaaacguucggggaggcuggacagaaguacaauguccucuuugugggcuauugccugagccacgaucagagauggauucuugccuccuguaccgaccuguacggggaacuccuggagacaugcaucauuaacaucgauguucccaaucgcgcucggagaaagaaaucuagcgcccgcaaguucggacuccaaaaacugugggaguggugccuuggccuggugcagauguccagccugccguggcgggucgugauuggcagacucgggcggaucggacacggcgaacugaaggacuggucuugucuucugucccgcagaaaccuccagagccuguccaaacggcugaaggauaugugccgcaugugugggaucucugccgcugacagcccuuccauucucucugcgugccuuguugccauggagccccagggaagcuuugugaucaugcccgauuccgucagcaccggcucuguguucgggagauccacaacccugaauaugcaaacgagccagcugaacacaccucaggacaccucuuguacccauauucucguuuuucccacauccgcuagcgugcaggucgccucugccaccuauacaacggaaaaucuggaucuugcuuucaacccuaauaacgacggagccgauggcaugggcaucuucgaccugcucgacaccggggaugaccuggauccggacauuaucaauauccugcccgcguccccuacaggaagccccgugcacucuccuggcagccauuacccccacgggggagaugcuggcaaggggcaauccaccgaccggcuccuuagcacagagccucacgaggaagugccgaacauucugcagcagccccuggcccucggauauuuugucuccaccgccaaagcuggcccucugcccgauugguucuggucugccugcccucaagcgcaguaccaguguccccuuuuucugaaggccagccuccaucugcacguuccguccgugcagucugacgagcugcuccauagcaaacacucccauccucuugauucuaaucaaacgagcgacgugcugagauucguccuggaacaguacaacgcucucuccuggcugaccugcgaucccgccacacaggaccgccggagcugucuucccauccacuuugugguucugaaccagcucuauaauuucauuaugaacaugcuguga

SEQ ID NO: 71990 - RNA, 6633 nt, Artificial Sequence
  derived and/or modified sequence opt5 from MED13L__Homo_sapiens__NP_056150
augaccgccgcugccaacuggguggccaauggcgcuagccuggaggacugccacuccaaccucuucucucuggccgagcuuacagggaucaaguggcggcgguacaauuuuggaggccauggggauuguggacccauuaucagcgccccugcucaggacgaucccauucugcucuccuucauccgcugccugcaagccaaccuucugugugucuggagacgggacguuaaacccgauugcaaggagcucuggaucuuuugguggggcgacgaaccuaaucuggugggggugauccaccaugagcugcaggucguggaagagggacucugggagaacggccugucuuaugaaugucgcacgcuucuguucaaagcuauccacaaucuccuggagagaugccuuauggauaagaacuuuguucggauuggcaaaugguucgugcgccccuacgaaaaggacgagaagccugucaauaaaagcgagcaucuguccugugccuuuaccuucuuucuccacggggaaucuaacgugugcacaagcguugagaucgcgcagcaccagcccauuuaucugaucaaugaggaacauauucacauggcccaauccagcccugcuccguuccaggugcuggucucucccuacggacucaacggcacccugacagggcaggccuauaagauguccgauccugcuaccagaaaacuuaucgaagaguggcaguacuuuuaucccauggugcugaagaaaaaggaggaaagcaaggaggaagacgagcucggauacgaugacgauuucccuguggccgucgaaguuauugugggcggggugcggauggucuaccccucugcguuugugcugaucucccaaaaugacaucccgguuccucagagcguggccucugcuggaggccauauugccgucggccagcaggggcuuggauccgugaaagaccccagcaacuguggcaugccucugacaccgcccaccuccccugagcaagcuauccucggggagucuggaggcaugcagagcgccgccucccaccugguuagccaggaugggggaaugauuacgaugcacucuccgaagcgcuccggcaaaauucccccuaagcugcauaaucacauggugcauagagucuggaaagaaugcauucucaaccggacccaaagcaagcgcucucagaugagcacacccacccuggaggaggaaccugcuuccaaccccgcgacaugggacuucguggauccgacccagagagucucuuguagcugcucccggcacaaacuucugaagcgcugcgccgugggcccuaauagacccccuacgguuagccagcccggguucucugcuggaccuuccuccucuagcagccugccgcccccugccuccucuaagcauaaaacagccgaacggcaagagaagggcgacaaacugcagaagagaccccuuauccccuuucaccaccgcccuagcguggcugaggaacuguguauggagcaggauaccccggggcagaaacucggacuggccggcaucgacuccucucuggaagucagcuccagccggaaguaugauaagcaaauggcggugcccucuagaaacacauccaaacagaugaaucucaacccuauggacagcccccauucuccuauuagcccccugccucccacccuuagcccgcagccucgcgggcaggagaccgagucucuggaucccccuagcguucccgugaauccggcucucuacggcaacggacuggaacugcaacagcuuuccacacucgacgaucggacgguccuggugggccagagacugccucucauggccgaggugagcgaaaccgcccuguauugcgggauccgccccucuaauccugaguccagcgaaaagugguggcacuccuaccggcuuccgcccucugacgacgcugaguucagaccuccggagcugcagggagaacgcugugaugccaaaauggagguuaacagcgaauccacagcucuccaacggcugcuggcccagcccaauaagagauuuaaaauuuggcaggacaagcaaccucagcuucagccccuccauuuccuggauccucugccccucucucagcaaccuggcgacagccugggggaggucaacgauccguauaccuuugaagacggagauaucaaguacauuuucacagcgaauaaaaagugcaaacagggcaccgagaaggacucccuuaaaaagaacaagucugaggauggguuuggcacgaaagacgugacaacccccggacacagcaccccugugcccgauggcaagaaugccauguccaucuucagcucugcuacaaaaaccgacguccgccaggauaacgccgcugggcgggccggauccagcucucugacacaggugacggaccucgcgccuucccugcacgaccuggauaauaucuuugacaacagcgaugacgaugaacuuggcgccguuucucccgcucucagauccagcaagaugccggccguggggaccgaggaccggccucugggaaaagauggccgcgcugccguccccuaucccccuacaguggccgaccugcaaagaauguuccccaccccuccgucccucgaacagcaucccgcuuuuagcccuguuaugaacuacaaggaugggauuucuagcgagacagugaccgcgcugggcaugauggaaucccccauggucucuauggugagcacgcagcuuaccgaguucaaaauggagguugaagacggacugggcuccccuaagcccgaggaaaucaaggauuuuucuuacgugcacaaagucccgagcuuccagccuuucgugggguccucuauguuugcgccccucaagaugcugccuagccauugucugcuuccccucaaaauuccugacgcuugccuguuccggcccuccugggccaucccgccuaagauugagcaacugcccaugcccccugccgcuacauuuaucagagauggauauaauaacgugccgagcgucggcucucucgccgaccccgacuaccugaauaccccucagaugaacacacccguuacccuuaauuccgcggcuccugccagcaacucuggggccggagugcugcccuccccugcuacgccgcgcuucagcgugcccacaccucggacccccagaacaccucgcacccccagaggcgggggcaccgccuccggacagggcucugucaaauaugauagcacagaccaaggguccccggcgagcacgccuucuaccacacggccccucaauuccguggagcccgcuaccaugcagccuauucccgaagcccacagccuguacguuacacugauccuuucugauagcgugaugaacaucuuuaaggaccgcaauuucgauuccuguugcauuugugccugcaacaugaauaucaagggagcugacgucggccuguauauuccugauucuagcaacgaggaccaguacagauguaccugcggguuuuccgccaucaugaaucggaaacucggauauaacucuggccuguuccucgaagaugagcuggacauuuuuggcaagaauagcgauaucgggcaggcugccgaacgcagacuuaugaugugccaauccacguuccugccccagguggagggaaccaaaaagccccaggagccucccaucagccuccugcugcuucugcagaaccaacauacccagccuuuugcgucucucaacuuccuggacuacauuuccagcaauaaccggcagacccuccccuguguuuccuggucuuacgaccgcgugcaggccgauaauaacgacuauuggacagaaugcuuuaaugcucuggagcaaggcagacaguacgucgauaacccgaccgggggaaaaguggacgaagcccuuguucggagcgcuacagugcacuccuggccucacucuaauguccuggauaucagcaugcucuccagccaggacguggugcgcaugcugcugucucuucagcccuuccugcaagaugccauucagaagaagagaacgggccggaccugggagaacauccagcauguccaagggccucucacauggcagcaguuccacaaaauggccggaagaggcaccuauggcuccgaagagagccccgagccucugcccauuccgacacuccugguuggguacgacaaggauuuucuuaccaucucuccuuucucccugcccuuuugggaacgccugcuccuggaccccuauggaggccaucgggauguggcuuacaucguggucuguccugagaaugaagcgcuucuggagggggccaaaacguucuuuagagaccucagcgcuguguaugaaaugugccgccugggacagcacaagccgauuuguaaaguucuccgggauggcaucaugagaguggggaagaccgucgcccaaaagcugacagacgagcuugugucugagugguucaaccagcccuggagcggagaagagaaugacaaccauucccgccugaaacuguacgcccagguuugccggcaccaccucgcuccuuaccuggccacccuucagcuggauucuagccuccugauucccccuaaguaucaaacacccccugcggcugcccagggccaggccacccccggcaaugcugggccgcucgccccuaacggauccgcggcucccccugccggcagcgccuuuaaucccacauccaacucuagcuccaccaacccggcugccucuagcuccgcuucugggagcuccgugccucccgucuccucuagcgccagcgcgcccggaaucucucagauuuccacgacauccucuuccggcuucagcggguccgugggaggccaaaauccuagcaccggcgggaucucugccgacagaacccagggaaacaucggcugugggggagauacagaccccggccagagcuccucucaaccuagccaggaugggcaggaauccgucaccgagcgcgagcggauuggaaucccgacggaacccgacucugcugauagccaugcccacccucccgcugugguuauuuacaugguggacccuuuuacauaugccgccgaggaagauuccaccucuggcaauuucuggcugcuuagccugaugagaugcuacacagagaugcuggacaaccuccccgaacauaugagaaauuccuuuauccugcagauugucccuugucaauauaugcuucagaccaugaaagaugaacagguguucuacauccaguaucucaagagcauggcuuucucuguuuacugccaaugucgcagaccgcuccccacacagauucacaucaaaucccugaccggcuuugggccugcggccagcaucgagaugacgcucaagaaccccgaacggccuucucccauucagcuguacuccccgccuuucauccuugcucccauuaaagacaagcagaccgagcugggagaaacauuuggcgaggccagccaaaaguauaaugugcuguucgucggguacugccucucccacgaucagcgcuggcugcuugccucuugcaccgaccugcauggagaacuccuggagacauguguggugaacaucgcucugcccaauagaagccggagauccaaaguuagcgcccgcaagauuggccuccagaaacuuugggaguggugcaucgggaucguccagaugaccucucugccuuggcggguggugauuggaagacugggccgccucggccacggggaacugaaggacugguccauccuucugggagaguguagccuccaaacgauuucuaaaaagcugaaggaugucugccggauguguggcaucagcgcggcugacucccccucuauucugagcgccugccucguggccauggaaccucagggguccuuuguugugaugccggaugcugucacaaugggaucuguguucggcagaagcaccgcccuuaacaugcaguccagccaacugaauacaccccaggacgcgucuuguacccauauccugguuuuuccuaccuccagcacaauccagguggcccccgcuaacuauccuaaugaggauggguucucccccaacaaugacgauauguuugucgaccucccguucccugaugacauggauaacgacauuggaauccugaugacgggcaaucuucacucuagccccaacuccucuccugugcccagcccgggcuccccuagcgggauuggaguuggcucucauuuucagcacucccgcagccaaggggaacggcugcucucuagagaggcccccgaggaacugaaacagcagccccuggcucucggauacuucguguccaccgccaaggcugagaaccuuccucagugguuuuggagcucuugcccccaagcccagaaucaguguccucuguuccugaaagcgucccuccaccaucacaucagcgucgcccagacagacgaacugcuuccggcucgcaacucucaaagagugccccauccucuggauagcaagaccacauccgacgugcuccgguucguccuggagcaguauaaugcccugagcuggcucacaugcaaccccgcuacgcaggaucgcacauccugucuuccuguucacuuuguggugcugacccaacuguacaaugccauuaugaacauccucuga

SEQ ID NO: 71991 - RNA, 4365 nt, Artificial Sequence
  derived and/or modified sequence opt5 from MED14__Homo_sapiens__NP_004220
auggcccccgugcagcuggagaaccaccaacucgucccuccgggcgggggaggcgggggaagcggcgggcccccuuccgcucccgccccucccccuccgggagcggcuguugccgccgcugccgcugccgcggccucucccggcuacagacugagcacccuuaucgaguuccugcuccaucgggcuuauuccgagcugauggugcuuacagaccugcucccucgcaagucugauguggaaagaaaaauugagaucguccaguuugccagccggacgcgccagcuguucgugagacugcucgcucugguuaagugggccaauaacgcgggcaaaguggaaaagugcgccaugauuuccucuuuucuugaccagcaagcuauccuguucgucgauaccgccgaccggcucgcuagccuggcccgcgaugcccuugugcacgcuagacugcccuccuuugcgauuccuuacgccaucgacguucucacaaccgggagcuauccccggcugccgacauguauccgcgauaaaauuaucccucccgacccuauuaccaagaucgagaagcaggcuacacugcaucagcucaaucagauucugagacaccggcuugugaccacggaucugccuccccaacucgccaaccugaccgucgccaauggacgcgugaaauucagaguggagggcgaauuugaggcuacacuuaccgucaugggggacgaucccgacguuccguggcggcugcucaagcuggaaauccugguggaggauaaagagacaggagacggccgcgcccucgugcauucuaugcagauuuccuucauccaccagcugguccagagcagacuuuuugcggacgaaaagccccugcaagauauguacaacugccuccacucuuucugucugucccuucagcuggaggugcuccauagccagacccugaugcugauccgggaaagauggggagaccucguucaaguggagcgcuaucacgcugggaaaugccugucucuuuccgucuggaaucaacaggugcugggccggaagacgggcacagccagcguucauaaggugaccauuaaaaucgaugaaaacgacgucuccaagccucuccagauuuuucacgaucccccucugcccgccucugacagcaaacugguggagagagcuaugaagaucgaucaccuuuccauugagaaacuccugaucgacagcguccaugcccgcgcucaccaaaagcugcaggaacucaaagccauccugcggggguucaaugcgaacgagaacucuuccauugaaacagcccuuccggcucuggugguuccuauccucgagcccuguggaaacagcgaaugccugcauauuuuuguggaucugcacucuggcauguuccagcuuaugcucuacgggcuggaccaggccacccuggaugacauggaaaagagcgucaaugacgauaugaagagaaucauuccuuggauccagcagcucaaauucuggcugggacagcagcgcuguaagcaauccaucaaacaucuucccaccauuucuagcgaaacacugcagcucuccaauuauagcacgcacccuaucggcaaucugucuaagaacaaacuguuuauuaaacuuacccggcucccccaguacuacaucgugguugagaugcuggaggugccgaacaagccuacacagcuguccuauaaguacuauuucaugagcgucaaugcugccgacagagaagauucucccgcgauggcccuccugcuucaacaguuuaaggagaacauucaggaccugguguuccgcaccaaaacagggaagcaaacccggacgaaugcuaaaagaaagcucuccgaugaccccugcccuguggaaagcaagaaaacaaagcgcgccggagagaugugugcuuuuaacaaaguucuggcccacuucgucgccaugugcgauaccaauaugccguuugugggccugcggcuugagcucuccaaccuggaaaucccccaucagggcgugcaggucgagggggacggauucucucacgcuauuagacugcucaagaucccucccuguaaaggcaucaccgaagagacacagaaggcgcuggaucggagccuucuggacugcaccuuucgccuccaagggagaaauaaccggacauggguggccgagcugguuuucgcuaauugcccucugaacggaacguccaccagagaacagggccccucucgccauguguaccuuacauaugagaaucugcucagcgaaccugucgggggccggaaggugguugagauguuucugaacgauuggaacuccauugccagacucuacgaaugugugcuggaguucgcccgcagccuucccgacaucccggcucaccugaauaucuuuucugaggucagaguguauaauuaccggaaacucauucugugcuacggaaccacaaagggcuccagcauuucuauccaguggaacuccauccaccagaaauuccauauuagccuggggaccguuggaccuaacucuggcuguagcaauugccacaacacgauccuucaucaacugcaggaaauguucaauaagacccccaacgugguccagcuccuccaggugcuguuugauacacaagccccucugaaugcgauuaacaaacuucccaccgugccgaugcuggggcucacacagcgcaccaauacggcuuaucaguguuucuccauccugccucaaagcucuacacacauuagacuggccuuucggaacauguacugcaucgacaucuauugucgcuccagaggagucguugccauucgggacggcgcuuacagccuuuucgauaauuccaagcugguggagggguuuuaucccgccccuggccucaaaaccuuccugaacauguuuguggacucuaaucaggaugcgcgcagacggagcgucaacgaagacgauaauccucccucccccaucggaggcgacaugauggauucucucauuagccagcugcagccgcccccucaacagcagcccuucccuaagcagcccgggacauccggagcuuacccucuuaccucuccgcccaccagcuaucauuccacagugaaccaaagcccuucuaugaugcacacgcagucccccggcaaucugcacgccgccagcucuccuuccggggcucugcgcgcccccagcccggcuucuuuuguuccuaccccuccucccuccagccauggaaucuccauuggccccggggccagcuucgcgucuccccacggcacacucgacccgagcucccccuacaccauggugucuccuagcggcagagccggaaacuggcccggguccccucaggucucuggacccagcccggcugcccggaugccuggcaugucccccgcuaacccuucucugcauagccccgugccugaugccucccacagccccagagccgggacaucuucccagaccaugccgacgaauaugccuccuccccgcaaacuuccccaacggagcugggcugcgucuaucccgacaauccugacccauuccgcccucaacauucugcuccugcccagcccuacccccggacuuguuccuggccuggcuggguccuaccugugcucuccccucgagagauuucugggcagcgugaucaugcgccggcaccuucagagaauuauccagcaggaaacacugcaacucauuaauuccaacgagccuggagucaucauguucaagaccgacgcccugaagugucgcguggcccucagcccgaaaacaaaucagacgcugcagcuuaagguuacccccgagaacgcuggccaauggaaaccugaugaacuccaggugcuggagaaguuuuucgaaacacgggucgccgggcccccuuucaaggcgaauacccugauugcuuuuacaaaacugcuuggagcccccacccacauccugagagacugcgugcauaucaugaagcucgagcuguucccggaucaggccacgcagcucaaauggaacgugcaauuuugucugaccauuccucccucugcucccccuaucgcgcccccuggcacaccggccgucguucuuaaguccaaaaugcuguucuuucugcagcucacccagaagacaagcgugcccccucaggaacccgugucuauuaucgucccuauuaucuaugacauggcuagcgggaccacacaacaggccgacaucccccgccagcaaaauuccucuguggccgcuccgaugaugguuagcaacauucugaagcgguucgccgagaugaauccucccagacagggagagugcaccaucuuugcugccgugcgggaucuuauggcgaaccugacgcucccucccggcggccgcccuuga

SEQ ID NO: 71992 - RNA, 2367 nt, Artificial Sequence
  derived and/or modified sequence opt5 from MED15__Homo_sapiens__NP_001003891
auggacgugagcggccaggagaccgauuggagauccacagccuuccggcaaaagcuggucucucagaucgaagacgcuaugcgcaaagccgggguugcgcacagcaaguccucuaaagauauggagagccauguguuucucaaggcuaaaacgagagacgaauaccugucccuuguggcccggcugauuauccacuuccgcgauauucauaacaagaagucucaggccagcgucuccgaccccaugaaugcucuccagagccugaccggaggcccugccgcuggggccgcgggaaucggcaugccgcccagagggccuggacaaucucuuggcggcauggggucccugggagccaugggccagcccaugagccucucugggcagccucccccuggaacauccggcauggcuccgcacagcauggccgugguuucuaccgcuacaccccagacccaacugcagcugcaacagguggcccuccagcagcagcaacagcagcagcaauuucagcagcagcaacaggcggcccugcagcagcaacagcagcagcaacagcagcaacaguuccaggcucagcaauccgccaugcagcagcaguuucaagcugucgugcagcagcagcaacagcuucagcaacagcagcagcaacagcagcaucugauuaaacuccaccaccagaaccaacagcagauccagcaacagcagcagcaacugcagcggaucgcccagcuucaacugcagcagcagcaacagcagcagcaacagcagcagcaacagcagcaacaggcccuccaggcucagccucccauucaacagccucccaugcagcagccgcaaccucccccuagccaggcgcugccccagcagcugcaacagaugcaucacacacagcaucaccagcccccuccgcaaccccagcagccucccguugcccaaaaucagccuucccagcucccuccccagucucaaacccagccccuggugagccaggcucaggcccuucccgggcaaaugcuguauacgcagccuccccucaaguucguccgcgccccuaugguggugcagcagcccccgguccaaccucagguucagcaacagcagaccgcugugcagacagcccaagcggcucagaugguggcccccggaguccagaugaucaccgaggcccuggcucagggcggcaugcacauuagagcccgguuucccccuacaaccgcuguguccgccaucccguccucuuccauuccccuugggcgccaaccuauggcgcagguuagccagucuagccugcccaugcucuccucuccuagccccggacagcaagugcagacgccucaguccaugcccccgccuccccaaccuagcccccagccgggccagccuucuucccagcccaacagcaaugucucuuccgggccugcccccagccccuccucuuuccugccuagcccgagcccccaaccuucucagagccccgugacagcuagaaccccucagaacuuuuccguucccagcccuggaccgcugaauacacccgugaacccuucuuccgucaugagccccgccggcuccucucaggcugaggaacaacaguaccucgauaaacugaagcagcuuagcaaauauaucgagccucugcggcgcaugauuaauaagaucgacaagaacgaagaucggaaaaaggaccucucuaaaaugaaaagccugcuugauauccugaccgaccccuccaagagaugcccgcucaagacccugcagaaaugugagauugcccuggaaaagcucaagaaugauauggcggugccuacaccgcccccucccccugucccgcccacgaaacaacaguaccugugccagccucuucuggacgccgugcucgcuaacauccgcagccccguuuucaaucauucucuguauagaaccuuugugccugccaugacagcuauucacgggcccccgaucaccgccccugucguguguacacggaagagacgccuggaggacgaugagcggcaguccauucccagcguucuucaaggagaaguggccagacucgacccuaaauuccuggucaaccuggaucccucccauugcucuaauaacggcaccgugcaccucaucuguaagcuggacgauaaagaccuuccuagcgugcccccgcuggagcucuccguuccugcugauuaccccgcgcagucuccccuguggaucgaccgccaguggcaauaugaugccaacccuuuucugcagagcguccaucggugcaugacguccagacuucuccagcugccggacaagcacucugugacagcucugcucaauaccugggcccagagcgugcaccaagccugucuguccgcugccuga

SEQ ID NO: 71993 - RNA, 2634 nt, Artificial Sequence
  derived and/or modified sequence opt5 from MED16__Homo_sapiens__NP_005472
augugcgaccugagacggcccgccgcuggcgggaugauggaucucgccuacgugugugagugggaaaaguggagcaaauccacccacugcccuucugucccgcuggcgugugcuuggagcugccgcaaccuuaucgccuucacaauggaccugagauccgaugaccaggaucucacgcggaugauucauauccuggacaccgagcaccccugggaucuucauucuauuccuagcgaacaccaugaggccaucacaugucuggaaugggaccaauccggaucucgccuccugagcgcugaugccgacggccagauuaagugcugguccauggcugaucaccuggccaauagcugggagucuuccguugggagccucguggagggagaccccaucguggcgcugucuuggcuucacaacggcgucaaacuggcccuccauguggaaaaguccggggcuagcucuuuuggagagaaauucuccagaguuaaguuuagcccuucccugacccuuuucggcggcaagcccauggaaggguggaucgccgugacagucucuggacuggugaccguuagccuccugaaaccuuccggccaggugcugacaagcaccgagucucucugucggcugcgcgggagagucgcucuugccgauauugcguuuacgggaggcgggaauaucgugguggccaccgcugacggauccagcgccucuccgguccaguucuauaagguuugcgugagcguggucuccgagaaaugucggauugacacagaaauccugcccucucucuuuaugcgcugcaccacagaucugaacagaaaggacaaauucccugcuauuacccaccuuaaguuucuggcccgggauaugagcgagcaagugcuccugugugccuccagccagacgucuuccaucguugaaugcuggagccugcgcaaggagggccuccccgugaauaacauuuuccagcagaucucuccugucgugggcgacaaacaacccacaauccugaaguggcggauucuuuccgcuaccaaugaucuggacagaguuagcgcgguggcccucccgaaacugccuaucucccuuacaaacaccgaucugaaggucgcuucugacacccaguuuuaccccgggcucggacuggcccuggccuuccaugauggcagcgugcacauuguccaccgccucucccugcagacaauggcuguguuuuauucuagcgccgcgccuagacccguugacgaacccgcuaugaaacggccuagaacggccgggccggccgugcaucuuaaggcuaugcagcuguccuggaccagccucgcccuggucggaaucgauucucacggcaaacuguccgugcuucgccucagccccucuauggggcauccucuggagguuggacuggcucuccggcaccuucuuuuccugcucgaguacugcauggugacaggcuaugacuggugggacauucugcugcauguccaacccuccauggugcagagccuuguggaaaagcuccacgaggaauacaccagacagacagccgcgcugcaacagguucugucuacccgcauccucgccaugaaggcuagccuguguaaacuuuccccuugcacggucacacgggugugugauuaucacaccaagcuguuccucaucgccauuagcucuacccugaaaucccugcuuagaccccauuuucucaauacaccggacaagagcccuggcgaucgccugaccgagaucugcacaaaaauuacggacguggauaucgacaaggucaugauuaaccugaagaccgaagaguucgugcucgauaugaauacacugcaggcucugcagcaacugcuccaguggguuggggacuuugugcuguaccugcuugccucccuccccaaccagggaucucugcugcggccuggccacagcuuccucagagaugggaccucccugggaaugcuucgcgagcugauggucgugauccggaucuggggccuccugaaacccucuugucugccuguuuacacagcgaccagcgacacgcaggauuccaugucucuucuguuuagacuccugaccaagcucuggauuugcugucgcgacgaagggcccgccagcgagccggaugaagcucugguggacgagugcugucuucugccuucccaacuccugauccccagccuggacuggcuucccgccucugauggccuggucucccggcuccagccuaaacagccgcugagacuccaguucggacgggcucccacacugccuggcagcgccgccacccuucaacuggacgggcucgcucgcgcgcccggacagccuaagauugaucaucugagacggcugcaccuuggcgccugccccacagaagaguguaaggcuugcaccagaugcgggugugugacgaugcugaaaucuccuaaucgcacaaccgccguuaagcagugggagcagcgguggaucaaaaacugccucgccguggaaggaagaggccccgacgcuugugucacaucccgcgccagcgaggaagcgccggcuuuugugcaacuggggccucagucuacccaccauucccccagaaccccucggagccucgaucaucugcaccccgaggaccgcccguga

SEQ ID NO: 71994 - RNA, 1956 nt, Artificial Sequence
  derived and/or modified sequence opt5 from MED17__Homo_sapiens__NP_004259
augagcggcgugagagccguccggaucuccauugagucugcuugcgaaaagcagguucacgagguggggcuggacggaaccgaaacauaccugcccccucugagcaugucccaaaaccuugcccgccuggcgcagagaaucgauuucucucagggcagcggguccgaggaagaggaggcugccggaacggaaggcgacgcccaggaguggccgggggcuggaucuagcgccgaucaagacgaugaagagggcguggucaaauuucagcccucccucuggccuugggacagcgugcggaauaaccugcgcucugcucuuaccgagauguguguucuguaugaugugcucuccauugucagagacaagaaauucaugacacuggaucccgugagccaggacgcccugccucccaagcagaauccucaaacccuccagcugaucucuaaaaagaagucccuugcgggcgccgcucagauucugcucaaaggggccgaacggcugacaaagagcguuaccgagaaccaggaaaauaaacuucaacgcgauuuuaacucugagcugcucagacugcggcagcauuggaagcugcgcaaagugggagacaagauccucggcgaucuguccuacagaagcgcugggucccuuuucccgcaccauggaacauuugaagucaucaagaauaccgaccuggaccucgauaaaaagauucccgaggacuauugcccucuggaugugcagauccccucugaccuugagggcagcgccuacauuaaaguguccauccaaaagcaggcgccugauauuggggaccugggaacggucaaccucuucaaacggccccugccgaaaagcaaaccuggcucuccccacuggcagaccaagcuggaagccgcucagaauguucuccuguguaaggagaucuuugcccaacuuucccgcgaagcugugcagauuaaaagccaggugccucauaucgucgugaagaaccagaucauuucucaacccuuccccagccugcagcucuccaucucucugugccacagcuccaaugauaaaaagagccagaaauuugccacagagaagcaguguccugaagaccaccuuuauguucuggagcauaaccuccaccuccugauuagagaguuccauaagcaaacccucucuuccaucaugaugccgcaccccgccagcgcuccuuuuggccacaaacggaugcgccugucugggccccaggcguucgauaagaaugaaauuaacucccuucagagcuccgagggacugcucgaaaagaucaucaagcaggccaaacauauuuuucugagaucucgggcugccgccacaaucgacagccuggcuuccagaauugaggauccucaaauccaggcccacuggucuaauauuaacgacguguacgaaagcuccgucaaggugcuuaucaccagccagggcuaugagcaaaucugcaagucuauucagcuccagcugaacaucgggguugagcagauucgcgugguccaucgggacggaagagugaucacgcuguccuaccaagaacaggagcuccaggauuuccugcuuagccagaugucucaacaccagguccaugcggugcagcagcuggcuaaaguuaugggcuggcaagugcucuccuucagcaaucacgucgggcugggacccauugaaucuaucggcaacgccagcgccauuacaguggcuuccccgagcggcgacuacgccaucucuguucgcaaugggccugaguccggaagcaagaucauggugcaguuuccccggaaccaguguaaagaucugccuaaguccgacguccuucaagauaauaaauggucucaccucagaggccccuucaaggaggugcaguggaacaagauggaagggcgcaauuuuguguauaaaauggagcugcugaugagcgcucucuccccuugccugcuuuga

SEQ ID NO: 71995 - RNA, 636 nt, Artificial Sequence
  derived and/or modified sequence opt5 from MED19__Homo_sapiens__NP_703151
augaagaucaccaacggcagacacggggacagcgccggagcugagggcacaauggaaaauuucacggcccuguuuggggcgcaggcugaucccccuccgcccccuaccgcccucggauucggccccgggaaaccucccccuccgcccccucccccugccggaggcggccccgggacagcuccgccucccaccgccgcuacagccccucccggagcggacaaguccggcgccgggugcggacccuuuuaccugaugcgggagcuuccuggcucuaccgaacugacagggagcaccaaccucauuacgcauuauaaucuggagcaggcuuacaacaaauucuguggaaagaaagugaaggaaaaacuuuccaauuuucugccggaucuccccggcaugaucgaccugccuggcucucacgauaacagcucccugcgcucucucauugagaagcccccuauccugagcuccagcuucaaucccauuaccgggacaaugcuugccggauuuagacugcauaccggcccgcucccugagcaaugccggcugaugcacauccagcccccuaagaaaaagaacaaacauaagcacaagcagucucgcacacaagaccccgucccucccgggaaaccguccuga

SEQ ID NO: 71996 - RNA, 4746 nt, Artificial Sequence
  derived and/or modified sequence opt5 from MED1__Homo_sapiens__NP_004765
augaaggcccagggcgagaccgaagagagcgaaaaacuguccaagaugucuagccuccuggagagacuucacgcuaaauucaaccaaaaucggcccugguccgaaacaaucaagcuggugcgccaggucauggagaaaagaguugugaugucuagcgggggacaucagcaccucguguccugccuggagacgcuucagaaggcccugaaggucaccucucucccugcgaugacagaccggcuggaaagcauugcucgccaaaacggccuggggucccaucucagcgccucuggaaccgaguguuacaucacauccgauauguuuuauguggaaguucagcuggacccggccggccagcuuugcgaugugaaagucgcucaccauggggagaaucccgugagcuguccugagcugguucagcaacucagagaaaagaacuucgacgaguuuucuaaacaccugaagggacuugugaaucuguacaaccuccccggcgauaauaaacugaagaccaagauguaucuggcccuccagucccuggaacaggaccuuagcaaaauggcuauuauguacuggaaggccacaaacgcgggcccucuggauaaaauccuccacgggucugucggauaucugaccccucgguccggcgggcaucuuaugaaucugaaguacuaugugagccccuccgaccuccuggaugacaaaacggccucuccgauuauccugcacgagaacaaugugagccgcucccucggaaugaacgcuagcgucaccaucgaaggcacaucugccguuuacaagcugcccauugcuccucuuaucauggggucccaucccguggauaauaaauggaccccuagcuucucuagcauuacauccgccaacucuguggaccugcccgcgugcuuuuuccucaaguuuccgcagccuauccccgucagcagagccuucgugcaaaagcugcagaauuguaccggcauuccucuuuuugagacgcagcccacauacgcuccccuguaugagcucaucacccaauucgaacuguccaaagauccugacccgauuccccugaaccacaacaugcgguuuuacgccgcucucccuggacagcagcacugcuauuuccugaauaaggacgcuccccuuccugauggccgcagccugcaggggacacucguuucuaaaaucaccuuucaacaucccggaagagugccgcugauccugaaccuuauucggcaccaggucgccuacaauacccucaucggcuccugugugaagcgcacaauucugaaagaggacagcccugggcugcuccaguucgaaguuugcccccugucugaguccagauucagcguguccuuucagcauccugucaacgauucucuugugugugucgugauggacguucaagauagcacgcacguguccugcaagcuguauaagggacucucugacgcccugaucuguaccgaugacuucauugcgaaagucgugcagcggugcaugagcauccccguuacaaugcgcgccaucagacggaaggcugaaaccauucaggccgauaccccugcccugucccuuaucgcugagaccguggaggacauggucaaaaagaaucugcccccggccagcucuccuggcuacgggaugacgacaggaaacaaucccauguccggcaccaccacacccaccaacacauuuccuggcgggccgauuacgacccuguucaauaugagcaugucuaucaaagauagacaugaauccgugggacacggcgaggacuuuagcaaggugucucagaaccccauucugacaagccuccugcaaaucaccgggaauggaggcuccacaaucgggagcucuccuacacccccucaccauacgcccccucccguuuccagcauggcgggcaacaccaagaaucacccgaugcuuaugaaccugcucaaagacaauccugcucaggauuucuccacacuguauggaucuagcccccuggaacgccagaacuccucuagcggcuccccucggauggagauuugcucugggagcaacaagaccaaaaagaaaaaguccagcagacuucccccggaaaagccuaaacaucagacagaggacgauuuucaacgcgaacucuucucuauggacgucgauucccagaaucccaucuuugacgugaacaugaccgccgauacgcuggacacaccucacauuacccccgcccccagccaguguucuacaccuccgaccaccuacccccaaccugugccccacccucagcccuccauccagcggauggucagacugucuagcuccgauagcauuggaccugacgugacagauauccucuccgacauugcugaggaggccagcaagcugccgucuacgagcgaugacugccccgcuaucggcaccccucuucgcgacuccucuagcuccgggcauucucagagcacacuguucgauuccgacguuuuucaaaccaauaacaaugaaaaccccuacacagauccugccgaccucaucgcggaugccgcuggaucucccagcuccgacagcccgaccaaucacuucuuucaugauggcguggacuucaacccugaucugcucaauucucagucccagagcggguucggcgaggaguauuuugacgaaucuucccagagcggagauaacgacgauuucaaaggcuuugccucccaagcucuuaauacgcucgggguccccaugcugggaggcgacaacggggagacaaaguucaaaggaaauaaccaggccgacaccguggauuuuucuauuaucagcguugcgggcaaggcccuggcucccgccgaccucauggaacaccauuccgggagccagggcccucugcuuaccacaggagaucugggcaaagagaagacccagaagcgggugaaagaagggaauggaacaucuaacuccacgcucagcggccccgggcuggacucuaagccuggaaaaagaagccgcaccccguccaacgauggcaagucuaaagacaagcccccuaagcggaaaaaggcugauacagaggggaaaagccccucccacucuagcuccaauagaccuuucacacccccgaccagcaccggcggaucuaaguccccuggcagcgccgggcgcucccaaacgcccccuggagucgccacacccccuauucccaaaaucaccauucagaucccgaagggcaccgugaugguugggaagccuucuagccacucccaguacacaucuagcggauccgugucuagcuccggcagcaaaucucaucacucccauagcucuagcuccucuagcuccgcuagcaccuccggcaagaugaaaucuagcaaguccgaggggucuagcuccucuaaacugagcuccagcauguauucuucccaaggaagcucuggcuccagccagucuaagaacuccagccaguccgggggaaagcccggcagcucucccaucacaaaacacgggcuuagcuccggaucuagcuccaccaagaugaaaccucagggcaagccgucuagccugaugaaucccucccucucuaaaccuaacauuagccccucccauagccggccucccggcgggucugacaagcuggcguccccuaugaaaccgguccccggaacgccucccagcucuaaggccaaguccccuaucagcuccggcucugggggaagccacauguccggcacaucuagcuccagcgggaugaaaucuagcuccggacucggcucuagcggcucccugucucaaaagacacccccgagcuccaauagcuguaccgcuucuuccagcuccuuuucuagcuccgggucuagcauguccagcucucagaaccagcacggauccagcaaaggcaagucuccuuccagaaauaaaaagcccagccuuaccgccgugauugauaagcugaaacaugggguggucaccucuggacccggcggggaagacccucucgauggacagaugggcguuuccacgaacagcucuagccaccccauguccagcaagcauaauauguccggcggggaguuccaaggaaaacgggaaaagucugacaaagacaagagcaagguguccacaucuggcagcuccguggauucuagcaaaaagaccuccgagagcaaaaacgucgggucuacaggaguggccaagaucauuaucuccaaacacgacggcgggagcccuucuaucaaggcuaagguuacccugcagaaaccgggagaauccagcggcgagggccugcgcccccagauggccucuuccaagaauuacgggagcccucuuauuucuggauccacacccaaacacgagagaggcagcccuagccauuccaagucucccgcguauaccccgcagaaccuggauagcgaauccgagucugggagcuccaucgcugaaaaaucuuaccaaaauagcccuuccagcgacgauggcauucggccccucccugaguauucuacggaaaagcacaagaaacauaagaaagagaagaaaaaggugaaagacaaggauagagaccgcgaucgggacaaggauagagacaaaaagaaaucccacagcaucaagcccgagucuugguccaaaagcccuauuuccucugaucagagccuguccaugaccucuaacacaauccucagcgccgaccgccccuccagacugagcccggacuuuaugaucggagaagaggaugacgaucuuauggacgucgcccugauugggaauuga

SEQ ID NO: 71997 - RNA, 603 nt, Artificial Sequence
  derived and/or modified sequence opt5 from MED22__Homo_sapiens__NP_598395
auggcccagcaaagagcucugccccagagcaaggagacccuccugcaguccuacaacaaacggcuuaaggacgauaucaaaucuauuauggacaauuucacagaaaucauuaagacggccaaaaucgaggaugaaacccaggugagccgcgcgacacaaggcgagcaggacaacuaugaaaugcacgucagagcugccaauauuguucgggccggggagucccugaugaagcucgugucugaucugaagcaguuucuuauccugaacgacuucccuagcgugaaugaggcuaucgaucagcgcaaccaacagcucagaacccugcaggaagagugcgaccggaaacugauuacacuccgcgaugaaaucuccauugaccuguacgagcuugaggaagaguauuacucuagcuccagcucucugugugaagccaaugaucucccgcugugcgaggcuuauggaagacuugaccuggauaccgacuccgccgacggccucagcgcgccccugcuggccucuccugaacccuccgcugggccucuccaggucgccgcucccgcccauagccacgcgggaggcccugggccgacagagcaugccuga

SEQ ID NO: 71998 - RNA, 4095 nt, Artificial Sequence
  derived and/or modified sequence opt5 from MED23__Homo_sapiens__NP_001257451
auggagacccagcugcaaagcaucuucgaagagguggucaagacagaaguuauugaggaagccuuucccggcauguucauggacacgccugaggaugagaaaaccaagcucaucuccugccugggggcuuuuagacaguucuggggaggccuuucucaggaaagccacgagcaguguauucaauggaucgugaaauuuauucaugggcagcacuccccgaagcggaucucuuuccuguacgacugccucgccauggcgguggaaacaggacugcuucccccucgccuggucugugagagccucaucaacuccgauacccuggagugggaaagaacacagcugugggcucucaccuuuaaacuggugcggaagauuaucggcgggguugacuauaagggagugcgcgaucuucugaaagucauucucgagaagauccugacaauucccaauaccgugucuagcgccguugugcagcaacuucuggccgcuagagaagucaucgccuacauucucgagcggaacgcuugccugcugccugccuauuucgcggugacggaaauccgcaaacucuaccccgagggcaagcugccucauuggcuucugggcaaucucguguccgacuuugucgauaccuucagaccgacagcccggaucaacagcauuugugggcgcugcucucugcuucccguugugaauaacuccggagcuaucuguaauagcuggaaacuggacccugccacccucagauuuccccugaagggccugcucccuuaugauaaggaccuguucgagccccagacagcucugcugcgguacgugcucgaacagccguauucucgcgauauggucugcaacaugcuggggcuuaauaaacagcacaagcaaagauguccugugcuggaggaccagcucguugaucugguggucuacgccauggaacgguccgagaccgaagagaaauuugacgacggaggcacgagccagcugcucuggcaacaucugucuucccagcuuauuuucuucgugcuguuucaguucgcgagcuuuccccacaugguucucucccugcaccagaagcuggccgggcgcggacuuaucaaaggcagagaucaucucaugugggugcugcugcaauucauuucuggcagcauccagaagaacgcucucgccgacuuucugccugucaugaaacuuuucgaucugcucuaccccgagaaggaauauauccccgugccugacauuaauaagccgcaguccacacacgcuuuugccaugaccugcaucuggauucaucugaaccggaaagcccagaaugauaacagcaagcugcaaauccccauuccucacucucuuagacuccaccaugaguuccugcagcagucccugcgcaauaaaagccuccagaugaacgacuacaagaucgcucugcuuuguaacgcguauucuacaaauagcgaaugcuuuacccugcccaugggggcccucgucgagaccaucuacggaaacggcauuaugcggaucccucugcccgggacaaauugcauggcuuccggaucuauuacgccgcugccuaugaaccuucucgauagccugaccgugcacgccaaaaugucccugauccauagcauugccacaagaguuaucaagcucgcucacgccaagucuuccguggcgcuggcucccgcccuugucgaaaccuauagccgccugcucguguacauggagauugagucucugggcaucaaaggguucaucucccaacugcuuccuacaguuuuuaagagccaugccugggggauucuccacacccugcuggaaauguucuccuaucggaugcaccauauccagccccacuacagagugcagcuccugucucaucuucacacgcuggcugccgucgcucagacaaaucaaaaccagcuccaccuguguguggagagcaccgcccugcgccuuauuaccgcgcugggcuccucugaagugcagccucaauuuacacgguuccucagcgaccccaaaaccguucuguccgccgagagcgaggaacucaauagagcucugauccuuacacuggcccgcgcuacgcaugucaccgauuucuuuacaggcucugacuccauucaggggaccuggugcaaggauauccuccagacaaucaugagcuucaccccgcacaacugggccucucauacgcuguccuguuuuccuggaccccugcaggcguucuuuaaacaaaauaacgugccccaggagagccgguucaaucuuaagaagaacguggaagaggaauacagaaaauggaagucuaugagcaaugagaacgacauuaucacccacuuuuccaugcagggcagcccuccgcuguuccucugccugcucuggaaaaugcugcuugagacagaccauauuaaucagaucggguaucgcguccuggaacggauuggagccagagcucucguggcccacguucggaccuuugcugauuuccugguguacgaguuuucuacauccgccggcgggcaacagcugaacaaguguaucgaaauccuuaacgacauggucuggaaauauaauauugugacccuggaucgccucauccugugccucgccaugagaagccacgagggcaacgaagcucagguuuguuacuucauuauccagcugcuucugcugaagcccaaugacuuucggaacagaguguccgauuucgucaaggaaaauucuccugagcauuggcuccaaaacgacuggcacacgaaacauaugaauuaucacaagaaauaccccgagaagcuguauuucgagggacuugcggaacagguggauccucccguucagauucaaagcccuuaccugcccaucuacuuuggcaacgugugccuccgcuuccugccggucuuugacaucgugauucaucgguuccucgagcugcuuccuguguccaaaucucuggaaacacugcucgaucaccugggaggacuuuauaaguuucacgacagacccgucaccuaccuguauaauacacuccauuacuaugagaugcaccuucgcgauagagccuuccucaaacggaagcugguucaugcuaucauuggcagccuuaaggacaaccgcccucagggguggugucuguccgauaccuaccugaaaugcgccaugaaugccagagaggaaaaccccugggugccggacgacaccuauuacugucggcucaucggacgccugguggauacaauggcuggcaagucuccugggcccuuuccuaauugcgacuggagauucaacgaguuucccaaucccgccgcgcacgcccuucacgucacgugcguggaacugauggcucucgccguuagcggcaaagaggugggaaacgcucugcucaacgucgugcugaagucccagccucuuguuccgcgggagaauauuaccgccuggaugaacgcgaucggccugauuaucacagcucugcccgaaccuuacuggaucgugcuccaugaucgcauugucagcgugaucucuucccccagccugaccucugagacagaauggguuggguauccuuucagacuuuuugacuucaccgccugucaccaguccuacagcgagaugucuugcuccuauacgcuggcccucgcucaugccguguggcaccauagcuccauuggacaacugagccugauccccaaauuccucacagaaguccuucugccuauugugaagaccgaguuucagcugcucuacguguaucaccuggucggcccguuccuucagcgguuucagcaagagcgcaccagauguaugaucgaaaucgggguugcuuucuacgauaugcugcucaauguggaccagugcucuacacaccugaacuauauggaucccauuugugacuuucuguaccauaugaaguacauguucaccggagauagcgugaaagagcaggucgaaaagaucauuugcaaucucaaaccugcccuuaagcugcggcugagauuuaucacacacauuuccaaaauggagcccgcggccgugccuccccaggcuaugaacucuggcagcccggccccucaauccaaucagguugacacgcucaccuga

SEQ ID NO: 71999 - RNA, 2931 nt, Artificial Sequence
  derived and/or modified sequence opt5 from MED24__Homo_sapiens__NP_001072986
augaagguggucaaccugaaacaggccauccuccaggcuuggaaggagagauggagcgacuaccagugggccauuaauaugaaaaaguucuuucccaaaggcgcgaccugggauauccugaaccuugcugacgcccugcucgaacaggccaugauugggccuuccccgaauccccugauccuuucuuaucugaaguacgcuauuagcucccaguucgaugacuuuucucgggaucucugcguucaagcccugcuggacaucauggauauguucugugaccgccucagcugccacggaaaggcugaggaauguaucggccugugcagagcccuucuguccgcgcuccauuggcugcuucgguguacagccgcuucugccgagcgccugagagaagggcucgaggcuggaacgccugccgcgggcgagaaacagcuggccaugugccugcagcggcucgaaaagacccugagcuccacaaagaaccgcgcccuucugcacauugcuaagcucgaggaagcuagcucuuggaccgccaucgagcauucccugcuuaaacugggggagauucucgccaaucugagcaacccccagcugagaucucaagcugaacaguguggaacacucauccgguccauuccuaccaugcugagcgugcacgcggagcagaugcauaagacaggcuuucccaccgugcacgccgucauccuucuggaaggcacgaugaaucucaccggggagacacagucucugguggaacaacuuaccaugguuaagcgcaugcagcacauuccuacaccgcuguucgugcucgagaucuggaaggcuugcuuugucggacugaucgagucccccgaaggcaccgaggaacugaaguggacggccuucacauuucucaaaauuccucaggugcugguuaaacuuaaaaaguauagccauggggauaaagacuucaccgaggaugugaacugugccuuugaguuccugcucaagcugacaccccugcuugacaaggcugaucaaagaugcaauugugacugcaccaacuuucuccugcaggaaugcggaaaacagggccugcucuccgaggccucugucaauaaccugauggcgaagcggaaagcugaccgcgaacacgccccucagcaaaagagcggggagaaugccaacauccagcccaauauucagcuuauccugagagcugaaccgaccgugacaaacauucucaaaacgauggaugccgaccauuccaagagcccugagggacugcugggcgugcuuggccacaugcucucugggaagucccuggaucugcuccuggcugccgcggccgcuaccggaaaacuuaagagcuucgcccggaaauucaucaaccugaaugaauuuacaaccuacggcucugaggagagcacaaagcccgcuuccguccgcgcccuccuguucgacaucucuuuucugaugcuuugucacguugcgcagaccuaugggagcgaagugauucucuccgagagcagaacgggagccgaagugccuuucuuugagacauggaugcaaaccugcaugcccgaggaaggcaaaauccugaaccccgaucauccuuguuuccggccggacucuaccaaggucgagucccugguggcucuccugaauaacagcucugaaaugaaacuuguucagaugaaauggcacgaggccugccuguccauuagcgcugccauccucgaaauucugaaugccugggagaacggggugcuggcuuuugaguccauccagaagaucacagauaauauuaaaggaaaggucuguucucuugcggugugcgccguugcuuggcucguggcccaugucagaaugcugggccuggacgaacgcgagaaaagccuccagaugauccggcaacuggccggcccccuuuucuccgaaaacacccugcaguuuuacaaugagagaguggucauuaugaacucuauccucgaacgcaugugugcugaugugcugcagcagacagccacgcaaauuaaguucccuagcaccgggguugacacaaugcccuauuggaaucugcuuccucccaagcggccgaucaaagaggugcugaccgauauuuuugcgaagguccucgagaaaggauggguggacuccagaagcauccacaucuucgacacacugcuccauaugggcgggguuuacugguuuugcaacaaucugauuaaggaacuucugaaagagacccgcaaggaacacacgcuccgggcuguggagcugcuguacucuaucuucugucuugauaugcagcaggucacccuggugcuccugggacacauucucccuggccugcuuacagacuccagcaaauggcauucucugauggaucccccugggaccgcccucgccaagcuggcuguguggugcgcccuguccagcuauucuagccacaagggccaagcguccacaagacagaaaaagcgccaucgggaagacaucgaggauuacauuagccuuuucccccuggacgauguucagccuucuaaacucaugagacugcucuccagcaacgaggacgaugcuaauauccuguccucucccaccgaccgcagcauguccucuagccuuuccgccucucagcugcacacggucaacaugcgggauccgcugaacagagugcucgccaaucuguuucuucugaucagcuccauucucggaagccggacagcuggcccucacacccaauucgugcagugguuuauggaagagugugucgacugccuggaacaagggggacgcggcucugugcuccaguucaugcccuuuacaaccguuuccgagcuggugaaggucagcgccaugucuucccccaaagugguucuugcuaucaccgaucugagccugccucucgggagacaaguggccgcgaaggccauugcugcccuguga

SEQ ID NO: 72000 - RNA, 2244 nt, Artificial Sequence
  derived and/or modified sequence opt5 from MED25__Homo_sapiens__NP_112235
auggugcccggcagcgaggggccugccagagccggauccgucguugccgacgugguguucgucaucgaaggcaccgcgaaccuggggccguacuuugagggacuccggaagcacuaucugcuucccgcuauugaauacuucaauggcgggccucccgccgagacagauuuuggaggcgacuauggcgggacgcaguacucucuggugguuuucaacaccguggauugcgccccugaaagcuauguccaaugucaugcucccacauccucugccuacgaguuugugaccuggcucgacggaaucaaauucaugggcgggggaggcgagagcugcucccugauugcugaagggcuuucuacagcccugcagcucuuugaugacuucaagaaaaugcgcgagcagaucggacagacccacagaguuugucugcugauuugcaauagcccuccguaucuccugcccgcgguggaauccacaaccuacagcggcuguacgaccgagaaccuuguccaacagaucggcgagcgggggauccauuuuucuauuguguccccucgcaagcugcccgcccucagacugcuuuucgaaaaagcugccccucccgcucugcucgagccgcugcagccucccacagaugugagccaggacccucggcacaugguccugguucgcggacucgugcugcccgugggcgggggaucugcccccggcccucuucaauccaagcagccggucccccugccucccgcggccccuagcggggcuacccucucugccgcuccccagcagccgcugccucccgugccuccccaauaccagguuccuggaaaucuuuccgccgcccagguggcugcgcaaaacgccgucgaagcugccaagaaucagaaagccggccugggccccagauuuagcccgaucacaccucuccagcaggcugcccccggggugggacccccuuucucccaagcgccggcuccccagcugccucccggcccucccggggccccuaagcccccgccugccucucagcccagccugguuuccaccguggcuccuggaagcggccucgcccccacggcucagccgggggccccuucuauggcgggcacagucgcccccggaggcguguccgggccuagccccgcucaacugggagcccccgcucuuggcgggcagcagucugucagcaacaaacugcucgccugguccggagugcuggaguggcaggaaaagccuaaaccggcgucuguugaugccaauaccaagcugacacggagccugcccugccaaguguaugucaaccauggcgagaaucucaagaccgagcaguggccucagaaacugauuaugcagcugaucccccaacagcuccugaccacacuugggccucuguuucgcaacuccagaauggugcaguuccacuucacgaauaaggaccucgaaagccugaaaggccuguaccggauuaugggaaacggcuuugcuggguguguucacuucccccauaccgccccuugcgaggugcgcguccuuaugcuccuguauucuuccaagaaaaagaucuuuaugggacugauuccguacgaucaaagcggcuucgugaaugggaucagacaggugaucacaaaccacaaacagguucagcaacagaagcucgaacagcagcaacggggaaugggcgggcagcaggcucccccuggccugggacccauucuugaggaccaggcccgcccuucucaaaaccugcuccagcugagacccccgcagccucaaccccagggcaccgucggggccuccggagcuacaggccagccccagccucaagggaccgcgcagcccccuccgggagcuccccagggcccucccggggccgccagcggcccucccccgccuggacccauccugcggccucagaaucccggcgccaacccucaacuuagaucccuccugcugaaucccccgccuccccagacgggggugcccccuccgcaggcuucucuccaucaccuucagcccccuggagcccccgcgcuucugccucccccucaccaaggccucgggcagccgcagcugggacccccucugcuucaucccccucccgcucagagcuggccggcccaacucccuccccgcgcuccccugccuggccagaugcugcucuccggcgggccccggggaccugugccgcagcccggccugcaaccuucugucauggaagaugacauucuuauggaccugaucuga

SEQ ID NO: 72001 - RNA, 537 nt, Artificial Sequence
  derived and/or modified sequence opt5 from MED28__Homo_sapiens__NP_079481
auggccgcuccccugggcgggauguucagcggacagccuccggggcccccucaagcgcccccuggccuccccggacaggccucccugcuucaggcugccccuggcgccccgagacccucuagcuccacccugguggacgagcucgaaucuagcuuugaggcuugcuucgccucccuggucucucaggauuacguuaacgggacagaccaagaagagauccggacgggaguggaucaguguauucagaaguuucuugacaucgcucgccagaccgaaugcuucuuucugcagaaaagacuccaacugagcgugcagaagccugagcaggucauuaaagaggauguguccgaacugcggaaugagcuccaacgcaaggacgcccugguucagaaacaccuuacaaagcugagacauuggcagcaagugcucgaagauaucaacguccagcacaagaaacccgcggacauuccucagggcagccuggccuaucuugagcaggcuucugccaauauccccgcuccgcugaagccuaccuga

SEQ ID NO: 72002 - RNA, 666 nt, Artificial Sequence
  derived and/or modified sequence opt5 from MED29__Homo_sapiens__NP_060062
augcucaagagcaacggcgagagacggucccgcaaugcccugcccgcuguguacgccagaaaaauggcggcuucucagcaacaggccagcgccgcuuccucugccgcuggggucagcggaccuuccucugccggcgggccgggaccccagcagcaaccucagcccccugcgcagcugguuggccccgcccagagcgggcuucugcaacagcagcagcaagacuucgauccugugcagcgguauaagaugcucaucccgcagcugaaagaaucccuucaaacccugaugaagguggcugcccagaaccucauucagaauacaaacaucgacaauggacagaaaagcucugauggccccauucaacgcuuugacaagugccuggaggaguucuacgcucugugugaucagcucgaacugugccuuagacuggcccacgaaugucucucccagagcugcgacucugcgaagcauuccccuacgcugguccccaccgccacaaaaccugaugcugugcagcccgacagccuuccguauccucaauaccuggccguuaucaaggcucagauuucuugugccaaagauauccacaccgcccuccuggacugcgcuaacaaggugacaggcaaaacccccgcgccucccgccgggcccggaggcacacuguga

SEQ ID NO: 72003 - RNA, 537 nt, Artificial Sequence
  derived and/or modified sequence opt5 from MED30__Homo_sapiens__NP_542382
augagcacacccccucuggccgcuuccggcauggccccggggcccuucgcgggaccucaggcucaacaggccgccagagaggugaacaccgcuucucucugccggaucggccaggaaacgguccaggacauuguuuaccgcaccauggagaucuuucaacugcuuagaaauaugcagcugcccaacggggugacauaucacaccggaacauaccaggaucggcucaccaagcugcaggacaaucuucgccaacugagcguccucuucagaaaacugcggcugguguaugauaaguguaacgaaaauugcggcgggauggacccuauucccguggagcagcucaucccuuacguugaagaggauggauccaaaaacgacgaucgcgccggcccgcccagauuugcuucugaggaacggcgcgagauugccgaagugaauaagaaacugaagcagaagaaccagcaacuuaaacagaucauggaccagcugagaaaucucaucugggauauuaacgcgaugcuggccaugcggaauuga

SEQ ID NO: 72004 - RNA, 675 nt, Artificial Sequence
  derived and/or modified sequence opt5 from MED4__Homo_sapiens__NP_001257558
augcuggccaucagcagaaaccagaagcuccugcaagcuggcgaggaaaaucaggugcuugagcugcucauucaccgggacggggaguuccaggaacugaugaaacuugcccugaaccagggaaagauccaucacgaaaugcaaguccucgagaaagagguugaaaagcgcgauuccgacauucagcagcugcagaaacaacugaaggaggcggaacagauccucgcuaccgccguguaccaggccaaggagaaacugaagucuauugagaaagcuagaaagggcgccaucagcuccgaagagaucauuaaauaugcucaucggaucucugccagcaaugcggugugcgcuccccuuacaugggucccuggggauccgcgcagacccuacccuacggaccuggaaaugcgguccggacuccugggccagaugaacaaucccucuaccaacggggugaauggacaccuuccuggcgaugcccuggccgcuggccgccuccccgacguucuggccccucaauauccguggcagagcaacgauauguccaugaauaugcugcccccuaaccauagcucugacuuucuccuggagcccccugggcacaauaaggaaaacgaggaugacguggagauuauguccacagauagcagcuccucuucuuccgaaagcgacuga

SEQ ID NO: 72005 - RNA, 762 nt, Artificial Sequence
  derived and/or modified sequence opt5 from MED6__Homo_sapiens__NP_001271138
auggccgcuguggacaucagagauaaccugcucggcauuagcugggucgacuccucuuggauccccauucugaauagcggguccguucuugauuacuucucugagcggagcaacccuuuuuaugaccgcacaugcaauaacgaaguggugaagaugcagagacugacacucgagcaccugaaucaaauggucggaaucgaauacauucuucugcaugcccaggagccgauccucuucaucauucggaaacagcagcgccaaucccccgcucaggugaucccucuggcggauuauuacauuaucgccggcguuauuuaucaggcccccgaccuggggucugugaucaacagcagagucucccucuuuagcuucuacaagcugacggcugugcacggcauucagucugccuuugaugaagcuauguccuauugucgguaccauccuagcaaaggauacugguggcacuucaaggaccaugaggagcaagauaaaguucgccccaaggccaagagaaaagaggaaccuucuuccaucuuucagcggcagcgcguggacgcgcuucugcucgaucugagacagaaguucccgcccaaauuuguccaacuuaagccuggggaaaaacccgugccuguggaccagaccaagaaggaggccgagcccaucccggaaacagucaaaccugaggaaaaggagaccaccaaaaauguucagcaaaccgugagcgcuaagggacccccugaaaaacggaugcgccugcaguga

SEQ ID NO: 72006 - RNA, 441 nt, Artificial Sequence
  derived and/or modified sequence opt5 from MED9__Homo_sapiens__NP_060489
auggccagcgcuggaguggccgcggggagacaggcugaggacguccugcccccuaccuccgaucaaccgcuccccgacacaaagccucugcccccuccccagccuccgcccguuccugcuccccagccucagcaaucucccgccccgcggccucagagccccgcccgcgccagagaagaggaaaacuacuccuuccuuccucuggugcacaauaucauuaaaugcauggauaaggacucucccgaggugcaucaggaucucaacgcucugaaaagcaaguuucaggaaaugcggaaacuuaucuccacgaugcccggcauucaccugucuccugagcaacagcagcagcaacuccagagccugcgcgagcaggucagaaccaagaaugaacugcuccaaaaguauaaaucccuguguauguucgagaucccgaaggaauga

SEQ ID NO: 72007 - RNA, 1500 nt, Artificial Sequence
  derived and/or modified sequence opt5 from MEF2A__Homo_sapiens__NP_005578
augggcagaaagaaaauccagauuacccggaucauggacgagcgcaacagacaagugacauucacgaagcggaaauuugggcugaugaagaaagccuacgaacucagcguccugugcgauugugagauugcucuuaucauuuucaauuccucuaacaagcuguuucaguaugccagcaccgacauggauaagguucuccugaaauacacagaauauaaugagccccacgaaucccgcaccaacucugacaucguggaggcgcuuaauaagaaagagcauagaggaugcgauagcccugacccggauacauccuacgugcugacaccccacaccgaagagaaguauaaaaagaucaacgaagaguucgacaauaugaugcggaaccauaagauugcuccuggccugcccccucagaauuuuucuaugagcgucaccgugcccguuacguccccuaacgcccucagcuacaccaauccggggucuucccuggugagccccucucucgccgcuuccagcacacugaccgauucuuccaugcuuagcccuccccagacaacccugcaccgcaacgucuccccuggagcuccccaaagaccgccuucuacgggcaaugccgggggaaugcucagcacaaccgaccugacagugcccaacggcgccggcuccagcccuguugggaauggauucgugaacucucgggcgucccccaaccuuaucggcgccaccggggcuaauagccugggaaaagucaugcccaccaagucuccuccgcccccuggcgggggaaaccucggcaugaauagccgcaaacccgaucugagaguggugauuccucccuccucuaagggcaugaugccgccucugaacacacagcggaucagcuccagccaggccacgcagccccucgcuaccccugucguuucugugacaacccccucccugccuccccaagggcuuguguauagcgccaugccgacagcguacaauaccgacuacucucugacguccgccgaucucagcgcucugcagggauuuaacuccccuggcaugcuuucucuggggcaggucagcgccuggcagcaacaucaccucggacaggcugcccuguccucucugguggccggcgggcagcucagccaaggauccaaucugagcauuaacacaaaucagaacaucucuauuaaauccgagcccaucucucccccucgcgacagaaugaccccgucuggcuuccagcagcaacagcagcagcaacagcagcagcaacccccucccccuccccagccucagccccagccgccucaaccccagccucggcaggaaaugggccgcucccccguugacagccuuucuagcuccagcagcuccuaugaugggagcgacagagaggauccgcggggagacuuucacuccccuaucgugcugggcagacccccuaauaccgaagaucgcgagucucccagcgucaagcggaugagaauggacgcuugggugacauga

SEQ ID NO: 72008 - RNA, 1107 nt, Artificial Sequence
  derived and/or modified sequence opt5 from MEF2B__Homo_sapiens__NP_001139257
augggcagaaagaaaauccagauuagccggauccuggaccaacgcaacagacaggugaccuucacaaagcggaaauuugggcucaugaagaaagccuacgagcuguccguccuuugcgauugugaaauugcucugaucauuuucaauucugccaaccgccucuuucaguaugcgagcacggacauggauagaguucugcuuaaguacaccgaguauuccgaaccccacgagucucggacaaauaccgacauccuggaaacacucaagcgcagaggaaucggccuggaugggccugagcuggagccggacgaaggacccgaggaaccuggcgagaaauuccggcgccucgcuggggagggaggcgaucccgcccugccuagaccccggcuuuacccugccgcuccggccaugcccagcccugacgugguguauggcgcucugcccccucccgggugcgauccguccggacucggcgaagcccugccugcgcagucucgccccagcccuuuuagacccgccgcucccaaggccgggccuccgggacuuguccauccccuguucuccccuagccaccucaccucuaaaacacccccuccccuguaccugccgaccgagggccggcgcuccgaccucccugggggacuggcuggccccagaggcgggcuuaacacgagccggucucuguauuccggacuccaaaauccuuguagcaccgccacacccggcccuccccuggggucuuuuccguuccuuccuggaggcccucccgaauacgggcugggagaucccccgcccccucccggccuccugcagccucccacccuggcgccuuggcagcccuccagaggcgacgggccgccugccgugagcucccagcccucuggaggccgcagccucggggaggaaggaccucccacacggggcgcuuccccgccuacgcccccuguuagcauuaagucugagagacugucccccgcccccgggggcccuggagauuuuccgaaaaccuuccccuacccucuucugcucgcucgcagccuggccgagccccuucggccuggccccgcccugagacgccucccucuggcugacggguggccgcgguga

SEQ ID NO: 72009 - RNA, 1098 nt, Artificial Sequence
  derived and/or modified sequence opt5 from MEF2BNB-MEF2B__Homo_sapiens__NP_005910
augggcagaaagaaaauccagauuagccggauccuggaccaacgcaacagacaggugaccuucacaaagcggaaauuugggcucaugaagaaagccuacgagcuguccguccuuugcgauugugaaauugcucugaucauuuucaauucugccaaccgccucuuucaguaugcgagcacggacauggauagaguucugcuuaaguacaccgaguauuccgaaccccacgagucucggacaaauaccgacauccuggaaacacucaagcgcagaggaaucggccuggaugggccugagcuggagccggacgaaggacccgaggaaccuggcgagaaauuccggcgccucgcuggggagggaggcgaucccgcccugccuagaccccggcuuuacccugccgcuccggccaugcccagcccugacgugguguauggcgcucugcccccucccgggugcgauccguccggacucggcgaagcccugccugcgcagucucgccccagcccuuuuagacccgccgcucccaaggccgggccuccgggacuuguccauccccuguucuccccuagccaccucaccucuaaaacacccccuccccuguaccugccgaccgagggccggcgcuccgaccucccugggggacuggcuggccccagaggcgggcuuaacacgagccggucucuguauuccggacuccaaaauccuuguagcaccgccacacccggcccuccccuggggucuuuuccguuccuuccuggaggcccucccgugggggcggaagccugggcuagacgcguuccccagccggccgcucccccucggagacccccucaguccgccagcucccugucugccagccuccggcccccuggagcucccgcgaccuuucugcgcccguccccuauucccugcagcucuccuggccccuggcagucccuguguggccucgggccgccuugcgccggaugucccuggccuacagcuggccccgggagacgcagccccggaggcaccucuccugagcggagcccggggacggccagagcccgcggcgaucccacaucccugcaggcuucuagcgaaaagacccaacaguga

SEQ ID NO: 72010 - RNA, 1392 nt, Artificial Sequence
  derived and/or modified sequence opt5 from MEF2C__Homo_sapiens__NP_001124477
augggcagaaagaaaauccagauuacccggaucauggacgagcgcaacagacaagugacauucacgaagcggaaauuugggcugaugaagaaagccuacgaacucagcguccugugcgauugugagauugcucuuaucauuuucaauuccaccaacaagcuguuucaguaugccucuacagacauggauaagguucuccugaaauacaccgaauauaaugagccccacgaaagccgcacaaacuccgacaucguggaggcgcuuaauaagaaagagaacaagggaugcgaaucuccugauccggacagcuccuacgcucugacccccagaacagaggaaaaauauaagaagaucaaugaggaguucgauaacaugauuaaaucucauaagaucccugccgugcccccucccaauuuugaaaugccugucagcauuccgguguccagccacaacucucucguuuacuccaaucccgugagcucucugggcaacccuaaucugcucccccuggcccauccuucccuucagcggaacagcaugucucccggggucacccaccgcccgccuuccgcuggaaauacgggcgggcugaugggaggcgaccucaccagcggcgccgggacauccgcuggaaacggcuaugggaaccccagaaauucuccuggacugcuugugagccccggcaaccugaauaaaaacaugcaggccaaguccccucccccgaugaaucucgggaugaacaaucggaaacccgaucugcgcguucugaucccucccggaagcaagaacaccaugccuucugugaaucaaagaauuaacaauucccagagcgcgcagucucucgccacacccgucgugagcguggcuaccccgacgcugccuggccagggcaugggaggguaccccuccgccaucucuacaaccuacggcacagaguauagccuuuccagcgcugaccugucuucccucagcggguucaacaccgccucugcgcugcaucuuggauccgucaccggcuggcaacagcagcaucugcacaauaugccucccagcgcccucucccagcugggggcuuguacaucuacgcaccugagccaauccucuaaccucagccugccuuccacccagagccuuaauauuaaaucugaacccguuuccccgccucgggaucgcacaaccacacccagcagauacccccagcacacccggcaugaggccggacgcucuccuguggacucccugagcucuugcagcuccagcuaugauggcucugacagagaagaccaccggaacgaguuucacuccccgaucggccucacgagacccagcccugaugagcgcgaaucccccucugugaagcggaugagacugagcgaggggugggcuacauga

SEQ ID NO: 72011 - RNA, 1566 nt, Artificial Sequence
  derived and/or modified sequence opt5 from MEF2D__Homo_sapiens__XP_005245226
augggcagaaagaaaauccagauucaacggaucaccgacgagcgcaacagacaggugacauucacgaagcggaaauuugggcugaugaagaaagccuacgaacucagcguccugugcgauugugagauugcucuuaucauuuucaaucacuccaacaagcuguuucaguaugccucuaccgacauggauaagguucuccugaaauacacagaauauaaugagccccaugaaagccgcaccaacgcggacaucaucgagacacuuagaaagaaaggauucaauggcugcgauuccccugagccggacggggaagauucucuggagcagagcccccuccuggaagacaaguaccggcgcgcuuccgaggagcuggauggacucuuuagacgguauggcucuaccgugccugcccccaacuucgccaugccugugacaguccccgugagcaaucaauccagccugcaguuuucuaacccuuccgggagccuuguuaccccgucucuggugacguccagccucaccgacccccgccugcuuucuccucagcagcccgcucugcaaagaaauuccgucagcccuggacucccccagcggccggccuccgcuggcgccaugcugggcggggaucugaacucugcgaauggagccuguccuagccccgugggcaacggguacguuuccgcucgcgccagcccuggacuccugcccguggcuaauggcaacucucuuaauaaagucauucccgccaaguccccuccgcccccuacacacagcacccagcugggggcgcccucuagaaagccugaccuccgggugaucacaagccaggccggaaaaggccugaugcaucaccuuaccgaagaucaucuggaccucaacaacgcucaacgccugggcgugucccagucuacgcacagccugacaacccccgucguuuccguggccacaccgagccuccugucucaggggcuuccuuucuccagcaugcccaccgcuuauaauaccgacuaccaacugacaucugccgagcucuccagccugccugccuuuuccucucccggaggccuuagccuggggaacgugacggcuuggcagcagccucagcaaccccagcagccgcagcaaccucagccuccccagcagcaacccccgcagccccagcagccucaaccccagcagccucaacagccccagcagccuccccaacagcagucccaccucgucccggugucucugagcaaucugauuccuggaagcccccucccucauguuggcgcggcccugaccgugacaacccacccccauaucuccauuaagucugaaccggucuccccuagcagagagcggucucccgcuccucccccucccgccguguucccggccgcuagacccgaaccuggggauggacuuuccagccccgccggcggcucuuacgagacaggggaccgcgaugacggacggggcgauuuugggccuacccugggacuccugagacccgcgccugagccggaagcugagggcagcgccguuaaacgcaugcggcuggacacguggacacuuaaguga

SEQ ID NO: 72012 - RNA, 2346 nt, Artificial Sequence
  derived and/or modified sequence opt5 from MEFV__Homo_sapiens__NP_000234
auggccaagacccccagcgaccaucugcucuccacacuggaggaacuugugccuuacgauuucgagaaauuuaaguucaaacugcagaacacgucuguccaaaaggaacacagcagaaucccgcggucccagauucagcgcgcuagacccguuaaaauggccacccuccuggugacauauuacggcgaggaauaugcggugcagcuuacccugcaaguccuccgggcuaucaaucagcgccugcuggccgaggagcuccacagagccgcuauucaggaauacucuacacaggagaacgggaccgacgauagcgccgcuuccucuagccugggagaaaauaagccucggucccuuaagacacccgaccauccugagggcaacgaggggaauggaccccgcccuuauggcgggggagccgcgagccugagaugcucucaaccggaagccggccggggccucucccgcaaaccccugagcaagagacgggagaaggcuucugaagggcuugaugcccagggaaaaccucgcaccagaucccccgcucugccuggcgggcggagccccggaccgugucgcgcccucgagggcgggcaggcggaagugagacugcggagaaacgccucuuccgcuggacgccugcagggccucgccggcggggcuccuggacaaaaagagugccggcccuuugagguuuaccugccuagcggcaagaugagaccccgcucccuugaagugacgaucucuaccggggagaaggcccccgccaauccugaaauucugcucacacuggaggagaaaaccgcugcgaaccuugacagcgccacagaaccgcgggcuagacccaccccugauggaggcgccuccgccgaccugaaggaggggcccggaaauccugaacacagcgucacgggccggcccccggauacagcugccucuccucgcugucaugcgcaggagggcgaccccguggaugggaccugcguuagagacuccuguagcuucccugaagcugugucuggacacccccaggccagcggcucccgcucuccugggugcccccggugucaagauagccacgagagaaaauccccgggaagccucucuccucagccccugccccagugcaagcgccaucugaaacagguccaacuccuguuuugugaagaccacgacgagccuaucugccuuaucuguucccugagccaggagcaucagggccaccgggugagaccgauugaagagguggcccucgaacacaagaaaaagauccagaagcaacuggagcaucuuaaaaagcugcggaaaucuggggaggaacagcgcuccuauggcgaggaaaaggcugucagcuuccucaaacagacagaggcccugaagcagagaguucaacggaagcuggaacagguguacuacuuucucgagcagcaggagcacuucuuuguggcuucccuggaagaugucggacaaauggugggccagauuagaaaagccuaugacacccgcguuucucaggauaucgcgcuucuggacgcccucauuggggagcuggaagcuaaggagugccaaagcgaaugggagcugcuucaggauaucggagacauucuccaucgggccaaaaccgugcccgucccugagaaguggacaacgccccaggaaaucaaacagaagauccaacugcugcaccagaaguccgaguucguggaaaaaucuaccaaguacuuuagcgagacacucagauccgaaauggagauguucaacguuccugagcugauuggcgcucaggcccaugcggugaaugucauccuugaugccgaaaccgcuuaucccaaccugauuuuuagcgacgaucucaaaucugugcgccuggggaauaagugggagagacugccugacggaccccagcgguucgauuccugcaucauuguccuuggcagcccgucuuuccucuccgggcgcagauacugggaaguggagguuggcgacaaaacagccuggauccugggagcuuguaagaccagcaucucucggaagggcaacaugacgcugagcccugagaauggguauuggguggucauuaugaugaaagaaaacgaguaccaagccuccagcgugcccccuacacgccuccugaucaaggaacccccgaaaagaguuggaauuuuuguggacuaucgggucggcucuaucuccuucuacaacgugaccgcccgcagccacauuuacaccuuugcuuccugcucuuucagcgggccucuucagcccaucuuuuccccuggaacaagagauggcgggaagaauaccgcgccccugacaaucugucccgugggcggacagggcccugacuga

SEQ ID NO: 72013 - RNA, 3423 nt, Artificial Sequence
  derived and/or modified sequence opt5 from MEGF10__Homo_sapiens__NP_115822
auggugaucagccugaacuccugccucucuuucauuugucugcuucugugccacuggaucggcaccgccagcccccucaaucuggaggacccuaacgucuguucccauugggaaucuuacagcguuacagugcaggaguccuauccgcaccccuuugaucaaauuuacuauacgucuugcaccgacauccuuaauugguucaaguguacaagacaucgggugagcuaccgcaccgcuuauagacacggggaaaagacaauguaccggcgcaagucccagugcuguccuggauuuuaugagagcggcgaaaugugcgucccccauugugccgauaaaugcgugcacgggagauguauugcgccuaauaccugccagugcgagcccggauggggcgggacaaacuguucuuccgcuugcgacggagaucacuggggcccucauuguaccagccggugccaguguaagaacggcgcccugugcaauccgaucacgggggccugucacugcgcugccggauuccgcggcuggagaugugaggaccggugcgaacaagggaccuacggaaacgauugucaucagcgcugccagugccagaauggcgcuacaugugaccacguuaccggggagugcagaugucccccuggauacacaggcgccuuuugcgaagaucucugucccccuggcaaacacgggccccaaugcgagcagcgguguccgugccagaacggaggcgugugucaucacgucaccggggagugcucuuguccuuccggauggaugggcacggugugcgggcagcccugcccugaaggacgcuucggcaagaauuguagccaagagugccagugucauaacggcgggacaugcgacgcggccaccggacagugucacugcucucccggcuauacaggggaaagaugucaagaugagugccccguuggaaccuacggcgugcugugugcugaaaccugccagugugucaaugggggcaagugcuaucauguguccggagccugccugugugaggcuggcuuugccggggagcggugcgaagcgcgccucuguccugagggacuguacggcaucaaaugcgacaagagauguccgugccaccuugaaaacacacacagcugucaucccauguccggggagugcgccuguaaaccuggauggucuggccuguauugcaaugaaacguguagccccggguucuacggcgaggcuugccagcagauuugcuccugucaaaacggagccgauugcgacagcgugaccggcaaguguacaugcgcuccuggguuuaaaggaaucgacuguucuacccccugcccgcucggcacauaugggauuaacuguuccagccggugcggauguaagaaugaugccgucugcucuccuguugacggcagcuguaccugcaaggccggguggcacggcguggauugcuccaucagaugucccucuggaacguggggcuucgggugcaaccugacaugucagugccuuaauggaggcgcuuguaacacccuggacgggaccugcacaugugcgccuggauggcgcggcgagaaaugcgaacuccccugucaggaugggaccuacggccugaauugcgccgagcggugugacugcagccaugcugauggaugucacccuacaacgggccacugcagaugccugcccgggugguccggagugcauugugacagcgucugcgccgaaggccgcugggggccgaacuguucucucccuugcuacuguaagaauggagccuccugcagccccgaugacggcauuugugagugcgcucccggcuuucgggggaccacaugucagagaaucugcucuccuggauucuauggccaccgcuguucccaaaccugcccgcagugcgugcauagcuccgggcccugucaccauauuacaggacugugcgauugucuuccuggcuuuaccggggcccugugcaacgaaguuugucccucuggacgguucggcaaaaauugcgcgggcaucuguacgugcaccaacaaugggacauguaacccuaucgacagaagcugccaguguuaccccggauggauuggcuccgacugcucucagccuugucccccggcucacugggggccuaauugcauccauaccugcaacugucacaauggagccuucugcagcgccuaugauggcgaguguaagugcacacccggguggaccggacucuacuguacgcaacgcugcccucugggcuuuuauggcaaagacugugcucuuauuugccagugucagaacggggccgauugcgaccacaucuccggacagugcacaugucggaccggcuucauggggagacauugcgagcaaaagugucccagcggaacauacggcuaugggugccgccagauuugugauugccugaacaauucuaccugugaccacaucaccggaacaugcuacuguuccccgggcuggaaaggcgcucggugcgaucaggccggggugaucauugucggaaaccucaauagccugucuagaacguccaccgcgcugccugccgacagcuaccaaaucggcgcuauugccgggaucauuauccucgugcugguugugcuuuuucugcucgcucuguucaucauuuaucggcauaagcagaagggaaaagaaucuagcaugcccgccgucacauacaccccugcgaugcgcguggucaacgccgauuauacaaucuccggcacccuuccccacagcaaugggggaaacgcuaauucucacuacuuuacgaaccccuccuaucauacacugacccagugugccaccagcccucacgugaauaacagagaccggaugacaguuaccaaguccaaaaauaaccaacucuucgugaaucugaagaacgucaauccgggcaaaagaggccccgugggggauugcacaggaacgcugccugcugacuggaagcauggcggguaccucaacgagcugggagccuuuggccuugaucgcucuuauauggggaaaagccugaaagaccucggaaagaacuccgaauacaauucuagcaacugcucccugucuagcuccgagaaucccuacgccaccauuaaagacccucccguucugaucccuaagagcucugaguguggcuauguggaaaugaaauccccggcucggagagauagccccuacgcggagauuaacaauucuacauccgccaaccgcaaugucuaugaaguggagccuaccgugagcguuguccagggcguguucucuaacaaugggagacuuucccaggaccccuacgaucucccuaagaacagccacauccccugccacuaugaccugcugccggugcgggauuccagcucuagcccuaagcaggaagacuccggaggcucuagcuccaauucuagcuccucuagcgaguga

SEQ ID NO: 72014 - RNA, 3135 nt, Artificial Sequence
  derived and/or modified sequence opt5 from MEGF11__Homo_sapiens__NP_115821
auggugcugagccucaccggccugaucgccuucuccuuucuucaggcuacacuggcccucaaccccgaggacccuaaugucugcucucacugggaaagcuacgcgguuacggugcaagaguccuaugcucauccguucgaucagauuuacuauaccagauguacagacauccugaacugguuuaagugcacccggcaccgcauuucuuacaaaacagccuauagacgggggcuucgcaccauguacagacggcgcagccaguguugccccggauauuacgaauccggcgauuucuguaucccucugugcacagaggaaugugugcaugggagaugcgucucucccgacaccugucacugcgagccuggauggggcgggcccgauuguagcuccggaugcgacagcgaucauuggggcccucacugcucuaaucggugucagugccaaaacggcgcccucuguaauccgauuacgggggcuugcgugugugccgcuggauuucgcggcuggagaugcgaggaacugugugcccccgggacccacggaaagggcugccagcugccuugucagugccggcauggggcguccugugacccccgcgccggagagugccucugcgcuccuggcuacacaggcguuuauugugaggaacugugucccccggggagccacggagcccauugcgagcuuagaugcccuugucagaacggcgggaccugccaccacaucacaggagaaugugcuugucccccuggcuggaccggggccgugugcgcgcaacccugucccccuggaacguucggccagaauugcucucaggauugcccgugccaucacggcgggcagugugaccaugucacaggacaaugccacuguaccgccggcuacaugggggaucggugccaggaggaaugucccuuuggauccuucggcuuucagugcagccaacauugugacugccacaacgggggccaguguucuccuacaaccggagcuugcgagugugaacccggcuauaaagggccucgcugccaggagagacugugccccgagggacuccacggcccgggguguacccugccuugccccugugaugccgacaauacaaucuccugccauccugugacgggagcuuguaccugccagcccggcuggagcgggcaccauuguaacgaauccugcccuguuggcuacuauggagacggcugucaacuucccugcacaugucagaauggggccgauugccacucuauuaccggaggcugcacaugugccccgggguucaugggagaggugugcgcugucagcugugcggccggcaccuacgggccuaacugcuccagcaucuguucuugcaauaacggcggaacguguucccccguggacggcagcugcacauguaaggaaggguggcagggacuggauugcacccuccccuguccuucuggcaccugggggcugaauugcaacgagagcugcacaugugcuaacggagccgccugcuccccgauugacggcucuuguagcugcacccccggguggcugggcgauacaugugaacucccuugccccgacggaacguuuggccugaauuguuccgagcacugcgauuguagccaugcugacgggugcgauccugugaccggacacuguugcugucuugccggcuggacagggauccggugcgacucuaccugucccccuggaagauggggccccaacugcuccgucagcugcucuugugagaauggcggguccugcagcccggaagauggauccugugagugcgcgccuggcuuccgcgggccccugugucagcggauuugcccucccggauuuuauggccaugggugugcucaaccgugcccucucuguguucacucuagcagacccugccaucacaucuccggaauuugcgaaugucugccuggcuucucuggcgcccuuugcaaccaggugugugccgggggauacuucggccaggacugcgcucagcuguguagcugcgccaauaacgggacauguucccccaucgacggaagcugccaauguuuucccggcuggaucgggaaagauugcucucaggcuuguccuccgggauucuggggccccgccugcuuucacgcgugcuccugucauaauggcgccagcugcucugcugaggacggggccugucacugcaccccuggauggacgggccucuucuguacccagcgcugccccgcugccuuuuucgggaaggauuguggacgggugugccagugucaaaacggcgcguccugcgaccauauuagcgggaaguguacaugcagaaccggauuuacaggccagcacugcgaacagcgcugugccccuggcaccuucggguacggaugccaacagcugugugagugcaugaauaacucuacgugugaucaugucacagggaccugcuauuguagccccggcuuuaaaggaauccggugcgaccaggcugcccugaugauggaggaacucaauccuuacacaaagauuuccccggcucugggcgccgagagacacagcgugggggccguuaccggaaucaugcuucuucucuuccugauugugguccuucugggccucuuugcuuggcaccgccggagacagaaagaaaagggccgcgaucuggcgccccgggugucuuauaccccugccaugagaaugacauccacggacuacagccuguccggggcuuguggaauggaucggcgccaaaacaccuauaucauggacaaaggcuucaaggauuacaugaaggagucuguuugcagcuccucuacauguagccucaauuccucugagaaccccuaugccaccaucaaagacccucccauucugacaugcaagcugccggaaagcuccuacguggagaugaaaagcccuguccauauggggucucccuacaccgaugugcccucccugagcacgucuaauaagaacaucuaugaagucgagccuacaguguccguugugcaggaaggaugcggccacaacagcucuuacauucagaaugccuaugaccuccccagaaacucccauaucccugggcacuacgaccugcugccgguccggcagagccccgcuaauggaccuucccaagauaaacagagcuga
